United States Patent 8,067,671 (METHODS FOR GENETIC CONTROL OF PLANT PEST INFESTATION AND COMPOSITIONS THEREOF) - sequence listing, part 15

SEQ ID NO: 14892 - DNA, 3667 bp, Heterodera glycines
  misc_feature (3505)..(3505): n is a, c, g, or t
  misc_feature (3548)..(3548): n is a, c, g, or t
gcaaaaattgcgttgacctacccccattttaatgtgtttttgattaaaaaatatatatttgaattaattcattaaaatttctcgattcccgagtcgagaaatttctcggattttttgttctcgtatcgtttcccggggttatttctcggtctcgtttctcggttcccggtaaaaagcacttctcgcagatcactacaattcatacaaaataaacagagaaagataaaaaatgcaaattgttttactcaaaagatcgggaccaaaaagccgagataggtatttgaagaaatcgggatttaaggactaattccgactgagcctaatcgtggacaattaaggaattgatggacccggacaaagggttgtatgacgaaaatgaggacaaatttacattggccattgatctcacagtgaaaaatgaaagagaaaaacatatttacgaatcaaatggaacaattgaaattacgcttttatacattaaaataccacaaagaaattagctggatattatttcttcatatcaaattttaaaattttcgagattttgttgtttgctttatcaaattagcattgaattttgaatgttaagggagaagagaagcaaaacgtttgacttcatctcggaccgatatttagggtaagtaattaaatttagatttaaaattagttatcattgtgggtactgctccgatgctataataatttacataggaatttctcgtttaatgataattcaaaaacttaaatttcggtattggggttagcttacctgaatacaagtgctacttttgtcaggacttgaaaaatttcctttcaatgttaaaaataactttctttttaatatatatatatatatatatatatatatatatatatatatatatatatatatacaaatttcctaaaatatttaatttaccaaaatatttttattattatttaatttttcgttttaaattcttcaaacataattttaaacatttgtgattgcttgatttcattgtgaaagaagcagacaattagataattgctcactctaatgattcccaaagtattaattatttactaaaatatgatgctttaaaaaatagtaaatttgaataaatatctgtttgaagatccaagctcgaatgggtgccgcaaaaccaatcaaaaatggtcgaattgacctggaccaactcagaaaaaagcatgttttgcatttgtattttgctttaaacatgaaattttttgaagattgaaacagaaaaaaatagatttaactgccccaaatgtttcaattagttaagttattgcaaaaagccataaatttgctgtcactcttcaaattacaccaagactttgtatggattttcatatatttggattttcatatattttttgcacaattatttcggtataaaaatcatgaaagtattttaagcttggtttattgcgtatagtttttgggaacgggcggagtcattatttaaaaaacatcataaagggcgttatttagaaaaccatcattataaaatatttgatgaaaaatatttaggtatttaaattaacatttttctagcatttccaagagacctttttttgctcttcgggccaaatttttttgctcttatgttaggtatatcaacaatttcaaaaccggagaaaaaaaaggaatttttagctccgaaaaatgacaattttcggtgccgataggcgccgccggaaaaattttttggaaattgtataaatgaaaattttatttatatcattataaaaaaaagagaaaaagccattcccgagggccagggaagcaaattataaattgtaccaaatcctggtaagcccttatcaatctttgattattttggaaagtttcataattcaaaaacaatttaagattaactatttaattaaatagtacttgtgttttggtaattcatgaagatccccttttttctattaacatgtggaatcattgttaggaccacaagtcaaaacatgaatgaatttataatactttttaatatcagagtcattaatgattgttctgaagaaaggagagcggattgaatgagttgaaccaactcagggagatttgtttttagaacagagcccggaattttaaatcatatttttctatgcgttattatggcgagagaagcccaaaatattttctcagaacatttttatttagggctacttataaaaaaataaaaaccgcccgaccctaaaaatatatattttcttgaaaaaattttctcaaaatctgttaacaaatcgcattagaataatttcatgaaaatcaatgaattattaaaattttattacatttttattttttcaaaaattttcaatttataaagacttccagtttccagcagggtttgatttcgctttcacccttttggagtgaaagattttcacatcactaatgaatggcatttttttgtggggaaaggcaaaaaagttcatatatctttaaatacattttaatttacaaactttttgtgttaaatgcgatccaaaatgatcaaagattgacaggagcttcccagctggtataatttatatcgtgttcaattgctgttagtctgagcaaattgaatattaggatgacttgtaaatcattaagaaagaaaaaggctgttaatctccaaaattaaatttgaaatcattatttgtgctgtcaaatatttaaattattcggttgtccttaatgctttttgatacattgcacccgttggcccttgggaaaggtttttctcttttttataatgattttcattcatttttttttgaaattgtgtatatcctcaaatgtcgggtcctcaaaaatcgggtcctcaaatgtcgggaatatccgcaaaagtcgggtcctcaaatgtcaaatcctcaaatgtcgggtcctcaaaagtcgggtcctcaaatgtcgggtcctcaaatgtcaagtcctcaaatgtcgggtagccgtaaaaagaaagccaatgtatgcaataatctccatgatgtagaccaaagcagcaagtgtctaaatgaaatagacatttaaatttagacttatacttaattgtttaataaaaaataataggctaaatatttatttattattgtttttttacctgtctgtggaaatgtgagcccaaaaagcttccaattggagcacaaatactcgtcacgggaacagaaacataaaaagatacaaaaatttcttcaattatttaagttacaaatagactagagcgaggaaacttgaagtaggaccagaatattggaaatcctaacaggtccttgtcctgttcctggccctaaaatacactaatctcttattaaaacgattcaattacattttttaataaatatttttttggttttatttaaaatataatttttgatttaacccaactgaattcaaaacatacttttatgtaattgtatgccaactcattaatcgcttcgtccattatcactgcccgccagtaaaagcagaattgtgaattcaaagctacaaatttttattttttanaaggcaatcaaaatttaattttacccattaacactacagttgnttggtgttgcaattttctcactaacactgaacaataatgtcaaaactgagaaaatgcagatgtcgacaccttcaaataatggttattaatgtgatttggcaaacatttttaattttttt

SEQ ID NO: 14893 - DNA, 3291 bp, Heterodera glycines
  misc_feature (829)..(829): n is a, c, g, or t
  misc_feature (3239)..(3239): n is a, c, g, or t
tttcggaagaacattaaccttaatagtagtaataaatttctgtatcctgtggtcccggcttttctggtcccggcaaccgaatttaaaattctataataaaaaaaagactctgacatccactacgttaaaaaaagtaaaattattttattcaaagtcacatcgattatctttgacgtgcgagcaaaaagacgatgaattttcatctgtcagaggtgggggggccttgtccaattgctcgctcgacaatctccattcttcaacatatgatgataatcttattagttttaattttatttttttagcaaaaaatattaatataataaagccgcgaaattccactacccagtgctaataagggattttaattcccttcttacgcgtccgtcttaattagacccctcagggcttggaagggaagggatgatgatggatcactgttggtacctcacaggggaagcgattggccgttccactgaagtaactcccgactgacttgaaatttgtctacgaaatattgtttaaaaaagagcaaaaatatgaataatttctttaaaaaatttattaattcacttaaaatgaaattcctactcatttcgtgcctcttttttgctgtgctaattaaaagttgcagttcaacaaacaccgacaaagcacaaaaaggtccatttaaataaaaacaattttaatttagatttttaattttcatttaaaattttttaaatttaattttacatcgctgatcatctccaaattgatgcttctcgtcgccacttgagggtggcaatctcgaggctgaccccgccaggaaggcgctttgctgaaattttgntatatttccaaacaaacagtgccagacaaattctccacggcaagtgcccccactgcgacacctgccaccgttttgagggttgacataaaacccgtgccgttgttgttcgccgtgccattatttgtcgaattaattaaatgctctattagctttacaaaaagcaaaaagatttttgaaacaaatttttcaaaatttcgactttttcgcaatttcctgtataacttttttggtaattgtctaataaaaaacctataaagtgtttttatgtgtgattttgagtgtttcatattccaacaagttttgtgggtttggaaagtatttcttttttaaatgaataataataatttgtcaatttaaaacattttattttttcttaatcatttcattttgctgattgattatccatactttgtttaaaattaatataattatatgtataatataattttctctttgttctaatattctataatttttctaaacgcttctcattgtttgctatgatcatgctttttttctctttttctttttttgcgttgcccaattcccccccccacccattttcattttattaatatgcctttttacattaatatttttagttttattattttttcgcttaaataatgcttcttgtattcctgcttctattagcatcagtgtttattgagacagaagtaaatattttaaaataaattatttaactgtttttccattcattcaatggcagagatttgtttaggaaaacgaatgaataaataaattgaaatccatcccattttaactcatttaaattttccactcaaattcagtgtttaacgccaacggaactgttcaattcgcttatcattcgcctgtcatcatcatcaccaatctcatcatccaatgatgatcaactcggctcaacttccttctctgttctcccacaaaatccgccggtcgtcgaattgccattggccaatgcgcaaatgttgcagcaatgggttggccaagtcgcgcagcaaattgtcgttgaggacggcacttttgctggacattactcatgcgttgccaaaaatggcatgaaaaaagcatttttgtccgttggattgcccaaaaaacaactgaaagcaaatgcgtttcttttgggggacgaattttaaaaaatgggagagcaaaaattccattttttgaaaatgcttttcgcatttggcgcattgctaagtgccgaaattgagcaacaatcgtccatcagggaaagaagcttcccacgcatatttttgaaggcatacgaatgcgtagcggacaaaaaattcgtcggaaatgaaaaaaagtaaataattttaatatttttaattagagtgccacgggaccgggacctggtagcggacaactgagtacaactgagtaccaaggtcccggttttgaccgggactagtcccggttttttcccggttttcccagccaaaaattcccgggttttcaacccgaaaaggtcccggtcccgggtttgcccaaaattcccggtcccgtggcactctatttttaatctcccaaatgttgccttttcttaaataagtcgactaaaaaaataattttgaatattttttatgtatttatttaagttttctaccttttgcaattgtatcaaaaatggaggggcaaactgagcaattgaatattgagaaggttttgttggtaattcaaaatgaagaagatttgacggatcgtagtcttcaaatcggctgtaaatttttgaaatgtttgtaatgaaaacgatagaaaaccaaaaaataatgactaggaaattgcatataaacgatataccattggataaagcagggtcgacttctattgtgaatttttaattttagcggtgcattttgcctgcttcaaaagttacagggcctcaaaaatcgaaattttgtgcttgagggctcattttcaactttcgtgtatattttttgcagccctgtttattaatgtaagattcgaatctattgaccaaaaatattgtcaataagtaaaataatgaaaatttttcaattctactatacattaaaaaagttaaactaagttaattcaatatttgtaattaattaattaactaattaacagctcgattatatgggctatgaagactattgaaaaaatgacaaaagtttatgatacacaatttagaaaaaagaagactacacgaaatttaaatggggatttgttatataaatattttaatggcattttacctgaaaaattctggccctgattcaatatttggaattattgtagattccaatcaaggcattttgccttaatgctaataaatttttagctgaacaacaaaattacgctcatttgtcaaccactaattttcatcattttgaaattttctaatcactcacattcggattatcagtttacatattttccnaaaaaaaaaagaaattaatttttctttttttaataatagagtagaaaaaaag

SEQ ID NO: 14894 - DNA, 1642 bp, Heterodera glycines
atgattagggctgctaattttatgtaaatacatattttttcctggattctccatagcctaattaataggaaaaacactttcttttttgtgtttgcgaacaaaagttgggacttttatttacatattttgggatttttctacatatcacatatgtacatatttttatacatattttggactttttcgtacatatttcgcaatttttcgtacatatttttcattttttttacatattttgaggatttttgagaatttatagaaattttttgtaaaaaattaaaatttttttttgaaaatgtacgattttttttcaaaaaatgatatatcaaaaattaatttgtaaaaaatattcaaatgtgattctaagcctattttggtcatttttatggcattttgtgcctatttcactttttacgaagaatttttttccaaaaaataaccattaaaaaaattttatttacatattttcctacatatttgaggatttttgtacatatttcatacatattttagcattttttatacatattttatttacataattcgcaaattttcttacataaaattagcagccctacttatgataaatttcgccatttttttaatctatccatttatccgtctgaatttgtttgctcaagttttggcatgcacatcggaattgcgaccaagaaaatgccgttgcacagctgtgtgggatgccatgagggcagttatgcatacgatgacaatggcaaattcttgggcagcggtgcattgttggatggcacgagcggacggattggatgtaattaaggcgaattatgggcataattaaacactaattgttgttggtctaattaacgaatgttatatcgagttaactgaaactcgcacaatatcgtttttaaaatgtttttttttaccaaaaattttcttccataaaatctagttttttcccataaaaatcgactcaaaattcctcgaaaatttatctcttggccaaaattaaaattgcacaatagccacactggcttaaaatccagcaaaaacctggcacgaatttccaaaaccgagcaaatgctggattttccacgcaaaataaaaagtattcatttttgacccaaattttatgcttgatttaagcacttaattatgacgacctattttcggctggcacgagtggacagagcacatcggcagctggcttccgaaattttctgtacaaaaatacaggtacaggaaaaatacaggttaccgaaaaatggcctgtacctgtacctggatccaggaaaaataccaggcccggatccaggtacaggtcgagctctagtcttaatgttcttaattttaaattgttttaacaccgtccgttgcatacttactttgattaaattctaataaaatttttttggtgatgctaatgtttaaattaaaattttaagaagaaagtttccatttgttgattttttttcattattttaattggttgggattaagagcctgatgattatttaattctttcctaatttacgatatttcgataattaatgttaaatttttttacgggctctgtcgaccgtttctgccggatgcttcgatcgcccgccttagtagtagatagcttaacgaccgccgataaagatgtttttcttttttgtga

SEQ ID NO: 14895 - DNA, 2071 bp, Heterodera glycines
  misc_feature (70)..(70): n is a, c, g, or t
  misc_feature (2019)..(2019): n is a, c, g, or t
  misc_feature (2025)..(2025): n is a, c, g, or t
  misc_feature (2037)..(2037): n is a, c, g, or t
ttggatttgtaaacacaaaaaaaaagttatagtccgaaaactttggctggcgcaaaaacgacccccgccncaatataccaggaaccgattcttagagaaaaaatgaatagaaaatccattagtgtggccaaattctcactttctttgtaacaaaaaaaacaccaattaaactaaaatgtgccaccatttcgatgatggcaatggcaatttggagaacaaatgcttttttgtttctttggacgcttcacacaattccttaaaatttgatagatttaatctaaatactttttgaatttatatttaaaaattaccgcattggtatagtcgctgtagcctaagaagaaaaaacattttaaagaatttcaagcttcttggccttatatttttctatcggtgtttttttgcattagtggacacaaaattcatttacttaaaaatttttggcgaaatcttcggtttttcggaaaagaaaactagagaatttccgtcaacgatgttccggtattttttaatagaaaactgatcggtaatcaatacacttgctgattatttatgccatcagtttcttaccattactccccttttgttaatcaattttaatcataaaatatttttattaatttttgaaaatgatttttcattatttttgatcaattagacttttacttcattttatggcagtgcgccatgtagcagaagtgcgaagatggctcgcagaggtggatttcatttcgaaaatgcatcttttggacgaccttgcagtgcatggaacctgtttgttgtgtattggataaaagcagcaacacaaacaaattttgggattttgagaatcacttcattccatggggagttattttgtccaaaaatcggacatttgtcagggtttttcggtcattaaaatggagtctatttttgcagaaatatttcgttattctattaattagctatttttatagttttatttgaactttaaatttcttaaaaaacccaaatcatgggtgggttcccgactctaaaatgccactctggatcaggaccattcgaccaatatcggcattcaaggctagaaactggggtttgaatgtcgctaatccaatccggtgaatccataaatttttctgcaaaattccagtctcaaatatcatccctaccttgttctttggcatttggacgcatttgatacgaccgcacgggcaagtcttttttttttgccaaaattttgcactcatcctcgctgagcttcttctgcaaaaaattaataaattaaacgattttaggcaatcttttttttgttgctttttatttaattattaaagtaagaaacaatatttaacaacaatttatttatatttaacaacaatttatttaattttgtcattttaattcattgttttgtttttctgaaactttaaaaaatctcattgaaaatttaattatctttctaaagcagggaaataaaaaaatatttatttattttttatttttgggttcactttcattgatatctattctaatctatgggttttcctgatggttctcttttttcatttatttatttagatactaagtacattttattatccattttaagtcttaccgtctcgtttgcgaattctggccgattgttgggattttcagtgtctaaatgtggtgaaatatattaattattattattttaatatttcatcacatattttacaaaaaataaagttaagcattttgaaaatttcaaactacggttgcaattaccttcacttcatgacaaatgcggcacgcaacataaggaaaatgttgtccacaacaagaacactgccaaatgtagaaattctttccaatacgtttgccttcactaaaatgaattattttaatattttctacatcatttcttttatccattgtgcataaaactatttagaaaaacggggcgggaattttggaaaaaccgaagccacgacatgggtaattcaagacgacaaaacgggattttgtaaaagaaaataaagataaaaataacttganattctnttattcagcaantaatgtaaaaattaaatttttctattttctaaaa

SEQ ID NO: 14896 - DNA, 1659 bp, Heterodera glycines
gcttttgtacgaccacatcttccaaacacaaattgatgttcttccagcgaaaatttgtttatttgagcggaggaatttgaggacggaataattcaaagtaccttaaaatgggatgattttatctgttaacaatgctttgaatcaaattacgaaatcagaagacgattaaagcgaattttgttgggcagcggacggtcgggcaatggaaatcgcatagatttgtcatagctgataaatacggatagtttcggctttagtccaccgcccttgcgaatttcgattcgtctcaaaattgccaattcgcttttgccgtcgaaatgtttgttcactaaaacattgaaacgtggtgagagaagtgccaatttgaggccaagttcaggacgaccaaaaaatggaagaatgtccatccaaacgtcagtacaaatccagctaaaatgcggaatatagagcgattgagaattcactaatttataacccaagaaattctcacattttcttcaaaattcgtttattcattttatttgtcactcgaacacttcgccgttttccaagtgatgtgataagtgaacccatcgattgttgttcatgttcaccaattgctggtgaagaaatttggcggtggtaggcggaggaatgctttttctttttctcggcgggcggtgccattaaaaaaattaaatttcggttcctaaataaagacatttttagaaaacatttgcacaaaacaattttagagaaattttcaatttctttatatgcgtaaagccgaaaaaatacataagaaaaggaacgaatgaataaacaaacaaacaaattgatcaatgatcacactcattgttcacaccatcccaaaaacgaaatcagagaaaacaaaaagcattttttctctaatttttcctctccttttagcgtactatctaatattttcattattcggaaaaataacatttaatcgccacattttttctattcattttgggctcataatcagtttccgggggttttcgagggtgcttattacgaatctaaacttagatttgcccaattccaaaccccaaacccgaattccagcaaaaaattattttttttcaaaacacgcgttaaaatcgaccaaatttttgcgcaaattgcgtactttttattcacttttaataacttaagtattgttttgcatcaaaataaagttttaggtaaatgattcgaacttttccccagaaaaatattctttggaaaaaaatcaatttttctttgaattctggatcgatgatcgaaaataagcaaatccaagttcattttctggaactgaattattgacaagaatagtatcgtagaggttgagattgaaagatataaataaatacgtgaaattgactaattgaccataaacaatgcaaaaatatgtaatttaaacatacatcagcttgcgcatgaataattgtgtatggaaaggccatccgaagcataacaacagaagaatttggacaaaatatctggaagatttgagaaaaaagaatatcttgacttatacggggtttttttctcgcggcccaatccccaagaatatggttaccaaatcgaaaagctctcggtgaagacagatcgatctaaggggtgggggaaggttgatccgaccaagtataaacccgttttttgaaccga

SEQ ID NO: 14897 - DNA, 2325 bp, Heterodera glycines
acaaaatgaaaacccatttctttggtgaaaatttggtttttccccaaatgtgccatggttttgcaaattgttttggcccattccgtttcgaaaaggccctccatttgatcggcagggcggaggattttgcggatgctgttccccgtcaagtcgcgctttctgaacgcttccctccttgcccctattcgtctgaagaattgctgagcaatttccgcattttctcccgcttccaactccttgatcagagcatttccgaggccttggaagacgtggaatggggccaacagcatctgctcaaaactgatcgacggcagcagagatgcacaaacaatgcctttcgtcagagcccgagcctctgccgttgctttgtctcctccatgggtcagctgctggaactgatcggcttgtctctccaattcttgcacagttcgaatttggcattttgctgaactgatcagatggtctcttcggcagttacacactggggatgggaatgctgtcattgccgaaccgcaatggccaatgatggcccacagaaaacacagatcaccgccaagaaacctggaaaattttcaaaaaatcaaaaaacaaaatttattttcaccatttcactttgcgcccgtcaatttcattgaggtgctcaatttgttcccaaaacgatctgcagaaattcttcaaattcgttcgtgaatcttttgcgggaaaaacagccgcaacaaaattgttggaaggggaatttgggcgcaatgcatgggccaatgaaatggtaatttttgtgaatccctgcccgtgatcgccactgaccttcagtggcagaccacgggcagggatcaggctgatcagattgtcctttgccgtggacaatctgaaacgcagtgccccggcaatgtcagagcaaacatatccaggcccgcctggcgttgaaatgacatcatattttaaagctgagcaaattcttcgtttgattttgatcacccaaaaaaaataggtcggatgaaaaaattctgaaaaactgtacctttatcaatggtgggaaggtgtcaaagcgcctgttgatcagcctcagagtcgccttcatccgtttgtaagccatctgtgtcccaagctgggcaagcagcaggagcccatcctcagcttccatccactccttccgctcctggcccttctttggcgtgtagtgcgcgaatttgtgccggatatcccgatggatccgatccagcgatgcgcggctcgcggaacgcgagcgatcacgatcgatgacgcccacaattgcgtcgacgatgtcgcgcctggcgctgcgctgcagttcttccagccttttcttcggtcttcctctgtttggaggcgctaaaattgaaaaaagatcaattttatgaaaatgaaaaaggaatttcactcacttttgctggtcgttggtggtgccatcggtggtgccatgtgttcgtccagctggcgacgcagatcactgatcagcgcttctcggttacggacctgctcgcgcagaaatttgatggtgtcgtcccggtccttgagctgcttctccagttgttcgatgcgctctgatcgctcgtcaatggccagcggtggcggggtcgtctctccggtgtccattggcgcagttggtgttgtcgaaaacggcaccaaatcgccgattggtgtgacagatgtcgacggcagtgaaaagccaaattccaaaatttcctcgtccatttctggcgttggcactggtcctggagtcgatggaggcggttccatcgcttcttcggcggatgcagcagatgttgacggccctgcttcgtcctgctgtggcatttcggcattgggattcgactgtgaagcggctgaaattaaaaaaaatgcttttttgagttaaaattggtgaaaaactcactttttttggccaggcgggcttgtatcgccttggccgtctgcgcttttctctcctcccgcttcttctcacgctctttcactccctttttgccgtggattttaggtaataattttctttttcccatctaaaatttaaaaaataagaattttaaaagaaaagccgttataactttttagttaaccctttttttgctcttaaaaacccttacattttgttccaaatttttttctctatcgatatgcaaaatttggtatagatttaacatccagaaaaaaagttaaacatcacgaagtgaatgttgtttttcctaataatgaaaatattagatagtacgccaaaaggagacaaaaaattagagaaaaaaagataatgtttttctctggcattctctatttattggtacacatctcgttttttgggatggtgtgtgtatg

SEQ ID NO: 14898 - DNA, 2071 bp, Heterodera glycines
aacaacaaacaaaacggcattcgcacgccgagtaaatacccttacgggctctgatcagtgatcaaagaagtaagacagcacgaaattttagtaccaattctatacacacgtcacttgaggttggagttttccagatccgagaatttattccgagatttcgggtcgaaaactttcacagtttacctccggaaagtgccaactgtgcttgtgtcgctgagttccaagccgagcaaagcctcgatcagccgtgggctggtgaccacatagtcgcactgcgggtacacccgattcacaaagtccttcaggcactcgtttagctcgctgtaagccgttgcgacctgctgcatgcgcacagtcgttttgtccatcgcatcggcgccttgtcggacagcagcagctgaacattgggcattttgatggcatgaaaattctttggaatgtccatcaaaatattaatcagatttctaattgactcacaaattttgccatttgcgacagcggtcgccataatttggtcaattcgttcgcgaaatgaacgcggcacattaacgacgaatgtttgaaggtcggagcccatctccaagccgcgcatggcacacaaattgtcctggcaaaagaagaaaagggatttctattccaatgccatgccaagggattttcattccagtgccattcccttcctcctccgctttctcaccctttctcgttgaagaaagacattcatctggagcatgtcagtgtcggcaaagccatgcacagaacgaccgtggatgtaaaagccgcgcttaacgaaaaggacagtgattaaagtggcgaaatcatcaggcgcataattcttctgtttttggaacaaaattctaatgaaatttttggccaactctgtcaattgttggacggtgtcactcactcaccagcggatttgtcattgccagcacactgatgttggccaccgagcacaggtccatgaagttgcggaaagggtccaccaccctctcgacgattagcacttggaaaagccattggcccatcgcaatggcaacgtaaaaggaaaagtcaaccgcgaaacgactcatcctcgtctccacgatttcgggcggttggtcaactgcaagcggaaatttaacggcgccggaaaatgcgtcagtgtaaaatgcttcagtgaaaattttattgtcataaaacaagtttcttggttttcgagtttcaaaaatcagattttggggtcgaaaaccagaacattttgcgaaactgcttcaaaacagttgtttttacattctatttaatcaaaaacgtattaaatattatattttcagctcccattatggatttgaatagtattgaggagtaaattagcaaaccgtaatttcatggaattaaaaaatcagatttttaacaatttttttgcggcgcatttaacaaaaaaaaatttcaggaacggggggggggaagtgggtccggcggtgccgataggcgccgggaaaaaattttgaaaattgagtgcaatttgttaccagattttgtcgaaaaagagtccaattttgtgattttgagctatttttaaagaaaataatggatctttagagtccgacggtgccaataggctgccgccgaaatttttttttgaaattttatcaagttgtttaacagatttttgtccaaacgatgagcaaaattttgcgtatcagagcgtttctgataaatcagaacgagatagaaaccctgcttttggttcaaaaccggcgtaaatgatctcttattgaaggattgatggctttctattggtctccgtgtatttaaaccggtttcgaacaaaaaccctaatttcgaaaatttcgacttgtttcgaattcggacccggggttcggaattcagaacgtgttcttataaaacttaacttctaaattacgatagtaatgctatagaactttcttttaaaatatttgtatcacggacgaattttctactaacgaattttccactgacgcattttccgatcacgaatggaacggaacgctttatatgtaaagaggggtcggttgaactgatgccctaccgtattcataccagtcaa

SEQ ID NO: 14899 - DNA, 2143 bp, Heterodera glycines
  misc_feature (91)..(91): n is a, c, g, or t
  misc_feature (93)..(93): n is a, c, g, or t
  misc_feature (115)..(115): n is a, c, g, or t
  misc_feature (126)..(126): n is a, c, g, or t
  misc_feature (145)..(145): n is a, c, g, or t
tgcgctgagcagagacaatcatccgatgtccattaaaatttgttgaaaatgacccgatttgaaagagcattgggaatgacaatatttcaantnggcaaagcatcaagaccacatncaccgaccttntaattttagttattaaatntagttatttaaaaaaattttatttaaaccatttacactaaaatacacctcttcgtgatgctttctttttgctatgttgaatttatttcgcatgtttacggcgcttggtgcgtttacacgcacatcgaccggaagttcagcccgaacatttcggacaatgtttcgactggttgtcggaaaatcacttcgagcctcttggcgaatttgctcatttgcctgtcttatctataccaaaaatagatggtttgcttttttggcttacattgagttggccaaaaactgcggcatggttgtggtcggctgacatgcgacccatcttgtaacgacttccatttgcatcgacgtgccacgccatttgaacacaatctcgcccaggacagtaagggggacgttttgggcatttccagtattcccagccttgctcgattcgagagtcgctctcataagcatattcgaacccaagacgagaaaggagaattttgccacggttggatttcgcttcttcaaatcgaacaagagccatttttggttgcagtaaacgaatgaattttcatatcgttcatttttatgcattgcaaaaactagataaggactaaacaaatatgcaaataggcaggcactcgagaacgcatgggaacgatggcgagataagaagtttgagttactaataatattcaacagttttaaagtacaatttcttttatgtaaatcatttattaaagtacaaataatcacttattttatctagagttaccatacgcaaaaagcgataaatactgtattaaagaagttgataaaaatgaaaaatttttaattttatgcatccactgacgaaaatgttcactgacgaattggaacactgacgaaaaaaatggaaaacagcaaaataaataaaaatagtacactgacgaaaatgttcactgacgaaattattcgctgacgaaaatcactgacgaaatcgttcactgacgaaaatgcttactgacgaaaatataattacacggtgggtccggcggtgccgataggcgccgggaaaaaaattgagtgcaatttgttaactgattttgtcgaaaaatagtccaattttgtgatttttgagctatttttaagaaaataatggatttttagagtccgatggtgccaataggctgccgccgaaagtttttttgaaattttttcaagtttttttacggattcttgtccaaaaatgagcaaaatttgcgtatcagagcatttctgataaatcagaacagatagaagccctgcttttggttcaaaaccggcgtgaatgatctcttattgaaggattgatggctttcagttcgtctccgtgtatttaaaccggtttcaaacaaaaaccctaatttcgcaaatttctactttcgacttgttcgaattcggacccgggtttggaattcagtacgtgttcttataaaatttaacttctaaattacaatactaatgctatagaactttcttttaaaatatttgtatcatggacgtattttctactaacgcattttccactgacgcattttccgatcacgaatggaacgctcgctttatatgtaaagaagggtctgttgaactgatgccctaccgtattcatacagtcaattattaaagactaaattttgagcgataattaaattcccgtttctcactctcgagttgcgtagttttacttcgctctcaaatcaattctcggtctcggcaaactatggctcaatattttaagccttcggtttgatagcatggttatgagtactgtatggatgggtttgtaccgtatcccctctcaatttcgtcgactttttgtttgtttacctcttccaaacccgggctgcaatttggcaaagttgccaaattccatgtagtccagcagaaacagtacaaccagcagctgcacactgagtcgagtcttacggtacagctgcaactcattccattcatttgcgatcagataagtacgccttgaatttgaggaaggggggggggg

SEQ ID NO: 14900 - DNA, 915 bp, Heterodera glycines
  misc_feature (884)..(884): n is a, c, g, or t
atgtataagatgcaaactaatgcataattgaagcagaattttccctcatcgaagataaactattcaatatttcttaggctggtttggcaattctttctggcattgttggcatcggtggtacaattaagactggcgagaaggcttgggcttttggcgctgctttaatgttggccaatattccatacacttttctatgcatttttccagtcaacaaacgtttgctggctaccaacgtaacaaaataaattggaattggaaggggtggagcccaaacaaaaaatacaaatttaactaagggagaacacttatggcctggttattatatgtagttcattaaaatatcgtaaaaattgagctgaacacgaaccatttaatagcaaaaatcctaagatttttaaaacccagaggtggaattttggttcgaattccgtatttacttatgtttgtatgcatgtaaaatgaatacatttataggcatttaaaaatgtatacgaaatctgtcccctaaacttaacaagtaccggaattttttttttttgatttctctcctctccccgtaaattggactgacccgccaaaagcatggcccaaaaatgaattaattctgtgggttctcttaaaggaagcaaatgctgatgaaaacactcgtgcagacatacagcgctggggccgacttcacgcggtgcgcactgtccttggtttaattgccactggcgtttatttatacgcagtaagcaaagaataaaaggagaaaggaactttaaatccgacaacataacataaaatgacatatttttaatgtcaattttgcatattcacaaatttgtgtgcgtacactttcaatcacatttttatatttgcactttattacataaaaacattanagcgtttacttagcttgttgatttttattaa

SEQ ID NO: 14901 - DNA, 2142 bp, Heterodera glycines
  misc_feature (14)..(14): n is a, c, g, or t
  misc_feature (178)..(178): n is a, c, g, or t
  misc_feature (1981)..(1981): n is a, c, g, or t
  misc_feature (2024)..(2024): n is a, c, g, or t
  misc_feature (2052)..(2052): n is a, c, g, or t
  misc_feature (2084)..(2084): n is a, c, g, or t
attctcactaaaanaattccctcaaaggtcaattcttaggggtgtaataatcggatttcaaggcaaaatccgattacgattatccgattccgattatggcccaaaatccgattaattgcgattccgattacgattccgattcggcacatccctggtatgtggcgtccccccccccccnccctccccgcttttcctccttattcgccctttatattaagttttgcaaagttttggcgttctgattactaaataaataataaacctatttgcactgagagcccaaaattgggccgctgtgtatattacaaagagcactatttagagaagggtcgaaaaaatcaaagtggggttcgaaaaccaaacgagggatcctttttaaggaacaaaaatggataggctaaatgccttcgagactgaaccgtcgagtgggtaaaacatataatgttcaacaaaatctaaaacggttcctctcatttggagtttacccatcttttgtctaaaaaattctttcgaattcggcatttacagaccgagagacgtcaaatgatatatcatttatagaattgaatgaggcacacttttattagaatggcagattggatgcttagaaaataaatttacaaacaataattatgacttctctctttctctaccaccctccgttattcgtgcgcacaatcagctgctcccgtcccttcccaactccgatgtattcgacgggtacgcccagttgattttgtatgaactccaaataggcacggcatttgtccggcaactgttcccactgacgggcactggtcgttggcgactgccaaccctcaaaggttttgtaatggacgcacaaatttgcccaatcatcgacggtcgctgaaaaaagataaacacttgaaatggcataaaaacagtcgttaattttgttcagctcacctggagggtactcaatttgccgtccattcaattcgtaaccaatggcaattttaatttcatgaaattggtccaggatgtccacctttgttacagccaaactaaaattatgaaaaactataaatatgaacatataaaataataattgggtgaaacgtacgaagtgaatccgttgatcattgcagaataacgcaacagaaccaagtcaagccaaccacagcgccgttttctgcgagtggtcacgccaatctcagcaccaacttcttgcaaacgtttgccctcttcgctgggctgtccctatggaaagacaaacaatgcgatcaaattaacataatttttggggcaagtacatacatcggcgtcaagcagttcagtcgggaacggaccggagccgacacgcgtttggtaggctttgaccacgccgatgacgcgacggacggctgtcggcggaatgccaaggccggtgatgcaaccgccgacggtagaattggacgaagtgacgaacggatagggaccaatgctgccgggttgaatggtgccacgttttctgcaaattgatcggtgttcaataatttcgttttttggtttacgagttttgatccgttatggcatcgcgcgacaatgtcaatctgagaaagtgagagggtttaacaaacaaaacaacaaagcaaatgcattaaaagaaagcccaatgaacaaatactttccccagggatattttcttttattttgtaattatttccatcggcggaatgccggaatccttcggaattggtgtcccgacagaaaaaaattcaaattttctttacactttctcatgaaacctcgtatgcctctgtgaattgcaccgattcctcctccgtgttggcataacgtgccatgtcgttggaaaacaaagaccacaagcaaaagaaaaggtgcacgtatttaggaggggaaatgagaagaaaagaataaaatatgtacatttataggcagttaaaaatgtttgtgaaatctatcccgtaaactaaacaagtacccacaccgtttcaaaaaacgagatgtgtaccaatanatagagagtgccagagaaaaatgcatctctcattttggcgtanctattttttttgtctctggtattagagnaaaactgaatttacttcatccctgtttacttnttttctgctttgtaatccgctttcaatttgcatatcgatagagaaaatattctgcatc

SEQ ID NO: 14902 - DNA, 1420 bp, Heterodera glycines
aatatataaaatcgcagcgtttaggcaatttccaaaaaagatttgattaattaagtaattacttattattttcgtttgtaactttcttggaatgttcgaattttctagttttctcgtatattacattatttagtctgtactttcgaatgataccaaaaagatagggtttgttcaaacatgaacaaagttattgtataaaaccattaattgtactcataaaagtcgattggactcataaagtgcactagagccctgtttttgtttacttatcggtattatccacaatctttcattttttaatcttcagttttaactaaattagaaaatttcgcttttcgctacagttatgttaattgatttcatcctctaaatcatcattcaaattcagtgaaaaataatgacagaaatcacatccctcgagttataaataggtctcaaaagtaaaattaactgatggttgattcgccgataaattaatcaaaaagaattgatgaaaaatttaaacattaaatagtgagaccacaactaatcaagacagaaaccgcaacaaatctcggacttcattgacactccgtctcgttattccgtctctgatttcaggttcgagtgccaaaaaatcactgacgtttccagcgggaaggactatcattgctttaccagcagcaatggccgcttcgacttttgtttttaattcatcaattttcacaattcggccgtctgatttcactgtgccagtaaagcacttcgagtcttgcacgagccgatccctcccaagcgctaagaaacccattgccgctgctgaagaacaagacccgccttctctcagtgccattttagggaatatcgacacatggaactttctttgattgaaaaaggcgtcattagcgcacacttctttctagcaatcaaacgcatgctttagcgagcgctgaagataagaattttaagacaattttattattgaattatcaaattcgatacttttactgtttaaaaccaaagtgggaccctttgttttctaatttttttgtcataaaaaataatgcggaccgggtcagtttagtctgacaagccgttttcgcacataatttcttatgtttttttttgttaatcataaatgaggaaaacttaagattaaaaaaaaatttcgggaccaataatctttaccattgcccaaaaaagtcgtaacacgaaaaaattaaatttttgacttgtttccgaagggttaggggttggtcaaaattagtgtcagattcattataagcgactccgaatttttaaagctttttaaattagggtattaaaaaccttcaaacgagtatccatttcattgccaagacgtaacgattcccgtaagtagtaatgattaaatactgcatctatacggatttttatcaattttcctaaaacgaaagaatta

SEQ ID NO: 14903 - DNA, 1380 bp, Heterodera glycines
  misc_feature (1343)..(1343): n is a, c, g, or t
  misc_feature (1363)..(1364): n is a, c, g, or t
gcgaaatgtatgttttaacattagtaggcgaaatgtcgagtaggcgaaatgtcatgtagccagggcaatcgcatcataatttccaaagacagcgttttgatcaaacaccgccctccgctattcatccaatgcgcactttccaaattcgtcatcgttcaacggataaaacgcgcgggttgcgtcattttgctcacaaagtttgtgagaaagtgaagcaaaaagttcaaactaattacaacgaagttgcggaagaattggtcaatgaatattttgacaatattgttgaagtcccatcggacccggttaattgatattattcgtaatgaaataatgcatttaaatttcaggaaaaattacaatatgatacaagaaacattcgccgtcgtgtttatgatgcgcttaatgttttaatggcgatgaacataattgaaaaagaaaagaaagagattcgttgggtgggcttgcccacttcgtcgttggccgagtgccgacggctcgaagaagaaaaggtatgacgccacagcaaattcaacgattgaattgttaaatttcatggctttaggcacaacgtcaggaacgaatccgtcaaaaaaccgaacaacttcaggaactgatagttcaggtgattgaacaaacatagttatttcacttaaattgatctttttagttagtttcttacaaatctttggtccagcgcaatagagaaagtgaacgagtgaatggcaggcctttggtgccatgtaatcccgacactgggtaatttcgacactgagtaatttcgacactgaactattttcaaaactttcactgttttacttcattttcgacactgagtatttttgacactgagtaatttcgacactaaagagttttttgaaaaaaattcatgccaaaatttgaagattggtcaaaaactaaatataaataaactgcaaatatttgtacatataattttctcattatataactggggacaaaaattcacaacagtttttaaagtttgatatactttcgttaagcagtttgagcggaaagtccaatcatttccttaacaaaaaattggtgatatgcaatagcctaacatttgtgatggcacttttgatataagcttaacttgggaacaattaagtaaaaaagacacaaaatttttaagacagcgcctagggggtttgcccagttgtacacaatgagcgttgtgattgaacattcagcagtccctaactttggaaccaactgctgaattgcagggtaaatcaatatgaaaaagctgggaatttgggattaaattaaagcgtcctatatgaaaaactttaaagaactcgtcatatattttgtaaacgctntggattgggccccgacgaannttgttgaagaagaaga

SEQ ID NO: 14904 - DNA, 1497 bp, Heterodera glycines
  misc_feature (1472)..(1472): n is a, c, g, or t
atataaatacattccctgtttataacacgtgaatatctcttctaagatgttgtctattattattttcggaaatttctaactattgaattattgcaaatttgtataagaaatgttttccgacttgttgtaaaatatatgttttttatattgtaagtgtaagaaagaatttgttaaattataattattattttaaaataaaattaagatcatattattttaaaaaatgaacataaatattccataaaataagtcaggaaaaataactgtttctaaatgttaactttgaacaaaatttattttcaaaaattttattaataataacctttaacttaaaagaaatgaataattaaagataacaaattgaaaatatttaaatatttttttagaaatgccattaaaaattgacaatgccaaaagaatgcagcaaattgttcctaaagtcaaatcatcagagaatgtgacaggatatttggaaaacaaaaatgaagaaaaacagcaaagaatttcattcaaaaattattttaatgaaatcaacgcttattttaactattatggtaaaaaagcggataattaaaaaaaataaaaattataattttcagggtaattaataaatttaatatttaaattaatttagtgcctaaacatataattggactaattgctcttaaactgatcaatgcaattcaatggcacttggaactgaacaatggtcaattgacacatgtgttgacacctgatcatttggtggctatccgtgttggtgatcaatttagcaagtcggaactgctcggaaatgttcaccttgaaatcgatgccgaaattcaacgcgtggaagacccacggcagagggcacttcccagcgctgatcaaaccaaaatcatttggctaaaagacttttcttatatgagtccacagcaaataaaggtgattcattctaatcacttttttaatattatagctttagaatttttatcatttattaatcaattaattagcaatttttaaaatttaaaatttgtctatttttatattgaaaagctattaatatagtttatcatattatatttagagataaatgtttaaaatgtttatttagcacaatattattacgtcgggagaaagtgatattatttggtcatttggaatcactttatatgaaatgatcagtggtgaaacgcccatatggcatacaaataagcaatatttttattgaataattttattaaaattaaaaatgcatcttaaacatttttcacaatttttgtagtgccatcaaaccaaaacaacaatggcattggattccgttgaatgacgaaaaaggcgaaataaatgaggcaattaaaaaggtaattaatttaccaattaaatacattgagtcattaattaaaattttaagataaataaagaacaaaaatatgttgaaatgtttcgtgataaaactcaggaatttatggaagcaaattttcccattntgtcattcgttgggacttccgctga

SEQ ID NO: 14905 - DNA, 1552 bp, Heterodera glycines
agttttatttaatttgaggaaagattcataaataatttcctctccaaaaaaaaattatataagattttccctttcttatttttattgcttttaataaaataagtatatatggcattaccataaatgttaaatatttaggggagggggcggggtgtaaatcagggatggcgctgaatcccgaaaaaccagacttttaaatttaatcctttgaattcaatcaaaatttatctaatcaggatttaaaaatgcttctttttctaataatatttttaaaagaaaattattaattaaaaaggcaaaatatgaattgaatctcaaaaaattattttaaattttataaaaaaatttatttgaagttttataaaaaaagtaactattttatgtaacaaaaaaatttaaaaaggggcatctcttcagctaaaattgattttcgtttttttattgcatttttgttaggaaatttttgtcaaaaacaaaaaatggctttaaaaattaaaaaaacagaaacccaaattaatattacataatcaaagtttaaaaatctattatattatttgacaaattccgtcacaaaaaatgtcgattcaaatttacgcaaaaataaacataatgccaaaaaatttatttagtaaatacataaatgaaaaagattatgcaataataaaatttagatttttcatcactttttttctttttatttattttttttatcttttataatttgtttttttctacttaaattaaattaaatactgctatttaaattaaaattctaataaattagagagagggggaggagataagagagaagagaaaagagagagggagaaagagagaggaggagagaagagaggaacgaagagaagagagaaaaagagagagaggaggagagaagagagaaacgaagagaagagagaaaaagagagagaggaggagagaagagaggaacgaagagaagagagaaaaagagagagagggagaaggagagaggaggagagaagagaggaacgaagagaagagagaaaaagagagagatataagagaaaagaagggaaatagagaggtggaaagaagagaggaaaggagggagaaaagagggggagaaaaaagaagagagagagagagaggaaaggagagagagagagaaaagaagagagagagaggtgaaaggagaggacagaagaaaggataaaaagagagagagagagtgaggagaggataggataaaaaaggataaactaagagagagagagagataggaagagagagagagaggggttgagataagagagaggaaaggagagagagagagagagagaaaaaagagagagggagaaagagagaggaaaagagagagaggggatgagataagagagaggaaaggagaaagagagagagaggaaaggagagagagagagagagaaaaaagagagagggagaaagagagaggaaaagagagagaggggatgagataagagagaggaaaggagaaagagagagagaggaaaggagagagagagaaaaaagaaagagggagaaagagagaggagga

SEQ ID NO: 14906 - DNA, 1249 bp, Heterodera glycines
ttttttgggaaaaaaaatctttttcaaaaaatttcccccgggggggggggggggggaaaccatgtttttaaaatttttccttttttttttttttaatttaaaaaaaaacacttccgggggaaaaaaagggggttgaaaaattttttggggaaaaaaaacttttccaaaataatccccctgggggaaggggaggggaacaaatttttaaaatttttaattttttttttttttatttttccaaaaacggtttaaaaattcaaaaaaaaaacccttcccggggggaaaaaagggggttttaaaaatttttttgggaaaaaaaaccttttcaaaattattccccgggggaaagggggggggaaacatgatttcaaaattttcaattttttttaatttaattttctcaaaacggttcaaaattcaaaaaaaataacattcccggggggaaaaaaggggtttgaaaaattttttggggaaaaaaagactttacaaaataatccccctgggagaagggagtgggaaacatgatttcaaaattttcaattttttttagtttaatttactcaaaccggttcagaattcaataaaaataacattcccggtgcgaaaaatggggtttgaaaagtttattggggaaaaaaagactttacaaaataatacccctgggagaagggagtgggaaacatgatttcaaaattttcaattttttttagtctaatctactcaaaacggttcagaattcaataaaaataacattcccggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatg

SEQ ID NO: 14907 - DNA, 1869 bp, Heterodera glycines
tgatttccgtttttttccatcgttcttaaacccattttgtccctctcaatttttcacttcattttttacgtattctgatttcatattttcatctttcttaaacccgttttttgtccctctcattatgttcaatttttcatttctattttttatttatttccatttttttctggtcttaaacccatttttcccctctcatttatgttcaaattttcatttctattttttatttatttatattttttccgttcttaaacccattttgtccttctcattatgctcaattttcacttctaatttttacttaataaaattggataattaaggcttaatgtttaattactcgcaaaaaatgtttgagcaacggccacctcttattgacatgctaccccctctgattcgtcccgatttaatcccccccacatcctcattaaatcaactgcctccccaacgccaacaatttttgactcctccgaccaattttcaacccccgcttctctctcctcaatccaccaatttgcgcccattcttttttactgctccaccgacatttgcccgccctccgctgtttgttgatcctaataccgttcattggccttctttttctgtgccacctcctcctgtccatcggccatgtctaatgcctagtgcacaaaattggtctcctcgtcctattccacaaattttaccaacagtaccactgtgtcaatttctaccacaacctgcccatccgacacaatgccatggaaattttttctccaaaccatcggaacccaagttgtcattgtctcgtctgcatgatacagcaagtatgtttctattcataaatgtaaaatactatgtattttcatcaatatgataaactatttttaactgaatttgaggatgcgacaaagaacgaatttctcgtcaaacgaaaaatcgtcgctttgacagttcaccgacgagagtcccggatgttttttcatgtgatttattgaatttatttattacgcatttaaaatttgttaagtgtaaattcaattccccattcattttaaggtgtcgttaaccgatcgaatgggattgcacgttcgccgatcaaaaatgtctcttccgaaaattgcggtaatttttagtatttcataataagttagcaaattactatttattaaattcggttgcaggaaatcgatcaaatgaaagaagcgtgcgatcgtctgttaatgcgccgagaagaatttcacgtaaatttgcttaaatcttaataatatcaaaataatcatattttaatagactgcataacatttaggtgagcgacatcggtcattgagacgaaatgcgcggtcgcccactaaaaggacgagctttaatggattttccggtatttgatttcctcttacaaaattaacactatttcatttattattcattttaaatctcaaaatttccatttttcagaggataaacgataccaaaaagtgaaacaattgggcgatcaccgagtcgtgtcccggatggcgattctcgtatgattaattttattattggtatattaataaaaatagagaaatatttacgtaacatccaattagtttttcatataccaaaatttctgaaaaatacaatccactgaaaacaaaaaaaacaattttatatttaattattgtcactttgaccattttatatttacagataaaagatcaaagggtcgccgacaaaatgatgtgtatccgtccagaggcgtgtttgaccattatcgtaataaaggtaaattccagagttgtgcatgccgtattttcactaaatatgtgcattttccattcataatccgtcacaattttttgtattttaaagaattttcgttaattttagatgacagacgtcgtc

SEQ ID NO: 14908 - DNA, 1346 bp, Heterodera glycines
  misc_feature (15)..(15): n is a, c, g, or t
  misc_feature (50)..(50): n is a, c, g, or t
cagagagttatcaantatgggatatacgcctgatctgattatatcagatntaaagatataccaaataaaaattaaaaaaataattttcagagacttttggcttttgtcgcaaaataaattagccgatttacccagaacctttggattaaaatgttcaccaaaattatattttccgcataaatttaattcagaaaaaattatggtaaggcataaaattaatacttagataaatttgatttaaggaaaattgataactcatctcccacccatagaagattattatcccgactcattaaaaaaaaatgaatttattaagtttaaaaaatggtatgacgaaaattataatacgtcttttttgttaggtaaaaaatttaaaaaaaattttcgtcattaaaatttttagaggaccaattagaaatatactgtggccaagacaccgaaattttaatgaatgcggttttaagtatgagaagaatttttttagaaatcacaaaagatgctgatacacctcaaggatatgacgttataaaggtattaaaaatggtttatttaaaaaaaaattttttaggaggcatcgactctagcgggcgtagcgatgcgaatatttagggcaaaatttttaaaagaaaaacatttagcaataataccggaaggaggttttgaaaaaacagacacacaaagttcaatcgcgattaaatattttgagtggtttatgtacaaaaatggggttaaaggccgacacgccggaaatggcggtgaaataaagattggaggtaaaaaagcatgaaaattcagaattaaatatgttttaggttttaaattagattttatatgtggaaaaaagaaagtcattatcgaatttcaggtccctagaaaaaagtttttttttattttttaaattcttacagggttgtgcatttcacggtttgtttttaattattaaaaaggtgattataaatttaggctgcccaaaatgttataagtcaaatcatttatgtcctaatgaaaattatgcagaacaaaattttttgaagactcagagtagaatgaataaactaaaacatgtggcaaaaaaatatggattaaatgttgaagaaatatgggtatgttaaatttttatcatataaatcctattattttaaaggaatgtgatttaaaatcaatgttaaatcgaaaaaatgacacaaattataatagcgaaatgaaaaacttttttgatgaattatacgacaaaggtaaaataagctttttttaaaacggtatatttattaatgtactaggtccgattgatcctcgagatgcttttagggggggccgtacacaggctttttgcttatatgcagaat

SEQ ID NO: 14909 - DNA, 2950 bp, Heterodera glycines
  misc_feature (2901)..(2901): n is a, c, g, or t
  misc_feature (2940)..(2940): n is a, c, g, or t
ttctcgaagataggaattgattatacaaacgatccgttcccccccgggcaaacttatgtcgcattttctcggtgcagatcttggaaaggtttaaaaataaaattggcaaatgagaatagcgaaaaaaaaataaaaaatatagtgtggcaagaaattttaaaataaacgtatatatttataaaaattaaattttggaacagaattacaataaaataattcagttaaggttaattaaattgtatggtaataaattagaatggaactttgattaaagctgaataagagatttagaaatgcataaatatttcattattatatgttttgttttggaaatttaatataaaaatattgtttttctttttttcattaataaagaaaaattatttgtttgctttttcaagaataattgaatgtataacataaaaataacacacatataagcaattttaacaaaaatatgaatgaaaattaaaacaaaaatatattaaaaacagacaaaatatatattggaaaaaattggagctaattaaggtaagttaatcgttgcattaacaaggggggtgcaacgtatgatagggcgggatataaatcatccctttaactatcatttaacccctgaaagctccaatgatacccgatgctttggtgcgttcacgccgcgggtatcgttagtaagccaaaaggccgaagccaaatccaaagcagaaaaccaaaaaattaaattaaagaaaagaaaaaaatatgacattctatggttttttaaattttagttttgaaaaatattaaaattaaaatatatataaatttaaaaaatagattgttttaagttattattatgatttttaaaaaggttttgtgaacagattattggccgataaataggttaagtggtttttgatcattaattgttagcatccagtgctttgttggccggtaaatgtgttgttagaaaagttgtcgcggtgttttcttcaaaagtaaataaaaacaacttttacattaatacatattatgttaaataaataaagttaattcattcttttctttaaaaaataattcaaatggatctttcatttaattccgagaaaactcctccaaagcgtgccaaacgttcaccaattcaacgattaaaagctggagaaacgatgatgtgcgtataaaaatataattaattaataaaataaaaataatatggttaagtgatataaaattggttttgattatggccgattctgtgcggattgttggagaaaaaagcaaagtttggacgattattggtagcgatggagatgattacatcaacggtggaacgtctaatcccgtcgttgctgccaaaactgattcgaaaaactcttttgaagtatgctgatctgcgtgctttctcttcggcagttgtggcggtggcggtggagggggcaagtggtacactggtgtcggggtctgcgtacaagcattggagcgaaaaccatggtcaacgttaaaaacacggcctttgtttcgaatcttacaattttaaaatttgtttcttgaattttaaaagcccaaaaaaatgatgatgatgcaggtcagaaggaaatgggtaaataaatgccaacaccgattaccgagacttttcattttctttcgttttttatcctatttccctctccaatattatggctcgccgcggacctcttctaccgatttacaagcggcgtaacgttcgccgacaaattcaaattaatcaggtataataaagttttaacgaaatttaatcatgtttatttttttaagattttcgttttgggcggacaccaaaacagctattgcctatggggttgcgccctcgcttctcctttcatggctcctttggtaacgaattgttttaatttttaaaatttgaaaatgaaactatttcagagttaaatctcgagagaatcgatggacgatgggcaaggagagagagcaattaaccgagaagaggcgtaagacaaataatttaaaataaaatctcctcaatattttttttaaaattatttttctaacctttttctaattatcaatgtttgatttaataaaatgttaatttcgatgaaatttgtttttttttacttcaaattaaaatataggtgaaaatttaaaaatcaaaatttttaaatatttccatttttaaatccattttaaaatcctttcttcaaaattcgtccatcgttctttgtgcccgttctggtctcattcggtctgaaatttgtaaaaatttgaaatgaatgaaacattcctattcactctcaccacttcaaccgcctcgtcgatggtctccagctggcccgaagtcgagacctattttgagagataaatgcataatttttccttcactcctctcccattttttaccttttccaatccgacgcgttgcgagcggcgcattgcgcactcgtccccatgtggcaaagtggggctctgaaaattttttaatattattaacaaataagtggagaatttgcttccttccctcctctcccgttttttaccttctccaatccgacgcggcgcgagcggcgcgctgcgcactcgtccccatgtggcacagcggggctctgaaaatttgtttattattaacaaataagtggaggaagtgagggaggggtggggggattacccgaggcaccgggcagaacacggtgagaggacggccggcaccctccggcggcaattcctggtgggtgcgctgacgccgatgaggatgacgagtgcgggcctggccacggacgaagaggagacagaaaatacaaaactgatttacaaaaaatgaaatttattttaataaaatttaaaaattaataaacaaaaagtttcacctgagtgatcagaatgaagaggaagaagacaacgatcagcccgctcacgctgcctttgtcattngtattgttgttgttgatctgaagcagcagatccgtcatngtgatgtccc

SEQ ID NO: 14910 - DNA, 2924 bp, Heterodera glycines
ttttggtcggcgctttgttcggctcattgctccgtcggctttcgttccaatcgcagtcccaaagtgcgctcgccgccggagtgtccggcgaagctttacaaaacattcgaacggtcaaagtgttcgccatggaagaggcagaaacggagtcagtcgaacgaatgaatgcaaaatgcagatcaaaggaatattttgcgctttctttatcagactctatcgtaaagaggtgcaaacggcgtgttccctcggcgaacggctcggcgttggcatcggtctcttccaggctttgagcaatttcttcctcaatggtccgtctaatcaccgatatgtccgttgttaaatagttttttccattgttgaggaattgtattgggtgttttatatggcgggggacaactcgtggctgatcagcaactctccgcgggcgatttgatgtcctttatggccactgctcagataatccaacgttcggtgtcccaattttcgttaattttcggaaatggaataaaggtgatgccatttgtttggtctttctttgtttgtgactccttccttccatctctctgttaggcttggacttcttgcgcccgaattctccaattcttgcgcattgacccgaattgccataatcacttgaacggtaatgaacaaatcccaaggcattcgctgatcggtgacattcatctgcacaacatttgtttttcttacccaactcgtcctgaaaaggccgtgctcaacggaatcgatttgcatttcgccggtggacagacaacggccatttgtggcccgtcgggtgcaggtgggcgccgtctgatcgaatttaaacgcaattaaatactattcccacaaattaaattcacattaagggaaaagtacaattgccgcattggtcgagcgtttatatgagccacagaatggcaaagtctgaaaggatggtaattggtgttgccgaatttcgctgctttggtttaggttactttggacggtcgggacatccgctcgttggaccccctttggttacgccaaaaagcgatcggagtgatctctcaagagcccattctcttttcgacgtccattagagagaacattcgttacggaagaccaaacgcaaccgaagaagaagtgaaagggacggactactaaaggaaaaacaaatgcatttaaagattcgatctgccgccgaattggcaaatgccgccgaatttatcgaaaactttgccaatggttacgacactttggtgggcgagaggggcgcgactttgagtgggggacagaagcaaaggtgcttgaaataaatgcaaaaagaattgccccgaaacacgaaaaggatcgcaattgctcgtgctctgatcaaagaccctccgattttgattttggacgaggcaacctcagcattggacgccgaaagcgaaagcgccgttcgttgtgccctttgggtgcacttttcgcttctccattcgcttaaggttcaactcgcattgggccgcgtaatgcgcgaccgaacggtgattatcatcgcacaccgactgagcaccattcgaaacgccgaccaaatttacgtcctgaaaaatggacaaatggttgaggtcggtcaaacgccgccggagagaatttgcaaatcgtttggttggagtgagcaaaaagcattccaattttaagaaaggcacgcatgaccaattggtgaggaacagacgcggtgtttaccattccttagtcggcgaacaacggcaaaaatctccgggagaagatgaaccgacaaaggcaggaccaatcgagaaaataaaacaaattttcaatttttaattgtttgctatttaaaatagttgaataaagttgcataagaacaaaaacttcatttcatttccccatagggcctgaaaaatagactttttcttcggacaggttcgcgcatgccaatgtttgccatttttcctttattgtttaataaagagaaaaatacatctaaaaatataccatttatagatgtacttaattttcaattttagtacattaatagatttggatttccgaccgctgaaattatgtcaatttgcctttcgaaataagcttcacttcttaagtggccttattttgtcaagcttttctgcataaaagctggttgtacactgatataaagtggggtggtgaaaagatgcccgagattgctaattcccccttgtagtttatcagcttttaattataaattaataatttatctcgcaaaaaaaagaacgacaattcgaatatgtcattaggcaattgagtgtttcattcccggattggttcatcaaaatgtctgtcggacttgctccgggttgattcgcggtgcctccaccactttcggcttcttcgtgtccctctgccccctcagccgctctttcacattttccaatgccttcctttcgattacttctcccactaaagcatttccctttccgactttgccatttcgttctttgacctcacaaatggtcaaattttcagtcggttttcgctctttccgtaggcattcgattgaatctgtgccaatttcattggctgacgatggagggactggcagaagaaattgcatcattaacaactaattaagcattttcactcggtttacccagcagaaacccgcgcttccattctttgagctccaatttgacggcattctttgaacaatcgctcatttggtcggctttggcattattggatgaatctttcttatttttcgtagtcacgaattcctttatctgtttcaaaaactgtttctcttccgactccgaatcctgaaattaaaaacccaaaattactagtaattaatgcaacgtttaatttgcacaaactttgaatcttgaaaatcaattaccatccccagtttcttaggccaactctaggggaatattacttcgggtgactcctctttcgcctcgtccttt

SEQ ID NO: 14911 - DNA, 2115 bp, Heterodera glycines
attatgaatagggcgaggatttttagttttttaattatttttttctgcggctttatttagacgagaaatgcacgaaaaacacatttttagctcggaaattcttcgttttaacgccactattcatcactatgaatcactatttttggagctttgccactaaaaaaactatttcggaagttggccactaaaatagttttttgccactattttggcgcttcttcacttattttgccactattttggcatttttggaaaatttcccaaaaaatgcaataaaaatggaaaatataccccaaaaatcgacctaaaaaattcaaaaaatacacccctaagaatcgacctaaaaattttcaaaaatacgccccctaagaattggaaaattttctcaaaaattcttcccccaaatttttttcttgctcaatatttaagaaaatgttttgtaactgcaatcagtgaataaaattgtttgccttaattttaaattattttcaaattaaaaaatagctatttaaaaaattacacccctaaatttagaactttttcgccactattttgccactattttgccattttttgtcactatttagttaattattttggggttttttttcatgcatatttgagggtttttttgctgccttttttccgttctgtaattataatatataattcaatgtcatggagatgctatgcttggaattactgctgtgtttggaatcgttttcaatttttctgtcatttttataacagttaagacaaagtgggtaaaaattcaaaattcacaaaaatatgttttaaaaacattacaattgaaaaaattaaaatttagaaaattccgtggcaccataaattaccttttggcactttgctccttttttgaattgcttcatcagcttggtcattttttgtttgtgtacatcgcattttctggccaaaatttcgtcgaattttgtttggccacaaaactggtttttgtctcggcgtttggtcttggtaattaaaaaaaaaacttatgtattaatgaagttaaagaagaaatcattaacaatttccaaactttgactaaagttcgcattaatttttggacaaattatctgttaacaaaacgcattaaaaattacaaaattttccccggcggtgtctttcggcaccgcgggtccttcaaaatttgataatttttatacaaaaaaaaaaaaaaaatttctccggcggcctctattggcaccgccgaaccctccccccccccacacgtcaccaaaatttttttgaaaaagagtgccgcaaaaaagcagttctaaaaaaaggtccatcgcctggtgctaggtcacttcacgaaaagtgcaaaaatgacgacgtcaaaaatggggcgtttcgcgaaaagtgcaaaaatgggcgtttcgcgaaaagtgcaaaatggggcgtttcgcgaaaagtgcaaaaatgggcgtttcgcgaaaagtgcaaaaatgggacgtttcgcgaaaagtgcaaaaatgggcgtttcgcgaaaagtgcaaaaattattaaaaagagactgggcctcttcaatacggtgtctctttttattaaaacttaataaaataattattccgtgtgtttcggcccttatccgtagacacacaagccacagcaataaagcaaagcaaaagcaattttattaagcaaaataaatataaattaatttatataaaagattttgttttattcaaaataatttttttaaactaattatatttaatatgactagtcgtttaataatttaaataattttttattaatattattatacttgattttaatcgtcaaatttttatgattatttattccagtaaaaattatcaaatttagcaagttaattttttttaaatgattaggatctatgatcgcctcgaaatgtcccaattcgaaatatataaagattgatttatactccctcgcctggtcaactagcatctaaatattctaatagttagacttatcatatttaaatgtgtaccgaatccagcatatccgacggataaagagataataaaaatttatgaatatatgtggaaagcacgcttagaagtaaggaataagaaaattttttatagctttttataaaatatgaaataa

SEQ ID NO: 14912 - DNA, 2878 bp, Heterodera glycines
  misc_feature (39)..(39): n is a, c, g, or t
tttggcgcagacaagttaaaaagtttcataacttttttntattcaaccaaataaaagaatattgagatattaatctataggtctcaatgttctttattagcctgcaaagtttcaaaaagctatattaggtttaaaaagagatatggcgtgctgcaccaaaatggccagaaaatgtaattttttgaggtttttggccatcattttttttgcgtctcagctaaattttttgaaactttgcaggttaataggcccgttaaaaatcataccaagattatttaatttggttagtaaataaaaatgatatgacgttctgcgccaaaatgggcggttcccttttaatggcaacgcattcgaattgcaatgttaattaaaagcacttacaaaattcacaaaaaggtttcctctcaaatcctagtttttttctcaaatatttgaagattccgacccgaatttgggtcctcctgtgacaaccaaaaatatccatgttttgggtaaaccatttttaaccaccagcagagactattggccaaatgtggcaaaaaaaaaacaccgtgatgtaatggctaatcgaaaatagctgtgggagccgaaaaggttgtgggatcaaaagcaacagaggccaaatgaaggaaagatggcacccaaacaacagtcaatcaaacccccaagcggtggatgtggtctagtggctaagacaacggatccacgtaaggagccccgagcggcggttcaaatccggccttccaccccaatttttcgcctaaataatatggtgacacttggcggacaccccaggtcgtttggtcttcacaccactcgacactccagaaacaacagctggcactggggcaaaagaaccggaggcgcgccgatccttgcatagcgggaacggcccaacgccatctctcgagcgagggcgctcgaatatgagaggaggggaatgtaatggctgatcgaaaatagctatgggagctgaaaatgctgtgggagcaaaagcaacaggggccaaaatgaaggaaatatggccccataacaacagtcatccctccagtggtggatgtggtctagtggctaagacaacggatccacgtaaggggccccgagcggcggttcaaatccggccttccaccccaatttttcgcctaaataataccattgtttgcccataacgttgctggggcggcagtgcgtgtggtggtgccgtttgctccctcggggcttgggtgggcgctgggaagtgtccattggatacgggatgggccacctcgtaatggttggggggtggaagataatggttggcggggtactgtggggctggaggagggtatgttgcgttgttcatcatttttgggacttaggacggatcgagaaatggatcaattagctaaaataacgcataaaataaagaatgaatagaataaatagtgagaagcaaagggcgaagccgggctacgcatggcttataattacatagtgcgcgaccggttatgactctgtgagttccggcttacacttgaacgatctctctccgcccgggccgctaccgccacggcggccccagctgctgcttgggggcaacaacacgccaccaaagccgtaatcgggcaataacgaacggctaacaaaaaggcaaaaacccaggccaagcaaatgctcacagcaaaaaaggcctgcggcaacgatccaactgattgaaaaagggcaaattggatctgcggaagggtcactccccctgtgtatgtgccatttcctcccttggcgctgctgatttgtgaatattccccatgctttattaggatgaaaattaaagtcccacgcaagtcaaaaaaggtttctccacccaggcaatctaccgtacaccgtgtcatcaccacggggtgggaccaagaaaggactacagagttggggtgtcccttgggggtacaacgagttacccacatagtcccatcagtacaactaatggtagcaaatgcctcccctcgggacgatgcacaagaataattaaatcgtccacccgtccgacaactgtaacaacccattaagcgccccggggaaatagtacatttggatggggtatgttggacggctaagtgggtcccaatcatttttgcaattaaattaattggagagtacgggaatgaactccagacacggccattgccgtagccaattcgtacttggccaaatgaatttgggagtttaaatagggggtcgccaaccactctctccaagtcttggtcagcgcggcaccggcatttcacaactgccgattcgtgaaaagtgtaacacgatggacacacttcttcagagagggtgcaatttaaatgttgggcagctactctggatggacattcgaggtacgtcttccacttcgggaccagtgccacgtgagtcccgttggaaatgaaagttccccccaggattgggagcgggggaagcccactaggggaaaaagttattgacagatttgcggtagaccaatgatgagtgactcccgggtaaagatttatctcctcagtgtaagatgcccccttgatttccaaattgagcttaagtcttaagtgaaattgccaggatgggcacgtaaataattcataagcgaagggagaagcgggttgagcaaaaattcggtaaaaaagacacgcataggcgggtgacaagcagcctcttctgacaaaacctgatgcttcccgacaaaaattgaggcccgggaagtcttcccttaattcgggaaccgattggtgtggctctaaatctgagcagaatgaacccgagcaagacccagctgctggacaacggagaatagaggctatttgaatattgtaggaacgtgtccaacgccgactttcccttttacattggagagataatcccttta

SEQ ID NO: 14913 - DNA, 2502 bp, Heterodera glycines
tccccgtaattgggttttttgagttttaattccctggcccccccccatttcctttccccaatcgtccaaaatacagtcagtcccccccctttttcttatcccgcccccgggagaggtacgacttggcgctcctgggttgcgacgtaaacccatccttttggacagcgttttaaaggcgctgacgcggacaaaagcatctaactgtgtgataatttcggaaagtctcgactcatatttttcaggtttttgtaccattttgcagtaaaatgaatggacagtggtcataataatcagcgacattacaacttccgccaccgtgtgacagtgaattatatggagcaggagtcaggttcatcacaatggtctcaaaatatgggaaatataagaaattatggacaataattaaatgaaaacactcatctgattgtgcaaccaaacaatgcgcacggaaatttttcccagcccctcgaaaatcagcctttctcggcccccgcacaaaatcagtcaattcctcaaaactcgaaccatggacagcagctcgcaatccctctgaaccctgtcataaattttttcgatggaaacgagcaaaacattggaaacccccgtttggagtcaactgcagtttcacctcatatttcatatcaagaaaggggcaactattttgtgaactttcccgagggtatgcaaaatcgggatcttgttaagaaccgattcaataataaccgccaaaatcccgctcaaaattttcaaaatcctcccgtgtttgtgaattcgcagctgaaccggaacaatgaacggccaaatcggtttcaaaatccaaacgagtttccggttcgggactcaaatcgccgatccatccacaattcgccaattaccaaaacgagcaatactcggctcgagatgctcggatgtatcggcaagagacaaattcgaattttgtgaccccattaaacctgcaattctccgaaaatgaaaaccgacacaattatacccaatttcaaaatccaagaaatttccaacaaaatcccgaaatggtttatgcacagataaatccccccgtttaccaaactcaagcatttccagcccaaaccattcccatcccggacattattatggaattacacaaagtcacactttccaaccaatacgcaaacacaatgagagaaatccctacccttaatggaacggaagggagtgacaaagtccaggatttttttttaactgttgaaatgtgtgttggagagtggcgccacgaaaagaagttggaaatgttgaaaactaagctgaaaggaaaagctctgagggcacttaacatggcactgagtaaatttggaaataccgcgccattcgagacgataaaaacggaaataatgtcgacattgagggagacggattacaaggaagcaagtgcttttcaggaacttacacagacggggaaacgaaaggagggcgaaagtgttatgaaatttggtgaaagaattcaaaggctggtaaattgtgcccatgttggtttaagtgaggcacaaagagacgaaatttccaaaaaaattttcgttcttaatatcaatgacacgaacatggcaaaatttttggagtgtcagtcaaaaccgtcccaaacatacgacgaacttttaatggtcgctaatcgtcttagtttggttgaagagaagactgaggaacgttcggttcaaatccgaaattcacaaaatccattccacttgccaaacgcgaaccaaatctcataccaaaacgaacaaagtcgttattttggtcaaagaaatttccaaaattcttaccagcctcagccaaaatattttggaagaaccgggcggccaccgagtcattcttacggaaacaattttggaggacgaaattttccagtgaatcagaattttaaccggtaccctaacaatcagcaaaacagaaattttggtagcgaaagggcacagagtaacaaaccgagacaagaagtaaattttcaaggccaagggtctcaaaattccataatacctgcaagtaatgcaaatgccgtcccgttaaacgcccaaaaacaaaattttcgtcccggatatggttcgaacgcaattattgttacagaaaatactgaggacaattcgccagtgatttctgtcggtcattttggacaaaaagagccaaccgattatgaaaaattctttaacgctctttccactcattcttccgaatttccgccaaaaaacccggctcttgttaaaacgtcaaaatgtttggatatcacactgagtgttgtggacaaaaaggccaaaggcttaatggatttgggtgctgagactgatatagtaaaccctgaatttttgtaccgaatttcagtggaaaaaggaattaatctcgcagattggggtttctgtcccaattctggccttaccaaattacctttttccgtcgcatcatttactggtggaaaaattgcatttattggagtgattaatgtgccaattagaatgggagaggtcgaaacaacaa

SEQ ID NO: 14914 - DNA, 4005 bp, Heterodera glycines
  misc_feature (3085)..(3085): n is a, c, g, or t
  misc_feature (3181)..(3181): n is a, c, g, or t
ctggttccggtttccgggaccggaagaaaccggttccggcccgggccgatctctattattgttagaccgaatgaaataaaatacgaccatcacttctcatctgagttgacaaaccacgagaccaaagccaaaaatcacatcaaaatgtcggcacttttcgccgatagaaaatttcgaattgcgacacactgcgaagcgcactcactgtcaatgtcgaattttaaaatgccggaaaacgttcaaatacgagcaggagaattggccataaggcacacaaatttcaaaatatagtagtctatttattgaattcactcaatcatttgcatcatactgtattttctcaatctttttacagtatctcttccatttgtctttactaaaatgcatttcgcacaaaatacttaattatttgataattataatcataatttattgaaataaaatttatttttgctcttttttttatcgcatcacaaaaaactcattacaaatattcatttctgatagtccataagcagcaccgccattgatggaaccaaaagtgattcatccccagaggctattatcgctattagtgatcagttcgcctcccaccccttggctaattgttgttttgaattttgcttggctttcacgggagggggggggggtggacaatttttacgcacgcaccgctcatcccgcccattggggacgtgtgggatgtgtgcggtacccgcccatttgccgcgctgcttctgccgcagggaccgcccatttgggcactgtcggccaccgcatttaagcgctgtccgatcagcgaaaaatcagtcagttcacaaatttcataagctcctaaccaaaaagcactaactaataagctggggaaggaaaaaggaaaagccaaataaaaacattttttgaaaatttaatagcgattaaaaaagatttaaataatttttttggaaactatttaaatttctttttttatttcatttttaattagaacacaaaaaatattttttggtttaatatccaatattttgtatttcattgtaacattttaggaagagatttttcctctatttctgatcccaaatcccactccaaagcaacccgtctcactctcaattttgaacatgaacaagtggcttgcacttgtgtaagttaagggagggaggaggcttgaactctggccaaatattaactctctgtccactttcagtctgttgatcgccctgatcagcgcgcaggccagcgctttttcacttggtaattaaaaatttgattaaaaaagttttttttttttgaatttctccaaggctagtagcttttttaaacagagtttcgagtctataaattcttcgctctcgggtatcacttaacacgaatacaccatcatacacaggtgatgcaagcatcattttgccggacggaaaacttggcgacacgatgtgcaattatcaatggtccaaggccaagggcgagatgcttggaccacttgagaatgcaccttttattggccctgcttttgattttgtagtcagcgttggactaccacaaatcccacacagtgataatccggatgataaagacaaagttgccgggtcaatgtgcaaaatagactatggctgtgattggggaaaatgccatccaagcgctggcaaaacggcaagcacttgctgtgcagatggctttgtgttcatctgctgcaaggatgtaagtggagataaataaggacacgagtggataaaagcacctcaaaaattcttcataatttttgtctttagactgtaagcaatcaaaatattattttcaaaattatttcatgtaaattcataaattaggacgacgacatcacagagaattgtcaaagaatattttcatggattttgaaagtaataaaaattttaatgtgttcattcaaaaatttagcctccggaggtatgtgcaaaaaatggagttggtttggtgggtgaaacttaatataacaatgccaatgttgtcagccggaaccggcacaacttacacaaatggaggagtgcaaaaaagcagccaaagctaagtgtagctgtggatggttcgcttgtgtgcgcaaacgagggaatggtgcaaccccatgctgtgcagaaaacacggaattcacgtgttgtaaaaatgtaaaataaaaaataattaataataataataatatgagagattttcaacataaaagggaaattataaaatccataaattcagaattcttttttgaattttgttaattgtaattttttagatcactattgaatcattggtttggattattttatttaaaatttttctgcgatttttgcaaatatagccgcaaatcgtgcacgacaacgagtgcaatatggcaaacaaaagttgcaaaccatgcggttggggcgagtgcgtcccggcgcaaggccgttcgccaagcccatgttgcgcccagcactacgcttttaaatgttgcgaaaaagtaaagtggatcttgaatctgtacttttcttgtgcccgggccctcataaaatgttatggccctttctccagcaatcaattagatttttcaagagtaattttgcggtgctataaagaaatgccattggagattaaaaggctgagattttgtctatgatttttatcatattcgaaaaagatttcttttaaatctaagagccataggaaatggttaagcaaaattacctaagcagtgtttggccaaaatgttaatcagctgtcaatttgaaatttagtctttcaatttctcatctacttatatatttgtcaattgtgcaaagaaagtttcgtaaaaattatttttttagcctccaccggtacgtcgacagtatgacacatttggcatatatgtactgtaatcacatttaataaaggtgaaaccagcgcaactcatccaaatcgatgactgcgaaaaagccgcgaaaagttgcgactgtggctggtacagctgcatcccgcacccgggccaaccgtcaacgccatgttgtgctgagcactacaatttcacgtgctgcgtgaaggtaaggcgacagtctttggcatttgtatagtgtttcagctgaacaatggtcactcagaaagnacacttaaaattggaattggacaagggcatttgattatagactcagacagttggccacattaatcgctacaatttttcaacacaaaaaatgaatgnaaggagtttagattaattaatccatcagcatttgtggattaattaaacaatattttaaatatccatttaaaatttatttttccattttaaattattaacatttttaaatttatttaattgaatttgtactacggtaacatagataagatgaggaagaccacgtacctatgagagtagtaatttgctataagctttaggttgtgaacctgacgagttttggtgttatttgtttttaaattttaattatttttaggctccaccggtatgtcgacagtttcacagtgtgccaattactgtaatcgcacttttgtcggtttattgaagatcaaacccccacaaattattcaaatggatgagtgcgaaaaggcagcgaaaaattgtagctgtggttggtacaattgcatcccgaaaccaggccaatcgtcaactccatgctgtgctgagcattatcagtttagctgctgtaccgatgtaagacaaaaaatttaaaatagtgagaatccaagaaatgggaaatgaattgattgaaacaaatcatttgggattaaaatgcaatttatctggggatcaagttttttaaaacgggatttggaccatgatgcttggcatatcaagagagaatcatggcaactgttgaaatgcaataccattgagacataccttacccctccatagcttttttcgaatttgcagattttgtgatataaattttgtaaaatgaacattcgaaaatttagttaatcatattaataattattattgctttcatgaaaacggcaatgttttaaaaatttaattaaaatcttctttttagttgccgacta

SEQ ID NO: 14915 - DNA, 1469 bp, Heterodera glycines
aacgcgtacactttgtcaacatttaccgttattttcctctaaaatgctcccccaccccctcatcctaattggaacaccatttttcgattcgtctcactgcattttcctacccaaattgttcaaccatttatccaacaaatttccactccccaatcgctcatttagctcaccattttcccagttcttctgcttgtcgaatgccccgttcagacagtggcgagtcctccttctccaactcggataggtctttcccccatgttttgttaatattgtcctctctttccgcgtgacgaattatccaaagtgtttggcgcacaacgggacgcttatctaaggaaaagtggcacggacttaattaattcgatcgattttttccatttttaccgatcgtccaaaatttgtcagcctcgctctcttcgtttgatgtcaatttcaattcgacattggccaattcggctttgattttgtttaaaatgtccaaatgttctttcatggaaaagtcaatgtcatattctttttcctggtgaaaacccgaaaattgtgaaaacaattaaaattcactcacgggttttttcttgttgttgactttttctataaaataattaaatttctcttccaattgaactttgatgctctccaaatccgctttgttagcttccatttttttttcatattttgtcatgtcaaacactttccgctgcttctccaaaattcgtattacctttgagtttttgaattaacttttttagagattttaataaattatttttcacctttcccattccaaatcttattatgttcaatatagggtaagaaactctaactaataactactgggtcctaagtgttggcttatcaaataagacaattacaccaagatgatcagcagatcactccttcagcagaatgatcttttcataaaaatgtaaataattttaaattcattttctatccttcgctccgcttttatcattaacattgttgaggaggagatcacggaaggaggctaatgtgtgtgtgcaaaatgccttctcttcttctgtcgctcgttgtcctctttcatcaagttgaggcgtggctgaaaattgacaaatgatcccaaatgtctgcttcatccgttccccttataattaattatgcccggacagacagtaaacgattttcgattaattggcgttttcaatggaattgctattcgaatttaaacatagaaagctctaaaaatgaccgggcacggcctccacagacagtcgaccaaaagtgatgacagaccttccattcggaagcgtagccattgccagcccaaatccttgaacttgggcaaataaagcgccaattttgccataaagaccctcacatttggagtcaagaagacctcgaattctggttgtcaacattgccaatttgggtataaatcccgtcccttaataaactaattcgtgtataaaggaactttgcataaatgatga

SEQ ID NO: 14916 - DNA, 1280 bp, Heterodera glycines
  misc_feature (103)..(103): n is a, c, g, or t
gcggcttttatgttgattcgaaaatcgatagaaccccgaatttgggaaaggcaacacaaagaaagtaggaggaaatagtgtaaacgagagaaaaaggcaaatntaacaaagcaaaatgacatcgtttgaatgtaaaatgcgcgggctgtaagcatagtaaaatatcggcataattcccctaaatgggccatggcaataaaattggaaggattccaaggggtaaagcacacgaagggctatggtgagtggggtgggcatatccaaaaagccgaacagcttgtaaatccttgattgagcattttgtgaatcggccaaattctaatgctgctgctcatccccaattgttaaatgcacttttccattttgccataaatggaaacaaaaaaatggacaaaaaatgtgaattgatccttttagtaaatcattgacatttcaatgcttgtaaatataataattttttctaatgcgatagataatatttatatttacatattttagtcgtagagctctgattttatggcgaaaaaacggagtctctaaaaaagttttttgaaaattaattgttatattaaaaagaagattttttaattttttaaaacttattaataagttttctcaatttttaattttaaaaattatcttatgtgtggaataatactaagttcaaatgaattaaaaaacacattaagacgccataaaaacacgagaaaacgagacgagatgagacagaatttctaggattttttcaataaaaacaaataaaaaatttaatattaattaagttttgttttcaactaaaatttagtgaaataaaaattgtttctttaattattagggatgtcaaaatatgtacaaaaagtggtccaaatatgtacataaatatgtaaaaaaaaatcccgaaatatgtacaaaaaaccccaaatatgtaaataaaatttttttaaaaggttattttttggaaaaaaatcttcctaaagtttagacaggcataaaatgacataaatatgacccaaatttgcttagaatcaccttttaacattttaaaaattatttttttttgggtacattttaaaaaaaagttttttaaattttttcacaataaatttctaaaaattttcaaaaattctcaaaatatgtataataaatgaaaaaaatttgcataaattttggatttttttttgaggatttccaaaaatttccgtaaaaaaccctcaaaaaatgtaaaaaaaatgaaaaaatataagaaaaagtccaaaatatgtagcaattatggataaaaa

SEQ ID NO: 14917 - DNA, 1191 bp, Heterodera glycines
  misc_feature (1126)..(1126): n is a, c, g, or t
cattttatattctctgtagaatatattttgtattcgttataaatttatagctgcatacatttacctgcaaaatataaaaaagcatgaatgcttgatttttgtcgaataaaaaattaatatatacttaacattttatattctatgtagaatatattttgtattcgttataaatttatagctgcatacatttacctgcaaaatataaaaaagcatgaatgcttgatttttgtcgaataaaaaattaatatatacttaacattttatattctctgtagaatatattttgtattcgttgtaaatttatagctgcatacatttacctgcaatcagttgcctgatattgatgctatgtccgacgataacgcggacgaaaacgagtcgattgcatcgtctgacgccgagtcggttgcatctacacaatcgcataacagtcgccttgacaaatcccataaatttgtctcgctgcgagatttttgcaaatattatctcgcgataagggacgaaaatgctgaattgaaataccaccacattttgtcatgtggtgtaggacttgcccagcgctggatcttggaccaggcggccaaaattgattggcaaatagccacttttttgcgtcgtcctgatatggatctgcgcatcagcaccccgaaaaatttgctgcagtacttggtgaaccagtacaataggcagattgcacgccaaaaccccaatgcacaacggaaaaccgttgatgacattggcagcgttgttcgcctttctgaaaataatgttaattctcttcagtattggaaaaaaatgtatgaagattgcaattgcatttttgcgcgttatcacaacccgaaaaaggcacgtctcttcataacattcacgaacaaccgtgagtggccagaattcgaaaatatctacaaaaacggccaggttttcactgaccgttttgacatgtggatgcgtgtgtggagcagcaaaattgctgtctttcaccaggaactctatgaaaagagttttttcgggacaattcttggctcaggagagtccatggagtttcaaggacgtggaggtccacacgcacacattgtcgctcagactgacctggacgctgttcccgaagtgatccaagaatatatcntgggtcacattccatcattgccccgagatggcgatgattcccccattgcacatatgcatcgcgaa

SEQ ID NO: 14918 - DNA, 2339 bp, Heterodera glycines
tgtttggccaaattgtcaagcttttgcgcaaaccctcatacaactacagagtgcttgctacggcatccaccggctgtgcagctattttgctgccatatgggaaaacggcccattccaccttccgtctgggcagagacgtgtctctcgaaaaacttccaagcattccgctggagagtttcttcgccagacggattcgtgaagcacaactgatcattattgatgagattacgatgctaaacaacacggtgattgaggtcatcaaccgagtgtgcaaagagatggcaatctatcagcacaaagacctcctcttcgggggtaaaacggtcatattcagtggcgactttaaacagtcgctgccggttgtgcctcatgagggtttaactgcgcaagttacttcttgcttccaaacgtccccgttgtttggtcagttcacaaatatgatattgacaatcaaccagagattgggacaaggacaacaagattatttggaaatgtgccgccaaatcggcctcggaaaaaccggagaattcttctggattcctccgcaattcctcgtcaagagcagggaagagctaatagactttgtctatccaaacttccaacaacttctcggtaatgacaaggagctgctcaaccgattgatcctcgcgccgcacatcgacacgtgcgacgagataaacgctattatgatggcgaatgtgccaggtcaagaacgcgaatatttgtctacggacaaacctcttgacgagcgccctctggatatcgatgaaatcgagtctgaagtggctgcgctgaacagacgcaccgactcgggaatgcccccgcacagtctccaacttaaagttggaagcgtagttgttctccttatcaacaaaagtgatagggaaggactgataaatggcactcgcatcgttattgaagagcttggtgacgatcgcttggtcggtcgcgtgatcaacagcaacgctgttggaagccaagtaaggttattccttgaacgaacccgtaatgtttacgaggacaaaacgccaggcggcgtgaaatacgagcgtttgcagtttccaataaagcctgcattcgccatgaccattctaaaaggtcaagcaaacaatcagcacggttggaatagatcttgaaagggatgtattttcccacggtcaattatataccgctttttcacgggccacggacggcaataatgtccgggtatatgcgcccaggcgggaaacagacaaccaaggctgagccaaagtgctgaacattgttgcaacaaatatgcttaagttgcaataaggcaattatgttaggtccagtgtgtgcggtactttgtgataccgctccattctcatttgcacttaaatataaattcttatgtataagtgccgccacctggactaagggagggaagagggatgacgtgcgagttagggcacttccggtttccattgcactgaaaaatgcaatgtgtcagctcatcacatgagtgaaaccaagtgcatgtcggttgacactaagaccctaacaccggcctaggtaacgaagctcgaaaagcgcgcagcgctttaaagcaccatccccatgtaagcacgccccgctagtttcatttttatatcgaaaaccgaatgagtcataattttcaagtaattgattgaattttaagctaattttaatttaaaaaattatattaagttctgaaaaattgactggaacacataaaatcgcaaaatatgcgcataaaatatgcaccaaaaatggcaaaatatgcacataaaaagtgaaaaatatgcacataaatttttccaaattgagggcaaatttcttcaagtttgttaaatttaagcataaaaatcccgaaaatatctaaaaatagtataaatgattattttagaaccaaaaaagtaatatttatttattttgaagaaaattaagcaaaaaatggagaattttctattttctgactatttttggcataaagtttcaattttttttaaagttacttttttatcagaaaatatacccaaaaatctgatatttttgaaaaattttcggtcattagagcccaaatggccgctttaatagagggggccgttttaatagaggatttattgaaaaaatgccgaaatatgcacataaaatatgaatgaaatgccgaaatatgcacaaatatgcaaatatgcacataaatcgcgaaatatgcacaaatatgcaaaatatgcatatggaaatccatcctagaagcttcaaaccaggctaaaaacatgttttttttcatgcgtttcaggcctcccacagtccaggaaaaaaatatgcatgtgcatatgattctactccctactgat

SEQ ID NO: 14919 - DNA, 3904 bp, Heterodera glycines
tcagcgggagctacaataacaaaatgaacacagtatatcctttttcgaatacagtacacaatattgttgtatttgcgcgacacacacctggagtaattaattaattaaatgttaattgaggaacaaaaataattgatgaatataatgactattaaatgaccaatcaattaatccaatcaataaaatcacacctttaattacacaatacacacagaagagatgatgcacataaatcattaattaattacttataatttatataattagtcaaattaaccaataattttctaccagtgttggatgaggcggaagagaaacaaaataatgataaaagaaattaatcaatcgataaaacaatcaataaatgataaaaaaaaatggtgttcggttgattttttgcaggtagagttgtgtgtttaaaattaaaaataataaataaataaataaggtattttgttttaaatctaaaaatggaggaataaaaaacacacacagcacagagagatagaagagagaggtcaccgaatatgttgttgttgtgtcggaaggaagaagaaaaaaaaatgggtttttcaaaatatatatttgtttgtacattatgggtttgtgcggtggcaaaatttgaaatttccgagttttttaaacctcgcttggtgccatgaaattttaataatttccgacctttggcagaattttcaggcttttttaaatatatcaatcacctcaaaacgtttaaaatgccataacccatctgtttacagtgcttgtgccccataaattttggaccaggccagaagttgcaacaaatttttttctaacgcttaggggtataaaaatttttggaaaatttctcagttttcaatgaaattgcgcacacgccagccaaacccataagaaaaaggggagaacggaaaaaaatatttggacacaaaaatgaaatggatgcaaaaatttggccaaaagaagaaggagaaacggacgaacaaaaaatgaaccctcgccccataataaagaacccgaagacaaatccactcaaaattcaaacaaaaacaaaaaaaaacagaaattcgttgcggtataaataaaaatttgcgtcatttctcgtctcaagactgaactggctgtggcaccattattattttaatttccccgtgtcggccccacaggggccgtcgcctccgccgcgctgctctgcagttgaagttacagcgtttgttgttgatccatttcctcatcctcatgctgctcctgcttgagcgagaccactgttgccgtcgccggcggcatggctttttgatctttttcgctgcttcttggcccttttactgtgccaatggcgccgtcctccgccgccacttccctttgatctgcgtcgccgccgtctttgccctcctccaacttcatttgttgttgattctgctgctgcttttcctccttttccttcttctcgtccgccgcggtcggaaatatttcggcggccagcttaatgtgcttaagcattttctcgtcctcggtgggcacccgggcgcggaacagctccttcgccttctcggtgacctgtagaagagataattttgaaaaaaaattttattttaaagatcgaaaatttgatttttctaaaaatttatggacaaaatttttgaatttttataatgtttttgaagcgaaaaatttgtcgcgaaaatttcggctttgtaattgaattttataaaagtctctgaagcttgggttgttctaattttcaagaaaatgcttgaaaatcagcaattttccacgtcatatttctaaatgcagtttgatttgagaaaatttcattctatttcatagttcggttttttttgagagatttcttttaaaaaaatattttagaaaacttaaaattgtgccaccctgtttttcccccctctcaaactcacaatgttcagcataacaaatgcttttgggacagtttcgtagatttggcgtgcctcctccggcccgtagatggactccaaatacctgtataagtattattacaaaaaattctaagacatccactctaacaccctctctttgtgtctaacgtcttccctacacactctctcgttcatccggcatttttgtttttctctctgctcacacattatgcacacagttatcgatctctctcccaccttttgagcagttccgtgtaggtggcgtgatgtttgaccgcagccgatttgtcctccgcgctcagatcagtgttaatgtgatggttgaacatcatgatcaggatcaccaaattgttggccatcttaaggcaagaaaaagtgatcaggaaacagggatgtgatcagagagtcagcagcactaccatcatatgctaaatacccattctgatcagaaaaatttttggcgaaaaaattgtattttcatcaacagggcaaagttttaaaaattaggtagtccaaaaaaaattatcgccaaagagcaaaaaaaaaaagtctccgggttcccgatctgcgatttttttttctctggttacggaactgctgccctgaatagtatgatcaaagccgaacgtataaaaaaaattcgtctgatcaaaaaaaaagacaaagtcgcgttcaacatcgtaattcttttggcactgcttgttgattttttgatggatttaatgcagatttgcaaaaaaaaattttgaggtacgaaacccaggcaagagcctgtgggttctttttcattgctaccaaccatttttaagatccaaaacacgccattcaatttgcgaaacatttttttccgaaaatcccttaagagaaaattcaagtttttttttttgaaatttttattttgccaaaatagtgtgctctaaatagtctgattactgctgatcaagatcatcgattgctgactgacctggtccttcatcagtgtttgatgcaactgtttgtagaagccggtcacgcgccgggtttgcatgctgccgttcagcatctggtcaagaatgttgaagttgagccgaatttcgcagttgctgatcaacggtcgtttccaacattcgttttccacgtcaacgctcacggcgctgaaaaatgggcaaaaatctaataaaattttaaaagctttatgtgtaagaaactaatgacacccaaacgaattatagggcgcgccaaaattgattggcgcccaaatggttggcgccccgaacggaacggcgaccaaactgattggcgctccaattggatggcgcccaaactaattggcgcccaaatgatttagaacgctccaaaataaaatggcgtccaaataagtttgggtgcgccgaaacggttggcgccccaaatttgacagcgtccaaactgatcggtgccaacctaactgtggcgccccaaattttacggcgcccaaactggttggcgcgaaaatgagttaaggcgcgccaagtaattggcgtcccaaacgggacggcgtccaagccctaaggacaaaagtattggcgcccaaaattggtaggcgcgcaaaagaactcggcgaccaaaatccttggcgcgtccagacggatcggcgcccaaaaatgggcgccaaactaaaataataatgacccgcgtcactcaccctctgacggtgagcatgtcaatgatagcgtctttcattagtgcaaaacggccgctctggcttagttcattgaaggcgggcaacttcttgaccaccttgaccatacggcgcagcattgtttctggaagttgcgtcaatgatttttcgtaaccaatcgattgtcaagcaattaatcccatcaataatcgatcaatcaataaagtaatcattgaaatgtcaatcaatagacgcggtcaatggcaattcgtacaaaggcacacagtggcaactcgtacaaagagcactcgtattttacaaaataaagccaaagcttatgccctcgtaa

SEQ ID NO: 14920 - DNA, 636 bp, Heterodera glycines
gtctcttctctcctccatcccatcatgcgagcgaatggagaatgcggcgtttatgttgtggaatatgcaagagcaattttggatgtaaatatttttaaatgtgaaaaaaattttatggttctcattttaaggcactatctcggaattggaacgctgaatttgattttagtcatataaactctgataacattagctcaataagacggcattggatgaaaatcattcgggaacgaactgcacttgagaaatgatacaatagacacgaacattcatgttaaattattttcgatacatacctatgtaatttggtactagttaagtttgtatcccccttttgggtcaaatttttttcaaatttttttttcttttttattgtcgcaattgctttttagattaatggaaaagcttaaaaatttcactcttgccgaacgagatttgtcagtcacagatcacttttttccacatacatttctgattttttgtggcgaaagcagtttggaggaccggacattttttataatttgtggacccaaatcgcggaattgtacccaataagcacataaatctccgttgatatgtcatttaaatcagttgcgacgacaaaaacgaaaaaaaaaatattgcaacaatgtgacc

SEQ ID NO: 14921 - DNA, 1846 bp, Heterodera glycines
  misc_feature (1355)..(1355): n is a, c, g, or t
actttgcgctttcgaatgatacccaaaagataggatttgttcgaacatgaacaaagttattgtgtaaaaacccgggattgtcaatcgattggactcataaaagtcaaattggactcataaaagtcgattggactcatataagtcgaatggactcataaagtgcattagagccaaaatatttcccagcctaatgggtttgaaccataaccacaaaaacacaaatttaaccaacgggaccacttttcgctttaacattggaaactgactggcaatggggagggggcagagaagtggcgatagagtgtaggaaaaaaggagaacagattgttagaggaccgacgacagagatcgtttgcctccctccgttaatgggtcggtccaatgccaaattattttaaaaccgatttttttttccataattccgtcttccccgccttagggcacaccggacggatgaacgagcagagcagtcgttcccatgccattttcacggtgaccgtcgaatgtgcggagacagtaaaagccgctgacggacgccaactgctcacttagggaaaattgcacttggcggttggtgattggaatttacaattattgctgtaacttttatggaaattccaaaaatttcagcgacattttcaaattggtttcattcccttagggtagtgaacgccaatccaaaataaatgccactggcgaccgactaaaggaggcgtcgaagatcaatttgtccctctcgacgcttggcaatgtgatcagtgcgttggcggacgcgaaagtccgcacattccgtaccggtgtgtggtggtgaagaacggaaacttttttattccttttatagtgaatgggatttgggtggaaaggttctaaaaccctaccatatttttaataaattttgagtttattttcaaaacaggccttgggcaaatgaaaatttcatgctcaaactaacacttaatgtcggcacatttttattacttctaatcgctcggtgcctttgtgtagaaattcatagaaaaaaattttttctaataatttatgtggaatttaccccgtttttcccgagcttatcccaacccatttagaaggtaaaatttacacacccaattaaaggaaatctgttttttgaattcaaaaaagcttaaaatttttgttaaaaaaatctaaataaaaattctctcatataacatgcaagtgtttccgactaattagaaaggaaaaattagagactcattaagggactgatttgtgcatttaaatcaaaaaatccggcattatttgtaataaattctcaaattttcaaaagaatttcaatgaatttatccagtctttcacccggttaatttcgctgcatntaaaccaagtgattccgattgtgggttgagtcccagtgattgaaatgctggtggattgagtcccgttgattggaatgttggtgggttgagtcccagtgattgaaatgcaggagaattgagtctcggtggttgcgataccgaagaatcaggtgaggttaggtcccagcgattggaatgatggtgagttgagtcccggtgattggaatgccggagaattgagtcccagtgactggaatgtcggagagctgagtcccggtgattggaatgcaggtgtgttgagtcccggtgattgaaatgctggagggttgagtcccagtgattgaaatgcaggagaattgagtctcggtggttgcgataccgaagaatcaggtgaggttaggtcccagcgattggaatgatggtgagttgagtcccggtgattggaatgctggtggattgagtcccgttgattggaatgttggtgggttgagtcccagtgattgaaatgcagg

SEQ ID NO: 14922 - DNA, 3838 bp, Heterodera glycines
  misc_feature (3755)..(3755): n is a, c, g, or t
ttattatatatacctatgtatatatatatatatatatatattttttttttttcttcattttatcatataaaataattttattgggtcagaattttaagcattttttacggcaaatctctgatcattttttcattttgcttttccctataattttatgaagttaaacaattagaggaataaatgaaatatcaaaaaatagaacttataaattagcaactgttcatctatttaattaaggggttaagtgaagaagggaagaaagaagtgattaatggccgaaaaaaggaaagaaaagaatgcattgagaggggataaacggggaaaaaagagcgaatgggagtggaaaagaaagaaatgaaaaacggatggacgacggaatgaacggaggaggggggggggggagaaaagtgaaggggaggagggaaagggagggggaaaggaaaagtgagagggaaaagtgagagagaaaagtgaggggaaagggggagagggaaaggcagagagaaaagggagagaagggggggggagggagcactcggctcattgctggtgagttgggcagctaacatttgcaattattttcccattttaatttaatttttcaacaaaaggtaaaagtgccaatgcctcgtcttctctcttccttcgcctttttcgttttgtcaattatttgttcgattgtcttcttcgaacccatccatggccaggacgtgtgtcgacatcagggcaaagagtaccgaaatggggacgaatgggtgggtcgaattaaaaaataaaccaattaatacataattaattaccaaaaccaaattaataggtattaattgacagattgtttccaactctttcattatgaattgcatcgtccattacaaccgatgggaaacaaaggttatttggccatgagacggcaatatttttcaaaatgccatattagctaaatgtttaaaaggtgtgaatacgggggaaggggtgacaagattcatgaagaaagggcgaatttgacttggagctcagtggaagagctgcccatggactttgtggagcgtgggatcggttcccacccgatgcctaacattttctcttcctattaagtcaaatatcactcattagcaatgtccaacaattgctctttctgccagatcatcgcctgtctgtcaatgttaggcgagagaatccccgtaaacggacagatcagtgatcagcacggagtgtggaaatgcgagcagaagccgaacggaagcacacgattggtgcagcagaagcagtgaagggaggaaaagtgatcagtgatgggagagacgaagcaaagcattgattggcagaggaaaagccatcacagcaaatcaaagactgttccacacactttttaataccctgttaattactcactaattaatgtccattttgaccctggaaaaattagtaaatgcattggttgcttcagtaacttggttaattatttttttagcaatttaattaactataaaatttttggattaatttaatactaataattacttaataattgggttgcgtgataaacttgatatcagataatttattctccgttctcaggagtgagacatgacaatctgaatttaataattaattccgttttgtctcaatttgattcaaactacaaattcactaattagctgaaccgattagaggatcaactttttgggaagagaaacggacggagaaagggaggcgaaaatcgaaattatttattgacagtccgtcgatggattcgttgggtgggcggcttcttcttttttttctttgtttttctatttgggcttttcttttttttcgtttgcccttttggccttccaatcggctcttcttttgatcagtgtgaccaaatcaaaagcaaataaatggaaggaaacagtggaaccgaatcggcgccagggctaatttattgcgcgacacatttgggatgacgcgacttagggtggtggtggatcgcccattaactaataattggcgaggcctataaataaaaggacaattccattccgccgtgttcattatccattaaaaacattcaattaattcttttttgccatttctttagtacatattaattcgattcgttcctaacttattttaaattccgtttgattccgtttttaattcccttccctccggcagttctttctgttgcaatttgtccaaaatgagccctcttccgctgctgctgcttctcatttccccgcttttcttctgtccttccgttttttctgatgacattctccgctttgaccccgcggcaccgccggccaaaatgccctcaaaatcgtcactaattaacttgtctaaaaaggaccaagttacacttgacgaaatactcattagtctcagacaaaaatcgccaattgagcaaacgcacgacatgaaagcattcgcacaactgtcgaaggcggacttatgaaagtgagcggtgatgggaaaaaggctaaacgaaacgcaaggcaattaatttcagttgaaaatcgacgccattttggaggagtatgccaaggcggtggagaagttcaagttggaaatggcacccaaattggaggccatgagtttgaaggaggcgcggtcgtgcggtgatcatgtggtgctgatcatcaccgacccgaaactgagcccagcggagaaagtggcgagagtgaacgacgcggtgagaaaaaggaccaattaaaaaggcaatccaaactgaaaattaattgatattccattaaaaggttggccgactgtcggaggacgcccaaaaggagctgaaagcgatcaatttggcagacgcagggcaaatcgtccaaaaggggggcccttttctgaacggacctgccttttggccatgaaagaacgaacgaacgaatggaagaaaagtgccgacaaattgtcacatcacaccccacccatttaagtgttttcatttcctaattagttccataaatgttaaagattttttatgttcaaaaataaataataaaataataattaacgaatatttaaagatttttgcaatcatttattgcaatctttcctcaattcgtttcatttcgtttggcatttgctccgttctcctaaaaactaaaattaaatatgcaaattagttcaaaatctttaaatcaattaaacatttaattatgaattgaaatcactcgtcggcttttcttcgctattggcttccatgcatcgaaaaatgcgccgaaatttgtcaacaaattgggcaattggcgcccgttgcttcggttttcggggtaaaactaaaaacaataaaagctgaccagaagtgaacaaaatgccaaaggtgtgcggcacctgcaaaaaaagcagaaatttttaaaatattattattattatttggtatatttttaaaaatttttcccaccatcaaactcaaatcgttgatcagaatgccaaaaaggcaccattcaatggcgatgagaaaattggccgcacaaaggggcaaagggagcatcgaagtgttccgatcccgaagcagcgatttctggggggaatttaattgcgaatgaacgattgaaggaaggaccagcattgaaagcggggcggcataagaggcgacatttaggcaagcacaaacaatgccaaggggactggtgcgcaaaaagggagtgaccagggaacagccgataaactggagcaagacgaacagaaagacgatcagaaggaagacgcagagaatttggaaactgatcagacactaaaggaaagggaagactgatcagacactnaaggaaagggaagactgatcagacactaaaggaaagagacaaataagaaccgataagaggactgatcacaaattgattgacta

SEQ ID NO: 14923 - DNA, 2814 bp, Heterodera glycines
  misc_feature (123)..(123): n is a, c, g, or t
cagcagttccatcgccgcgacaacacctcgcgatcgcagtggttccgctacatgcttcacatcagaggcccgcacgccaactggcgagatggacactggctgtgggactggcgcactctggcncagctctacaccatcacgtttaacaaccgaatggaggcccaaaaagtccagtacatgaagcagctgcagggaagacgacgtcttgtccttccaggctcaatcattaactggataagcgctctcagggacaacaaaggtagggcaaacatttcgagtttaataatcaaatagctgctatttagggtacaagggcgacattggccgagtctacatgaccgacgagcacttccgcgggtcccggcagtactaccagcgcgagtacgccaactgcatgaccatctgcagagaagttggaaagccggaccttttgatcactctgacgatggatcccgaatgtgatgaactggaagagatgctgccaactgacccagatggccaccgccagcagtggtacgaccgtccggatgtgatttgtcgtctctttgtcgacaaattcaaagagctgcgtcatgaccttaccgtcaaggaggtcatggggcccgtccgtggctggttctactcattggagcatcagaaacggtaaactgagtcctttggttttgaatatttatgagtcatttttagtggcctcccgcatgtccatttcgcactgattttggactgggacagaatccgaagtggcggcaccatcaacacgccagaagactatatcgagcagtacatctctgcagaaatcccggacaacccctcgggccgctcatccgaagtgttgctcaagcgagagctttacaaaacactgaggatgaagcacatccacacgtgctcagctcgaagatgtttggttgacggaaagtgcctcaaacgttttccggttagtcaatattttacttcacttttatggttgtcaagcatatcaatttagaagccattctcgtacgacaatgtctacaacgaacacgcttacccgcggttacaagaaccttgtccaaaattgtgcaaggactggcgaggttcgctgtcgcaaagaagactgcaagccatcgaatgcgctgccggatggacttcttcattctgaacgcatcatcgatggtcttcatccagaggtcttcgtcagtgaggagaccacgtgctcccgcagcttcaacaaaggtagggaacacgttgccgttgacggtgcgcaatgactcccatccctttgggtcaagcacaaccaacagaagcagtcgaattgcctgtaatagaaaaaatgatcaaattggtaatgtgcttggcgttctaccccccccccccgaaaactgggctttttggaaaaaaaatatttttttgaaacctccccggcataattttttttttatttaaataacgcgtaagggaacataaaataatgccaccaattccatttaaaaaaaacccgaaaattcccccctaagaattggctttttgagttggccccccccccccccccgaaacgaaggtcctggctacgcccttgtttcacaagccatttttgatgttaagctttttttgccttaatgcgaggaaaaagtgaattgaaaatgcacgaagaagtcgccgatcaatggaggaaagaactttcgaacatcggatttgacgaatctaagcagaaaattactgcggaggacttccaactgtaacccttaaagattttgatttcaaactctatttttcaaaagcccactgatcaaaaattggtgggggagtggatagtaaccgtcaaatgttctattaatagcggttttagcaatgcttatataggaaaggttcaaaatgcctttgtcttgtgaaactcttattcatatggtctgtttttaggttcgtctgttctgctctgaaccctgtttgctcaattgtcggaagtgtcgttgcgcaagaggcaatcaaggtaaagaggataattcgttttgtctcatcaattccgtcattttcagtctttgtcgcagaacgacgaaccgttgaaaaatgcgttcttttattcagcacttgaaagttgcggaacagttgttgacatggccgtgtgatgtccgtgaaaattttgtttaaaaaattgtttttgtttgctttactaccaccagcaaggaataaaaattggtacaaatttgctatctttcaattttttaaataaatttctaactaagtattttttgtaatttttcacgttatcaaactatttttttttaaggctctgacgaggatttttaaatgttgctattaaatcgtataggtattatttttttgtgaagagattgtaaacaaaacaagcatgaggcatgataaactgtatcaatcaatgttacatgtgtaaagcggaataaaaacaatcttaacccattgccaaggtttaaattggcagccaattgcgaagaattaatccatgatgatcacaaatctttgccgagaaaggacagttaagaagtccaagaagttcatagttaagaggaaagaagaagaaaaggacgagcagaaaggccaaaagaaatgtcataattgtggaagcgacggtaatgaccagcaaacgtttgtcccctcctttggaacagaaagaaaagtacggtattacaactgaaaaggaaccgataagagaactcaaaatgggttgaaggtttgtaaaaaacgataacctaaagccatcagtgagccaaaaataaatccgaataattgagcccaattatctaaaagcaaacatatttccataataatattataaatgaactaaaaaatttaccaatgtat

SEQ ID NO: 14924 - DNA, 3537 bp, Heterodera glycines
  misc_feature (3489)..(3489): n is a, c, g, or t
ttgggaatttgttgattttgttttttctttaataaaaatttgttgacaatgttacatgaaaaggttgttccacaatatacgtcttcatcttcaaaaaacaggatcaaataattgcaaattgagaaaattacatttccattccctcggacaattcatcgatgtccatgtcggacccttccgatttgtcacctccttcctgctcctcctcttccaattcgtcaccatcttcctcatcatcactgaattttgtaaaaaaaaattaattacggggagttcgttaaaacttaattttttcaggatggaccaaatgacaccatcttacacataccacacaaaaatttttgtaaaaatatcggcgagaaataattaaatatactataagttacggtatttcaaattggcggcaccgaaatggtccggccgacgtgactccgaaccggggtgagagagaggtagaccccacccctcccccacgccccgaagacaaagttctgacaagccattgatttcattagcacctaaccccaaatatctatccccccccccccaatttcacggctatcaatgatagcaaggaagcaaacaagttgatttttttaacttttggtccatccatcaccaattgttccttcctcttatataaattaatgtgacttgatcacctttcatcgtccatcacatcgcttaaaatacaggaaaataaattccattggtggtcgaagtgccaattctttgcctccgcttcgtagtgtgcccatttttgttcattgcgtttgattggggaacggacaattagaattcgcgcacccttcacatgaagttccatcgaaaacgacagtcgttctccggtcgcatggttgtcgaaacgatatggagacacttcttcattggacgcgaaatgataaatggagattatgaagtttgagcaaacatctgattccaaaaatgcctaaaaattaaaaaaaaaatttaaaaaagaattaaaatccaaatttttgattaaaaattaaaaaccaaatccgaataatagtttttgcagaaattacgaattgtttaggaaatttggtgtccaaatttctcccctacagttgcaccaccataatcaccacacctcgaccaatcgcataattttcgtgtatatttttgccacttcaacttgtttggcgtcgtatttgagcaccttcgggcactctctatcgcttgataaaagccattgggccagaacgatgccatccgccgacgcacttgtggaaccgtcggccgaaaaatcaggaaaagcggcgccaatcgacacgacataatttgatggacagcgattgacgagaaaagtaggcaaaaaatgacaaattcgcttcaatccatccggcaaaatgagggcataaatatggtcacggattgatggccaaattttttgggcaaaatcgcgaagcactttcttttttattgcttcaatgtacagattgatgggcgacgtggaaaagaggaggcgaaagtgttgaagaagtgtcaacacgttgtcactgaggctgctaaattaggcaagaaagaaagtcggataaattttaaggtattttatcacttactcaacatccacgcttttcacgcggaccaaattgtccggaattggaggagttggaggaattgacaatgggacaagcaaatccacaattcgaacaatgtttggcatttcttgacaaattgaaatctccgccaaaaaccagttttgttcttccatgaactggcgcaaaagttttcgaagaattgtttgagcgatttgttcaaatttggacggcatgttaatacacttgaagatgtcattcaataaactgtccgggagctggtggcttaaacatttagaaaagttaaaaaattaaaaatatatatttatttaccctgctggatttgccatgagagattaagcgaagacgaagacaaacaatagccaaatatgccggaaaaaaggaacctttgtttagactaaaaacaatggcatacgtattaaaaaaaagagaatggaaaatgaatatttggcatttactgaaattgcattgctgctggaaacctaatgagtgtgttcaaaagtgggggcgtcggcctactcaaatcattaattttatgtttccccatcagttcctcagttgagattatcttttgagtactttgcgggtgcattttttggggagcgggaataatttaaattaaaatttataaataaaatatattttaaattaaaattttaattcaattaaaataattttgcaggaaggtcgagccccggactattatcgtagaaacaccgtttttgacttgaagctgttgaaggagcgcgacgtggaagagggtcagccagtgctaattgcattttactctcttcgacactctcgacttgaacccggcccgggatttgctggatcccattggatttgggggataatcccgcgggattacgtccaagaaaaatgttgaatccaaatcccgcagcgggttatgcgtaaattttaaatttccggcttcttttttctactctcggctcgggaaataaaaccaaacgccacagatttggaattcaaactagaaaaatcgggaattgggacccaaaaagaaaattttaatttaaaaaatgtaaaattcaaaaaaaaaaaaattttttacagcaccgcttgaggatggcctaattccgccgggtggtcacgtgccgccggacgagcaaggctgggagagtccggtcgactcattttctccgcaaaggtcgcgacaaaatttttgttgaatttaggcgtactgtatgtttaccgtaccttcaatagtttgagctacttgaatatcttaaactatcaatagctttaagttcttatggcttttgaattaaagctgtttattgaaatattaattaaactgtgtgcctattccgtgagggggattactgtatcggtaccaaaagtatttggtttaaatattcctatggtattccgtttcttccttcctcaattacaattattgtttgattagccccataaaaaaataattttattaattaccgtaatacagcaagtcatggattgaatattatggattactgtctcaaaactcttgaattgtatacctttttacatatttttcttggcacagttccggcgtggacacaggacgacgggacggcgacgatgaagaggaggacatggagaaacggcgctttgaacggctgttacatgaaaaattggacatgccaacgtaaatttttaaaaatatatacgaaggcttttggaatgacatctttttttgcctagcccgaaatttatttcaagaaaaagctatcagaaaacccaaaagaaaaaaaaaatcaattttaatgtttatagaataacgggaccttgatatactgagtgatttaactcattaattttaattgcacgaattaattaattaaagaagtgacaatggcctctatttggctcggacggtcgctcccgtgctaaacaaagcattggnctgaggtgttgttttaaaaataaaattaaataagttttaaatccaaaa

SEQ ID NO: 14925 - DNA, 1245 bp, Heterodera glycines
ttgctaaaacataaaaactaaatatattaattaccgtttgcgaattgataattgaccttcacgttagcaattttcttttgaaaagtaaaatctgaaagtaaaagaattaaaaaaagtaaaattgtttttaaaaacaagtcgtttttcataaataccagaaaaaaattaaaaaataaattttcatagagaagcattttaaaaggaaatttttatataataatagagtattttaagaaaataataaatacgtatttccaatacggaaatgatacacaaaatatcacctgagctgttgtacgaaatcaagataaatttcggaagaaaagttcattattaaataccaacaaaaaataaataaagaaacagctttttattaataaaaaaattgcaattcattttataatttttttaaatatttataatgatcgaaatcggcactcttgcaggaattatagaatctttattatagtttttttttaaatttagcgttagattaataatttttaaattaaaaaatgtcttagctaaatgtttaaaattttggatttaatttattatactaaaatcccataagttgaacagaaaaatttttacgttgcaattgtgtgaaaagtagagaccggacgggatcgggatcccgcgggatttcttcgggatcccgcgggattaaattcgggatcccgacctcgggatccgtcccgagcgattttttaaattcatcgggattgatcgggatcgggatttcatcgggatcccgaaccgggatccctcccgaccattttaccaatcccgcgggatcccgcgggattgaagtcacgataatttttcaaaaaatctccattttttaaattaagatcttgaattttaaattaaaaaatattgtcatctgctaatttttcttaaaaaatctcttaaaaatcccaaaaaattttacaggtctccaaaataccactaaaattttcaaaatttgacgcaaaagttggccattttgtgacttttatttcttcataaaaataattattattttttaatttttaaaacattattgtaaatgttattaggtagttttatggcgcaacgctttctaagaattttgtccaataatcagaataaaaattgttgtatacgcatttttccttcggtgccaatcggacatcaccagacccaagaacccattattttttataaattagttcaaaatatggacagttttttgtataaattctgttaacaaattacatttca

SEQ ID NO: 14926 - DNA, 1629 bp, Heterodera glycines
attaatggcgattgcgcaccgccctccctctcaccctcttgcgcttttgtaacgtataaaatttctcaaaataaggagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtagtagtatatggcgtcaaaagcgcacggttgcgcacgggtgtttaccgcacaaacccgtgcctatgggaggggcgcagccctttgatgttgccgcccggggacattttcccgcacaatcccaagcctataggaggggtgcgtgccaaccgaaccctatgtgaggggttgtttctttgaagtctgccgccttgtagattttatttcctcaaatccgcactggcgatttttttttcactccccctctccgcgccgcgcagcgccgcggaaggtcatcaatcatccacctgtcaccaaagtgacaggtgaaggaaattcaatttttcttttgcaaatttaaatctttttgatcccaaaccttttgggcggttttaatttctcaaatcctgagtttttttatgacggtttctctaatcctgaaattaaaaattcattttttgaaaatgtgtcaaaacagtgcgggttttttttttgcatttcctccccgctcgccccgcgccgcgatgccgccgccgcgaaaaaaaaaatcgataacggaatttggaagaagtgtgaattaattgatattagcagcaaataatatcaattataaattgcacaataaaattgattatttaaaaataaaaatcgaaaatgaataaataaattaaaaaactttttcaaaagtaggtcacctttcaaccaaaattgattgatgggtttttatttctcttccattatttcgaaatctgcacgtgactttttgttccattatttcgcaatctgcacgtgactttttgttcaaattatttcgcaatatctcccctaaattaggtcaactgtcaataaaatgtgattgattggtttcttatttaaatgtctccattatttttagttttctgttccaactatttcgcaatatggcccgtaatttgcaaa

SEQ ID NO: 14927 - DNA, 2123 bp, Heterodera glycines
tccgttgagaagccaacctatggcaaaattaattatttaattaggcaattaattaattaactttcattggtaatttatgaattttgaaaaatctttgttgccgctctcaaaactctcgataattatcccaatgtcctaattgtaagctctttgcctcaacgctgtgccatctccgttcctccttgcgtcttctgaactgtgcctttctctgctccgccggtgttacttttggcggcactgtttccaatggtggcacaattacggtattgctgctgttcccggctacggttgctttgctggttgcggcccgctccaccttttcgccctgccgtttttttgagtccacaacgggaaattcgcgctgagacatttttcgggtcggcgtttcggtcaatgctttgttacacatttgctgaaagattgaataaattgatcaaattcatccagtctcccccccccccaattattttcaatcctcaggcatttttattgacattaattcattagcagtgattaatgtattaattactaattgattgattgatcgctctttgaccttcgattgttgctggatcagcttcgacgtttgcttctgcacttcgtccggctgtgctgcgatgatcgactccaacagctctttgacctcgggccgctcgtcatagaacgggtgggcctttatgcgagcgatcagattgatgctcaccggaccacgctccatttgctcaagcacctgaacgatggctaatctccgaccgttctgatcgggtttagcatgagaattgatccgctgctaatatttttgaaaaaacccaatcccaatttcccgattttcacacatttttagtccgcttatgctctattactaatgtcatggatgaaatgctaatatctcttccaacaatcggttgcctcgcactcgcctggttcatcaacgcgttcagcgagtccgtctccagtcgccagtatcgctgcgggtccatcgctgggccaataatcgtagttgccggggtcggagctgctgttgctgcgctcgtcggcaccgtcgtcgatcccgcggcaacagcagcagccattgtcaccgtttgtggttttggcactgcgcttttttgttccttttgtgccgttggtgttgtgtctattttgacgctaaatgtacaattgaaattgctttttctccatgcttttcctcttccgcccccgaccttttctctgctggtctctgctgttccttctctcttttctccgttgtctcttgccttttcagcgatgtcttccgtttggccggcttctccttttgctgctgcttttcattattttccttctccgctttgtttgcttcttctttttctgcgccttccttttgcttttcctccgcctttttgtcctttgcatttaaatttaaattattttttttattatttccaattttattttcgggcttttccctacttctgttggcattgggctcgtccttttgccgccgctttgcagtcggttttcgagctgtttcagccgttccaatgggtcatggaatgcgtttttctccgtctccgcctccgtcagtttagctggcttaaacattttaattacctaattaaaaatggctttttctaatattttccagcattcaatgattttgcctcctttgcgggtgctttttccctcagcattttttcatctgtgctcatttcctcctccgccttcgacgctcggcgtgccttcggtggtttgatcggtgactgttcgttgtactcctccgcctctttgcgtcgtcgacggaattcctcaattttgcgacgggtcgcctggctcaggtggccaaactccatgaacacgtccgtctcgtcggccaactcttggaccaccataatctcagcacgttcattcagcggcgttgggtcagtgatctgagcgagcagagacaaatttattgtgttttgccagtgatcagagcgatggaagcaaattttgagactttgatcactatatcaaagggatgagagtgagtaattttgtttttttttggacagtgatcgaatgagaagtgagttctcctaatgggtctcattaattaagccaatacggctatttggggcccattgatctttttattgcctcaaaat

SEQ ID NO: 14928 - DNA, 1038 bp, Heterodera glycines
aaaggaaggtttgttgcaagaaaacattcatttgacgaaccaattggtcagccaatggccaatgttttcagtctgataaaacgcgcagaaaatgccgacggccatcggaagaacgtaaaccaaagagaagcagccgatgcggaacatcaacttgctcagtttgtcactggcgtctgtctgctcgaatttgtcggtcacgaaacggtggcctttgatgtacgagcgaatgcgaaggatggaaacgaacccactggcgaaaagcaccaatccgacacataaaagagggaaaataattggcaaattcaaggaaaattgaaaacaatgcaaaaagtaaaaacaaaccaatggcaatgctttgagggaccaacgcgagtcgaaagtaaaactcggggcgaagattgccaagggagcaaatgccggtgaacatatcgccatcaacggcacccatggcgacgagcagaacggagccaatggcaggtaaggaccaggcgaggatgttgaaataggaggagaaaacccaaaatggaagtggacaaattgagaaaatgagagagatagagggagagagagaaagacaaaaagggaaggacagacctggccaaccggcgcttctccccatttgagggtggtgaccagaaaccaggagaagcacagcaccaaccaccaaagagtgccggcgaagttgaaaaagtaatggacgactgccaccgcagaacagagaatattctcattgccctgcgggaaaacgaaagttgaaacaaaaaatggacacaattttggggtagactgacctgagtgaccaactgttgtttggttgcggaggaaacagcgcaggagagactgtcctcctccaccaggccgaccatataagtggcactgaccagcaaatagcaaatggccatgtaaaagatggccttttcggggaattcgaagctaaaccaaaggaaacagagtcattggccaattgaaacgaaggaaaaaccgttcgatgtcaatgagaaatgtgacaattgtgaaggcacagcaaacgcagcacgt

SEQ ID NO: 14929 - DNA, 2085 bp, Heterodera glycines
attcggcatttagataaaacaataactaacatacatatgtacaattattgtattattcagggggaaaactaaggtgggcggtcaaaaacaaatatatacattatatatatcatatatacgtgaactgtttcattcagatttaaaataatgacagagcgggatatgcccgagccaaattcgccacttcctcgcaaaagagtcggcttcaaagagccgcacacggggcttgtgaaaaatgatttcttcgggtattggtacttacaatattggtgagtctaaattgtcaaactcaaatctaccgattttctttaagccttgtgaccggtctttacatgttggagccgtgggagaggaaaatgttcaatgttttcgtcacgggtttcattgccgttttatgcagtgccttttatgccttgtggaatgcgttgattaattaatttaattttttaaaaacgtaaatttatttatactgccaattttatttatttaataaagagtcaaaagcaattttatttggttactttacaagttctcttcaacccctttaaattgaaatagtctgtgttagaatggtcaaattgttttcattctgaaatggaatttacggtcccatattgaatagtgatttaggtattctgattatttatttccaaaatgtttctgaaactttttcacaatgggatattgtagttcagtagtaaaagtcatggaaatctttcaaaatgctcttggacaaacagcacgcgaaacaaattccgatgatttgcagggcgccaagaagggcgctggcacagccaaccaccgtcgcattggtcacaatccaatgctgaactgcctgcacacagcccaccccataaagcagcggttgggccattttggcacatccgtcatgaaaatgcacgcagcacgagtcgggtgcgtagattttccaatcggtggcattatttacgccacagcagtgcaattgtcgctgaatgatttttcaattggttattgaatcagtcggttggtttccctacttggacttggttccaagccacagaaactccctttgagcggttatagcgttccattccctaaaacaaagacgtgaaatgtttgtttgtcatccattgccaatggtcaaaccgtggccccatttacttgggtcaattggcttataagtgcttcattgagtggctcgtgaagagcatagacgagaatggcaatggcagtctcggccagcagcagaagtgcgagcagaacagcgaagctgaccgttaagcagtaattctcgcggatggcgccgcaatagccgacaaaaccgagcaaagtgcacagacagccgatggccaacagaagcacgggggtggcgagccgttcatcgccaagaatgtccaaaaggcccgtgtacttgagttgaagtacgacaccggcgattagaaaggccaagccgagagtctgtagagaaagcgaataaacgaattcggtcggattaatcacccaaaggacgaagttggcgaagaagaggaggtatttgaccaaagtgattccgccctcgaccatctcggaagctgacaaaacgcaactttagaagtctaattgtggctgttgtctttgtcctccttttcccagcccccgtaattcgatgctaattaaagggaattgtcggtcgttgaattgggcggtgcgcttcctccgctttaaccttttttacttttcggtccgtccgaaattcacacgacaacaattcctgtcaactgggcaagggtcctctgggctcttggaggagcattggccctcctcccccaatggacgcctaaaaatggagatgagcgagcgcctccccccccccccccccccatgccgtgcatcgtctgcctcgccccagagggaatatcccaacggaattggcccatagtgcccacaccacccaactccttggtcggcttccgcccttcccatccctaaaacatcaataagcaacttaactaaccaaaccaatgaatgtttcttacaaggcaagtgcctttttctcccaagcattttccattcagaataatgaaaaggaacagatttataagcaatcaaaaaagatgtctgact

SEQ ID NO: 14930 - DNA, 2628 bp, Heterodera glycines
ggggctagcgctcgaattttaaaattcattgaaaagttttcgagcagcagaagcacttgtatctggagcaattggcgcgacaaagtggtgcttccatggcagtgctaatagattcaatgatggataatttaaaaaataaaggtaaattttacaaaaaatatattaaaaaatgtaaaatcataaattaaaaaacagaaaacgctgatttggtcgccccgttgtttccaatcacttttgtcatcttgggtggggaattgcttgttgaacgtgaaaacttagagatcgactacattttcaactttttgagcggctcagtgacagacgacatctaaaagaaatttgttttgagggcactgatggagaaatgaaaagcatccatagagaagagaaaaatttatcattattattgatgtatgccctagtcaaagaaaaaaaattagaagtttatctttgtgattaagtaacgatcattggttctttattttggcgattttccaaatttagcgtaaataaaatgtttgaattttaatttattcattgaaaattgattagcctagcaggcggcaataatttgaaataaaaatttttaaatatatttacaaagatttgcatttacctttacaatggcttatttattttatataataatcaaaaaaccttaatagaccgattgaagctatcgtcctaatggaaaaaaggtgcaaaaaattcgcttaatttccattccgtttccattaatatttgtgaacattttccacccgaaaatttcgcatcaaatgtttaaaaaattttgttgaaaaaattaaataattttagtgtccatctgtccaattgtgaacacataaaattttatcaacataattaaagggtgaattttcctcaaatttctattttccccggaatcattttttaacaaaattggacaaaaaaacacagaagaaaacaattcacaaactcttgtttaaaaaaccatatttttttctattcatttattaaaataaattaaatttgattcgattatatttgaatgtattttccaaattgaatttgctgagagcgctagcgccctctttggaattgctgagaaagcgctagcgccagggctgggctcaattacggattgcggatattttgatcataaaaaattctgatcaaaactttctcagaaccaacaaaattaataagcttgctattattggatagccctacgtgtcctctattagcctacaaaatttcaaaaaattttattgagtttaaaaaaatttatggccaaaaatgtgtgcaaacttggtacattgcgtacttttgcccataactttgctcaaacttgaccaaattttttgaattttgataacttgtagagaaatgttggggctatccaatgataccaagaatgtctaatttggttgattttgacaaaagttatgggcaatttttttgaaaatttccatttgatggtttttatataactactcagcaccattcattttcacatttctacagtagggtttgatttatttttcttttgcaaatgttttccttcaattaatagtattaatgtaatactttaggattaaaggtgtttcctttttagtttttaaattcttttttctattaattttgctgtagtttttttttctaagaatctttggtgctttttaaaatttgcataagcatttttctcttcaatataaacttttagcattatttttttatttatatttgaattttttatgaaaatttttttttgtttattttaaatatgaattaattttagccattaatcgaaaagggattttttgtgcacacaacttataaccaaccttcttcatcacatttacattcttttggcatggcttgtcatttttcatgcagccatacattttagcttaaataaacaaaatttataatattattatttaatttatgaaaatatatttgtaatttaattttaagtttttatgactccatttttgtatatttaggctttttcttgtgaacaatgcccacattatgaaatatatatttattttaatctgtgaatgttggaatatttatgttttgtcgccctttgtttattaaatatttattatatttataatattctatattttgaatttgttaatttatcaatcaataaactttttgttattttcagttatataaaattgtcttaatttcttttgattaactataaaaaattatcgaatgttccgatgtgtacctttcttttttatttcaatacataaaatattatatgtttcttttaattattaattatttataaatctttgaagcaattgcctttttattaaacaaaataaaggttgtactaattcatcttacaactgttttgaacgtatttggtatattttaatttttctttacattttttatattgtctcttcgtttaatacatattttcatttagctattctgtacacaaaatttatttcaggatttctaattcagttcaaaaagtttatcttttaattaattaattatgtaataaattttggcgttctacatattctcttatgtttatgatgccgaatgcaatcaattatcattctttattaagtttttaataagtgaatttgtaattattttttaattgtttttcttttg

SEQ ID NO: 14931 - DNA, 704 bp, Heterodera glycines
ttttcccgacggcacgcccttatcggtgataaaaaatctaattttattaaaatactcgaaggtggcaaattcatttttagtgacggatggttagatcagaaccgaaaaattgcaacgcagaaatacgtttttgagatcctttcatcataacaaatgaataaaaaaatagttaatcactaaagttgttgctataaaatggccttttctcttaaatttttgtacttttggggtacttgatattcaatgttcgtttctaaatgttgaaaaattcaaatgggcattatgccaaaaaaattaaaagaagagtccggtttatcctattccaatatagccggactcggacatatcgtcgcctattggctcaaaatagcaaaaattggcaaaaaaagcaaattggttatgaaaaacctgtattattgactttgtaaatttatagaaagttagtgaaaatgaacattttttgaaaaaaagtttcggattttttgggtatcggtcttgggaccatgtctcggactcgagtcgccggaatttccgttctcgaacagcctaattatgatcatgatttttgtttcaaataattttactacccacaaaatttgttagagaaaaattattttttcaaaacttcgagcttcatgcttcgagcttcgaaaaaaattgggcttcgacttcggcttcgagtgctatgccgagcttagcccgtc

SEQ ID NO: 14932 - DNA, 3800 bp, Heterodera glycines
  misc_feature (125)..(125): n is a, c, g, or t
  misc_feature (904)..(904): n is a, c, g, or t
  misc_feature (911)..(911): n is a, c, g, or t
ttggccaaatgtcctctgttgatgagccattttgccggattctcctttccagtctagtccttccattgctggcccattttttgccccgtcgatcaataatttcccatttattccccccccccccnccccccccccccggcgttgggactttccgtccgtctgctgatcgatgtttgcgtttgttctgtgccctttctcctaccaactcgtcatatttgtgctttttctcgaattgctttctttgctgagtcatcgtttttccctttcccctgcaaaagagaatttttctaatcgcttttttaaaaatcttgtgtaatctgttggtcggctttttttccatcaaatgtttttctttggtctattttttctccttttcgtttctccgttttcggaagcaaatctttggacagaaacagcgcgaatgagcgatttgcagcaggtcattttgtgccagtttcggtcagccttgaaaagcatttggatggcatttgttcagtggcggttgctctgctcgcgttaccaagttgcgcaggcgtacatggaggacgtaaatgcacgcgttactgtgttcgccccggtcaacgacgtgtttctgtataaccctgacctgcgagcaatggaccaaaaagaagtgctttcacatatcggtaaaaaatcaaaacaaacatttggaaaggccaggccgactgcctttgctagtgagcaaagtggtcagcccaccttttcatacactgatcaatgccaaatccatcaatcttggcgaatgccccctttcagtggacacccaagtggtggagatcagttctggtcggaagtgggagaagcaaacgctgatccgaagcacgatcaacagcgggtacatctacgtcacccagttcgagaatggcccggccaattttgttgngcattgngcgggccgtcccttatcgacggttcatctccattttaagtcgtatttcgcaaacgctggcgcaatttgcaaccacgtgaccaaccaagtggggcatcatcaccggcgagcagtacttgtacaaaacgtgcactccgatgggccatcgtccataccccggcacggcactttcttttgttcgcgacgacgaaaatgccttttttgttgaccgacactatgacaacagggatttgacgtcagccatgcccagaaagcactcatccccggaaacattttagggaattgcgtgacattttggacagagtgccggacatcgccttggtcatttacggaagctccgcttggaatggcttccacacatattttctgcccaacaacaaagcattcgcaaaggtcgccgtgcatattgataaactgttggcatttttattttacatcggttaaatcattgcttaggtgatcgatcgaaatcgggttgaccgtgaggttttgttggcccatgtcagcggaatgaacagagtatcaacccaaggcattccttttgttaatcccccgttttcaggtgcttttcacttacccttggctttacgacggcggtgtccacttttacccttcaattcggtgccttttgtcatttcgttgtccctttttatcgcttcgcttttgtctctgctgtttcagtttctcctcgaatatcatagaagataattacaagttgaagctgtgcttgcgcaacatcaccgaccatcggacgggcaaatgggatttgtacgccgtgtccaccgtatacgaagtgagcggggagagagagagagggaaatggcaaaatgccaatgaacgtttttttgaatggattgagtgccatcttttcttatggtattgcttttgagcgttatggccaatttcggcggggcgctgtttgggccaaattgctggtgcccaatattccggtgcagaacggggtggtccatgtggtggacaacgtgctgggcattgtgaccaacacaattgaccaagtccgtccgtttcgttcgattcttccgatcactcgtcttttctgactgatcattttgtgatcagatgctaatggacaattaccgctgcaccactttgatgcgttatatgaacacaatcggacaagtgactccttcccttcccattctctccccatccgctgccaattgacagattgtgcgcaattatttctccgccaccggcggtttggtcacttttttcgccccgtggaacgaagcgtttgagcgaattcccgagccaatcgaacggcgccttttgcgcgacagaatttggctggaacaggcgagtcggactgatcaaccaatgaatgaatgaatgcactcatcacagatcattctgtttattcaaaagcacagattctcaaacttcacattgtcccggcgaaggaattgacaactgaagaaataaccaatgaaacggttgtggccacggtggacaacatgcgccatttgtattttgtgaggggcgaatggccaaaaaacaacgtcacttattacgtgatcggcggaggggtcagaacggcaattcaaatggtcggcacttggcagtttgctatgttttgtcggttcattcgcatttatttgtctgtttccatccgtaccttaggaggacgtgacagccgttaatggaattgtccattacatcgaccgcgtgttgggcgtgccgtatcaggtggacggagcacgggcggaatgccatgatgcccaaattattacagaggattaatcactcccctttttagtcactttgggaaattttgcgtaacgaaagtcgagcgcagcgatcatttgaaatgttgggcaatttgcaagtgattaaacagcaaaaaatgaaatcagaaatcaaacatgaccaaattgcagcttaaatacagcttggacccgtggcaagtgctgacgcccgaacaaaacttcactttctttgtgcccatcgatgaagcgtgggacaaggcattgccaagcgaaggcaaatgagcgaagaaccaaaacgaggacattttgacaggtcgcaccatcgctaaagaacagaatgatggacggaaaccattggcaagcgttgcaatacgtttacaaagtgagtgggaggatggcaaaagcaaaacaaaacgactgacggttcagcgccacgtgctgcaaggacaggcgctgatgtacacggaccttcgggagcggacttatgttatgatgaacgacgagaaagtgatcatccgaaggcggggacgatgtgagttgatcaggaaaaggaaagaaaagtgaagggccatcgaccgaatgaatgcctttcgcattcattggcatccactcgcagacttcgagttgtactggccccggggcaatcgcgtcgcgcgtgtgctggagggcggagagctcgccggcatcaacgggttcatgcacctcgtggacggggttagccccttttgcctttgccgttggcttttgctgactttcgccgtccgtttttctcaggtgctcatttatgagcctgatttgcgtgccgccgctttggtcggcgcttcgatcactgacaacaaccacactttgcttctttgcattgctttttccctatggacgcatcgctggaggcgaaggtaaaactgacaacagcgaaacgcaaaattcaatcgaccaattgatgccatgactcatttgtcacaggaattccatttctggctaatagccacttttctgagaaattaaaacgcagaaagacacttttcacattacatagacctctttattcactaatttgcatttttgtactttgagaaatttcttaggaataatgattgatctcatcattttaatttttagtcaacgaaataactttcttctacggaaaccgctttttgcttctt

SEQ ID NO: 14933 - DNA, 3348 bp, Heterodera glycines
  misc_feature (2794)..(2794): n is a, c, g, or t
attaatcccaaaaatgaattttctaaaaatgggtgccctttaaaagagtaccttgtcaaattttggcggattcatcttctctcactcgtccttgctcagcttggtctagttggcgcgttctcacacaactccaccgtgtacgtctcgctgtcgtcacgcaaaatgctggccttttggtgaaaaaatttttaattttggtgtcataaaaaataattataccttgacgaagccctctgtttcgtgaggcacccaaatcagccgtttgctggcccattcagcctaaaaacagcgtaatgttaaaaaaaaattatttttttctgagatctgttttccggtgtcaatttccgattaaaatgacaaatgagtggaaatgtgactaacatgtaatgcggggtcggtgattgatgtgcgtttgaccattaaaaactggaggtctgccggcgaagatgactgttgtgagaaaggggaaaatgagtttcgatggttatttttgtttcccccccccctccagtaatttgcatcaaaatggtgttacgcatttaatttctatgctaaattaattaaccggctcacaacagaaaatcaaaaaaataacggaaaacatcctgactattgtaaatccaataagaagcacccggcttctgggccctgcttctccaaaaccggatttttccaaatagcattggaccggtttgccgggcccagtaaaaagccgcaccgggttctcccggtccgttctctaatttatgtatacattcaagaaacggaatgaatgagttttgatattgccataaatgatgggtaactcccgttgaaccaatctttctcaacatggagaggatgccttttcctctaaagaaaatcccaacgggacgcgcaatcgaaggcattcgaacgcaaaaaaaggcaaagccaaaaacctgtgccgccgtttgctgctgcggtggtgttgccgctactgcttgctggggctggccgtagtaaattttcgactgacgtgtcggcggtttgggcggcaccgcggaggacaagcgtgccgttgcggttgtgccgttgccgttcatcatcacaccgcccccattcccattgatcataaaagtgtcgttgctggtgtgttcactgtttccgcctccgttcatttgaaatttgtgtggtggtgagtcaacaagaaattttttccaacttttaatcactctgaaatttgtcactttaatgacattttaagaggcatagattacaaaagccggaaacgcgaaatcattttgggaatccatatcggggggattttaaaatcgcttctattgcacttcagggtctagctaacttttactcagggatgatacttggatggagcatttaagttctagggcaaatccaattaacagattccattttgaaaattttcacgcgctggtatcggcatttttatatgcttcacaaaatgattttaaaaggattgagcatcggtcccgacttttggatgaaattggaaaatttgaaaacaaatttgtttttaaggtgtttggcgaaatgttttaaataaatattcaagagtttaatgactgccgacaaaaaaaatccagtaaagggcaggaaaattgaacaaaaaccatcaaagtctcaacgggtgctctctctctcagtttaatctttaaatggggacacttttcagcctccccccacaaacacataaatcaacgaaaaacttttaaacaacaaattttatgtatcgcattttaaaaggcacaaaacagaagaagaaacggggggggggggagaacacaatacaatcgatgggatgggatggggcggaggtggcggcggtgatttgtgcccacataaatacgcatacatacataaatttgcctctaccgtcgttgggggaggaggaggactctcctgtcccccacccgccacaaaaagtggcgtccattccttgggatggggggggggggggaggggggcgggggaatgtgaaagaatgaacgaagaaacgaacgaacgaatgaatggtaatggaatgaatgaatgggaacgacgacagcgacgacgaagacggacggacgaatggtggtggtacaacaacagcaaaacagcagcagaaggaggaggaggaggggaatgatggtggggggtgaggaagaggaaggagcattgatttatggaggaggatggggaagagggggaggaattggatgatgatgaatagggtggggatttttaggggcgaaaaattccaatttagggacctaaataggggcaaaaaattcgcgaaataggggcgaaaaagtttcaaatgtagaggtgaaatttattaaaattgccgttttctctatgtaataagttaaaattaaggaaaaaattttattcactgattgcagttagaaatgaagtacattccgaaattttcggggtttaagggtcgattcttaggggtgtatttttccaaaattttttgggtcgattcttaggggtgtatttttccaaaattttttgggtcgattcttaggggtgtattttaccaaatttttttgggtcgatttttaggggtgtatttttcttttttattgcattcttgttaataaatttcctaaaaatcgcgaaataagggcgagaataggggcgaaacgccaaaatagggacaaaaacttattttaggggcgaacactcaaaatagggatttttaggggcgaacatccaaaatagggattcctagggattttggcgaaaaaatgattttttgaaaaatttttcgggttttgggctcaaaaaggataatttagctcataaaggnccccctcaggcgatgccggcgctggcgccacatgcatttttcccgaggcacgggagcgcccgttctttttcgacattcccaccgatgtaccagcccgttccattcttgtggacacagtggtggagccgtcgaatgccaaactgaccattgccaacatccgtgcaaacaacttggaggccgtaagcatttgggattcattttcgagtcccgacacatgacgtcataacacgataaaattttgccgcgtttttgagtctcactctcacggggccacggggacactgagaaaagacccaggcaaatctaggaccattagctttgctgagcaatactgtaactggtccattacggaaatggtattgccccgaaatgagtacgatataccaagagagtcgtatgacccgagaaaatttgagaggttttttgattcccgttctcgagagccccagggggttcggcacagataaaagtgatgagcaggtctgtcaaaaatatcaaattttcttgattctacgtagtctaatttttaccattttctgacatatttttagatt

SEQ ID NO: 14934 - DNA, 1802 bp, Heterodera glycines
aatcaaattaaaatgtgttatgtgcatataggccagcaaagtcagtagataaaagtcaattagtggtgagccgaagtgacaaaaatatcaatgtttatattatttaaaatttaattattatttttattttaattgcttaataataatcataatttagcttaaatttaatcaaatttattcatatttgaatgtagctctacatattctctatgatttatgtaatttttaaaaaaataataaaaatttacgaaaaattgtgaccaaaaaagctcgaaaaatttagactaacaattttaccctaacttttttgaaattcattaaaagtttttaaaaatttaactgaataataaagaaatctctgggctatcttttcatatcctgtgcagtttgattaattgaatgtttaaacaatttttatgtttaaacgaccttacattttttggatgaccataaaaatatataacctattaattccttcataacttttttcagaaacatccaattttaatttaatttatataattagatagcccaaagattaatggattttaaaaagttagggtcaaaattgttgagtctaaatttttgattaagctaagttatgctttattattaagcaaataaaaataataaattaaatattacaaacattgaacatacttttgtcacttcgtcctagcaccaagtcaattgacggaaaaactggcctaataataaagttgatttttttttgtaaaatttttaggttattgaacgattaaacgaaatcgtcaaagatcctcataacttcgcagaattgaccgaaaatgaccttttggtgaatgcgctagtcacttttagttttcccaaattgcgtcacattttcaaaaaatacgaagaaaaatatggggaaaaaattgaagagcaggtggacaacgcttacatcaaagaattcaaacatttatcaaaaaaccgaataaagaatctacttaaactggaccttcatgtcgagcaacatttttgggtaattattttttgtgttaaattttttgatagatgcattatgtatttgtttagcaatttttcaaaattttattcctttcgctttttagctttttctcaaaaacttttttgtttgttctgaattcggaaaaattttcacattgcaaaaaatccttgagtctgagccggacgaaataattaaatttagcaaacattgaacgcaatcttaacggatattcaatatggtcgcccatatttttttgcacaattattgaaagaaaagcttgacaaattgcgaggaaacgaaaagtgggcctcagcggacgcgctgaaagacgtgacgcgaattttgctcactcgcgcacccatcgatttggccgacattgaccaggaatttcagggattgagtggcagcttgaccataagaatttcgatttcggcttacatcgagcaaattctcggattcgaaaaagagaaaaagcaaaaaaagggaaatgtttttcgaagcttttccatacgttcaaaatcgcacgaagacattggcaccgccgttagtagcgaatccaatacggcagcagcaaaaggaaagccatcgcagaaaattgaaactttgaaggcattcaaagaaattgtcgattgggcaacggagcagcgaaggctgagtttggcgagaaatggcaacagcggggtactgtgatggtcgttagcgtaaatgatggcaccatggggagtttcgtaaatttgtcggtacttgtgcagtttacgcccgcccgccccataaaaatattttttatatatataaatttttagaactcatattt

SEQ ID NO: 14935 - DNA, 2053 bp, Heterodera glycines
aggtatattttttttaagtatttaataaatttcacagagattttacaaaatccttaatgaattttccttaattatcgatagaacagtgttcaaattttcaagcgattttcagtaaaattctccaaatttctcctgaggattgtaagtaatatatgagttctttgaaaactcatacttactgacagacgataaactcttcgcgtctacaaaattttggccgttcttcttacctaatgactagacaacgtctacagaggtatcagaaatcacaaagatgcacgatcattggtaccaaaaaacagaaagaacgctcgagtatcctgtaaaaggcatcaaaaaagtcgctccagtttttttgaggttttatggagcaaaacacctacaaaatagccaaataacctcattttcgtcatttacatgcttatcaaatgcaatatagtgaggttctccaccaaatttggatcaccaaagaattcataccaagatataagtatgaaattttggcgatcatttttcaagaaaatattttagttattagggagttaatcttcatatattgtagtcagattgagtgctagtggatgtactttggatcagttcatccatactgtattgaaagtcatcgaaaatatacaccaatgagtccgcacggccccagtttttgggccgggaccgggacttttttcaaaaatttttgaaattttgattaaaaattcggaagaaatttcatagtcttcattttagcttagaaatatatcaagccatgtagatcatcgaccttttttgcttttcaaactccttttttagggccaattttttcaaaaaaattcgtcgtacaagggggagggggggtccggcggtgctgataggcgccgccggggaaaattttttgaaaatttgtttgtttttgttaacagagttgtccaaaaattgtccaaattttggaatattaatctttttttaacacggcgatgctgaggaaaaatttgaattttaataaatttattaaggaaatttgttgagtttttcatcaaatttggaaatgttttttggtaaaaaaaaagttgtgaaaatgttactcaatttcgtatggattttggggtctttttaacagttaaaattgcccaaattttcaagaaatccaaagttctatcttgaaaatttcgaattaaagacattttgccaaaatagttattaaatattttcaaatctgagttattttcactgatgaaatttagtcccgttagtcccggcccaaatggccgggaccgggatcgggacttggaaaatgaaccgggacgggatcccgggaccgggactcccgtttttccgggactcccggtcccggtggtttgtccaaaaaagccgggaccgggagtcccggcaaaatcccggtcccgtccgggctctaattatcatatttaaaattgtaatttaatgcatattttttttgctgtatgttaaattttagatttttcatcaatgaaaaattactaattcttataattatttatgcgtttttcattttatagtgttttttaaggaaaacctcactgtttccgtttctaatctgtaacgagccaaaattgtaagtcggataactaagttctatatagcttatcagtaacagtaaataacaattttcgtgggattttttaataagttaagtattatgcactttagtaattttttcatttttagttcagtgcaagggatcatttctcgcttgcgtgtctatgtttttcgtgttcttgtgctgacaaatgagcatgtatgaaaaaataacctctttattttttgcaaaactttttaatttcatacttcattttataattataattatttttggtttggcctttatatgcaacaagattttaacgatatggttgcatattacactgcagcaattatttgtttgagcttttgaataaataataaattgtcttttttattttttttgtaatagaaatatgttatagactcttgtttttaagtcaatcacacacaaatttttaatatcttaaaataaattttttaattatcatttgtaaat

SEQ ID NO: 14936 - DNA, 1838 bp, Heterodera glycines
  misc_feature (1713)..(1713): n is a, c, g, or t
  misc_feature (1734)..(1734): n is a, c, g, or t
  misc_feature (1825)..(1825): n is a, c, g, or t
ccccccccccgcctcaaattttgatgggtgttttactcagagttcgccgtgccgtcgtcgttcattttgtgcccaattttttgcccccccccccccctcaaaaagtgcacaaattttcactgaaaaaattcggagggcaccccaattttagggaggagaagaaaattacatttatttatttgtacaaaatgtacgcactcactacacaaaccattattccattctctgtgcccccattttcctatgggaaaatgccgcggggaacgaaaaaaaattaaaaaaagaaaattcggcaaaatttgggggaaatggaaatgtgaaattgcttttaaaacactttataaaatatacataaaatattcttgcccataaatggggtcaattttagagttggaatttattcattttatttttttgccttatgaataaaatggcaaattaaaatattcaaaaaatgtgtaaaaaactgattttcttattcgttcgtagttttcagaatacaaatacattagcataaaactgctaatattttgtaaaaaataaaattttatacattcagaaatttttttaacaaaattcacagacttttaaaacttaaaaattttacgaaaaatttttacatgaaattttcaaattttataaaaaggcggattctttaaaaaacttgtaaagcaaatattcagaattcatagaaaataagacttaaaatttcaaattaaagaaatttgcttaaataaagataaatttaatgaaaataaaaataaaatttaatacaatcaaaaaaatatataaaaaattcaattcaaaatgcagcaaaacaaaaaaaaacaaatggaataaaaaatgataaaaattattaaataattttaaaagcaattaaaaatctctgtttaagcaattgaatttagtgtacaacagaattttgttcattttttacattttttgagatctttacgccagaaacgcttttggcgcaatgccaatgccccgcgccttttcaaatgtaagtggcggactgtccgccgatgtcagcgctcgcgcggatggtccgcgtcagccgttccaccgccatcagtcgcccgttgcgcaggcactcctcgcgctccacgcggtcctccaccacgcggtcgccggggggaaattctagcggaaaatttgcttaaattaccgtatttattgaaattacggtaattgctacaaaatgtcaaaatgcgtacccctaaagtgcgcgtgccattcccatttgcgtggcacttgcggccgtggcgtcactctcggctccaccgacggcacattcgctgcccgaagcaccgggatacggtaggacacggtgttggcggcaccagaggctaccgtaccccgccgttggtcagtgccattgggcagcccggaagcgtggggaatggtcctcggcttcttcaaaatggacctcagccggtgggaggaggaggatgacggcatttggccattttggggcggcgaagagggaaacttagggggggggggggggtaattaaaacatttagtgaacgtatctatttttattccctgaaaaggaacccatctttgagtcggcaattattttttaggcaatcagtcaaaaatttatttaaaaatcatttaattatcccatcgaaataaatatttaaaagaaaaaaatgcttagaattatttatgaaaaattataagttgatgtaatttattgaagttaantaaattttatttatttattanaattaattatattttaattattatctttttttttttataaatttaaaatatttttaaaatcttttagggaatatacggtagtgattttctngtaaatttctcat

SEQ ID NO: 14937 - DNA, 1494 bp, Heterodera glycines
cgaaggaaagtgagtgaacggtgggcgcgttttgtgccttcttttgaacacttcggctgaatttcattcatttattaattaccctattaattattgacatttatttttgattaataattcgctaattaatttaaattacaaattttccataaagcaacacgcaacgaattggccaccgaagaacaaaatgccaaaaagcgatttggcatggaaatgccgtggaactcagcctaattaaaaaaattaaaaaaattgatttattaattagtaaatagtataaatacaattaaacttttaataattacttttttctctttgaatttcgccgattgggcagaaaaagatgatggcattttctgctataaaggagtccattttagaaaaacaaaataatcatttatttaattaattgaatttattttgtattatttttaccatttttgttgtcggttggccgtcccattgcgcaaatgtgcgcgaatttgtccaattcttttcatttttctttcgactgccgacggaccgaaatttttaatgaaattattgtttttttaattttaattaaatttattttcattcgatttccgatttatttaaaaaaaagtttcgtttaaaatagaaattgtggaaaaaagtctaattttaaatttgataatcaatggattcacagtatgtattaagaatgtaatcgtaatttcatttttcttttttttaatattttttaatttaaattttgtattggaaatatttaataattaatttaaatttttaccaaaataaatacaaagcagcggcaaaaccaacagaaatcacaatggcagagaggaaaagcacaacgaaaatggtgaaaaagagatgcaaatcatcgggaggcagagcggtggagggagtgggcaaaacgaagagaatgacagagaaacgcagaaaaagggatgccttaggcagaattggcattctgagttgaatgctttaaaaatatggaatgaataggcagtagagaccggacagtgtcgggatcctagtattgcttaagcaaatctcggtaatctctcgggatcccgaaaaagccaaaggattgatcgggattattcccactcatcagggtccatccgatttcacggaattaatttacaaatatgaaagattaaatattttaagttgctttaaagtttgaaaatccgcattcttaaaaaatgagatggttaaataactcattattaaaatgccgtaaaataaataaaataattatttttctctgttaaaaatgccatttttgtctctcatcagctgacaaatcgaccattgttaaatggaaaatgcacgcacatttaacaatttgatggcggcggtgagggtaaaatttgagtggaacagatggaatttgacgcgagaatgaggcagaaaattgtggtcccgaaattgggggggggggcaaaacaaaacaatcgatgcaattggggcgaatgggcggggggggggggggggggttttttt

SEQ ID NO: 14938 - DNA, 2232 bp, Heterodera glycines
tttcagcaccgaaaagtttttggaattttgctgtcgcttttttgggcggttactcggcatttcgactagccaattccctctggtattactcgcaatcgtactcgacggatcaccaccaattttacgacagtctcccgtgcgctctctcttacaaagtaccaaattattattaataattcgttttttgattgtttgacttttccccccaggtgcctttctattgtgcccttctgttcgagctgttcggctcctttttcctccgttttctcctccaccgtttccccctctcttcccggcatttcttcgctccgccgacaatcgccgctttcctttccttcggtgcctttccttctcttttttcctccctttttattcattttccttttcagcactcactttcatcggtgttcctggccttaatcccgtggtcacttcctcgaggcttcaaggtttagtaaacaaaaaacgtttcattaaattgtcgtcatttttgcacattttgtcaggttgtcccggcttggacttgcaatggttcattgtgcgttctttccgtcctcaacgcttttgacgtttcattttgcattttcagatgacttattggtgttgtccggtggtcggttggcttttggcctcaaaattggacaaaacgccgacaaaacagaagaaaaaaacgaccaaagaaaagacgaaacagaagaagagttgacccagcaatttgcgctttttttcgtttgtccattcttcgcacttctctcttcacactacatatccttctcctttattcttcctccattttattccgaatttgttgtgccattcttttcctccgttagtccttcatcacttttccgattttgtgccttttcattattattaaattatttaaagaatgaaattccattcataaaattgctgcgcttttcaattgttacttccaaatttccctgtttaaattcaaaaaaaataagcattttaaagggaatggccaaatcaactgaggaggaaagaattgcaaatgtccattttgaccttgaagtggtcaattcggattttattcgaccgatgcgaatgaactttcgccggagggggcgcgacttatactggtgcgaaaaacggcttagatcatgcgtttttagagggagaagtttttaaatgaatgaagtgcttgcccatttctagggacatggcgcttgggcacgacagtgtcggtaagccgttcgtcccattagtgtttcttccgttcgtttctgttttcattgccttttgtcccaattagccgcactcattttccacaccgaaaggaagcagttgctgttcgtcaagcagttcagaccacgtaaatttaattgctagatgccctcttttgacctttccccttattactttagctgttttcgttaacgtcgtccggtcactgcccgaaaacaaaaacaaatctctcgccgaagtccgctgggagaattatccgattgaaaatggatgcaccgtcgaattgtgcgccggacttatggacgaaccgggcaaaacgccgttagagcatatgaaaaaggaaatactggaagaatgcggttatcgagtggacgagtcgaacatccgcccgattcggcgttatgtgacgggcatttcgctgtcgggcgcaattcaacatttgttttacgttgagttggacgagtcgatgtgggaaccgaaggctggcggagggaatgagcacgagggcgaattcatccaaaatgttttcatggacatcggagaagccgaagcacttttggagaaggaaaatttggtgggaagtttttcaataaaaatatttatgagccaacaaaacacattttattatttgaatggattaaggtttcaccgtcttcgttccttttcgccatcagttggtgggtgctcaatgagaaggaacgtttgctcaaaaatgtgaaatgaaaagcgagcgaccaattccttttgtttttgcgggccatttttgtgcgatatttccaattaccttttttcgtcaaattatccaaccaaacggttcattatttatttaaaaatttgttttcaataaactcaaaaattaaaaagtaattttaaagtttgaaaggccttaactttcttttcaaatcttcagaattttatatgaaaaaatcgggtaaaaaataggattttggaaaaacaaaacaaagtgattaatccgctggagagggtgagtcatccatccgttttgtctctctttctctctct

SEQ ID NO: 14939 - DNA, 989 bp, Heterodera glycines
cttttttgaaacttaaccaaatttttcgaaattttgaatccaaatagagaacacttagggctatccaatgataccaaattcaatcagttcggttaacaatcaaagaatttatacttcaaaaactgggggcttgcgcacaattgtcccccagttcgcaaaattcgcctaaaaattattggtttttttttgtaagaaaattatcttttttttcaattttcgatggcagatgatctaaaaaactaacaataagcggtgaaaataaagccaacaaaaatttttttccaccccacagatttgctaccccttccggccctacctgtacctggagaccaaccagggccaggaattcattgtggccgcctacctgtccaagaaataccattttgtgcacattgaacacagcgagaaggagaatttggacttggtaatggttgccattttgccatataaatattattattttttaaaaatttcgctaaatttcctagaaaaaccatttggccggccttcgctcccgctttttgcgcatttccttcccgagcagtgccgagatggccaagttcaagcgcgacttgatgccacggatcaagaagaaccggctcaacgtccagcaatcgtccgactacacagaactgctcactgagtgaggagggaggctgtgccaaaaccaatttttggcggcttttgaattaccgaaatttgagaattttttatttttcgggtggaaccacgttttaaaaaattgcgatttttcttttgggtgggcttgagtataaaaatcttttgaaattttcctattcataatttttcggtttttttttggggggggggcgtcaaccgaaaattttgcaaacgggtcatgctcccatgtaaattgaagaaattttttttttcgtatcttttacggcacgcttttcccccaaaaattgagggggtggggatcccacggctccgaaaaaatttaatgaaattcgaattcttattttttt

SEQ ID NO: 14940 - DNA, 1921 bp, Heterodera glycines
ttttctcgtattattacattattcagactttgtgctcttctatgataccaaaaagatatgatttgttcgaacatgaacaaagttattgtataaaaacccgggattgtcaattgattggactcataaagtgcattagagccgataattttttatgtaaaacgagtctctcgagttcgaattcagcgcctaaaatgttaccctaaaaaatcgtagtggaaacaaaaaaaaatgaaaattttttaaattttaacccccccgcccttgcccatcttttcacagtgagtacgacttgcccttcgacatgcgcgtgtgcattgaccagcaatttttcgtgggccaatggtacaccgttttgggccgtgatccgaccaccaaaaagccgtcaatttgtcgcaacgaggcgctggtggacccaccggagcccgtggtattggaaaactacccaaaaaaatggggaaaaaattcacatttttccccagatttgtgcctttgacattgagacgacgaaagcgccgctcaaattcccggatgccaatgtggacaaaatcatggtgagatatcagagactacaccatggcagcccatttgatgccaacaaaattggcaatcataacccgccatttaatccgaattaaaaaagggaaaaattagaatgccaatcaaagtctaaattatttaaacggcctccctcatatgttatccaccggaaaattaaaaaagtatttttcaaacagaaatctaaatctaggacaatttgaaatgttgtcaagaagaaaaaatttgaaaaaatttctaccaattttttccgaatttccgatgagaattatttgctctccccctcccaagatgatctcctacatgatcaacgaggccggctttctgattgtcaaccgcgagattgtcgctgcggacattgacgacttcgagttcacgcctcggcccgaattccggggcgaattccgcgtgttcaacgagcccaacgagtgcgcgctgctcacccgcttctttgaccatttgctgcgcgtgcggccgcacattatggccacgtacaacggcgacttctttgactggtgagcgtttgtggtggattcattcatcatccccatggggggggggggggtgtttttttcattcgctccctaatttttcaattagaaaaaaaacaattattggatccatgtttcattgtgatgcaccactgcgtttccctcatccaccacgaaaattattattttttccttttcaaatagaaattttaaaaattttcaaagaagaaacttttgcaaaaaaaatttggtaatttgtcgtgtcgtaaaattttaaaaatagcagaattaaaaaaatatatttcatataaaaaattattttatttttttaaatttataaattgtgttgtggagcggcttcgaacctacacccattattgtttttaaaaatctaagtttggtgtcacattttcttgaattggaaaactttttatcggttttggatttggcgccggtgtcgcattttcagggagccccattcagcagagagctcccaattgtttttttttcgaaattccaaatttttggacagatagagagtataataaaacagttcctatttgggcgtttattgaaaaacgaaaatcccaacaaattttcaaatgtaaaaaaatatgaaaatccctgcaaattttcaaggccctttgtggagacgcgtgccgccgccgtgctgccgcccgcctcgcagcggatgagcgcccacctgggctttggccgggacgcgcaggacgagtacaaacaccccaactgcgtgcacatggacgtgttccgctgggtgcaacgggacagttatttgccgatgggctcccagtcgttgaaggctgcaacgcgggagaagttgcgatacgagccggtggagttggacccggaacaaa

SEQ ID NO: 14941 - DNA, 2085 bp, Heterodera glycines
tagtttatagtctatatacaataatctcaggactcgtctctaaaaccaaaatctcgggaacgggcgccgggaggggctcgggagtgtgacatcacttaaccaacttttgacggcgcatctgggaaaaatacgggttttccggtccggcggccagttcagcgccagcggcgctgaaacggcccaaaaatttttttgtccgtttttgccggcctgtatctttgcgggaagaagcgggagcgaaaaacgcttggtgggaggattttaagttggagtgtttgggaaaacttggcgtttatttggcaggcctacctgcaaaagcctggcctgtacacgttggcaaaatttgaaaaccatttttggcgtttttcgattttcgcgaataactcgctgggggttaagcggagcgggttgacgccgcttgagcatttgtgtagtttttaaagctgcatccgatggcgttttcagattttgaaaattttgaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgtttgaggcttataactcgtcaggcgttgattttagcggaaatttgtcttagagcatttttgtagagaattttaagctctatctaatgtgctttatctcatgtttttaccatgagtttaaaaaaagttataaaattaattgtgattttgaaactcaaaaccataggggggaccgaccccatggttttgcatttatgaaaaatttttttactcctaaattagccaaaatgcatttttatggcataatttgaggtgctgaatacgtacgtatatacgctttatattgcgttttggattttttggagggtggtaaaaaaattttgaaaaatcaataatttttggcccttgaaaattcaacctaaattttaaaaattcataactcgcctcaaaattgtccaattcagctcatttaaagcattaaaaatcgagaaaaatatggagaattttaagttgttttttgagtttccatattttaaaaattcacaaacttaggcctggatttctcaaaaattttaaattttcagaaataaatttataactcatttcaaaaaaggcgctaaagaatatttaaatattcataaaatccgcaatttttttctctataaagagaaatttatttgacctttttataatttaaatttccttttttataaaataaggtgctgagcatgaatgtgatgtttgttttacgtttcagaatttttggaattttttaaaaattctttattttttgggaaatttttggcccttgggattttgggcgaatatttgaaaattcataacaaatcgaagggttgataaaaaatcgtcgcggttttcgtgctgtaacttttctcagggaaccgggagcggaaaaagtccgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggttaagcggagcgggttggcgccgcttgagcatttgtgtagtttttaaagctgcatccgatggcgttttcagattttgaaaattttcaaaatttttcgagctaggccccctcgaaaatttttcgtttttgaattttattattttttgcagatttttcccaggaaaacggagaccactttcaagcaaccgtttttcgagctctatcgattggtggcatttttgaaaaaatttcaaaattttccggaaatagaaatttttttaggcttgagcgggacatttcagtcccgggctcataactcgtcaggggttgattttagcgaaaaattgtaatagagcagttttgtagagaattttaagctctatctaatagggtatccggtatttttatctttaatataaaaaaag

SEQ ID NO: 14942 - DNA, 1427 bp, Heterodera glycines
tcagaaattaatgaaaataagttataaggtgttctctatgtctccgattacgaatatagcatccatttttctaattccgaacccctgacccgaaatcgaacaataataaaattaaaaaatctgtatgaatgatatcctgattggcatcttacccatgagggtaaccttggtacaggaagcataaaattcgaaaattgtatggatggtaccctcatgggtatcttgccaatgagggtattattggtacaggaagcctatcaattctttgtccatgtacagctcatgtgatgaacggttgcgctgatctgagcccggattcgtgatcagcgacctcgagaaccccttaacacttattttcattaatttctgacacatttataggcattaaaaatgtatgtgaaaagtaccctgtaaactgtataagtaccaaaacgggtaggtcatctcgatgaaacacggaattaaactatacaatttatgcccaaccgatatgccattttattaatatatcaaatgtgcatataaatacaatgacgatgaatatgaatgagatttcacaaatatcgaacaagcgaagcacaatatattaatgggtatacaatatatacatattcaggccacataaggaaggatcactgttcacaaggggaacatttaagaagcattggaacagacaaaacacagcaatcggatgggaagggaatggtcgaaagcaagggacgggtgtgttggtgtcgcgagacgtcgtcgtcgaacactgtcatttgcacgcagcagggcctggctattcctctgcttggctcgtctccgctgtgctctgttctcccagcgcttcgtccacggtggatgcatcggcggtgtccttcttcttgcccttcttgtccttcttcccgtgcttgtccttcttgcccgctttgctgtcgtcgctcttccccgcctccttcgatcggtgtttgtctttgcgcttctcctcctttttgtccgccgctggtgctgctgctgctgcgccttcgcccttcttgtccttcttcttgtgcttgtcgcccttgctgccagccttcttctcctccttgtcgccggcggtcgtcgcttcttcgcctccttccggcttgggcttctcctcgtcgtcgctcttcggttggtcgagcatcgggccgaggtacgccttccaacagtactgaaaaggacaaaaatgttatgaaatgcaaattgaaaaaatgaagaaagcgcagcattacaattcctgctccgaaggcagcagcagcgatgaataggtaagtggccattgcgttgcgttgcgcactgaagcggttcgttggttggagtgtggtgaagaagaagaagaagaaatgtgaagcggagggaaagacgaccccttttatacggatccaattctgctggaaggaattggaaaaaaattgatataa

SEQ ID NO: 14943 - DNA, 3549 bp, Heterodera glycines
tttaagaatgcctgctgaaacagccaattctaattcgaacgttaattcttctgaaacagcaaataataacgcaatttcaactcatatgcttcgcgagaaaaacagcgacgaggcaatggtaagggaaattgtctaattggacaaatgctattctcccacccctcttctgatttaaaggaagttgaccagcaaatcgtgactgatactgccgacattttgcagtctgtgctcgaattcgcttttggcgtttcaatcgacgacaacaatggcattgcacaggaattctcctcatctcccgaattgcttttacaactgcaggattctgtgcgcacaattcttccgtctttaaattccgacgactctttggctttgtaatgaatgatccattcgtttatctgctttcatttggtgttttgtttcagtggtcaaaatgaattccaaccggactttgaccgcttcttcgccttccctgaggcttatttggaagttgccgtcgagtttctcactttgctcgtcaggtatttgcttggattttattttcgactttttactttttccatttagcaagtccaaaatgagtcggattttcctaaagaacttgtccgactttccgaagcaagttcttcatttgcttctcaacttggagagcataaagaaccctttcattggttcaaaggtaaaacccccgcttcccttttctgaacattttgctctgttcctctgattttttcaggtcgtcgatttgcttttcatgctgtgccctttggttaaccatgatgcatccgtcttttaccgtcaaattgtcagtgattctcttgctgttgaaggactgttcccatccctcgtcaaattttattcggccgttgaaacaactggtccgattttcttttttcttctcctttatgctcccaaaaccttaggttcacacactgaatttttcgacaagtttaacatcagaaggaacattcaagtcattttcaaatgcatgtggagtgatttgtcgcatcgcgacagaatggtccaatacgccgggtgttttttctgttttgtttatttttttaaatttcccattcagtgaattttctccgaattttgttcgtttcatcaacatggtgctcaacgacacaacttttctcctcgacgaatcgcttgacaaattgaaaatgatccaagacattgaatccgttatgagcaatgagaccgaatgggacaaactcagtcaggaggagcagcagctgaagacggaccaactcagagactcgaagggacaagtcaaaatgtggatccaactcggcactgacaccatggaactattcgttacgctgaccagcgacgcgccgcaaatatttcgcaacgaagcgcttggggaaagagttgcggcgatgctcaaccacaacctcgtccaggtgggcttgagggggagggaagggaaaagccaaaaaaaaagaaagaaagcccaaacaatgcacggcttttatagttgtgtggaccgaaatgtgcgcaactgaaagtgcacgacgcaataaatcgcttcgaatgggacccgcgcacattgacacagcaaattgtgaaggtctacatcaatttgggctcggaaatgttcgccaagcaaattgcgcaggatgaggtgacctatttcagacttatttatttgccgggacgcaatcccccaaaaaaggaaaagatgaatttttaaattgcaattagacattctctgatctccccaatttagcgttcgtacaccccggaagcattcagcacgataattgaaagattcaaaatgaggaacattcttacgatcaaccacttggaattgtttgcaaatttggcggaacaggcagaagcagcgtacaaagagaaaatgatgttcgaggaggaattcgaagacgaagtgcccgaagagttcaaaggtgtggcgcgagtgatattccccggaataattcgcctttttgagatgcgcttgtctacacgatgatgagcgacccggtcgaactgccctcgggacagatttgcgatcgcaaaaacattctgcgccatttgctcagcgacccgacaaatccattcacccgacaaccactcaccaccgacgaactgagaccgggtgggatttgtggggaatgttaagccaagatttatgcattggcaatgtttagaaaaagaactcaaagcgcgtattttgaaatgggtgcaggaaaaaagggacagtcgcaactgaaagcggacgaataattgacttcaacaaatgcctttaccgtggtcagtcaatcgacgagtgagtaaatggtttgactgtcaattccattgccatttataaccagtcaattattcgtccgccccttttatccacccacagcgtatagttgaaccatccgtcgaacagaattttcgtacgcgacttggttgtggtgatatgcaaactgaaaataggaaaaaaaattgacagactaaacagcagaagtacttaccgctgcctcagtgttgtatggactttcataatttggctcaagaagaacatgtgagattgcttggagcacatctgtcatattgttgctagcattccaaagtgtcagcagattaacacagaaatcaccattcttaactgaaaagcaaacaggattgatcgttaacgaaaggtccaacttactgttggggtggagtattcttgtttcgaattgtacttttggagcctgattgggatagacacacggaatttcaatattgaccgtatagactccgggaaaactgaaacattttttcagaacaaaagaaaatgcatcctcactaaagcgatgttggcggtcccggtattttcaccttccaacgatagatctgaaaaatgcaatttaaataagaggaaaaggtgaagaacgtacattttcatcaacaacttgaatttggtgtccaaggtcgatcaatcgcaacaattcgtttcgcaaactcggccttcttcttgaaatcacacaggcacaaacaacaacaaaaacgctgaaagaaaaaaaaataaaaaagcaaaaaacaaaggaatcttcctaccaaataacgacagggacaagcgcccaaagtacgatttcgagaacagagaaacgagaaagccacaaaagtagaatttctagaattgagagaccagcagaaccgtgctccgttttctttgcttcaatttcaatttggtttgtagaatgagaagatacattctgagaatcgtttgagcagaagcagtgttggaaaaaaacaatagcaccacaattacaccggcaatattgaacagcggcgaaaaggtttggcgattcggtgacccacgaggaaaatctgaattttggattgaagtaaaaagcgcatctcaaaaaggcgggttctagtcggttttacgcgtcccatgacactttacgcgtcccatgacattttacgcgtcccatcacattttacgcgtcccaacaacactttacgcgtcccatcacactttacgcgtcccaacaacactttatgcgtcccatcatattttacgcgtcaaaaaatgtttttcgaacagtcaatcggaaactataccttccg

SEQ ID NO: 14944 - DNA, 2927 bp, Heterodera glycines
  misc_feature (15)..(15): n is a, c, g, or t
aaaacagaatttaantcgctgggaaaaattcctaaaagaactaagtttacgattttgagcaaattttttgatgaaaattagagctttttgtagaaatctccaaggaaaaattttattttttaactaagtttattaagaaaatttttcaaatttttcttatttaaccaaaaatctatttatatagagaaaaaaatcagaaaaatttcctctaatttgtaagctaacttttgatgctgaacaaaaaaatcttttggaccaacatgatcagattactccttcatggcgatctgaacaccccaaaagatacagaaagtggggaaaattttagaaaaattcatagggtgtttggaaaatttttctggaaattttgattaagcctttcattataatttaagcgaaggagagaaaaaatagagatttttagccgtttttgcgacaaaaatgggttattttttgctattttggggtcaaaatttcaaaaataccggtaaaatgggggtccatccgccggtggtgccgacaggcgccgccgggaaaaatttttgcaattttgagtgaatttgttaacagattttgtccaaaatatgtcaaatcattggttaatttattggtctatggacgttttaaaaataaagaaaaataattttcaatgttaggaaattcttattaattaaatttcaattaaaattatcaaaacaaaatataaaaattctcctatcccagtggtgaattgaacttatgcaaaacaaaatgtatatgtattgtacaaaataataaaattatcataaataaatatttttttaatttaattatatataaacgacagacgaaaattgcgttgacttacaacaataacaacaaaaaatcgaaaacagtataaatttctcgaatagaaagcatttttcaaaatccatgcaaatttcgagaaaatatttatatttcaaatatttttcttcaaaagtatttttcttagaaatgttttaaaattctgttttttaaataatttacatcatgaaaaatcgacagaactgctggccaaaaaaggaaagtgaggctcaacaatttaaaaaaaaatacagtacaaaaaaacaaaacttcgttttcgttgtcgttggttgcactgctcccgcaaaatccgatgtaaatgcacatggactgatcatcacatcccttctgctccgatcagttcaccattgaactctcttcattttcattgtcgttgcactgctgttgttgttgttcttgtgctcttttccccattcatttttctgtccaatttccttggaatttcttttcgatcaaaattgcctgaattttcattgatttatgccattttcgtgcttttatgagcaaatggataaaacgatgtaaatttaatgaattcgactcacgcccattggcaagtccgtctccgtcagggctggagcgcgaccgcgatccgcgattcgcgggatttttttttgcgcgatccgcaggcgcggccgcggcaatttgaatacgcggtgcgcggccgcgggattttttttgcgcggcgtgccgcgcattttttggttgtaaaatttttataaagaaaatggtaaaaaattgaaaacagacaaaaaaatttgcacaaatttatgcttcttatttattcgttcatttttaaactgatattacaaaagacaggtaattattaattaatagggctcgaaattatatggactcaaaaacgtcaaatatggacaaaaagctcaaaaatggactaaaaactgctaaaatatatgctttaaacagtcaaaaattctaaaaatatgtgtttattcaatatttgcttaaaaataaacttaaaaagtacaataaacaaccaaaaaatggatttaaaacacaaaaatggtgaaacggatttattcccaaaaacccccaaaaatggatttttatggactaaaaaccttcacgaaatcaaaaaattttaacgcagaaatgccatttttgagcccctttcttcatagcatatgcgcaaaaaattatgttaatcatacaatttcgagccctagtaattaattgttaattgattattttaaacccagaatgataatccaatttacagtatgatgaaaagccatacagtacactcagtaaatggataagattaaaaagtcatacaaaaattgtaaacccaatttggtccgatcactccttcattgtgaccctgaaaacccgaaaattgcaagaattctgtaaaattgcgaatgtaggagtctatctttttttctgaaagttttaggttcgtggaattttgtctgaattttcccattttttgggtaaatttcgggttttcaggatgtccataagactggggtttttctgtatactgaatatggaagatagacaaaggatgggtaatgtaaaaatgactgctcaggtccattgggaaagttcgtccgataggaaagtaaaaggagcccataattgatttggcagacaagaactgaaattttaaaattttaaagaaaatatttttagagagaaggagagagggaagagagataaagtcagacagagaagagagaaagagagagagataaaggaagagagaaatggagagaccagagaaaaagagacataggaaagagaggagagagtgagccgagagagagagacccagacagagagataggaaagagacgagcgagagaaccggagcccgagagataaaggaagagtaaacgaagcgcgaaatccagcgaagagagaaagagagagacataaaggaagagcgccatggagagaacagacaaaaagagagataggaaagagaggagagagtgagagagagagacagaagagagacagagataggaaagagaggagagagcgaaacggagaaagagagataaaggaagagtaaaggaagagagaaatggagagaagagagaaagacagagaga

SEQ ID NO: 14945 - DNA, 2933 bp, Heterodera glycines
atcaaaaaaaaattcattttaaaaatttagtccatcagtatcctaaaataatttaattggcatcaaattttttagccttttgcgacaagtggccgatcaagcagctgagtcattatcacaaagcaaaagcaatgggaaggagcagcgaaatgcaaaaagagcataaaatgcaatttaaaaaatgttttgaaaaatttaattttattatttatgttgaaatttataaataaaaattgtgctaaattatttgtaaaaaatgtttaattttaaaaatagaaaattaaattaaattcagtagagcgttggaacacctacttacaggatagcttttattctttgacgtggaatttccaaatcaatttttgtgcggttctgatcattattgaaaaaaagagtatcaagttttgtaaaaatatgtaactaattgaaaatcgcaattaaaaaaaaattcaagtttttcaaagaaaaataaaaaagaatttatcggattaaaaaatttttttaaataaaaaacatttgtcttatcttttacataaagacatgaatgcatctgcttaatgcagggctcgcaagtttttttttcttcaaaataaggacaaacgaggttaaaactatgattttgaccccaaaataagatttttttaaaaacggctttttacattgtagatacaattaaaaacatggctaccaactgaaatttttcaaaagcggcatttggccaattaaaaaaaaatcattatttggtgtcaaaaattagcatttaggaaaattattccaaataaaaattcaataaaagtgtttttttttgcggcgcgattttttgttaggggaagcctgaaaataagaaaatagaaaaaggccaagatccggcccctccaaaaaggacaaatcttagaaaaaggacatttgcgagccctggcttaatgtcataggaacatgaattcgagccatccatcatacaagtaaacattcagtccctgtcatgataatagaccaacgttgtaagacctggtcaaaaaattgaaaattaaaaaaaaaaacttgagaataatagtggtgacttacaatgcagtaagctattcaaatccgcatcatcctcatccgcgaaaccacaatcagagtaacgactgacgagtgcttggcactcaaaaagcacagtctcgacctcaaataataataaattaaaataatgataatttaaaaaaatgttaaaaatttcatccaattttttaatgccaaaaattccaattactgtataacattaaattagccgcccgatagattgttgttttcaaaaatttgcagaagttatctttaggtccccttataagtcaataatttttcaatttttatttgtcaaaaaaaaattgctttaaaatcaatggaattcctttaagattttactctcaatgattattaaagcattcattgcccctccctgacgacaaatttgaaaaatggctcgctcaaagaacataaaattaattgattaatccaattaattttttaaatactttttattatttttgaaaatgatctgatattattcaagcattcttctttcaacttacaaaattttcgtcctcaatattggcattgagctcttcaaattgacgggcccctggtggcacggatgacaaatgttcgccataatttacaataactgaaaataattttttttttttgtgaggtttttaagtcctggatatgggctcagaaaaacccaaaaaaaaaatgaattttttgttttttttttaccagtgtaaatgcgacggacggcatccttttttttctcatcgtttttatatgctttaacaatagttttgagttctagcattttgtcggtgcattttttcgcctaaaaattttctgcattaattattaattaattatttaaattttttatacaattttttgcatgtgaattaaccaatggccaattttttcaatcagaaatttgtcaaatagaaatgacactcgacagtttgcccattttcggctaaatttgacaaagccagtcatttctaagagcagctctgctggaagaagttttggcattttctttttttttgacgggtgagtgagtaatttttagttttttggtggcacatttttcgttttattggaggataaatatgatggcatcattttccttatctgattagtctttaaaaaaaaggcaaattatgtgataaagaaaagacattgcggtaaaatcaaaagaaagcgaccccaaaatggaacagttcgtacccctctcccaccacgaaaatttttttacaagaaaatttaatttaaaaataaattaaaattttctagcgattttttcaatcaagaatgttcatgaattattatgcaaaaattttctaaaaaaaatcattaatttttttttcaaaagtttatttaaaaaaaaaccccgagggccgggggagaaacgatacggggcggcgaactgacccgatgctaacgcaaattaaaaaaaaccaaatcgaaaacttcgaattttgagtcttgttcgagttcgggattaggaattggttttccactgacacgaaattatttgtttagcccaaatgtaatctggctggcccgtcacaaaaagaatatttgcatatagtccattaaatttttcttttgattttaccgcaatgccttttttctttatcacacaatttgccccttttcatagacagaatagataaggaagatgatggcatcataattatcatcaaaaagtgccatccaaaaactaaaatttacttaccccgtcaaaaaaaaaagagaaatgccaacacttctttcagcggagatgctccgacggggaggaggaaatgttgtgcctaacccccccccccccccccccccctcgggggaactgggaccgccgaccccgacttttataactcaacccgagggtcgggattcttccctaa

SEQ ID NO: 14946 - DNA, 1412 bp, Heterodera glycines
aaattgaaactagaaaatttgaattttcggtattgttcgagttcgagttccggatttggaattggctcaaataaatgtcagattcttgaccagcaacccgccggaaaactcccagaaaataagttttcacgattgaaaccaatagtgttctttctcctctttgtttttaagaaaatctaaaatccattgattttaaacaaccgtcaaataattgttataaattatacataattagttatgtatgaataaaattgtaaaacggagcatttaaaatgaatacattggcagttgaaaaatgaaatgactaaatgatttttcccaaataaaagatcaaaaaagcaaaaaaaaaaaaaatcagtcagtcatcgacaaatttgtgcctaaatctttgaggggtacaaatgatttgtgatgaaaatccgtttactggcattttgccggttcggcaaaatgagtgtctcttaattataattttgctttttataaaaaacatggaccagagataattgtaaaaaagtttttaccttttcattctaattattatgtatttcattcactaaaactgtaattatgtagcttgaccgtaaaatgagggctcccggacttttcgacagaaaacaaaaaaatattggacttttcgacagtaaacataaaaacaaataatttttattaaaataaattatattgtttgtcagttttactaaatttcttataaattaacatactataatatgtattgctaaatcattatcactagagctaatatttttaggtttttacctaattttttttcctgagctctcagtgaccttaaacgcacgaaaaaatgtttttttgtagttgttaagcaatttttcgatttcttagcacctattttctagatttttattttttagcactttaaattaataaattttttccaaaaatctatgaataaaatggtaataaaaacgaaaaacgcacccccctaaaagtctatcaaaaatttcaaaaaatacatcttaagaaaagaaaattaaaaaaaaatcatctccatttatttgtttacattcttgaaaagaatttttgaatttaaaaattaagtatctcaataattatttgaattaatttgttgcttttggataaaattttaaaattttacacccctaaatttgaaacttaattacattttactgtcgaaaagtcccctccttaattttataatatttctgtcgaaaagtccggcgcccacaagcagcaggaggaggagaagcattcatccagctattttgcatcaccacatctgaagaagagaagaggaagaaactacagacaaaagtggtaatgaacatctttaccagggatgttgcgaatcgaaaaataaaatgcgaaatacgaataatacgaaactaaaataaaatacgaaatgcgaa

SEQ ID NO: 14947 - DNA, 3658 bp, Heterodera glycines
ataaaaaccccaaataaaacccataaaattctcctgatttttctccatttttaatgctttatttaatcaaaattggtcaaaccttaggccagatatgaattttcaaaatttaccccaaaatcccgagggtcaaaaaattgccaaaaaataaagaatttttaaaaaattccaaaaattctgaaacgtaaaacaaacatcatattcgtgatcagcacctcaaaataccccagaaaaaaatttttcaccctctttttcaacccaaaaaaaatttccgaaaatttctagggggcctagctcgaaaatttttgaaaatttccggccatataatacactattcgatagcattttaaaagctctacaattttgctctaaggcaatttttcgctaaaaccaaccctcaacgagttataggccagggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctagctcgaaaaattttcaaaattttcgaaattttaaaacttggttagatagcctttcaaatactacacatttttgctcagaaacaatttttcggtcaaagcaacccctggcgagttattcgcccggtactgaagtgtacattttgagcacacttcaattagccaagcgtgcaggccagggggtggctctaataaaaaaataaaaaataccagcatgtagaggacagttgtggggagtgccctctcagcgggcactttttgattcgggttttagaaaaaaagttaggggccctaaactgcaagaaaaagtgagaaatcggtccccgggactcagtcgtccgcgctgaatttttctctatagttttcccggatgctcctcaaaaagttgtaagacccttccactactttcagggcgctcccggccttcggccgggagaaaatggttttagcaacgaaactccttgtcaatataacgtatatattaactagcgggtgcgtgaaccgtcggatctggtacagggataaagcgcttcgcgctttgggagcttcgctacctagattagctctggttgtggagatttggaatttttaaaaaattatctgggacttttaggccgcttcgcggcctagaacgggcgctttgcgcccgttttttaaattttgttgggcttatacgggcgcttcgcgcccgtttctaaatttgttgggctattaaggccgcttcgcggcttcagacgggcgcttcgcgcccgtttctaaatttgttgggctattaagggcgcttcgcggcctaagatgggcgcttcgcgcccgtttctaaatttgttgggctattaaggccgcttcgcggcctcatacgggcgcttcgcgcccttttttagcctgttaggccgcttcgcggccttggacgggcgcttagcgcccgttatttaaattttgaggtacaaaagtgattagaagaggtgcaacagtgattaaagagtgattagaagaggtacaacagtgattaaaagaggtacaacagtaaattgaagaggtacaacagagattaagaaaggtaaaacagtgattagaagaggtacaaaagtgattaaagaggtacaaaagtgattataagatgtacaaacaatgatagaagaggtacaaacaatgattataagaggtacaacagtgattagaagaggtacaatcatggtttaaaatgaaataaataagaaaattgtattattggatgtattataaatgaatcaaattaaaaaaatcagaatccccaatcacacagggattctgaggtcttaagatgagtccaacagtgatcagaagaggtacaaaagtgattagaagaggtacaacatggtttaaaattaaataaataatgaaaagtttttataaaaatttaattcaaataaaaaaatgtaatttattattaataaaataaaaaatattttaaatgaataaaacaatgaaaatacgaaaaaaatggtagttattaattaaaaacaacgttggaaattattaattgaataattatttaatttgaaattaaattattttttttacaaattcaaaaaaaaataatgaaattctttaatttaaaaaaaaataaatttaaataatttaaaagaaatcttcaaattaattaaaaacagtcaaaataacccaaaaatgcacagaaaaatattgttacaccgtccggattcgaactttgccccccccccccaaaaatgatgcctcagaatccccaatcacacagggattctgaggtcttaacgatgtcaaaagtaaaatctgatcacgtattcgtgatcagcagcccaaataacccctaaagacatatttttggaagatttttgtgaaaaaaaaatttccgctcaaaaatcctatgcttcacccctttggtcccgaatctcaaaatcacttttatttttataaaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaaatccaaataaagtccataaaattctcctgatttttctctatttttaaggctttattcctgtaaaatttatcaacccttcgatttgttatgaattttcaaatattaggccaaaatcccgagggccaaaaaattgccaaatattttcgaatttttaaaaaattccaaaaattctgaaacttaaaatagacatcatattcgtactcagcaccttaaaaatacccagaaaaaaatttttcaccctctttttcaacccaaaaaaaatttccgaaaatttctagggggcctagcacgaaaatttttgaaaatttccggccatataatacactattcgatagcattttaaaagctctacaaaaatgttctaagacaatttttcgctaaaatcaacccctgacgagttatgggcccaggactcaaatgtcccgctcaggccaaaatttttttctatttccgggaaaaaaccgaaatttttccaaaaaaattaccagtcgatagaactcgaaaaatgatgttttggaagtggtctccgtttttcccagaaaaatcgttaaaaaatcataaaattcaaaaaccaaaaaaacgttttttaggcctaactcgaaaatttttgaaaattttcgaaattttaaaatttggaaaaatcgagctttcaaagctctacaataagtccgctggagccccctcgctcagatcaaaccctgacgcggtattcacctgggactgaagtggacaaagttggtactgaatttctcctattttctgcagcccttcctactataggtagaggcctggaattttttttgacttttagacaacacttcaacttaggttcctaccagcggaaagtttttgaatcgggatttagaaaaaaagttatgggccgtcaaacgcacgaaaaaatgagaaatcagtccctggtactcagttggcccttggaccggaaa

SEQ ID NO: 14948 - DNA, 2331 bp, Heterodera glycines
tggaagaaacattttgaatgggggaaagaataaaagagaaagaaaaaatggaaatagtgaaaatttattggcaaatgaaaggacaaaacccaaaataaggaagagaaaaattcaaaaatattgaaattaatcgactgaacattttcaaatggaagaaacaatttggagatgaattaaatgaggattaaaagattaaggagataaaatttccttccgttgttcgattttattctttacgaaaataaatggttttcttttttatacattttggtcatattttattactttatattagggttgctccccgacccatccggttgcaaaatgtcggaggccgggtaccccgatcgggtaagattaaaattttattttaacgaaaagaatctcaaggcatcccagccagggctgcacgcaattggatttgcagttacggaaatccgtaagtacggcgattttctcagttactgaaattcgtaatccgtaattacgggggtccaaaaaccccgtaatttcccgtaatccgtaatccgtaattttcaaaagtcaatttttgtcagaattttagaaaattttttcaaagtaaattaataaaaatccaaaacaaattttcgggatgcattttctttattttatatttcaattttacaaagaaattataattttatgtctgaaaaaattcattctttttgaatttttagggttcattttggaaaagtttttgaaagtctgataatataattgtatttatgtataaagttatttcaacattgataagaaccactagccagaaaaaatttcaggggggagagaacccaaagaatttttttggcctaaatttttttgtgttatttaaaaaatttcagagccggagagcaaaaacaggaattgtagccgtttttagccaaaaaggctaattaattttttcaaaagtgacaatttttcctggtaaaatttataatttttgatttccccgttcggcttctcactgcgctattttttatataaggtagcaattatgttaaaatttcaactcgatcgtttcacggtaaagaaaaagttacgaaaaaggagcaaaaaaagaagtaaatcaaaagaaaatatttttccttttttaaattttcctggtttatctcttgatgttttagatttttttaagttatttttttgttatttttattaattaatttatacactagcctagatagtgaaggtgctgctgtccaacccaaactaatggtcgagagaacgaggaaaagagggaaatagaattggggaaaggatgaaagagccaaagacccgggcccagggtggttggcctccccaaaatcagtcccaggaatgcgcattcgattggtgactcaatgagtggaggaaaagacaagagggagcagtactttattggccatgaaataaatacatctttaaaagataaaacgccaaaaggaaaaggcttaatctctctctatcattcgacggatcatcccaactgccggctcgccgaacagactctccgatcaactgccgctctcggggaaaagggataaaacagcaaggggaaaagggggcggaacataacatcataataggggaatgatcaaagatcaatgtcttctgcgcctcacataatttaaattaataccaaatggtcaaagtcaaaactgatcactacaagcacccaattatggcactaattatggacccttaggccctcctggtactttttatcattgttctttgtgactgaaaatatccaaattgcaagcacacattttgctgcacatccgctgacttccgtcgcttctgttccggcacaatctttggcacctaattatgccactaattatgggcaacaccacttatgccatcttcctggtacttttatcactttcttatatgtgataaacctaaatcaaattttaggcactcattttgtcgggaatcctccgatttccgcagcttcggctttgacaccaatttacggcatcagaaccaattatggccaacggcaaatggggcaattattttcctgaccgtcctccttaccatccgccgcagtgatcactggtgttgtcgtcgtcggatgattttggcaaaaggtaactgcagggaaatttgtgtgtgtttaatgaggcattaattagtgtctttatttatgcgttaattgactgacgaattcattaatttgttgtgacttcaactgtctgttgcttattctttacaaatttttgtgctttaacagaaaatattcatttccaattttggcattttctcatcacttttttgtttgatcatctgtggttttctttttgatcaaatcattttgtctcattt

SEQ ID NO: 14949 - DNA, 1498 bp, Heterodera glycines
  misc_feature (95)..(95): n is a, c, g, or t
ccccccccccccctcgccgggcgtactttgcccccggcgatctgcgcacatcccaccaccaataccaaaaaaatgcatagaggagaactgccacncaatttttggtggtaagacttggccataaaatgtgtgttgaaaatttggcccgttcgatggcgcaaaatggcaaacacagcaaatttttttaatgatacccctaatgatgtcattagcgattggtctttgggaccatttttttttgatggattgtcttttttttctcgccaaattttctttcataaatttccaccttaaaaattgcatccaatttcaacgacgaactctaataacacccaaaaattctttgtgtcgtccgtccctttttgagaccggttttcgccatgtaccaccaacctttatcatcatccacccgttccaaaggcaatttttttttttgattaaaaaatgaggactttttggagactctccaacattgactaaagaaacttaatttagtcaaattaaaacgggtgcacttcatttcttgaaattttcaatcaaaaaaaatcttagcgttttttcaaaattttatatgaatattactaaattttcaaaaagtcgctacaaaatttttcaaaaattatttcttaaattttcatataaaaaacttcctattgttttgaaactaagtctttttaaatttcgggcagggaaaagacctgctccgaattaaaacagcctcaaatatgttcatggaaattttctttaaaaatgcataatttagcaaattaattttttttcaattgtttggcgcttcgctttaataaattttcaaattttcccacccatggagcctccgcctcctccctcaacaacaaatggtccatactgctccaactcgtcggtgccaatccgtcgtgcggacagtgccaaatcgtccgcctgtgttttgccaatttgtgcctcttcgtccggctgttactgctcgcccttcccctcctcatgctgtggcgacagaattgtcaaagtcaactcccgtcagccgctcaccaaactgcttgacgaggaggaggacaacgacagcacgacggaaaactccacaaccgtgttgtcatcgggccaacagtcaccgcctaccgtagctgcggtgccctgctgcccaagcagtggacggtcagagacggcaccggcacaacgttggtggcccccgctgtggcagcttgggcctctgctggtagccctgtggcggcatcgacgaatcgcgctcatttggctggcaccggtgctgctcgcaccgttgctgcacagtggtgagctggtgagtgctgtgtgtactgcttgatcttcacggaatttgggttgagctgctggtgcccaaaaaagcgccatttaccatactctgctgtattctttttccactgcagcttttttcaggacttgtccttggtcaaatccatatatctgaggtttaccggtgcgggggcttcagggcagaatgttgtgtaatatcactcgtcag

SEQ ID NO: 14950 - DNA, 863 bp, Heterodera glycines
acaaaagataagcaaaattgccaaaatatttaaaccaaaatcccagcccaagtcagcaaagacaaaattcaaagaccaaccacaatgttcaagtggtcccagaacaaatcgaccggaaaagatatttaaaacattttttatatgtaaatgaacaaaaatatcgaaattgtggccaataataaaatggcataaatggcgaacaatggcaaaatcatttatcctcgaaaaatcgtgtaaaagcgctcaaagttagcccgcattgatttgctttttcattgctttccgcctaacattcaaggatttagctttagcttcattcaaataggacaaaatgaattaattgacaaaaatttgcaaatttatttatgaaattgcaatttaattaaaataaatcaattaagttatatatttatatatttttattaatcgataatctttgttctgattgagtaccgtatatgctctaattatagcccatgggggattatttttcaaccttctcagaatacaggggataattagagactggggcataaattgagactgggggattataaattttcttggaaaaaaataaaaattctatttaccccccatgggggataaatgatattttggccacttttcgtacatattttttgcatccctgattatatgaaactatatttataacatttctaatttatgaattgttatttaaaattattattaagcaaataactgcttcattttaaagatataccaaaatcaattttatgcctctcaaaaactattaaaatatataattcatatcaaattattattttttatgctaatatccctaataaatccaaaattttaaaaacgagttaataataattttt

SEQ ID NO: 14951 - DNA, 2608 bp, Heterodera glycines
tgaattgggcaggagatgaagaaacattggcaaatgccttttacataaagggattatatgagcaacttaaacaatttgggcttggttagcaacagggacacgttttattaaaccgtaattaaaaatgacgcaattaaaatggtgctcaggaagagctccaaaatgctaggcttgtttgaccaggaaaacgaggggggggggcatttagcgggtcgggagcagggatggacgaaatttcgtttcgttttcgttttgtcctacattttcggcactttttgagtttcgttttcgtgtttcgttttcgtctaccaaagttttttcgtttcgttttcggtttcgtcagagcaaaattggatgaaaaaagtacgaaaaagcactggtaagaataggccccagtagtataaggccccgggggcgggggtccagacccctgcccctgcttaaaaaaacacccatttttgttcttcaggattttgtcccaggtgccggggtccaaatccatgagaggattaattaaattaattcatccagaggcagagggactcgaacccaagaggtctaatccaaagcactaccactgggtcagcgatacaactatccgaaaaaggataattagcaattatatatatataatttaaaatcgattaaataattcaccaacgggagggggattcgaacccaaaaggccaaatccaacgcacaaccaattgaccgaggaacatagtcatccgaaaaaggatatttgtcagttatgtagtaaaaaaaaagtgccgcaagagtcaaaaatggacgggagaggggatgcaggcgacattctcccttttgcctatataaagggatatttgtaagcaaaaaaagcacaaataaaaaaattttttaaatgttcaacgcaccgtttacattaattttatctggcgctacgggaagtggaaaaactcaatggctattgaaacttttaaaacattacagtatgctaatcgcaccgcctcctgtaaaaatactctattgttattccgagatgaacgattctgtgatcgggttaatgaaacaaggaattgagacacataatggggtaccgacccaaacgttggttcaaagtatgcccaaacccttacttttaatcctggacgacctgatgttgagtgtaaataacgattttttggatttattgttcacccgaggcttccataactgggatgtaagtgtgatttttgtaaaacaaagtctctacggacgcaatattcgtaccgcaagagccaacagccattatttggttttaacccggaatccttctggtcaacttcaggtcagaacggtgggttctcaattgtttccgaagaggctaaactattttatggaggcatacaacgatgcaaccagcgaaccattcagctatttggttatatatgcatcctaatgcgcccgagtctgaacgtttaacaactaaaatcttcccggatgaacagcgtgaggtgtaactaccaattgaataaagaaagggtataaaaggttgagaaaatctgtaattttcactacaaatgtatgaattcagtccatatataagtgaaaacgcagaattttaaaaaaaaatcgcctccacgaaatcggaaaaaaagaaaaacatccttctgcgagacacaacagccgaacaaatattaggacttgttgaaatttgtgcaaacatattaaaattcaatttcagcctaagcagaagccaaaggaaacgcttggccgaatacgcggactattatcgtgcaattgcacgctcgcgtagcgaaaagactgcgagaaaaatgctacaacagggaagtggtatagcattaggggcaatattagtgcctattcttggcgcactagctcaacacctggtcgaaaaaattacagcctaaaaggcgggagctaccaatgaaatatacaaaaaagatggtaccagagagcgagtatttggccctcattaatctacttaaagggagcagcggcgtatttcctcctctaaccgacgcgttacagggcgagaaaacgttgcttgatgtacagattcaaaagaatttggctgatccaaaaaataacgctgaaataaaatgaagcgtcactcatggttatataaacgtagacaccaactaaaagatattattgagaacaaacctcaaaaagtaattgttgagagtggctcagttacagcaccaaacgttgcgccgtatatgggcattcaaaaacaaatacaatcgaatacgaacacactacaccgcaattcgacttcaatccaatcaattggtgccgtaagtaagagcaataccgatgtagaagaggacacggacttttcaactgcttctgatcagtttgagcctgctgctgatgctactacttcgtcaaggaaaacgccgcaccaaaagacgccaaccatttcattaaggaccagcccgaagatttcccaaaaatgatggaaattatcgggaaggatcacaaaaaatcggtgtcaatgcaagcagcggagaaattttgactaatttcaataaacccgtttcaggctctcatttcaccgaattgttaaagcatttgacaggtaagcgcgaagatgtgcccagaggccatcgcttcttcattcagc

SEQ ID NO: 14952 - DNA, 2717 bp, Heterodera glycines
  misc_feature (36)..(36): n is a, c, g, or t
  misc_feature (118)..(118): n is a, c, g, or t
agcagaaatttgaatgccaagtaacggaaaatgccntgggatgaccactccggtggactccacgttcagcttggcgtattttatggcactttcggtgatgtacacacattttgatgcncaaatgcaacttgcagccattccagcgatgatggaagtggggatcaacgagtaataactgaaaggggaagggaggacattttgaccaaatggaagataaatgggaaggcgaagaccgggggatgaaattggcagcgaagtaaagcacgtgaatgccaatgctcagcaccaaagtacgcttgcagccgagccgattgagcacaaacggcggcacaaatagagaggaaacggccaaagagaggtaaagcacactgaaagcggaacagaaagtgccgccgaggcacggcggactgaccaaagtgagtcggcacccatgtcgccgttgacggccgtctgaagagtttgcaggccgttgaagccggtgaaaaggaagagaaatgccaaagagaggacataaaatgagcgattaaaggcgcataagaaggtgtgctatttcagaccaacagatcagtgcggatcctccacttcatcgccttcagtttgggcccctccgtctcgcggaggatggccctgcgctctttccgaaattgtttcgccaaaattgcttgactgaaattgtgaaatcagccagaatgagtttggcaaaaagcacctgcccaggtacgggttcaacttttcgtccacgtcttcatccgtcgtgtccactgaggccaaaaatgagtgcatgtccaccaatcgcttcggcacgcgttcgccatgtcgcggcattcgcctccgcgagccgtgcaccggacagtacgggtcgtagacgtggacgcggaggggcgtctcggagccgcacagagcatcagccaaatgcgattcatccgtttgacgaaagagatgcgcactgcaaaagccgaacagaaaacgctgacagacgccggcggggaaaagtgccgtcgcaacggaaacgaacgcaaatgaccgaccgaccctttgtccttcgtccgcgcccgcctttccgctgctccgttaagcaattgtccgctcataattttccgcccgagcattggtgtctttgaattcgcctttttccgttcgaattcgcgcggacgtcgacaaaattcgtccaacggaagtggcgacaattccctcgtccggccaagcgaatgcaacggatcactgcgacgacgtttcattttgtccaagaaatatttaccgaattggcgcaaagagtcaatggctggtgacctgaagcggaagatgaacacagacaaatgctcaacgaatggtcggcttttctcttccctctctttctttcgtttttccttcccttcccttttccatttcttccctttcgcttttcgtttcctcttccttttccaactttcccttctcttctgtatttacttgcttcgactcttccgttttttcatcgcatttatcatttcgtgttcactctccgatcgctgcgtttcgtccaactcttcgagcagtatctgaacacgctgcaactgaccaccccacctccttctccgctcccctttcttcctccgcactcacatccgacccgcgtcctctcgctgatgaccccgaatgacttgtcccgccaaatgcggtgctactcattcgcttcccataaccttcaacgacaccgaccagtgcgttgccaatgtgtggactttcctcatcggagaccccttcattttcagccacggcattttcaccttcgactaatgaccaagcatttgcgtccattgatcaaaaattttattctttgaatataaaacatttaaacaaatgtgtagaatgattaatggaaaatgtaaaaatggaaataatggaaaatgaaaataagaatgccgtacaaaattgaaaaatacaattatgtatagcaagtcaagaaaacccaaattgcattcgattgcggaattgggattcattttttgtaccttactgctgaaccagacagtttaaatttgtaggaggattaagattccacagaatcaggcgggggttcgaccccaaatttggcctaagaaaaaccaaagaatgggaatttgtcagttcggagaacaaccaaactgctggtgagtgtccggcctttttccagccacaaaatatttctacgagggcatttgagcctttgaccaattgctaagattaaaccaaatgctcttcaaaatgtccaacggagaaggaaatcgatcagaggaataaatggcggggagagcttaagaaagcaaattgagagggcaataataaatttagtggggctaaatacataaaggggccaataaacaaatgggcagaggttataaaggaaaaaaggaggtaagaaacaatggctaacaaagagtaggaaaatgatgagatagatggttgtgaatccaatgtgggagtgatcagtgatcaccacattcaagcaagcattgtgctgcctttgttcgttctgtgcccaccgccgccggcgagtgttccccgtcgaccccacagttttcgtcccccttttcgggtttcttccgttctcttctcccatcctccatttctcttctttcgtcgacttccgtccgtccgatggtcccaattcatccgccgtcgattaccccccctccgtcgtccctttcttccgtttcgtctgtccctcctccggcgtcagtgcccaacgcacaaaactt

SEQ ID NO: 14953 - DNA, 1251 bp, Heterodera glycines
caaaggcagtaattaccccgtaccgtcgtttcccctcggattttttttttaaatttcggggggggggggggggggaaacgattcctctccggtttttcagtgattggttacacaaaagcaatttggaaaaataacatttaatttattttcgctcgtacctcataaaatgcgatgaccgcaagttggttgaacggatggccatttaacagttccaaactgctcgcgcgtaaataaaatcttaatcgaaatccaatggttgtcaaaatccatttgaaagtgttttcaaaacctccgtgcctccgaaaagtccttggccattgtctcctgctgattttgcactttgtaacgatgcaaatctcccaaataaattaagtgccgttgggccgagcgcaaaacgttcgtatcgtggataggtggatcggagttcgaaatggaacagtcagccaaatcttcagatggaaacccattttcgttggaaggccatcgcgaatacgatgagaaattcactccaaattttcgctcgtatttgtccagcaattcttcataaaagtcaatagcctacaaaaacaattaaaaataatatttatgttttgaacaaaataaaataatgtgaagtaattatgcgtaaaaattactttctcgctaaaactcgacctgttggaccaaactgagaaggtactgacggaacaccgacgaatgggggccggcacttccgctttgtttgcgcagagcttcgaccgctgaataaaagcaaactttccacagttcctgttcggcattcgttctgtgtttctgttccaaattgttgagaaggccatcggcataaagttgggccagggaaacgctgaaaacattcggaaaggcatttaattgcgattagttggaacagaatctgtagcagttagcatgaccataaataaacccgggtaatattagaaaacaagttttgaagttttctggctataacttttttgcaataaaccaattttttttttgaaattttattattcggcaatggcgcagttttgtggtttctgtgaaaaataaatttacaaatttaagcacatttctagggtagaaaaaagagatgaacacgaatctgaactcaattttgcaaaaacatcgatttatttttgacatcatacatgattattgcataaattattaataatgctaaaaatttgtttgtgggccttgaatggtaagcacaggagaatagccttaaaaaggagtaattaaatgtatgagaaa

SEQ ID NO: 14954 - DNA, 3130 bp, Heterodera glycines
tttagcggtggtcagcgtgtgccgttggacaagcaaacgccaaaactcactgaacagatgatcgagaagtggcaagttctgcccatcgacgtgccgcgtggcattgacacacagcgcgacaaagcaatgatacagaacgccaacccattttttcatgcgcactcagtgcgtgtcgaaacaaaaatgatgcaagccgaggcgcagcagctgttcccgccggcactcgccttcaccgcatccaatgagcaaattgagaaaattgagccgactaaccgtggcggtcagcataattataattaattaatgcacaattagcttttttgcgaatctcttgtttcttcttatcctagaatttttctgagaatttcataaaaaaatatctgaaaaagaaattttccagaaaaaaccgaaaatttcattttttttatagtttgaatgtgaaaatcttagctttaagtaaatttgtttgatagttatatatttgtaaaattaatttagaaaatttgaatatattttttttgccaattgtcatttaagaatgctttgtgtctatgtaatttggcaaccaaattataattattttaattaattctatatttatgaacccctaaatctccttcagttttggacttttcgttggctgcccgtggccaaccgttgccccgccgttacaccgtcccatgccaatttccaaaattctgggctgtcgtcatcgtccaatgcgctgtttccaaggaccaatgcaggtgagaaaacgattagtttgaatatacgtcgatgatttactgtatttggtcagatgtaagagatactgtaactttttttgagcggattaaacaaagcgatcaatcatcaactgtattctcgagtgcataacttttcttaaaagaaaaacttaagtgttcttggtatcattcggtagtttatagttagttctctaactgggtgtgcagttttgaaaaaattaagccttaaaaacatgatgaccaaaaaatttcataaaccagttttacatttctttataatatttttaaaaacatttttaaaaaagattaagttttaaatattgttaagtcttttcgaaaataagttttaaaatattaaatagtttttaaaaaattgtatatgtattctattatgttaaaaacatttacataagctatctaattgtgccaaaatataaaattttagcgtacttttaagtaaaattttgaatttatttttcccattttctgaccactttcgaaattattgaaaagataaatcacttaagaatgttctgcgaaagtttggtccggtgtgccaggtcgcgcggtgttcaaatggaattgccacagcggggcattgaccattttgatgacacgtcactgtgagttaagggtcaattcacggtcacagtttagggggcaaattccgttaatgattcacgcggaaattcaagtttcacgggctcaattccggtcgattcacatggcatttcacggtcactattcattgggaaaattcacgtcatatttcacgggatcatttcacggtcattattcatgggggcaattcacgtcacatttcacggtcactattcatgggggcaattcacgtcacatttcacggtcactattcatggggaaaattcacgtcatatttcacgggattatttcacgtcacatttcacggtcactattcatgggggcaattcacgtcacatttcacggtcactattcatgggggcaattcacgtcacatttcacggtcactattcatggggaaaattcacgtcatatttcacgggattatttcacgtcacatttcacggtcactattcatgggggcaattcacgtcacatttcacggtcactattcatggggaaaattcacgtcatatttcacgggatcatttcacggtcattattcatgggggcaattcacgtcacatttcacggtcactattcatgggggcaattcacgtcacatttcacggtcactattcatggggaaaattcacgtcatatttcacgggattatttcacgtcacattttatggggtcatttcacggtcacttttctcgggatcaattacggtcacgattcacggatttgctcagtcactgacaagactaaatttcttgtcgcctttatttaaaaaatgggcttttctaattgaatatgtgtttaataattttttaaacgcaaattaatagcatctttttccagtgagttcgtccgtgagcaattcggattttactcgaagcatcgtgtccgttttgttcttttcgttgcgcccggaaaggatgcgtcccatgccggtgatgtccaccatacgttcaaattgcaagaaattgaacatggtaagtgtttttctcttccttcttgtagtgatatgttcaagactcaaattcccgaaaatttaactcaaacaatagaggaagaaaatttcaattttgcgcgatgaaatttgaaattctttgcgggacggggatcccatggtcctcacaatttccattgaatgcgggattgcggactgggactccgtcccgcgccgggctcagaatgagtctataaaaacatgagactattctcgactcaatagaccgagagtcgtgaacattaccaccttcctacttcagttttctctctccctgctatctttttcactcttattcccctccattctctctctttttctctgccgtaattcatgtatcttcttttcctctctctcactctctctctctctttctctctctctctctttctctctatctctctctctctcacactctctcctactccattctttgactccccccattttcttctaaggaattgtgacccagcatgtttccccaaaaatcgtggacaaggccactggcccccggggtgccattatggttctggacaacatcatgctgaaaatgaatctgaaactgggcggcgctaattacgacatttgcacggcgcaggcattcaaacaggctaacggaatacgacacgacattgtgtaagtagtcattgatcagtcaggtgctaaacgattgcgttcctacaataaataaggcaataaataaccggtggtagttgagtgaaaaataattaccctaatgtatgaaatataaatatcattttgctttaa

SEQ ID NO: 14955 - DNA, 1705 bp, Heterodera glycines
caatttggaggtgtaaattaaaattattatattcctctcagaagaaaaccaatgaaaatagaagaaaggaacaatattaactaaaaaatattatttaggaaaatatttcaatacattagcataaatattaattttgaaaccttattttatcaaatgttctaaaaattgtaataaaagcatcatacttttcgaatcttcggaataattacctggtttggcgcgaataaaaaaagctaaaataatttaaggttcatccattcaatgcataaaacagaaaaatgagattttcgaaaaaaatttattcacaaatttcattgaaaattaattaccaactttgaggtgagcacgaaaaatcttaggatatagagaaagaaagaataaacaaacataaatataaaatgaaacccaattttgggtcaaatttttcaaaataaattttgagattggtggtccggcaatattactcagcgattaaataattcttgtaaatttattagtaatactcacttttgctcaattatgaactttgtacttgagtaaaaagagcataataaataaatataaatattaaaaattttaaaatcttgaagaataattttttaagaatagaaacataaactgaataatttaatattatgcttcaataataaatgcacaaataatctcaattctattacgccgtaatgtcgtcaaggaagaaaaactacccctaaataagcaggatgatcaattcaaattgaaacaaacaaaatgttttaaacaaattacataattatgccgaaatcattagcaataattaacaaaggataacataattatcatatttttcccatattataatttccactcaataaaattcatatttcctaataaataatttgtttttaaaaaaaaataaaattaaaggggtacttacttcatttttcatttaatttaagtagaaatttaaatataagaaaatttatagcctgtctaactgcctaaatttcaataaatttgttacaaaataaagaaattataaaagttgagtttttaaattcaaaggaaaaaagaaaggatgagataatgaaataagaaaattgagtttgaaataatgttcaattttatttccgcttttagtccttcagtttttattaaattttagaatgtttcttttctaaaatcaaacgaattttaattaaacaccgttttgcttaattatgtttttttgagttttttatatttaaaaaattaacagtttttaatttaaggtatttaatgtataacggaggatcttaataaaaatgcttttaaaaaatcaaaatcttaaaacaggacgggatcgggctcccgtgggattaaaattgattgaaaaagttgcctctgacaaaaaagaaaaatcagagaagaaattcatttttatcaaaaagaaaaataataattttgttaatcttttaaatcaatatcaactattttggataaatttaatatataaaattaaaaatttcagaaatatatgtaaataaaatttgaatatttgaacattcaagttaaaaaaataatatttaaacaaatcatgcatttgatttaaaagcgcgtaccgtgaccggaacgccgacatttgcgccgcggacatttgcgccacagacacttgcgccgcccagccaaatcgacatttgcgccgcagacacttgcgccgcccagccaaatcgacatttgcgccgca

SEQ ID NO: 14956 - DNA, 1488 bp, Heterodera glycines
gtttttaaattcaaaggaaaaaagaaagggatgagataatgaaattaggaaaattgagtttgaaattatgttcaattttatttcccgcttttagtccttcagtttttataaattttagaatgtttcttttctaaaatcaaacgaattttaattaaacaccgttttgcttaattatgtttttttgagttttttatatttaaaaaattaacagaattcattctccaaataattcattctccaaataattcaatccccaatgggtttcagatttaaacgtcggcaaaattccccaaatttgagtgagggagaggacattctcgcccgtattgaccggcttgaaaagttgttagaaggttcagggaatcccacactgaacccaatcatcgaacggctcgaaaagttggaaaggttggtggagcggctcgtggagggcgagaatcgatatggacatcgatttggtgacccccagcacacctcccccacttcggctcccacccccacaaacggcaattttcaatggggtcaaccgccgccttttgctggcaccggcgccgtgtcgcggatgataaccgacgccatcatcaactcagagcagctgaaggagaaggcaaatcgtgcggtcattgagaaattgccggaggcaatcgatgaacgggcactggtggatcaaattgccgaagaatgcggtgtcaaggacaaactttcgccagacattcatcgccacccaagaacgcggcctgatggaggggtaaaaaaggaccgaattctgaaagttccatttttggacaaattttcgcgagacaaatttatctataatttccgcaatgctctgaaaaaattgactaatttgccccaacatatcaaagtccgcagggacatgacccaaaacgaactcaaaattttatattcccttcggcaacaagcctatcaggccaatattgctgctggtgaatataaatattttgtggttgatttggaaatcaggtccctgaaaaacccccacccgctcagaactcgttagggacacgcgagcaaaccaaccgaaaaaaatagaaaaacggtaaaaaacaatccctggatttcttgccttttaataaatgcccgatcaatagcaaataaaatagctgatttagaacatttagctaaaaaatacaatccgtctataatcctaatcaatgagacctggttaaactccagaaatacggtagaagcggaacttacaataaattgtcaataccaaattgtttatgcaaaccgaacagaaaaaaagggcggaggatcggcaattctattaaaaacattgatcccttatcagacacttgggacaaaattccaatgcgaaattatacacattaattacttttgaaaaaaccaattcaaattataaatatatatcgtccacctgaattgtaccgttcagaatactaaaaagctattcaaatttattaaggatcaaagcgattccgaaaatatcatatactgtgggga

SEQ ID NO: 14957 - DNA, 3515 bp, Heterodera glycines
tggaagtgcatgtggcttttttcagcttcgacaaactcgtccccatcaatccggcaaatgatccattcgccaaaagagcgcattttgcgctcactttgcaagaaaattaaattggaagatggactaagcatcacagaaattgtaaaataaactaaaaagaccccatttcacaaaacgattatttgttaaggcgaagaaatgccccgaagcgatgtccggggctgaattggccggtttggtcaccgtaaattgatcattttatgaattgctttgaaaaaaactcaaaattgcagacagcatcaatgaatcgactgcgagagttaattgaaaaagcggaattggagggaataagcgatgcggaaatggcagcaaaagcgaactttgccctttccaaaaggcattttgacgacgcaattttggaaatgataaaaaactgatcaaaatttacaagttatttcattttatttatcgtttacttacaaaatggcagcataggaaataaatgagcactgatcaaaaataaaaatgcttttaaaatgttttgatcgcccccccccccctcccattgaattgttcctctgctgctgctgctcatttctcttctttaagcagttttgcgggttggggacatttggccattcgcagtgattttcaaatgctcttttttggcgcctttttcgtcgtttattttggcgtttagttccatattaagtgttggccaaaagccaaggcgttttatcaatttgctaacaaaaataacaaccaaaaatgcatttgtttgccttctctctcccttttacctgcacatttcgcgttgatttagcgtaaaaatgtgaattcccattgtgtgccctgccctgaaaatatcccggcacatatcgtaggccaattgtacggcataattctgaaccgctacagtgtcggtgccgattcggtcgagtgtctgctcaatttgtgcggggattggcacattggacaaatcggcaatttttttcaagctcgccgtactctttaagatggaatagacagaaaaaattattaaattaataattggatgaaaataccttaaacaacaaaatgccaggcaaaattgggacggaaattcccatgtttcgacaatcgacgcaaaactgttcaaacaaattggcatccaaaaagaattgagtgacgacgaagtcggcgccggcattgactttggccctgtcaaaagcgaaatttgaaatgcatttgacaaagttaaattgattatgctgcctcattaaactccattttaattgagttcgaccacctcaaatgttccatgcattgtctgtaagaaatatttttcatcggcggataaatgtgtcccgcaacggccaccgttagccgatcattgccaaaatatccgccggtctcttccaattctcgagtccatttgaccaaatcgatggcgaagtgttttgtgtttttggtgagaagctgctaatctcatagtatcgagattgttttcttttttgcccccccaccgtttgctccgttggcatgtcgtcccccctcagtgccataatattcgcaatgccatggctcaatgtttgcttcacatgactaatcgactcagtcctcgtgtgatcattgcagcagatatgcagcattgtgcgttctttgccgaaaatggccgcggtggcaatggcaatggccgacgaagaattcaatttggccaaatttcctgtgaagaataaatcagactaattgtaagcgtttgtagcttttttgaccatactaattgatcaatccttgtaattaccctcctctcacccgggtcatttcgtcttgaccaagtgatgtccacaaacagaggctgcgcctgcttcagatgatccaacatttcgaagaagtccgccaaatttttggggtgttctttcagcggagggtaaaattccaaagaaaagaaaggagcgcattggctgtgccggttgaagcggtcgttgatcacagaggctaacattgaactgatcggaaaagggggacaaagtccgatcggacggagagacggaccttagggagaggagaagaagcaaactgatcaattaatgataaaaaccaacaagcaaagatatttaggaaaatttgccttaaattgagttttggtaatttttatctttttccgtgggatacaaacggaattttcccactttaaaaattcatttaggagaatgaaagcacaaaaatatgttttacgacaaattaaattgagttaaaacaaaaataaacaaagaaaaaacagtgagggaaagtgtaaaatgaaaataaaataaggctgatgtaaaagtgtgatttgtttaaacggaagggaaaaaatgaacgaatttggaaaagaaattttaaaataattaaattctctcaaaaaattttggatgcttttaaattaataatagtgcataagaatgattcgaagcattcaattaataatctttatttgtttgagtattttcgacgcttttgggcggtgataggggggaagggggggggtatttaacgatggatgcgttgggttggttaatgtccgggtgggaaaacccccgtagataatttcccacccaaaattaatttggaggacggcaaaaagctctcacacactcagttcatgtgaaagtgaccggttttcatgaacattgagggaaatttgcaaattcgtttaaaaaaagccaccgaaaagttaaaattaatttcgaaaagcaaaaaaaaaagatttgtattaaataattattaataattgttagagaaagacatgaaaagtgacccaaagtaagtcaaaagtgccaaacctggcaataattgaagatttggttggagaaggcccaaaataagaaaaatggaaagttttaatgaaatcccaaaaataaattggatttaaaaaagtccataaaattctgatcacttccgatcaccctgctgatagactgatcttctgatcaccgtggggtaagtgattttttctgatctgaaaatataccatcatgtcaaatgcagaagtctaaggtttttaatgttttgtacttataatttaacagcaaatttgagacaaattttggcgaaaaaattcataaaaaaattcttctactctttttcaattttttttgtttgcttcttaatatttatggggcagattgagtcgattggaacggggctagtcgttatttaaaaaaaccatcattatgaaaatttttgtcgaaaaatatttataattttgctccaaatcaatcatatttttaattcttaatatcatttgatagccctaagtcttctgtatcagtctgcaaaattcaaaaaatttcgttaagtttcaaaaaagttatagctcgaggaactcaaaaacctgtgttttcgaacctttttggccatatctttttttaaagttaataaatttttttgaaatttacaggctcataaagaacgcttagttttatcgaatgatattaaggattaaaaatttaaaggttttagagcaaagttataagcacaaattttttattttg

SEQ ID NO: 14958 - DNA, 1646 bp, Heterodera glycines
  misc_feature (1601)..(1601): n is a, c, g, or t
attttaatatttaaaatgaacaaaaattaaagcataattcatgacgccatttgcacttctctatgaaacagcaacaaataaataaattaatccatgcaaatactgaacgatttcttgtcctcccaactttgattccccgtaaaaacggtcgacaaattcaattggcacctcaccgatagaaaagccgcccttttttgcccgaaacatcatttccatctgaacgaaatgtgaaacaattaagaactaattaagggagggattaattgtaagacctgaaaaacgtatccctttgacactgattcgacgacgagttttgacaaaacggactttcgatagagacggaacgaaccagtcaagtcggagacgcccggctgaagaaggaactgaaaaacaaattataaaacgaattccattctcaaagtttccagggaatttacttgtgccaaaaagttggctcctcggctgatcattttccgtctaaagtcccacccggacactccgccgcccatcgcataacgcgttcccgtgacaatgtcatagccatgcttctcctgaagagtgaccatctccggaatatgcctcggatggtgggacaaatcggcgtccatcaaaatgacaaattcgccctgtgcttgtttaagcctcaaatcggaggagtctttcgggcacataaaaagctagtcaaaacaaacccaaaaacataggcacttcccaatccgagtttgccttccctcgtcaacaatttaattcttcccgctccaaattctttctgcaaactttttgcgacttcctatcaataaaaacggattacacaataaaatttggttttaccacctgtgttccgtctggactgttgtcatcgatgataatcacttcataactcagcccctttaaatatctaaaaatttataaaatgtttaaatggggatcattattagaaatttattgttttttctacttgattatcagccagagacaaatgggaaggttttcagcttcgttgtacctgaaaatacggaaaaatcatgaaaaatgacagaaaataagcaacaaacgtcggcagcaaaatggagaattttggagtcaaaaaagtgttttgctgctttcgtccattatcctgatgagaatcatccataatctgttgaaatacaagagtttaacaagaaaaaaagcacttttacctaattgaaattttaattacctaatttttttttaaattggcattttatccaatttcactaatctgaattactcttgcactcgctcttaatttgactttgcttttgcttgctttgcacttagaaacgtggaaaagaattttaatatgcttttgacattattgtttcttcgttgttcatttttgtcttaaaattgccttttagtcgtctttttcaaatgcctgattatgatgaaaccactgatcttcaactttgcttcaataaaactcattttcaacgttcggattttaacgtcgaacgatttgtgaatttggcaaggaaacgcgtgactttggatcagctgcaaaatgacctgcgaatttacttgcggcatctccaaaatttcatggttgaactgatcaatgatgattatgccgactttgntaacctttcttctggtttggctgctttgcgtgattcagtggaaaa

SEQ ID NO: 14959 - DNA, 2115 bp, Heterodera glycines
tgattcagtgggaaaaagtttcttcggatgttcgggtatcttcgcttaaaattggacttggcttccaaattataagacaaatgaaagaataaattcacatttagaccaattaaattttattgtaccaaatgaaattaaaattttattttttttaaagattaaaaaacattttcaaggcaaattggacttcgttcaccacttcgattgccgaaattgaaaaatgttcagatgcaattgagcaaaatttgtccactttggtccgctgccaaaaattgcaaatttgccaaggagacaaactcgcgctgcttcaatccattcagaatttatgtgcatttgtggagggaagggctgctgacgacgaaccaacacggaaagactgtgccaactcattatggtcggccggcacctctgttttatttttaaaaaataacaaaacaacccctaaaggtattcaaaattggccctgctcatttccgcagtcgaactttggtcatcacgagtcaaaagcgagcacattcagccgatatttcatgtaataattcagcaaaatattaacaaaacttacactatttacttttatagcaaatgaaaatcgattgttacagaaaaatcagcgaatttttgttggattcattggaaagggaagttttcggacattcaaaagaggtccaattgcaaaatattgtactcaaattgagtgcatttaattaatttagtgcgataatttgtccgttttggtcgcattaattaaaacgattaacgcaaatgaattggctatttgtcgtattgtcaacggtttggtggagaagaaaattgtgctgatcggcgaggtgaaaggacaaaaattagacaatttgttggaaaacgcattgaggcaaatcattgaggtgaatttttaaaaaaataacacggaatatttgtgaaaacaaaatttgatgaacaataacaaaaaatccaaaggcatttaattcatttttgaatttaaggtcaggaaaagctgtgccgaacgtgcaaaaaggaatgctcaatttactcgcgaagtggtcactttcatcgacacgtgtcttctcaatttcgtcagctctttccttgaagaggtaaagtccaaaatcccggattttagttaaaatctttgggctgttacccctgtttataacgcatcactcataaaatatacaaataattatagtacaaatattgtaaatctaatttaatctgtttaaacaaaataatatctgtgtttatggtataacatagaaatggtcagtaaagaccgtacacatgcagaattttctgtatcagcaagtcgataacattttccaggattaattgaatctgaaaactgaattgagattctcttaagaatacacttaattaatctattacattttattctctctccctctttctctctctcctctcactgtctctcccctttctctctctctctaatccccccccccccctttttccattattttcttcctttgtttgatgtttttgctgttgattttgacctgatttgtgtctgttgcgcatgtttcgtgtatgtaaatcactttgtttggatttgtgttcagcgatttgaacttttcttcgatgtattggatttggtcatcgtaagagtccgatcctttagggttttttttataattgccatttcaatttggctttgatttaccgcaataacttttgaacagacaaccgatggatgttttttttattttctccatgaacagatcagttttgttcagaaaaaggatgatggccgtttcatagaaccaccgcgaattgcacaccgatcggaacagtcgcatactttcgatcatccgattctgaaatgtggcagaatcgttttgcaattttattgtaataattgacaatgaatggtttcttttctaccgttctgtcgtcttcgtataatttctgatcgaattcgctgatggcaacaacaaataaaattgcatggacattctgttcgttaaacaattattacttccttttttctcttttccccgtctcttacgtcaaaacaatggatccatttcttccgttcgcttctttgtccgccgagaaggaacactcggaaattgactttctttatttcgaatttca

SEQ ID NO: 14960 - DNA, 1272 bp, Heterodera glycines
tttgtataattccaaggggaatttcagtaattacaattagtttgaacccatcctcccccccccccccactccttatttttgtttcgtttaccatgattatccaaaatatttcttcagcgtttttaatgggtcatttttcttatgttatcaatgaaaacggacttttcccggcataccattggacatgtttttcaactttcccatttctcaggcgaaaatgctccacgcgtacacccaacggaaggaggacctgaagtacttcaaggagaacgacgtcatggccaaactgcgcccgaaaaactttgccagggatttgtcaatgggcgacttcaattacttcccctgggggtattccttcggagcgcactgatttctgcggagtacagaaaacgaaggtggacaacgcatttgcgatgccaagcacagattaggacaatgtttgttgaaatgtaccattgctattatattttgtgggaagtaagagaaataaaaggctagccttaaattacgaattgcacaaagttcttttgggcaatagataaaaactttggctgagaaagcaaaaattcgtccggcgaagtttcgactgtcgtctttttgtactgttccgacccataaacgtcgtattgcaaaatttactttgagtgacttggtttttaaatttgtaaatttttaatattcctgtggtaccggcaggtgccaccgcagaattttgagaaatttgttacgaaagttactaattaaaaaattatcatttagtgggcaattgtcttgtcttccttctttttcccccttgtctctcttctaactcttttttctcatgtttgcttcttttctccagttgtctttctttcctcctcctctctctttctgcctttctctctcctcccctctctcctctctctctctctcctcactcactcgctctcccctctctctctctcgctctctcagtctctctctcgctctcttcgctctctctctctctctctcccctctctctctcttttcttacctccctctttctctctctctctctctcgctctctcagtctctctctcgctctcttcgctctctctctctctctcccctctctctctcttttcttacctccctctttctctctctctcactctctctgtctctctctctctctttctgcctttctctctcctcccatctctcctctttctctctcctcactctctcccccccccctctctctctctctctctctctttctctctcttctctctccctccccctctctc

SEQ ID NO: 14961 - DNA, 1342 bp, Heterodera glycines
ctctctccccctctctctctctcctcactcactcgctctcccctctctctctctcgctctctcagtctctctctcgctctcttcgctctctctctctctctctcccctctctctctcttttcttacctccctctttctctctctctctctctcgctctctcagtctctctctcgctctcttcgctctctctctctctctcccctctctctctcttttcttgcctccctctttctctctctctcgctctctcagtctctctctcactctctctgtctctctctctctttctgcctttctctctcctcccatctctcctctttctctctcctcactctctcccccccccctctctctctctctctctctctctctttctctctcttctctctctctccccctctctctctcccctctctctctctctctctctctctctcactctctctctctcgctttctctctctctctctctctctctctctctctctctctttctctctcttctctctctctccccctctctctctccccctctctctctctcctcactcactctctcactctctctctctcgctttctctctctctctttctgcctttctctctcccccctctctctctctcttttcttacctccctctttctctctctgtctgtttgtgtttttccttttctacctccccttgtttctttgccttcgtcttttccattatttttctttatttgttttttcgtaccattcggcgccattccctcccccatttttttgctccttcttttgcccacacaacacacacttctgttctgctgtcgttgtctgttgtctcttcgtttgccttttccttttgtttctctctctcttcccattttttctctctgtttttttttttggctttttccgttcgcttttaattttctttttgcgaatgcgttgagtgatttctgtgtgtattatagtatttcttctcatccaatgaatttcttattagtgtatttttttgtgtctgcggtggaattggcgccccggggaaattttgaaaaaatgtcgcaatccgcgggccctccccagcagctgaccacagctcataaccagggctcccagatcaaaattttcaaaagccttatttgcaaacaaaaaagttacaaaatttattcaaaacacgtttaaaatgttcaaatgttatatttttgattttccatgatcaatttgagcaattttttattagaaataagcattttgtgaaattctgagctctttaaagggaatgattttttgcggcacttttttcaaaaactctttaaagtaatgggccggcggtgccgataggcgccgccgggaaa

SEQ ID NO: 14962 - DNA, 313 bp, Heterodera glycines
  misc_feature (23)..(23): n is a, c, g, or t
cttaaaattcagcgtccgaattncaattttgcacaacaacactgttcgacagcgaccattttgtgaatggcgaataaaattggcgaacttttgagaaaaccatttggaaaattgtaatccccgctggccaaatgtccattttcggggtgacctgacattagaagaaattacttattattagggatataaattatatgggtcggggtcgttttcgtacaggccgttttcgtacgagcacaagtttttggctataacttttttctttgccaaccaaatccaacattgttggtgtcattcgatagccctatgtatc

SEQ ID NO: 14963 - DNA, 2563 bp, Heterodera glycines
  misc_feature (2526)..(2526): n is a, c, g, or t
  misc_feature (2552)..(2553): n is a, c, g, or t
atggaaagaatttagagcaaacattaatcaataagttgggtgtgagtttcggtggcgcaaggagtaggaagcagaattgtcaaccgacaataagtaagtgagtagtataagtccgcaaatgtggtggtaagattttacccgcactattgtgcccttcgcagcgcgcgccggcgttcgccccctgacgtgcccattgtgggagagtgttgtgaccttcgcggcgcgcgtagccccatttttttgcgcgagttgcgcgctgatatttcacaaaaccatgcgagttataatatgattagtcgcgattatttgatttagtaaggttgcttttgtattcaatttacttagatatataataacatatttctgtagttatttatcttatagaaggggtaataaatagttcttgtactggttttttcaagtgctatcttgctgttcagctaattttatgtcatatccttcgtcggggtgttcggagtgtgtaatgctttttttttgtgaaatcattgatctgaagatgacagaggtcagaggacccccccccccctgttccacaaaatttttggaaaaagcgcgccgcaaaaaaagcgtttttaaagcagaaaaaaaggagtcgcaaattaggaaaatgatcagtgaaaactagagtggtacgggaccgggaattttgggaaaaaccgtgaccggtaattctcgcccagacccggtcccgacccaccgtagtgaaaacaaaaaaattggaaaaaattcattccggtgaaaaatacaaccatttttcattgcataaaataaaaattttaaatgtccttggatttcatgaattttccccactatgtccttgcaaatcggcatacccgtccttggaaaccgacattgggcgatcccatccctgactaagaagtattttattatattttatttattttgaagagttataaaaataaaactccttttgggattcgggaacaaagggatgtcacatatttcgagtggaaaatttattttcactaaaaacttgaattgaaacatcattctgaggaggttgaaaaataatcccccatgggggataaaaaaagcatatacggtacatatgtattttcaatttattgttataaataagcataaaaattgtgaattttcggaaaaaattggtttttttctggtttttatgaaaatttaacaaattttttggaaaattttggtgagattttcgttttgacactcttttaaaaacccaaattattaaatgattgtcaaacattatgccatttatcaaaatcacaaaatttaacagattctgctgacggtttcccacaaaagcctcaaagcctcattttgaaaatttagcctcattgacctatcaaaaaaccacaaaatgaggctaaagcctcatacctggagccctgattttttataaaaatagaaagaatattttttcgaaaaaataaaaattctatttatccccccgggcagataaatagagacggggagattatttttcaacctacttcgaaaggggtagatatttggagacgggcagattaattaagacggacatataattagagaaaatacggtatttgtcaatttttatgttacggatgatatcctcattggcatcttacccattattttgtttattttgtttattcataaaaaataaaaaagtcaacagaagggcgaaaaccacttactctgacgactattccggtaaatgtgtcgtagagtaagtgacaaaatatatggatgatcacaggaattaaaaaaagtacaaaaatatgtgaaaataaataataaataaattgagttcaaagtcaaatgaggtcaaaacataaaattaccaaatcacttagaaatttgttacattctagctttcccggtcttacatattaccctagtgaactttaagttttattttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaattgaaaatagtttcagatctgttcggccataaacaattttatgcgccatgaacagatcaaacagttttcgcctattctcaagtgttggcagttgcaggtattctaatcgattttggtatggaattggcggaaggctgcatttaaaaaatacccttttggtgaaatatttttgacacttcgatttttttaatatttttttgaagagacggattccaaacctccggagcgtattccaataaaggcctaatataagttttgtataacgtaatccaaatcttagacgatttggatttaattattcgaaacaaggaacgcatacgtaaatacgcattccttgttatttggttaatatgatcggaaaattgtaatttgttatcaatgtttactcctaaatccctaattgtatccacagcatttattgtatttccatcaaatttatatgttttcttttgngttttttgaacccaatataatacaannagtttttgaa

SEQ ID NO: 14964 - DNA, 1109 bp, Heterodera glycines
  misc_feature (1090)..(1090): n is a, c, g, or t
tattcattatttatttaatagtaagattttatttgtaattattttgctagtgaaactttaattttttaagcaaaggaaatccggtcattgtcataattagttttgggatttttagagattaatttttattagatttgtaaataatattttcaaatacagtcatggtcattatgtttagcatcaatggtattttatgggtcagtttataaaatttagtattagcactgatgctaaacatatgacaatgactgtatgactttttttcattaaaaatctatatgcctttaatatgttatttattatctgtcaatattcatgacttccgaaaaaataaattttcatggattttcagagaacaaagaattaaatgataggaattttaataataaaattatgaaagtacataattacatactaattcaaaaaccaaataacaaaaaagcaagggcaattaaacatgattactgattattaatattaaattaaaacaattttaattgccaaatttataacaagtttaaaaaataagtaaaatatattagaattttactttaatatttagacctataaaaattttattttaaatcataaattaagaatttgtaattatatttaaataaattgttatgaaattgctatataatcatattataaataatttccctatgttggagaagagcaaagtacattttctcatggtcacttatcgattgacatttgtccattccctcctccgttcctcccacatcacatttgttatttaaaggcgtggactcttcccccctcgttcacttcttctcctgtcttcacttttattattttattcattctccatccatccattcgccattttattgttatttgactcttcgtaaataaatcattttatttgttggtctttctcactcggacaaaagacacaacaaatttggcgcagtcagcagtcgtcttcaaccaacaagaagacacccggactgcacaccaacaaaaccaatagtccctagacgggtgaggtctgcaaatactgcagtttttcgccatcaacaaaaccaatagtccctagggaggtgaggtctgcatatattgcagntaatttgccgaaaaaccac

SEQ ID NO: 14965 - DNA, 1819 bp, Heterodera glycines
tggccattacgattttgaaatacggtacatcaacaccgcatcatttggccaggctgacgttctctcgcgcctcatcgccaattatccccgaccagaggaggatattttgatcgccaacatctgcaccgaaaccgagtgctacatcagcaccatgctgcaaaccaaaaccgaacaacttcccgtcactgcagacgagatcgcagaggcgacaccgaaagatgagattttaaagaaaattttggcattcacccaatcgaattggccaaagaaaagcagcgacccggacatcgcaccgtattttccgaaaagggaaaacattttggaaattgagggctgtttgctcttccaaaatcgcgttgtcatcccccaatcgcttcgcaaccgaatgctgaagtccctgcacatggcacatcccggaattgtgcgcatgaaagcactcgcccgccaacacgtctattggccgggcatggactcggaaattgaacggattgtccgtcagtgtgaagaatgccaaaaggcgcaaaaagcaccgatcaaggcaccgctcgccccttggactccaaccgacaaggtgttccaacgggtacacatcgattttgcgggaccatgccaagacggacatgtctacttcattttggtggactcattctccaaatggcctgaggtttaccaaatgaactcaatgacggccgcggcaaccgttttcacaatccgatcaatcatccaccgactcggcattccagacgaaatagtttcggataacggaactcaatttcgttcttccgaatttgcgtcactctgtaaggagttcggaattaagcacacttttacgccgccattccatccccaatgcaacggacaagtcgaacgtttcgtcgacactttcaaaagggcgatgatgaagtgcaaaggcgacaagaacagcctcgaaaaagtgctgctctcctacagatcaacgccaaattctgccatcgacggatattcgcctgatcagttgttccttggacggaaactccgcaccaaattggcacttgtccacccaaaaggacaaattgatcagtcggaaaaatttgaaaaaggtaagttcaaacagcatcaaaaggactactctgccaaaatggcacagcaattcgatcggaatcatggcacaaaagctattgagttcctcccaacggatcccgtcctgctcttgaattatcgtcttggaaaaagccattggcttccgggcacgattgtggaaaggctcaacaattcgcctacataccgtgtctacgttccaacactcggctgaattgtccatcggcatgccaaccagcttcagcgccgattggattttgaggacaattcaaattgggaaccccccattcaggaacaaatggtcaatgagccaaatcaaaggacaccgccacgccaaaacgcagcagccaatcaacggaccacacctgttgatgatcaggctcagcaaaaggctaaaagcccaatcggcgtccgacgttcacaacgcgtgccgaagccgatcaagcgattctcgccaggttgaaactgaggatgtttcaatctcgagaagggaggtgttggagaagagcaaagtacattttctcatggtcacttatcgattgacatttgtccattccctcctccgttcctcccacatcacatttgttatttaaaggcgtggactcttcccccctcgttcacttcttctcctgtcttcacttttattattttattcattctccatccatccattcgccattttattattttattgttatttgactcttcgtaaataaattattttatttgttggtctttctca

SEQ ID NO: 14966 - DNA, 3864 bp, Heterodera glycines
  misc_feature (312)..(312): n is a, c, g, or t
tttttgatcaagcgcttccaattcctcagctgtttttttaagttcctcgaattttttgagtttctcttcgtaagcgttgcgactgcgcaggaattccacctaaaaacatcaagaaaataaggtgcattatttgctttatcctttcaattttggccatcaggatttagaaagctatggctcagtggtttttgtaagaaagtgcgaagaggggtggtggaggttcgagtcggcttcacgacattaatattttaattctttttttttcattttgatgtagtcccttgactacaagaaaaccctgtaatactgtcnggtggtaacccccccccccctccccttttaattaaaaaaaaaaattcgagattgtttttgtggttcggtttttaaggccggagaacctgattctaacatttcggcccattacgaacccctcatctacagtaagtattacgaaaacccctcctcatgtcaggaacaccttttccttcttgaaattatctataatttttgtacaaaccaaaagaattccccatttgggtcataataaatttcaaaaagttgaattgtttgttgttgtacctctgcacaaatttcgtcaaatgatttcaaatttgatgcctctcgtgaaatggaattgctttggactgacagctgacgacgtccaatggcacttttaaattcggatggcattttcatctgattgaactaaaaattggcattttcagaacagtgccaacacattttctcctcattgtaataaaaccttttgcttttgcaagtcttttcccgtcgccaaaaagtgaaccgaacgagaaaaggacgacaacaatttagaaaaagagcagcgattagcaagcgtattcatattgcgtaaaaaactgcagaacaacggatggattaatttcgaaaattaaatttaaaataatgtaaaagtcgtaatttgggtttggcatcaggccgagataagaacgcagggattgaaactcgttttgccgggaattgagtctcaaccctgggtcaaatcctgatattgccggggttccgatcctggcccttttttttaaaaacctagaccgggacccagaaaatcctgcaggatccatccagatctaatccgggctctaattagcaactcattgaaaagaaaagcaacgaaaaaaagttgaaatttttaaataagtttaattaaaattaaaacgccataaatttgatttctcaagcgcaattttcaaattataaagaaaagtaacaaccccaaatctggccattattttgtctaataaaaattaaaaaacaacaatcaaatacgcccgcttttgactttcattgcataagcaaatctgtgccccgtattgagtttctcacaggccactgagacacatgcaataaaccagggcttcgatcttaaaatttttaaaatcctcatttcagccataaaaaatcctcatttgccactaaaatacctcaaaaaatcctcatttggcatgaaaattcctcatttttttaaacatcataaattgcgaacaaaattagttaactgtcatacttttcgtttgaaacaatcaaattcatcaatttcttgctttcatggacggtaaaaaaggaaaaaaagcgccaataaatatttttatggataattattggcgttctgttacatttactttttatctttgtttctctcaattttatgtactatcttgccttattttcgttttttagtttgatcacatttgatcagccataacttgcttcattcccaactaaactgaacaaatttgatatctaaaaaaagtttatgaaaagaagaatcttttgttaagcgaatgctaagcaatttgacatatcagaaaaaagttgtaagaatttcaaatttttatcaggttataactcaagtcctaaactgtggatttcaaccaaaatgcggaaaataatcatttctatattgattctaaatgtctaaagtgtttttgtacctttacaaccaaaagtattagaattttcgaatttggtgtttttcgtgtgttagagatgtgaaaatagtacgccaaaaggagagaaaaagaaagacttttttatgttttatgttgtaacttttgagtttaactatagaaagaattaaattcactatagaaagatgcagaattcttttctctatcgatttgctaaatttggtgaggatttaacatcaggaaaaaaaagttaattattaagaatgaagagatagtacataaaattgagaaataaagataaaaaagaaaaatgacagaacgccagtaatcaccaataaaaatatttattgccgcttttttttcttttttaccgtccatgatttataagcattttatggagtctgagcacggaaaatcgaagttgcaatacagtataaataataggcaataatggaccaaacgataatgaaacagcaacacacataaataaaaaagattcgatcgcgccttttcattttttgttcctgctcgtcagctttgcgactgcgctgcaaatccgcctaaaaaataaagaaaaaaatgcatattatctcttatacatcctttcaatttggcctccaaattttcaaggtcggagaatccgattttaacacacatatttcagcctattacgaacccatgaccagggattctagcaaaaatttgaaatttaatttttcgtcaaaaattcaaaatacgcaacaaaaccgtgaagcctaagcttgggcctaagcgtaagcctaggctaaagtccttgaatttttagtttcgaattttgttcaagttcggatcaggggttcggtattctgaaaaattaaggtcatactcgttaatcagcgccacaaattaccatagaaaagagaattttatttaaaaatttgaataccaaggaaccactggcatatttccaaagaacaagtttttggtcgagcgcttccaaatccgcagcgatttttttgagttcctcgaatcttttgatttccgcttcgccaaatttgcgattgcgttgcaattccaactaaaaaattgaaaaaataaggtacacgaatttatttttactagaaaacccggtgatattgtcgatggtagccccattttcgtaaaaaagaaaaatttaaaaaaaaatttcgagacttgttttttgggttttgaatttttgttcgatttcaggattcgaaatggattgtcagccatgggttctgcgaccctgaaaaccacaaatttttttcttttttagacaaacaaatttttgatcgagcgcttccaaatccgcagcggtttttttgagttcctcgaattttttgagtttctcttcgtaagctttgcgtacgcgctgcaaatccgcctaaaaattaagaaaataaggtgacttttactttacttaaacatagagttgagcgggaccgggaattttgggcaaacccggaaccggggacctattcgggttgaaaacccgggaaaacaccgggactagtcccggtcaaaatcgggacttcggtactcagttgtccgtgttcaggtcccggtcccgctcaattctacttaaacatttaattttggccacaaaattcagaaagctgtagctcatttgtcagtgggttttgcaagaaagtgggaagagggggtggcggaggttcgagcccgcctcaccacaacatcaatattttttatgccctggggcataataattcaaaaaagttgaattgtgtatgtacctcagtacaaagttcgtcaaatgatttcaaatttgatgcctctcgtgaaatggaattgctttggactgacagctgacgacgtacaacggcacttttaaaatcggatggcattttcttcggattgaactaaaaattggcattttcagaaccagtgccaacac

SEQ ID NO: 14967 - DNA, 3743 bp, Heterodera glycines
ctgatctccagcttaggccttccatggttggcttagtcattggctctttgctcgtcggcgccgcttttggtgcttttttcggtggacacttttcggacaaatttgggcggtataaagtgacctttgtcaacgcatttatgttcattttcggcacccttttgtccgctttggctccgagttttgaggttgttgttccctctgctgttttgggcttcacccccttcgtcaggtgatgctcttctcccgggtactgctcggcctcgctgttggctgtgcttctgccacagtgcctgtgttcctagccgagctggcgccatctgagaagcgtggccagatggtaactcggaatgagctgatgtgtgtgacgggacagcttatcgcctttctcagcaacgcaattcttggcaatgtttgggctgacaatttgcacatttggcgctggatgctcgttttggcaattgttccagcatttgtgcttcttttcggcacttgggcctttgttccggaaagcccacgatggcttatggcttcgaacctgcataatgaagcatttgaagtgctgaaaagcatcagaaccaacgaagaacaggcgaaagcagagcttgaagaggtgcagcaacttatagacgaggaccgcaaactgcaccaaaacgagacaattagtcaaataatttcagagaggtgcctcctctaattgccatctgagattccttttaaccctcgaagatgggcccgccaatgcctttttattggccttggcaccgcactgtgccaacaagtcactggggtcaatgcaattatgttctacgggacggaaattctgcagaagagtggcatgtccaacaaagctgcgctgatcgccaacatcagcaacggagtggtctctctgctggcgactttcgttggcatttggctgctcagtcgcagctgccgacggcctatgctaatgtgggctcagttcggcacagtcattgtccatctgatcatcggattttgcaaccttttcatgcatgaaggttttctcaagggcaccgtgattctgactttgtgtgtcgtatttcttgcctttcaacaggtctttcccccccccccccgacccttttaaaattgcatttccgtccttagggctctatttcgccggttacttggctaattttggccgaaattttccccttgcgcattcgcggcatcggcatcagtctgactacattcgtcctttggctgatgatgtccttcattggcattctgttccccattttggctgagtccgtcggcgtttccgccactttcttcgctttttccgctttcaacgtttttgctttacttttctccattttttggctacccgaaacacgcggaaagtcgctggaagagctcgagaaggaatttaaaagtgaagattgggaaaagttaaaacgagcgggcgacttcaacttcgatgagaacggttctgaccaatcggacggaccaaaggacgcgccgttgcggtacgggtcggacagagagaggacggagttggggagaaatgccgaaaacggaagagccaatgggaggagaagcgacgaatagcagcgaatgccatgccgatgacaaaagttgatttctattctctatgttgtacatacggaacaaagaaaatttttagctattaaaatagtgaaagctcaatggcaaagggacaaagggagggaaaagggagtgactaatgggggaggggaggcaatggcaaaggggggagagggcactgacggcggagaagggattgtcctccgctgattgagtctcgggatttccaattggccttctctcctcgtctgcagttccttttccctttttttgccatttatccatcgattgggtcaatgcttttcctcggctgctccgccctttgcccactctttcgttttgcttttccaatctgtccgctaatgtccctcgccttggttaatttattccttctcacttcccttttccaaaatgggtttgtttctttgacataaattttaatgtttttacttatcataattgcatcattttatacaaatgatccgacccaacattgttcttctgatcactgacgatcaggacattgaattgggttccatggcatttatgccgaagacattacgcctcctccagcaacgcgggacggagtttcggaacgcttttgtgtcgacgccaatttgttgtccaagcagaagcaccattctcaccggtctctacgcgcacaatcataaagtgatgaccaacaacggaaattgtgcaggcgaagaatggaggcaattagggggggggggggagagaatgacattggcaataaaattgagcagtccaatgctaaggtctgacttcgaaaaggacactttcgcggtgtacttggaaagaaccggcttcttgacgggctttttcggcaagtatttgaacaattacgacggaagttgggtgcctcccgggtggacgaaatgggccgcgttggtgcgcaacagtcgatattacaattactcgcttaacaaaaacggacacaatgaatggcacggaaatcgttacgaaaatgtcggtccggcgattctgcggaatgaaagagacgtttaggactacttgaccaacttggtggccaacctttcgctgcaattcatcgacgagtctgttttgctgaacccccacgggcagccattcctcgtcgtcctcagtttccccgctccccatgggccagaagacccagcaccgcaatttgccgaccttttcgaaggggtggaaacgcatcggtagggacgaaaagaaaccacagctaattgagcacaaaggactgattcgtggaactacgcgcccaacccggacaaacaatggctgctgaaaaggacggggaaaatggagccgattcacgtggcattcaccgaccaaaagcaccggcgaaggctgcaaacgctgcaaagtgttgacgatgccgtgaacagagtgccgctgggcattacaaggtcagggctaatgaccttcatttagctcgtccaacaccttcgcttccttaaccgactccacaacacttttattttgtacaccagcgaccatggctatcatttaggccaatttggacttgtcaagggcaaatccatgccgtacgaatttgacattcgcgtgccattacttatgcggggaccaggaataccacgcgggaaaatgtgtaaaatttgacgggaatttactgtaacacattttaatgttttgtagaattcgatccgttgtatccaacattgacattgctcccacaattttggacattgcggggctaaataatgccaaattggatggacgatcaatgctggaattagacgaaatcaatggcataaataggagaaaaaaaatggcatggcgtgaaacggtgcttattgaaagagggtaaaccaaaaaggagggggggggtaattggaaattttggaatttgcatttagtaaaatgccaaagttaaaacgaatcggagagagactgaagcaacagaaagaagggttgagcagaaagaagctgattcagagggaatgcgacaagtcaaagaggggcagcagcagaagcagcggaaagagttgtggcaaaagcaaaagggtcagaaaaaggagtcgctggcaatgtgccaaagacgcacacggaaaatggcacattattcgctgtcctctctcagaagaagaagacaaattatgtgaatgtgaagaggagagaaagagaggaaagagagagaaggacgcaagggatga

SEQ ID NO: 14968 - DNA, 2825 bp, Heterodera glycines
cagaccaagtagttgaagaacaattttttgccatacagtatcacaagctcttatcaaaagaggtttctgaaattctgattgagatccgtaccaatagcggcatcttgatgccattccaatacggaacatgtacattaacattacactttagaaaaatgtcctatttttaaatgatgaacacgttggaaattaacaaaacattgacaagaaacaacgtgactcgccactactatcttggttgttttgcagcagatcaaatacccgccggtgcaattgtcaaatttccccactgtatggtggttaatcttgaccccagcacatcacatggttctcattgggtgggcatatattgcgcttctcctttgcatttggagtattatgactcattggggttgtggccaccgcccagttttcacattgttgaccatttgtcacgctacaaacaaattgaatatagctctcttccccttcagtctgccaactcaagtgcgtgtggtcgacatgtcattttctttttgtttgtcgatgtgttggaatgacctttgaaaaaattgtcagctttttgcactttggaaagatgcaaccggataagctcgtaaacaattttataaaaagcataattttcaaagaatataaataataacaaacagcgaaagtatcaattaaagatgcatgttgattttgatcctctacaagtggattggtccacattctcgtccgagtatgtgcaatttggtggatacaacatttatcgggggttgccctatcagcgtggagcgggagttggcgcagtgttcagaagtcttatgagatacttgctgccgattggaaagcaaattggctacgcaattggatgtcagggaatggaaagcggaaatcgagtattcaccaacgtgctagagggaaaagacctcaaagagtctctcgtaagtgagagtaaggcaggactaaagaatcttctcgaaaaagcagccaacaacataaacatcagaagggtcaaggttttgattttaagcgatacaaaaaagactcggctcccaaaattggaaaaataaaacgaaaaaatataataaacttcaatcgttaatcgggccaccaatggttgatgagaccaaaaataaacgtctgcgtgttgactcattaggatcctattaaaaaatgacttgcccacaaaaaatcagcatcagcagtcccctagcaattaacagtggtctgaacattttctcagttcccccgaccaaagtgtctgttgtacgttctttctttcgttaggtgcttccgctagcaacaatcacgcaagaatcgccttacctatttcggctttacagtgacaatttgtggaccgatttatcgcgggtctatctttatctcgaactgtccattgaaaaaccgggagcaaacgataaatggattgctatagaggacgcggatactagtgtctctgccattcaagggattggtcaaacatttgtccagcaactaaaagttacggttggcaatacggaagtatacgatagcggaaacctatacccattcaaggcctatatcaccaatgagttaagctttccaataaatgccaagaaaaattttcttggttcaacagggtattattacaccgtaaaccaagatgactcaacagacgaggggttcaaagaacgttgtaagatctttaagggtggaaaaaatgcgcaattcctctcccgtctcgactttgatttgggaaaccaggagctttatctcttaaacaatttggacttgctgttcacaatttacaaagccaaagatgtctttctcttgcaaactttaaaagccaacgattcaaccaaatatcgtttgacagttcacgatgtcaagatttatgccaaaatggttgaggtacaaccttcactaaacatgagcctttacaaaacacttgagaaacaacccgccacgtacgcagtacgcaagaccgaaatcaaatcgtcattcatcagcgtcggtcgatacgaatttgagtataatgtcttcagcgcgaccattcctcggcgcgtgacaatcgcgttagttggaaattcagcatttcacggcgactacaaactgagtccattcatgtttgagccgtttgatttgcgtgaaatttcggtacatgccggtggggtggtctacccagctgttccttataaactaaatttttcaaaggatcactttgtcagtgcctttgttgacatgtatgaggcactcggaatggccaattcagaacgttcatttgacatttcaatgacccagttcaagaaaggatggaccttttttctgatcccattgacatccacgcttgacgacagctgtggatttgagctgttgagaagcggtacgacaaacgtacgagcaacattcaattcaccaattccacttggtggcgtggagatgattgtcttgggtgaattcgaccaaatgattatggttgattataatcggcacattgtgaccgactcaaagcttggataaaatataaataaaataaaaaaaaaaaagattattatgtaattttaaaaaatgaataacacaaatacaacgaaacccgccatccaaattttgaattctccgggtgaccaaaatgaaaccctttttcatgtactacttttttcttattatcttcttgcatttcctgtgtttttgcttttttggttcattttaattaggtggcttaaaagtcacggtcacttaacgccaagcgaggccgagacagtaatggaagagatgaaaaataacccccgacaaccaccaatattttttgcggcaaaatgacgcagaggttagagaaaacagacactgaactattctcttca

SEQ ID NO: 14969 - DNA, 2065 bp, Heterodera glycines
ggtcttgaatgatataatttttttattgaatctttattttgccataatgaagtttgccccgcccctttttttgaaaaaatttccatatgaaacaagttccctgagggtttttcaggtccctgatcacgaatccagaatcaatttcgaccaattcctaatcccggacccaaattcgaacagaaatatctaatttcgcttctttggtctaaaaaggctaataatatttatttcaaaataagtattaccatcgtttatgttatttggcgcacttttgaatctgacattccaaaacaatgcacaggtgggacacgacgaagaaagagccgaaatccatcttcaaaactgacgagacgttgggcctgcgacaattgccgacgctgctcgaatattcactgacccaaggacgccatgtggaggggcgaagagtggacttggacgaacaattcttgagcgtggagtacgtcattaatttctttctgaagcgccagttaaatctgttctgatgcggtgctatgcccaattaactgtgatagttctgtgatatgaacatgtgttgtatatatgtaatatatattatgtatttaatttcgattgtatatgtatattgtaattaaccgtattgtacataatttgctaattcacttgcattgtcgagatttatacagaatgaactaataattcgactatgtgattaaaaactaccaaaaatctttaaacgattattaaataatatttttcgttgcatttaacttatccattttccctgttacttgcgtttcttaattcttctaattagtgcgtaattgcacttacatacatatttgttagatcgtctaggtgcacactagagaccggacaggatcgggatcccgacctcgggatccgtcccgagcgattttccaaaatgttcgggattgatcgggttcgggatttcatcgggatccctcccgaccatttaccaatcccgcgggattgaactcacgataatttttcgaaaagtctccattttataattaagatcttgaatttttaattaaaaaatattgtaatttgctaatttttcttaaaaaatcccttaaaaatgccaaaaaaatttacgggtctccaaaatttcactaaaattctcaaaatttgacgcaaaatttggccattttgtgactttttccaaaaaagaattatcaaaaattattttttttaattcttaaaacattattctaaatcttattagcaggactgcaaaaaatatgaacgaagtgttgccaaaatatctcctgaaaatgcaccaaatatgaacaaaaaaaaacttgaaaattaggctcccggacaatccgtcagtaactaatctataagcaaatttattttaaaacacccagctttgtttgtaatcatgtgaaaattaatttaagtcgctaaaatcctgaattaataatttgtgttattttaaaaaaattatgaatttaaaaagaattaattgattattctcgatatggcaattaattgaagcatgaagtaactagaaatgttaagaagctataaaaaatttacatttattatatttaacaattattttcgcaaggtttttgatcattgctcaaaaaaaatttgctgacggattgtccattactgacgaattgtccttcactgacggattgaccactgacggattgtccggaccccgaaaattaggggtgcaaattaatttaaaaattttattcctcataattttatcggtttttttgcaattgcaaatcaaaaatttcacaaggttttcgacagtgaagctcactgttgatccactcgcgcatccattcaaatttggatttaattttaggcaatcaaaaattttttcctaagagtgcgcaaacacaaaaaagaaagtgtttttcctactattcagagcatggagaagccaggaaaaaatatgcatttgcatattttttgcagccctgcttattaggtagttttatggcacaacgatttctaagaattttgtccaaaaatcagaataaaaattgttgtctaggtatttttccttcggtgcctatcggcatcaccagacccaaga

SEQ ID NO: 14970 - DNA, 1469 bp, Heterodera glycines
  misc_feature (1462)..(1462): n is a, c, g, or t
agacgtttgaagcgaaaaaaacgggcaaaaaaggacccaaatgcgcccaaaagagcgctgtgagtttatttcgaggaaaacagttttatttaaaaaattttttataacccccaaaaatttttaaataatttttctaattgtaagggtattttggatgaaaagtcctaccacaattttttatgcattttcctccttttctgctttaggtcggccttcttctttttctcgaatgagaagcgtcaggaagtgtccggagagcatcccgaatggaaagtcgggcaaattgcgcaggaactcggcgttcgttggaaggcactttcggacgaagagcgcgcgatttacgaaaagaaagcccaggaggacaaagagcgatacgctgaggtgagagagaaaggagaacacaacggacgcaccccaaattaaaggacaaatttcaaatatttttttagtctttgacagattttggctaaaaaaccattcagattttttggcatattttggaaaattataaggccattggtggtccagaggctattcttattattagccatttaagaaaaaacaagtgatcagaaaaattaaatttaaatgcgcacggaaatgttgcacttaaattcttctttcaaattttgtcacttatttctctctaaaatggttaattttaacaaaaagtaaaatgttttcagtcggatggatttgaaattgacttttcctagggaaatggggaacgattgtcaactgttccgggttttcacgactttttaatcgctaaagcatcttttccattactttttgctgcaggaaatgcgtgcctatcgcaacgattctgctctgtcgtccggcacttgtcagaagccctcttacctggagggagggccgtccatggtcaaaacacccaatccgagaggattaaacaaaacaaaatgtccagttgattcagaccactgctgagcatgtgctgcagtcgcagggcggtgctcacgtggtgagcacatcggcgggcggacagccgcaaatggtcattctgcaacagcaaccgcagcagggacagccagggacgcagttgccaatgcaaatcttggtaatacaatccaatctagtgcattcattggccattttcagcattacaataagcagagtaaacgggagggattccccctccccccttggagtcagttcccccgcttggttaaaaaacatgtcttgggattggtccgtttattcgtcgttgttaaggaagagcacgtcagctcggcgtcagcggcacagcaatgcgcgacacagcagcacgcgtgaaagggtggaagaacaaaaagaaagaagaaaaataaatcctcatactctcccaccccaaaataatcaaaggccgtgctcttcccctccctcctccttttgtcgcattctcttttaccatattattattataacacatccattcgctcgcgttttattatattccctnattttat

SEQ ID NO: 14971 - DNA, 2151 bp, Heterodera glycines
atcagggctggccgtgattgaatttccaatcacggaaatccgtgagccgtgatcacggggctttaaaaaaaatccgtgacccttgaaccgtgatcacggcaccccaaaatccccgtgatttccgtgatccgtgagccgtgattataaaaaaaaattttctaatgattttttatttaaatttatttaaaaaacggaatttaatcgcgggaaaaattcccaaaaaatgttttaaagaaaccaaaacatataaaccgctttttttgcggcgaccttttccaaaaaatgactaagtttacgatttttggcaattttttgaggaaaattagagctttttgtagaaatctccaaggaaaattttttatttttaactaatttattaagaaaatttttcaaatttttcttaaatttaaccaaaaatctatttatgtagagaaaaaaaatttcctctaatttgtaagctaacttttgatgctgaaaaaatcttttggaccaacatgctcagtccttcatgacgatctgaacaccccaaaagatactgaaagtcgggaaaattttagaaaaaattcttagagggttgggaaaattttctgaaaattttgattaggcctgtcgttttaaatttaagcgacggagagaaaaaatagggtttttagcagtttatatgccaaaaatggtaatttttctgccattttggggtcaaaatttcaaaaatatggtaaaatgggggtccgtctgccggtggtgccgacaggcgccgccgggaaaaatttttgaaattttgagtgaatttgaacagattttgtccaaaatatgtccaatcattggttaatttattggtctatggacgttttaaaaaataaagaaaaataattttcaatgttatgaaatttcttgttaattaaatttcaattaaaattatcaaaacaaaatatataaattatcctatcccaatggggaattgaacccaagggacagacaacgaaagacagaaggattaaccaccagactacatatatatgtttactttctaatttgtaagcagggaagaatttatttatttttctcaaaaatttcttcacaccactttcctattttcgtctcaataaaattccctatataaaatgccaatcacggatcaaaatcacggaaaatttgaaaaaatccgtgacccgtgatccgagatcacggcaccccaaaaaccccgtgatttccgtgatcacggccagccctggtttcaatacaattttcatagggttaaaagtggaatatgatcactgataaaaagattaaatgaaatgacatcattcgagtctgaatgaatatgcaaaatatgaaaacaaagttcaagcatgaatctgagaagaacggatattatgcaatggcacaacaacatttgatccatgttctgttctgcaaacatatttgcaaaatgcttttcgatattctttgctaaaataagaaaagttattaatttttcttttcattaattaatgaattagaaaccacctgcacagaaaaagcacgggagtactgctggaaaatgccatcaaaccgagaccattactaatgggccaaacaaagtgttcaattgttaaaaagttgaagctgagcaatggcattatgccataaaagaatacagtattcttaaatgggaactgtaatagacagtaacagcgaatgaattagtgaccaaagtaaccccttaatttctgctcgaaaagataattgagtaccaaaattggtcttcgacaaaaattctgattattaaattagggtttttcattagcaaacataatcataattaaaataataatattattactccaatgaagcagatgagaccgattgacataataacactcagtgaaatcaataaacgtttgtttttttccaattctaaattaatcaattaagaaaggaattaaaaattgattaattaattttctcaaccagcaaatgattgtccgtggtgtccattacggaaatgattgaccagccaaatcaatgcataacatgtgaattcagcacaatatgttagtaaagctaatatattcgacattgaattagtctctggcagatgtgccggatcaccaattgtgcacatcactggtcttaattaggggcataaaaatttacatttaaattataatg

SEQ ID NO: 14972 - DNA, 1737 bp, Heterodera glycines
gatgggtcggcaattgctgtcctccgttcccccgaccgctttttgggtggcgacgctctttgggaattgcgcgacggtgtgccgcccacgccgttcgcttcccccattgaactcggcttcaccgttttcaagcagctgtgtctgtcgcctgatcagagggcgctttactgtctggccagtggtccccggagggcttcttctctgatcagattggacctgtccactgattgtcccacagtctgtgaccaccaaacgattaatcggcgcaacaaattgactgatcattttctttttctgtgctcaggtcgccgtcatccgtgaagcgcgtgcgcactccgaactctctcagctgcccctctccgtcccaacactgatcactttcaccgccgatggccattccctggaggggtatttctacgctcctcacagtcacacgcattgtgcgcccgagggcaaactcccgccggtggttcttttcgtccacggcggaccgaccgcatgcacaaaaaacgacttgaacatgaaaatgtgggtgattgcaatatttgggacttttggcaatccatcggaaggaattcgactcatttagacaatacttcacttcacgaggcttcgcagcatttgacattaactacagaggtgatcagaagaagaagaaaaataaaataaattgatgaaccaattttgggtgcctgagggcatgcaaaatccattagcattgttttggcaaattaattaatcacgctttcccaggctctgccggttttggccgtgagtttcgcgattctctgctcggccaatggggcgtcgccgaccgcgacgatttgatcggcggggcaaagtgcgtgtgcttcgtgccttgcttttcacatcctttgctttggttcatagatttctcatctcctccggcctggtcgacccgtcccgtgtgtttatcatgggcagttccgccggtggcttcaccgtgctcagtgttttggcccactcggatgttttcgccgccggcgtttccctttacggagtgtccgacttgggacagcttgccatggtgccagcaatccaaacaaaatgtcatgaaagtgtttcattttccccattaaggcgtcgcacaaatttgaacgagacaacacaatgcgactgatcgcccaactgcccgacggcatccaaacgtaccgcgaccgttcgcccattcacaactgcaatcgcatcaacaaacccgtcgcctttttgcacggcaccgaggacaaagtggtgccgaaggagcagagcgaagtgatgcacgaaatgctgagagccaaagggacgccgacgctgctcaaattgttcccgggggaggggcacggattcaaaaaggcggacacaattgcgcaatcattgcaaatcgctcactctttcttctgccagacaatggtctcttgagcacttagcaattcgtttttttcgtttttctaatttccatttctgattcttcaaagttagcagttgtttttgttaattttattataaataaacaaggaaaatattgtgggaagcatcaaaatgaactgaatgttcgtgacggcgaacagcgatctcgagaagtgcgttgtcgttcttcttgtcgctccgtccgtcttttcgttgctcttcctcctcctccccttttttcgttgcttcttcctcctcctcccctttttggcgccgcctaggaaaaattaagggattttcaatgaattttattaaaatttgttcaattta

SEQ ID NO: 14973 - DNA, 863 bp, Heterodera glycines
cccagagttaaaaatattggtgtgaacaaaaaaagtagcatatttccattttaatacatgtgaatcattcaccaccagcctcaagtcgttgcgcagggcatctgaactctttaattttacttgtgcaatggttccaatttacttacacagcacacctgcagcagccgccgccacaatagcgggggcaagccccttcacagcggacaccgtttccgggctccatggtgccgccgtcgttgttgttgatggtatcgtcgggcacggcgtccagaaggttggcgccgtcttagagttaaaaaaattagtttgggcagaaaaagaaaataacagatttgaaaattgtaggcaaagtgacccgaattccttttcgcccactggcttttgatttgaactagagtagagcgggaccgggaattttgggcaaaaccgggaccgggacttgccgggacctgagaagccgggaccgggacctcgatttttcttcgggaccgggaccgggaccaaccgggaaattaaaaattcaaaaaaatttaaaaaatttaactttaatttatttcaattgaaaataataaaagttaaattgttttttttatttaataaaatccgaaagcgataggcgccgccggggaaaattttgaaaatttgagtgagatttgttaacagattttcaacaaaaaatggcttaaatgaaatgaatgttcgtgacggtgatcagcgatctcgaaaaacgaaatagaattttgtaaattcagggttgggaaagtttttgactttttccattgtatcagaaaatttttaatgatcaaatgatcggatacaatcactttcaatcgcttatttaaagctttttatgcgatcaggga

SEQ ID NO: 14974 - DNA, 3775 bp, Heterodera glycines
  misc_feature (1661)..(1661): n is a, c, g, or t
aggaaagaggggcgtggaaaagctgaaagaccaaatggtactacaacgcattggacggcacgtgcaatcgcttccattacggaggtgcggggaaatatcaatgaaaaaaatttgataaatttaaaataatacccatttttgccaggtgcaaatttaagtcccaagagaaaacttttgaaaattgaaaaaatatttaaagaaatctacaaggggtacggtaacttgatcggatcaagttttgctgttttttgcttgtatccaaatccccaatcccaaagaatttgtctatctgtgatcagcccaagacaacaattctgatcacattcggtggatcaaacaatggcttaattctttcattgtttaggctgtgatggcaatgcgaatcgctttgacaccgaaaaacagtgcaagaacatatgttggaactacaaaggtgagtgagcatttcgtgctaatcattatttcaaattttaaaattaaataaaacgtttcttaaatccgtattgtggatcacataggattggtctaagtgatcgaaagctttgatcagaaaattttgttacaaattcctgcatttaatctgagtgaaatgtctgttccaaagaatagtgaaatcaactcagtaatgggctgataaatgcatgatggagaccaatgctttctgatcagcagattttagcatggacagtgaaagcaaattcgctgtcaatgctctgatcagataaatgggtgatcaatgcttcctgatctgattttaacatagaaacatgaaaccaaaactgatgaacgctgtcaattctgtgacccgatcaaaattcacacaaaacgtgtggcttaaactgatcagcctgatcattccggcactgcgattgactgatcaaaaaaatgataaaatttgttatcgttagacccgtgcgttctgcccaaagtcagcggtccatgtgagggccattcgcgtcgctttttcttcgacctgcacaccaaccaatgcctgctgtttgagtacggcggttgtctcgggtgagcattgtgcaaataattgccagattttcacaaaatatttttttcaaattattaaataaatccatttaaagatcattaataactactgttatgaaaaatttttgggtccgatacggcggcgccgaaatgtccctaagttgtaccaaaaaaaaaatatgacccattttttcagcaacagcaacaatttccacacgatggaggactgccaggcgcggtgccgtccgaccaggcccatgccaattggtgcgtgatgcgatacgccaaaaaaaacacagatattttgaatgacggacgacacactttgcctcaaaaaatttttgggcatttttaattttaaaatttccttttttttttaatttttgccatttttttttgctaccattatatggaaaaaaaacattcgcaaaaacattctgccatattgttattcccatctattttttttctctattcatgttgcgcctttccaattaaaaattatttttttcgtttcgaaataaaatttttcaaaatttatttgccaatttttggatttgccgttttttgctgtctaaaaatttttccaaaaaaagtactaaaaataactaaccctttggcctttgttttaattttttggtgtgtttttaacaaaaaccttnaactgcaactgatcaaatgcgataagctaacttcaagaaattaaccgattaaaaaagcgctaattcttattgattgatcaaaatatgctaacttagccagataaaaaaactgatctgaccagatcgcgcagagaaaattttgtgtgtgccgttccgcgctaatgcattcccctccggcacttttgtagttgccactaccactaacccatggcctatccgcttgactcgcgctaacccgtcaacaccaacaccagcagcagcagcagctgttgaactgcttgatcaccgtgatgggattttggccattgacaacaacaacgaccggctgatcagcagcaacagtgaccaacagacgccgcatcaacttgatgctgctgatcaacaaagtgatcagcagcaaaccgctgatattgttggtgataaccggagtgatcagcaaagtgaatggaaccaaaacggtgatcaaaagccgagtgatcagagtgaggctaatgatgaccagcaggaagaggtggagattgaagagggggaagaagaagaagaactgattgttgtgcctcgggaacaccttctttacggccaactgccaggtaaattgagtaatgatttactgtattaccgtaatcagtcagtcaactgcgagaaatgggcaacccaaaaacatgtccaaaattttttaaaaatctaccgcctaggtcttagcctgaagtcattccaaaaaacttggtcacatctaaatttttctaaaaatcctaccgcctaagtcatagttctgctgaattcaatcaaaaaaaaacaaccttataacctacaaattttcaaaaattttgccacctcccaaattccagaaaattccatctgtctgggccctagtctgcctctcaatttcaattttccaaaaattttacaaaattccccctcccccctgtgttgaagagttgtgcctgttgccggagcagcgtggcacctgttttggtgagcagttgcgctaccgctacgacgcgtcagtgggcgactgtgtgggctttttcttcactggttgtgacgcaaatgtgaacaactttgactcgtacgaggcgtgcgcacgcgcgtgcggtgcatggaaagcggacgcggtgtgcgagcggtcgccggacgcggggcgcgaccgctgcgacaccggcggcggcgaccatggtcagcgagttgagtggcgacagcgcgacaacagtaacatggcaggcggtatactgtatccataactcagctcataaatgatcagaaacgaattaaaaatttaaaaaggatattagagggaggaggattagcttatctcgaaatttgacatccataagattaagcataaaatttttgatttttcgaattttttgcgcctattttaattgtttatcaaatttaagctctcatagtcatctaatcataaaaaatgcaccaaatgttacatggttagtggagagattagtagtactaactactaagacagtattagcttaaactgacaaatttcggctgtgtaactttgcttaaaatattttaaatttttcttttaattttttcaatatttctaaaaattaatcgttcttctgaaaatgttcagaactgcactaaacattacatgaaaatgataattttaaaagattttgattataaatgttaaaaaatttttggcattttgttgccaatgtgttcgaaccgaaaacttcagccaacgtgccaaaatggtattacgatgcagcgctcggcaaatgtggcctgtttttctggtccggatgtggtggaaatgggaatcgattccaaaggtttctcggggaaaatttaaaaaattcaaaaatttccaccccctcccattttaaagtaaatcggagtgcgaaaacttgtgccgtcgcgaaatgttggcaaaaacacaccaaaaaagtgacatgtgcatgttgccaatggacgcaggaccatgtgccgacctagtgacaatgtggtattttgatgccgtacaacagcagtgccggaggcaagtacagtaccaatcaaaggatgggctgttacggcattctgttcaatctggccaaaaacctgatcagcatatcattccaaacagctgataacacctaattcttggt

SEQ ID NO: 14975 - DNA, 3532 bp, Heterodera glycines
taaggcaatgggggatggatggatgggatattcgttgcttcttttgcatgtgtgtagttcagcagcagaaatcctccaacagaggcgagtgggtccaaaatgcgccaatcgtttagccatttaggcaaaaaagccctaaattcaaattggatggacggatttgtgttcactcaagtcaacagaaaagcaagtgtgggaaaatgtatttgtaaatgtcaacattactgatcaaaagtaagcattgcacttaatactgagaaaattagatcacctggatcagccccgttattaggaggcgaggaattaattacctactactaaaatgaaaaatcaaattttcatatataaaaaatgcttaaattttttttttatccgaatagtctacccgaaaattgtaatactaaaaaaattgtagaacaaaaatgaagtctttgggttccctcatttgaattttttctgtttatgagcctgggacggatttgctgaatcaaacgcgtaattgataatcacagattaaatatgatttcaaatgctatgagagtcaatgcaatacaaaactgtccgtatatttaactacccaaaacaaaacaaaacatttgatcactgttagctgattaaattgctctttgatgagctttcaaaaatttgctgatcacacaaaaagttggctctgatcgatcagagaaagttgctgcatcgaacgagttttctcttcaccgatgaacattgtccccacactctcccccccccccaccctcacccacagcggggggatttacccatgcaaaattattgcgcagcactttctccgcatggctaatgatcactaatgatgatgatgatgatggtggtggtggtggtggtggtggactccgttctctccattcttttagtgtttttaagagaattaatgtattttttgataagcaaaaaaaaaacaggtgaaaaaaccaataaacaataaattttaaacatatgaataagataagagttttcggattttagagttggcaaccctgataataagggaccaaaaaacaaggtaatattttagtaatttatgattttgtccattttttgaatttttttttactggaaaagccgaaaaaatttctatgtaaatgtgtttttttaaatttaaaaacaatattgaaaaaatccaaaattcccactttcttctaatttcaaaaatcggatgcccaaaaattttttggcaaatttcaacgatgtcgataccggaatatagaaaaaaaattttccttaaacaatcttaaaaccgaacagctttcagaaatttattaacacaaataagtgacatacatataccaaaataatatacagtatacttatgaaaaaactataatacagtatgctttaactaaagtgcacagaaatctaggcggacagagattttttaggctaaaaaaaaatatttaaattttaaatattcgatgaataaaatagatgatggatattgcactaattttttgaaaatttttaaggaaataaatgaaagagttgaaaattttttatttttgcgactcttacccctcatagaaagtgtgaaaacctaaaaaatttcatggaaaattcgagttttcggaatcagaatttgtttcctgtttcatctgtcctcagagaatgaattatcactgtgataatctgctataataatcacattggttccagaaatggagcagccatgggatgatttcaaagtttttgaggcctccgaaaatgcaaatttaaaatttttttgtggacccagaaatttcaaaaaatttattcgattgaataacctcccctggcatacatttacaaaaaatttaatgggtcgaaatagaggtcatgtaattacgaccttaaattcccgtcatcggtggcaccttacagcacacaaaaatgccggatacggtagacggctggcaggtgtacggtggggtacagttaccataatcattgtaactatcgccatagtaatggtgatgccttttcactgcaccagcagttggcgatgctttgacgtcagcagacaaacagctagacataacgaaaatttgggatattgttacagtataattgagccgtacccacagtaattcgcctctcaattaaatggattacggtagttaaagtagtcttaccgttttgcatgccgagtgcgggggtcgacctgcggcagtcgcgcatcagggcaaaatgcgattggcgaacagcatacgcgcggcgcttcctccccttttgttgcaggctttcgtcgctgcacgtcacgcttgcaaacgaacgaggacgggcatatgccatgctgcacgctgtcaaggtcgccatgcagcgctgcagcagtgccacagctgcgcagttcgccagtttccggattcctgaaaattttgcaaatttcagaattttcaaaaaaaaatttctgttaatacctatatggttcacgattgtcagggcaatgccgcgcagtggtagcagaaataagtccgtaatttgttgtatttgttttggaatagtcacgcatttgctgtgccttggatgctcgccttaaatacagtaacaaaatttttaccgtacccaataatcgtgtttaatattttaattattcgggagataataaaattttctgtttttctctcattatttttcatttagcacgaaaattcttacaaattaattttcatgaattttcggaaaaatttcgtgtttttatttattttttgaaatgagtgtattaagtgcaacagatttacgagattaagcatgtgcttctctacctgttcattgggaacgggtgacagcacacgtacaagccgggccgattggacatggcacacgtgtaagagggagggcattccgctaaattggagagcaaatcgatgaaaatttttttgaaaaaaaaacaaaaactcacaggcttgcccaagcataacacaataccgtaccagttggcctaaataggctgcaaaaaagcgaatttaaattttaatccagattatggttagttggggcggggcataaggatatgtatataaattgcaatttaatcgctctccaattttagcttccgacatttactttaagattttactctttcatttttttgtggcaaagtaacacaaaaacttaaaaaatatttttcttttgtataagaattggattaagtcagttttcttaaataaataaaatgaatttttgtttaattcacgaaataaaaaaccaaaaaaatgaaaaaaatttttaatttatttctttttaaaatttcaatttttttatttttcgatttagggatggggggctctttcgaacatcctccaccattggcatttgtactgttctggccctggcactacaacccaaaaaaggccattgattaattgtgtgacccggcatttggccgtccatgcaataaggttggcccatctggttggtggtgatcagtccgctggtgccgggggggagcgcaggcaccagcgggcggcgctggagggaaaacgcgccaccggtgccgctaccgtaaccggcattactgcta

SEQ ID NO: 14976 - DNA, 1602 bp, Heterodera glycines
acaaattaaatttatttaaagtttcttatgtcctcccttttcttcttggattcatacgacatatttatatgtttgatcctatgaggtaaaaaaatgggaaactatccaaatgatcaagaaaaaaagaaacaattcataaatttgatcaaatttaagaaaagttgaagcaaaaaaagaaaataccaaaacaaaaaagagcccaaatcgaaggtaaaattggaaaattattaggagcaaatcgtgacaaaataaacaaatggatatttttagtgtaaaagataaaatttgaaattgggaatttgatttgggaattccaagtcaaactcttagaaggtggaagaagaaatttactataatttatcaattgatttttgatgataattaaattaaaattgataagataagcaagaaaaaataaataaatcaaagcctttaaaatcgtaaatgatgttgatttctgtccttagattaaaaacatatatatgacatttaaattcgattcaatccattaagtacaaatcttacgcctaagcacaataaaattgggtatccgtgccggggcacccggaaaaacgaatggatttgaatgtgtgaaattcggttccatccattaagcacaaatcttgcaccgaaacgcaagaacattgggtctccgtgccgcggcactcggattaattaaccctttcaccaagcttaacattataaaacaactatcgcggactaaagtaaaagagtccaattttcagataattaaggcaatttttacgaaaaatattcattggtcaacaatcattatttaaatgctttatgaattccgaatcgatcattctaatcatatcactttatctgctttctttctctgtgttttttctgtcttaatttccgcatggggcaaagcacagactgacgctgaccaggttgaggatgggcacacaaatctaaattaggcaaaatatgagcgaacaatttaaaaatttacattaaaagcgtggaaaataattgaaaaatcaaagacaaaaatagtttatctaatttggcaaattttaaattcgattggacatcattaatgatttaataaactttctttcactcaattaattgcatttatcaatagattatttttgagtaatcccactcaaagaaatgcaaattatactcaaatttggctaattaatcccattcaaaaaattgcaaattatactcaaatttggctaactcactttccctcccgtacaatctgcatcggtttgacatgttgtacaacagccgccacggtaatcgacctgtccctaaaatggtgcccaataaaggaaataggacaaaaaatggctaattaaaaataagcaactacttttagtggctcaaaaaaatttcaattaaattacgaatttcgaagattttgtaaaatttttattattttatatgtatcttcttacaggtggacagctgatgattgccacttctcttttgaatttctgaaaaaatcatattttaatatgaaaaaagtggagacggaaggattttgctggattcattggccccacatcctccatagtttttttggcattttatttacagcacatcagcagccttatgcgagca

SEQ ID NO: 14977 - DNA, 1312 bp, Heterodera glycines
ctggattcattggccccacaatcctccatagtttttttggcattttatttaccagcacatcagcagccttatgcgagcagggacgaaagaagcctaaattggaaagttaagcatttttttgctttatttaaaaaataaactggatttcttaaattgcactgattattcatccgtcccctcgggctgagaaatgggaagagaaattgtcgacattaaattaaagaaataaatttgaaatgccgatgtgcggacaatacaaacagaacaaacgtggcaaattcagagtatttgtaaattcccatttcatctgagtgaatgtttggcatttatttaatgccattttgaataatacaaaatatttttcatcgcccccccccttccccgccgaaaaaccgtcagcaatgtttcgctcggatgacaaaatatgttttggcgcaaataggagaaactttttccaaaccgagtctcatttcggagcgcaaaattcgtgaaaaaaaagttacgggtttataaaattattagaacaatttattgtatttgtttggtcttaaattgtgagaaacaacaattttccatattttacaattttattcattcgtttctttgctgttttccatcacttttaaaaaagtaaactcaataatttacttctaaatcattttcgattatttttattataaaataattaattggaaatggaaatggtccaaatgatcaaatattaaatatcagtgttataaaaagtgatcaaaacaagaaagaaggcgtcaggaaaaaataggaaattttttccagtttatcaacaatttttgtccaataaatgccgacggatgagaaaaatgaaagagaagaaaaagttaaaaaatggaacaaaaaaaaggaccaaaaggggaaaaatgaaaatttggcaattgatcaaatgggtgaagaaatggaaatacacccaaatgatcaacaaaaaaatgaagtttgatcagaaattataataagtttttacttatatcctgtgaaaatattgaaaatataagtgaacatttgtgaaaagattttttactaaaaatggaatcaaaatcattcattgaaaaaatttaaataactttaaaaatattactagagattaagccaaatcttctcttccattcataaattgtattatacgcaacgacaattttttccgctatttttaattcaattttccaattcgttgccaaattgaattttttggaaaatgcttctttcactttttcaaattgcttaattttttcaagcttttgctggtttgttgataatttcttggttaacccttaaaggg

SEQ ID NO: 14978 - DNA, 1252 bp, Heterodera glycines
caagggccgactcagtccacaaggatagaaaaaagaaatagggattttggaaatatttttcaaattttcacggacaaacccgttctggaaaattccaagaaagtattgggttccctgatatataatttcaagggccgactcagtccacaaggatagaaaaaagaaatagggattttggaaatatttttcaaattttcacggacaaacccgtactggaaaattccaaggaagtgttgggttccctgatatataatttcaagggccgactcagtccacaaggatagaaaaaagaaatagggattttggaaatatttttcaaattttcacggacaaacccgtactggaaaattccaaggaagtattgggttccctgatatataatttcaagggccgactcagtccacaaggatagaaaaaagaaatagggatttttggaaatatttttcaaattttcacggacaaacccgtactggaaaattccaaggaagtattgggttcactgctatataatttcaagggccgactcagtccacaaggatagaaaaaagaaatagggatttttggaaatatttttcaaattttcacggacaaacccgtactggaaaattccaaggaagtattgggttcactgctatataatttcaagggccgactcagtccacaaggatagaaaaaagaaatagggatttttggaaatatttttcaaattttcacggacaaacccgtactggaaaattccaagaaagtattgggttcactgctatataatttcaagggccgactcagtccacaaggatagaaaaaagaaatagggatttttggaaatatttttcaaattttcacggacaaacccgtactggaaaattccaagaaagtattgggttccctgatatataatttcaagggccgactcagtccacaaggatagaaaaaagaaatagggatttttggaaatatttttcaaattttcacggacaaacccgtactggaaaattccaaggaagtattgggttccctgctatataatttcaagggccgactcagtccacaaggatagaaaaaagaaatagggaattttggaattttttcaaattttcacggacaaacccgtactggaaaatccaaggaaattttgggttccctgatatatattttaagggcccaactccgtccccaaggataaaaaaaaaaaaaggggatttgggaaaaattttttcaattttcccggacaacccccgactggaaaattcca

SEQ ID NO: 14979 - DNA, 1269 bp, Heterodera glycines
ccccgtgcccccgcgggggcgaaggtcgcgggggcggggattgcgggggtcagagtcgctgggacggggacgggggtgaggccaaaaaacctgtcccgcccccagcgggggcggggtccgaaccctactcgggacatttatattttatgttcattttttaaaattctccgctgcttctcttcatttggtccttcccttttccatctgttgttgattaagctgtgattcgattcattttgatcgtttattatccctttttgtctttatccttttttctcccagtgcaaatgccaacagaatgtttgttttggctcacaaaatttgggttttctttttccataataaataaattaattgtttctctttgatttcctttatatttcgcctgcgtttcgttcattccattgttacttttgttttgttcaaataacatatgatttttgctcaatttaaaacgatttactcgggaccgagtcgggagggaattctttgttctcccagggtcccggttttcgaaaagttcatttgccggaccaaccgggaaaataagcactataatttatcttattgttgttagtggttaagtcttttgtgcttcttcttcttttttgcttgtattctatcccctaatagaataggaaatttattaaacaatttaaataataataaatttcttcttttttatttaaacaaccgaaaccattgaaaaaatgaattatttgaaaataatttaaatttaaatttgatactaaatttaaaaattgttttaacttttggctttatgaattaaaaacaaaagaaattggttttcataaaaaaataattaataaaaatcttttttccttgaaaattcccgattgatcccggttgaaaatccagcaggtcccagtcccggcttttctattccaagaagcattgtaaatatcagaaaaatttgtcaattatttatgagttttaaaatgctatattaagaattaatgtaaaagattattaagtattgtggattgattatttctgaatttataaaaggaggaatgggagatgataaacaatgggctgggaaatttcccaaaaattaattccaattttggcggggggaattaattacaaaatatgacaacgttcagattgattttccattagattcttgctgatcagttacccccccccccattcaaagcattgtttgtcccaaaagccacgtctttgatagtttaacacagaaatatatttggattttaccccacttttattgaatatttatttttt

SEQ ID NO: 14980 - DNA, 2387 bp, Heterodera glycines
ccctttctctcactttttcaggtgctttttcactttgactctcgaccaagtgccaatttggggccttttcatcaattccgttctgctcgggtctctctccccactttccttcgttcgttcacttctctccctttctcagtttctttatgaccggctatttgccgttgggctttgaatttgccgccgaattgacctttccaattgccgaaggcaccacttcgggactgttaaacggatctgctcaggcatttggcatcggaatgacttttggcatgggcttggtaagtgttggcatcggttttcttcccattggcactttcgctggctggcctttcaaggtgatgcattccctgtcgatcctttggtgcaatttgatcatgtccgcattccttctgatcggcttctttctcaccggttttgccctcacatccttccatttaatcttacccaataaatccctctcaatagcaattatcaaatcggatttgagaaggcaaagggcacacaaccaacagcaggcatttttattggggggggggggcaaagaattcttttgtttattttagcgaacggaaactcaagacacaacgcaacctgatcagtgatcagaccgagggccgataaaattctctctaagtcaaattctccaaaggaaatgatctcccacaaacccaatgaattaataacgacagagataccaattaactctcattcgaccataataattagagctcggcgcgggatgggacccgcgcgggattttgtgggatcacagtccgcaattccgcatttttaagaattgcgggattaatccctaggataacttcactcaaaactttttcgggctcaatctcgcaacggaacccgcaacttttgtttttgtgcgggatcccacgggatccgcaatgtatttttttgaaggatttcaaagataaaaatctggcttctattcttagatttatccatttagtaaataagcttgaacaatttgttaatttatctttttgaatatttcaatttaattttttgcaattccttgcgggacccgcaaatttgaaatgcgggattaatcccgcgggatcctttcccgcaaaatttaattcaaaattcgcattggaatctgcaaatttgaaattgctgagctctattaacatactatgtttcctgtaatagtatgaaacgggtttatcattccccttgaaaatgtcttttaatgaggggggggggggggttctattagggaaaatggcaaaaaacacttattttttttctcactttgtcaacgcttttacaaaatgtttctttcccaacctttccctcattcatttattgtttttattttgacaaaattggctccaacagtgacgacccctaactttttcaattcgggtaattgtaattttgaaaagtgcaattagaaataaactccaattgttttttatttgttaattgattattgctaattgactatcacattttaatttgtttgattgccttttttcctttttcctccaattgttgtttcacacaccgtccgaaaaaacgagatgtgtaccaataaatagagcggtaggggtcaactccgtcttgccaactccgtctcgccaactccgtctgggccaactacgtctaggggccaactccgtctcagccaactccgtctcgccaactccgtcttagtgtataaggggccaactccgtctcagacaaaaaaaaaatatttaaaaatttttttcgacgaatttttcaaaaaatatacccctaagaaattaaaaattttctcaaaaattcatctgcaaatctatttatttattttcatgttctgatttttaaaattattcatcaaaatatcgctttggcttaattttgttacttttaaaaataaatttaccgttatcatttattagtatatacttacctaacagtttaaagtaccattaattttttagccttgcgaaaatggaaaatgctgaaattaaatctcaacgaaaaaataaaaaactcgaacatgaaggctgcctgtatgtcttccatttgttgaacgccgatggtgacgtaaaattttggcgctgtgaacatcagcacggcgaattcaaatgtcgagggcgcattcacacaacgctcaatgacgtcgttctgaagacaattggtatacacacgtgcaaccacagcgcggcaaatgtcgtcgcacaaaaaatcaccaccggcattaaactcacgtgagaattttttaaaattaatttttaaattctcaaatttagcgtttcaaaacagacgcagcctttgcacgagcagccaaaatggtcacttcgctggcgttcgtgccgctggcggaccttacacccgcgttggcagcactagaagactatctaccaaatgagcttgag

SEQ ID NO: 14981 - DNA, 2783 bp, Heterodera glycines
atcatcggataaccaatagaaaaatgatcaaaactatacaatgatcggttatgctttgaagatgattaattcgcttattaattggattaattaaactgccaaaattgcctcaaaattatttccgtgtcttagcgaagccctcaaacaacttttggtctccgggtaaatgatggcattaagcatggcgtgctttcttcgccttctcagaaaaaagacttcgttgatgttttcttccgggctttctgaaaaaaaacgaaaaataaacatatgcccattctctcatttcttatacaccttttcacagcttcttaaaacaaaaaactttcaaccaaaaagatatgtcaaaacattttgaaaattttgagcaaaaatataaattttctgtcaaaaattttccatttttgagttttttatataacaccctttttgttgtactgctgcagccccctccgtctttcatttttatttccaaattccccccccccccttccccctcccctcgccttcttcgtccgtcagaattgccgtttcgcgtgttggctctgagcagattgacaattttttgcggaaaaagatcggcacattcagcgaagagctgtccaatgcgctggcactgctcgccgtcatttcgtcctcttcttcctcctcgtcttgggaactgctgaacatttttaaacaattaaatttaattaattaagcctaattaatttaaaagggaaaaatatgggcgaaacgcaccgacaaataatggcatcggaacaaaggagggaatggtgccgggggcatttgtttttgccgaagagcaatttattaaggaaattcattttcatttctaatgattaagcttttgaagaggagcaaaaaataattcccaaaaatattattaaatatttgctaaaaaaaagtctaaaaacccttctttagcgtccgtctgctttttccgaccactaatttttccacaattttttatttttttgtcaaatgttcctacttttttatggcttttgccctttgcttcgcaattcctttaacttttgccatttgcctttcctaccaataaatatggccaattttcggcttggccaactttttcaattcacatgaccccccccccccttccccattaaaattgttggcttttgctttttctgttcgttcagtgggtggcagcagcagctgtctttccaagaggaacaaattaattttaatgagttgcttaaatgatgacgtattccaaagaatgttaatgataatgagaggaaatgattaagaaaaaaaagatgaagactgatcatattagcaaagaaaagtgaataaatccaaaggttagagcaatttacagccctttatttggtcatcaaaactggtttaaaattaattgacaatttaatattttgattaaatttaatattaactacaaaataaaagttgtaacggtaaagctaaaaaactataattttagaaaactatcaaaattcaaaccaaaacatacatactgtaatcaaattctgtaggtttctcgccatataaatccacgtataaaatttcagatagtcatacgaccgtatgaaaaaaaatctgtattaatgatgcattttgttaccataaataataatgttgctgatggagttgcaaaaacttcggctgatggactctgctaaaattttaaagttataaaattaataaattttaattggacctcgggacttccaattggtactgaaacggatgttgggtgtgtgtctttggcatttcgtctctcggcaaatacgacgggggacaagcgccaagtttaaatgccgaaatgtgttcatccttataattaattagtgaaaaggggcatttaacacaaaatgagcataaattagataaccaaaaaacacctcatcatactgcaaaatgttcggcatattcggctgtcgcacaatgcgcggagtctgctgatcaaagcggcgctttttcatgcgatcataggcacggtctttgccacctgtgcccttttcggcactcaaaaaactgcctttgaatttacaaaataattattataaaattaaatattccataaatattattttatttgtctaaaatcgatagcttaattagcgcaccgttttattttaaagtacttatgatccaagtaattaattaatgaccaactaattacttattgactcatctcctccattttccattggatgcattgcgtgcaaatccatggcacactgttggaagtgtgccgggtgtgcagttccggcataatgtggctcatctcccgcaataaaaacaatggcgttcacacgctgagcaacggcactcggatggcgtacaaaattggcactcaattcaacggcatgcacccattgctgattggttgacaaaagcattcgctgatgatgaccatgctaaaacgccctaattaacataattaaataaatatatctggaaatgcctcatcaaatgagttgtcgtccgttgtcattgtgccaatgtttgtgtccatttgccattgccatcgcttttccctttgtctgaacgtgtccaccatttccctcatcagctgttccgtcctccttttgtgttctttccgtgccaatgcttctcctcctccccctgcttcttgccggtgtttaatcgcttgctccagttgcttggactgaaccttttttggcctaaaattttctgataattaagcaatttgcattttaatgctcaattatatattttatttaatttattgctaaataaaattcctaatttccatatactttcactatctgtcgctg

SEQ ID NO: 14982 - DNA, 1108 bp, Heterodera glycines
atcaacggatgcggccactcgcttcagcacggccaacaccgcgtccaaccgatcgcgcacttcgtcccgacggcacagctcgtggatggtttcgatctcgccgctgatccgcttcagcagctcgtgcaccgttttacgttcggcgtacggcgttaatcgactttctaaacagggaaaagaaagactaattagcaaagagttaaaattggcgtaacgggagggatcagctcattttgcgccactgtcccgcgaaaaaataaaataaaattttgtcttcataaatttttacaaaaccgattttttataatttttttattttctaagtttgttttagggaaagaataaaaatattttcaataggtttctttgaaaaaagtttttcttattttttaaaaaaccaaaacacaaattaaagagcaatgtttttatgttatccaaaaaaaagagaaatttaatttgataattcaacggcaaaaactttattcgaaggctcagcgtaatatttttttgtcatttattagcttatatgaataaaagttctttgcccatcatcattgccttcgctaatgttaatactcaaaatgaaacgcgttacaactgagcaccaaaaggcacaaagaacaaaaataaaaataaatatttattgtttattaagaagtccctggaattcgtgcgtctattcgaacggggacggttccgtgccgtattaaacattttaacagaaaaaagtcaaaaatacgcaaatttagaaaataaaaagttgataaaagaaaagaaaaaattttaacaaaaaaataacaaaaattgaaacagacaatacttaattttaaatccacgcataaaattgttaaattctcagaaatcagtgaaagcatttttccgttgttttcgagatcgtacgctctaatctggccccatcacattcattccataaaaggcagagttcccaagtgtgcttatttctagagaccggacgggcccgggggctcggcgggcttttaccgggcggcccgggacgcccggtaaaacgggttttttttgaccgggcgggccgtcccggtcaaatggctaagcccggtcccggtactttcaaaattccggtctctac

SEQ ID NO: 14983 - DNA, 1888 bp, Heterodera glycines
  misc_feature (65)..(65): n is a, c, g, or t
ttcatcgaaatattttgaggtgctcgtggtcacttccgttgcggaagagggtaattaggaataanttaggaaaacaatagcaattagcgatctttgagcgatttcattttaaataatatttgttgccttttttcggtgtcaacatcgccgcttgtaatctgatcatcaagtgcgtttctataatgatttgtcgatttggttgatcacttcttcacttttttcatttaaggtacaacaacgtcggcagcgaacggcaaatgatccaacgaagaggtaaaagggggcgagggagtgatcagaggagggcatgggatgatccgatttggggcacttaaacgaagggcgagcattgccatgccattttgccaatcactttttccctaggccgtgcccggcagaagcacagcctgtccattctgttggcgctggacaccggcattgagcagcaggagttcagcaacatgcgcaaggaggccatggcaagtgaaagagcgggattatcagcaaggatggctgggaccaaaagcctcaaaatttaacgaaactccagtccaaaaaaacatgaatacggccccacatctgacttggatgttgattttaaaaaatttattttatccaacagatgatgcgctgcattgaggacatgcaggagcaagatgagcagacactgcgcaaatcggtgggcattttggcaatttgtccacgcccctttttattaatccatttatatatatttagtctgtgtattttagaatttttaattggactatttatttataattaattaattgccaatgtaaatgttcaattatttttaagattgaggaaaaggccttcgaattggccgaacttcgcaacgacgagaaaatgaaggtggagagcaaacgggcccagctgatgggcaaacggtgtgtttatttggtgtgttcatcgtggcatttctaattttactttttccccgttagtttcgatttgaaatgcgcctgcggcactgtgatttgctgcagtgaccgcgtccgatcggtgatgggcactctgtttgtgtgctgtgaccccaaagtgtggaggcgatcgaagcacacgctgacacgcgccccaacggtggggcggggatttagaaaaacattatttattggagcaaattgtcgattgtgatgtcttcgaatgctttaaataatcatctccgtgtttcggcatttgcttcgctgtccaaaaattgtgccaacttaagctcgtttcaatcacagattgatagagccattaatatagcattggttaatagctctgatcggaagtgattttctcacccgtctttcatagattttctttggcagaattatattattattattattttatttataattttccacgctttaagaaagagaaattctacacaaactgtgcccgttgggagtgcgcaaattgtggcgaacattggggccaaattgtcaaattttccaacgtgtttttgcccgaaattcgcgtccgcgcattcatattggagcgagtggatgaacaatggtcagcacagcaaaacaacagatggaaatttgcacaacaataaatatttaattgtttatttttaatagtaacgaaaataaattttattatttttatttaaattttattatttacaattagccaaaaaaaaaaacacttttcagcagtcaattcgaccgaaacgaagtcgtgtgcaaaaagtggaaggacattgagcagaacaatttcaacgtggacgccattagcatggcggacatcgtaaattgaacccatccattttcatttaaatcaaaatttcacagcgttcgatgtacgaaagccttttggagacgaaccccgaggcgcacttggagtacgaaaagcagagcagacaggcggaccaaca

SEQ ID NO: 14984 - DNA, 1539 bp, Heterodera glycines
tctggttttaattttgggtcttttttttcttaattttcactttgtcgctcttcgttctccacatgaatatctccatcggataatcatagcctgtttttttgtcagttgttgacatttgttgaagcccttggcaaatttgtttttatatattgtcattccgttttatttaagataaagcttattcatcgtacatttaaagcccaaaactctcgagttcacctcgggaatttaattaagaaaggggcaccgatgtctcgaatgaataaatgggacttttctcgccctaaaaactccccaaattaatatacttttttaattgattgggggtataaatgtacccaagcttagccattttttacatcctctaatctgccaaaattttattggacattttgctgggacaacagaaaacagcctcccccctctccacccataattagctttttgtgccgtcttgtcctcccctcccgccacaaaacaatccgtcgtcgtctcgtcatccaattgtcggccggccccccccccccccgaaacaaccgcgatttaagcggcgagtaaaatggacgaaccctccctgccccccccccccgggggatggcacgcaattggccgtcgaaatggcaaacgttaaaagttttaaaatgacgatgctttttgtgctttttacccattttaaatgagcttatgttcttctcgtccatcgagataaaatgtttaatttgtcagattgtaagccaaatggtaattagaggtaattaagcgaactttaactaatcgccgccgcatttgagggaaaatttaactgaaaaaaggaattcgaaaatgtactcgaaattttctgctaaaaattgcctaatttcagcttcgcttctctttggcactgtctgtcttcccatgcattttttcattatttttctctttgccctggtcatttatttatgccgtggaattttccccgaatttccccggggagcgttccgtcaccggccaaaaaaaaaagtttttttggtgccgcttttgtttttccctttttggccatttcccatgggattttttggccctttttgccgtgccgtggcccattttttacaaatttgggcggcacaccatccttctggtgacctttttacattatacactttaattttaaaatttttaccacggcaattttgtaaaaataattttttcttttttcttaatttatttttttgccaatattgttttaaattaatttttatttatttcaaatgttttcttaacaattcgaataaagattgttttaattctcaattttttcgctcctttttcaattcgaattcgctgtttttacaaggcaaatttaatccaatttgaaaaattttcgatgaaagtttctgtaatttttaaatttatctctaaatgcacatttttattattttatttttttttatttaaaaattttttattatttttttgttgaagaattttaattaattatttaatttcattaaatcttattcagaaattttttcattttagaaaaatttaaaattcattact

SEQ ID NO: 14985 - DNA, 2638 bp, Heterodera glycines
atttggcacgtgatcagttggccgttgatggggagctttcgatttggaatgctgtaacattttttaaaatttattaaaatggaaatttgttttttcctatttttcccttaggcactccgttgggccgacgcgcaatgcctccaaaaaggcaaagaatgttcgggggaaagtcggcgtgatgtgcttggcccggcactgttcaaaattcgtcttacgcacatcactcgggaggatttctacaaatatatcggtgaaaaacttaaacctttcggtgaatttaaatagttggccttgtaatccttcaacataatggtcgaaaatccccgactaaatttatttgtggggtcggtataataataataattaatttgccagttccgaccggtgtgttgacagtttgcgaaatggttgcccttttgtaccatttccaccctgaccaacaaatgccgaggatgctttacgactcattgcaattcccaactcacagacgggcaacatatgacggtatgatttgattgggcaagatttttcatttatattattagtttctatctctgaatttttgatgaatttaaaatattttgttaaaactctattgatcaactgtattttcatcatctttttttttttcagtaatcgaattttgcttctcttgtaagaggtgacagcgaccaataaaacttcggggttttcgtttgtctcggaaattcggctttcaaacattctacaactttccctaataggatgaataaattaattatgcatttttcagaccccaacaaacctcagggaacgctcattatggaaatcaaaaaattctctgaatttttgaaagaaaatgacaacgttacacgtctaagcgatgccgtagtttatatcacggcacttccatggcgattaattgtatataaaaccaaacacagtttgatgtttgaagcgaaatacgacacggcacaaatgagtgggcaaattagccaaaggaaacaatattttaaataaattaagctttgaactacaaatgcccttattcgacaacgtttcgaattgcttcgcaaaaggagggaaaaacggattttgttaagaagaaaatgggcaaaattggctcggatgcatacaaccgatgtacatttagttatatttcattgtcggtatgtgtaagaaagcaaaaaaaaaaaagaaaaatttttgagaaatacgttttcaaataaaatttcgtgaatatttcgggtagcgcctatcggcagacagtaaaccatccgcggctttattttttgagttaaaatgctccaaaaaatgaatttttgctgtgaaatttttaaaaaatttaaattttcgctctgccgtaccctttgtataaaataaaataaataataatttatagaaactgatgtgcccggacaacggatggtacaataaggaggaggacacagtgaaagtgacggtggaagtgaccacaggcgaactttgcggggaggaaaaagcggcgaaatgaaaagaatgaattttattttatccatcccatacaattaattgttttgtgtcggattaaacgcttttcctatacaacatttaattacagtaacctgagtttttttttgccgaaaaaccgttatgaaaagaaaattacagtcaaagatggtaaaaagcaaaacaatttttggttacattgacgcaaatggaagaaataacagaaaataaaatcaaatttcaaatatgcaataaaaatttgagatttatgtaagaaaagtcacaaaatatctaataaaatattgaaataaatatttatacacgcaccaaatgtcctaaaattagttctcaaaaacctcaattttaacaaaaatgaaaatatgtaaaaagtgcgaaatattgacaactatgaacataataaatatgtacactgagccggaaaattggttatagaagaaaacttataatttttagcgaaaaaacgccgcaaaaattgaaaatttacatttttgatttatttttgacataaatttaccaattttcgagaaagtttaaaatttttacgagaaaattttttgaatgttttttaattttccgatcataaaggtcgaaaaggctaatttagcttatggggacagttcaaatagatgatattcgaaaaatgccaaatatggatataaataataaataacaaaatgtggaaacaagaattttcaataattagcattctaattatattcagaaaaagaatttattaattatatcaaaattaaccatcttccagaaacttatacatatttgcgaaaatgaagcttctcccaaaaaagcaaccaaattaaggaattgttggacccgagcaaaggattttacaacaaagatgaggacaaagtaaaattggccatttatttcattgtggacgagccaaaaacagagaaatttgtttccaatccgaacaaatccaacggcacactttcgatggaaattgaaaaattatcggaatttgcgcgagaaatcgaagaaagtgaacgtaaaagcgaagaaactgtgtatataaagggaatgccatggaaaatatgggcaaatattaaaacaaaaaatgaaagcactgagaaatggttgggctttttccttttgtgcgacgcttctgaaaaaggtgcttatcaaataatat

SEQ ID NO: 14986 - DNA, 3048 bp, Heterodera glycines
tctttcgtctatttctctgtctgctttgctctctttctttctctatttctttctctgaattctctgtctcttcttgtcaattctctatctgcattgctctctttttttctctgagtttctctgtcttatttccttaaaatttctttgtttcttttcttctgttctctctctttcttgtctatttctctgctttgtttctttttcttttccctcttctctttctcctacgccattttataaaatgtgctttggttggtgttttgttgtgaataaaacaaatatcaaactgaaaaagcagtagcagcagaagaactgacagacacatgcacaaaccctttcttttttgacaccgatttttattattttaaaaatatttatttatttttattattatccataaatacactaacccaaagaagtcttgcctcaaacatataaaattgttcaatgcttaatactagggctataattacatagaaatgctattttgagcccctttcttcatagcatatgcgcagaaaaatatgcaaaagcatagaatttatagtcctaattattacataataaaagtcagaattatcgttgtaaatattttagatgtctttttcaaatacccaaaagaagaattcccatattttttttaatgactgagttttggattccgaattgaatgatttgtcaaaagttacgcgcaaaaagtctttcgcaaaattaaaataattcatgcttactttctgtattatatgtatatatttttttgtcattttagcacaattttgtttaacaataaattttttgaaaaaatggacaaagacattgtgccaaaagaaggaaatcgctttaaaaagcacttcgacccattgactaccaaagaaggtgggctttgcataaaatgacatcattatttaattttatcctaatttgttaaaaatttaagcaaagtcttccgtcacttttcgatccaccgaaattactggtgattattttgttctaccataacgatcaaaatgggctttggataatttttgaaaattttttaccgaaaaaatttaattttctattttattttgctttaaaaatatatgtcataatgtgcgaccaaattttaacaatggatttcttacaaattatggtcctaaagttcagaattttataattttttcaaaattctcaaagaattcgctaatttttagcccatgaatatttggatttttcattgtttcgtttggtgccaccgcatttggtggaccctggcacaattgtggtgaaaactgtgcgacagccaaatgttcttgaagagcacaattatcacaagcggccaattatgtacattatcaatcaattaattataaaatcaatcaatcatctcacacaagggataaagccaaatgccttatttttgacataaaaattgaaatttgaatttcaaaataattaaatttgtgtagcgatcgttcgctgccatcggtgccaaatttgcctctctttcagcaaaaccctggtcagaaaacggttgtattggctgcgttctccctccccaacttttgctgattctgatcactcgcaaaacaatgaatcgtcgatagaatcagcggcgaatttgcatgagaatacggcgacggaggagagaccgcgcgcagaaagttaggcaaaattttcttttggaaattttcgtgttttcctttaaatttaaaaatttaggggaagaattgatgttttgtaatccattgataactttcaaaatttaaagatttaataattaatgggcggggaaaacattcaaaaagaagcgaataaaattttaataactcaatagtataatacagtaaatcatcagagttttacatatattaattattagagccctgacttttaggcacgaaaattttttaattaggcaagaaaaatgtgaaaaaaggcaccaaaaagttcaagatagaagcttcaaaccaagttaaaaactcgttttttgtgcgtattaggccatagcaagttaacaaaaaaaggcaatgcctcaaaatccgggctctattaattattgaataatattctcaatttaaattctactcatttttggcacatcacaaaatgttggcgccgatgccaccgcgtgtatgacgacgcgtccgtctgacgataacgagtcatatttggatgaacaggtggcccaataaagcaattacgggttcccatcgtcctaatggggcggggtcattcgccgtggccaactcacagcaccttattttaagagttaattgccaccacatttttgtcatacacacggagcgaatatttaatttgttttaatcccttcttagggcctccgttggcatcggcttttcgccgtgcccgacaatgatttgtcgacactcctgcgcatttgcattgaatttggcggtggcacggcacagaattggtcaaatggcaacaaatgcattgttttcggttgcgcatttgcacaacaaaaaaatgccgacgctttgtgcccttttcggctgatttatgtgccagaacgacgcaccatttatggtcaaattgagcacaaacacgcacatttattcgctgaagcgatcaataatactatgaatgacagtgacaaagaagagaaggaagagagagaggaggaacagcagagaaaaattagagaaaaaaagatcgaatatggaaaaaagcaaagtgagggggaaaaagaagcgaaagaagaagtgatcggagatgaaccgggagagataggagagcagcgagaggaaagcagagaaaaagcgattgggtatgatcaacaaaatggaggggagaaagaagaagtgatcggagatggacaacagcaaagagaagaggaggcagagaaggagagggaattgaggaagatagcagcagaaagagggacaattactgctgatgagcaacggaaattgacctcaaatcaaaatggtaaaaagagaaaatctaataaatactaaaaagggaaatttcgctttttaatttgatttttcctgtattattaaagttttttataaattagtcattgaaaatgccattgcttcctcc

SEQ ID NO: 14987 - DNA, 1556 bp, Heterodera glycines
agtgccagcagctgggcatggagcagctgaagtgccaccgacgggcgccggtaggcgctcgggagggggccagaattcccaaatttcggccatttccccccccccccccgtttttggcacggaattccgatgtcctccgctttttcaatcgaattcttccctttttttttgctggagtgccaacagctgggcatggagcggccgaagtgccagcagctgggcatggagcagctgaagtgccaccgacgggcgccggtaggcgctcgggagggggccagaattcccaaatttcgcccatttcccccccgtttttggcacggaattccgatttcctcagcttttcaatcgaatttttccccccttttttttttttgctgaagtgccagcagctgggcatggagcagctgaaatgccgccgacgggcgccggtaggcgttcgggaagggtacaaatcccccgatttaaagaattattgtgttttaatttaaaaggttgtcccgtgtgtggcagacattttgccagccgacacaacatgctcaagcaccaaattgtccacaccggtaaaaacaattgcataactttaatatgggtataatttacaggagttaaaaaatacgaaggtcgtttatgtaaaagacgttttggctgggccgggaaccttacagtaattttcaaaattttgggtccatgacaaaaagttttttcgcagaaacatttcaaaacgaaacatcgtgccaaagggttcacctttttctgtccacactgtcaccgtggatttgaccttattgtaatctctgcttattatttaattatttcctaactttgaatttgaatttagagtgaagtgcgcaaacacaattttgtcgtacaccaccaatgaataatgaccagcaactgggcacaatgaattttatttcctattttaatcaatcaatattcatattcatttaattcttcgaaatagctatttaaaaaaagtcttataaccaattgaacatctaaccgcgtaaaaaatctcaaatgtcattaaaatcctgctttttttttgtgcattaaaaaccacaagacgatctttaaattactttaaataattgattatttagcataatgcttttaattttctttaacaggattgatatgtgattaatttttcctttgtttatttaaagctaaatttattttaaacttttacaaatactccgcattttggttttagtctcggctgataggcaattcagttttcctttcgtctatttaggtataattttatgaaatttaaagttttaatttatcgaatttatgaatacgccatttttcggccgtcgttagtcattacaattaaaacattttcaagccttttccatcactcgtcttttatgaacaccactgatccaatattcgatgctgctgttcattcgctcttttttttgtttcagtagacagagagttgattctcggttttatccaatgctgttaacaaatgcattacaatttggctctagtgcactttatgagaccaatcgacttttatgagtccaaccaattgacaatacctg

SEQ ID NO: 14988 - DNA, 1716 bp, Heterodera glycines
caagaagctaaaaagtaaaatctcagcgtttaggcaattgccaagaaagatttcagtaattaaataatgattgattatttttgtttgtaacttccttaaatgtttagattttcttgttttctcgtattattacattattcagactatattcttttgaatgatgccaaaaagatacgatttgttcgaatatgaacaaagttattgtacagaaagcaggtattgtcaattggttggactcataaaagtcgattagactcataaagtgcactagagccccattcggctttatgggagaatgaaataattttaaattgactatatttcaaattgcaattcttggaaactgaattatttttagctcaaaattttgaatcgcatttgtaggcaccagcaccataaaatcatcaatttactcaatgaacgacttcccatttgttttcatatttctattttgttaaagctttttattttgcatatcattttattcgcaggtatcttggcctatagcagtgaaactgctccaaacttggagaatttaatagttttggcgaatgtctgtaattcaaactgccagcccctaaaaattgacacaaaatcgcaaaactttgtcatttttggcaaaatctgttaacaaatcacactcaatttgcaaattttccctggcgacgcctatcggatccgctgtgccctcggcgccgctataccgtccttttcccccaaaaattacgccgtaaaaaaaaaaagtgtcttgaaaagcaaaaaaaaaaaaaaggccgagttacatggccgccaagcaaaattttggatctgggcccaggccgacagataaataagctttttttttggtcgtgccgcccgtgcccatccattatcaaagccggactgcgggccggtgttttcaaaattccagtcccaagtggattatttaaatttggtaatatgtttatcaaaattacctaattttagatttcgccgtggccctctatatttaaatctgtttcatcaattattgtactgctctttaaacttttcagcgattattaattattttcttttaccattttatttaaatgcttaattttattcttaaaagataatttctacagttcatcaatattataactgatctttgaacttttcaatgattaattattttttaccattttatttaaatggctaatcttttttttaaaatttcgcctcgacacttgcgcctcccatttaaaattgacatttgcgccgtcctacaaaatgccccgttcaaaataatccaaaaaatttatttaaacaaaattcttcatatattaatgcggtttattattttgttttcattggcatcaaatttgtctttgctgctgagtaagacattgacaaaaaataggtgttcgttttgattatttttgcatttcttttaattgcttttttattgttacacagtattttgagtacaagagtctctcccttgaaatttgacatttataggttttaaaaaatctaattatgtaccacccaagtttagatataacttttattaaaattttttcatcgaaaatgagcggcctctcacgattccaactctccactgctactgctggccagtaaaagcgtaaaagcgatggcgccccagcaaaaacgaaaactctgaaggaagtgttggacttcaaaagcgccggagatttcacgtcacggcaaaagtcgtgaatttgcaatataaaa

SEQ ID NO: 14989 - DNA, 2488 bp, Heterodera glycines
gaaaataataaaagatgaattttcggtagccaatactcggctctccggtagtcagtacctaattaagctcggccctccggtcaccaatacctcacaaggctcggatctccggtagccaatacctaattaaacttggcccgccagtaaccaatacctcgtaaggttcggcactccggtagccaatacctaattaaacttggcccgccagtaaccaatacctcgtaaggttcggcactcctgtagccaatacctaattaagcttggccctccggtcaccaatacctcgcaaggctctgacaccgaacactgaaaacttcattcttttgactatgaatttttatttttatgcaaattgttatcctcgtggtctaaaatttatatgagaataaaatatacctttcctattgatttggcaaaacgcataggatggaaaagggagtgggtaaactgagtttgcaatggtaaggagcaataatgaccgaatatgtgttggagaggaagggcagagctgaggaaaccaaataagtgaaggagaggggggtgaggtcacggcgtcatcttatcctgtaaatcgattcctctaaaaggaacaaatggaacgaggctatcgccaactgcttgcttaacaaaatccaatatttaagatatttttggtattggggttaagtttatttgaattattttccttttctccgtaatgtattttctctactcttctatatctgcttactttcactgttatttcagacctacatattgtctaaataatcgtttccgttagctatttttcaatatcttttcttccaacactatgttttattctcgaaccgttatcttccaagtgttcgtattcttgttctttatcaaactattctcttccttatacattacctaatgtttgccttactaactcatattaaattctcactatttaatattgactctcttcaaccacatttctgagttctctatctctatctcttacacccattattaattgtccttgattctatggtgcagtacaatatcctcatatgatttcttcatttattcctattacaagacctgcttcacgcatacatttagcccttatctaccctttctcgtcacatacagtcagtcagtcagctgtttgtcaaacctactttctattctcggttcaatcttagattcaaaattgtctatttctcttgtttcctttgaatattacttattcaatggaattgtaaatgttccttattataattagaattattttacgttgaattaggcaaggagcattgtttgtgtttatgattaaaattaacaagttttatataagttaataaatattatgcagaactttcaaacacactttatcctcaccctcaaaaaaacatacaatacacacacatacgcacacgcatagacacgcacacacgcgcacatgcatacatacgcatacacacgcacatgcatacatacgcatacacacacaccccatgtgtgtaatttttacacatttttgagtaattccttcatttaatcattatttttcttaatttttgttaaattgtatcttctattccttaataatttacaattgtgttacaaaaccctgactatttttctcgttaaatacctttttaatttataccttttaatattagtaatgacacattttttcaattttatttctgaataaacattcaaatgaaaaatacaagtgtaaaatagagaataaaggaaattataaaaagaaagtatgcaactcttttgatagatttgaaggcatatcagaattcttagagttccctttgaaaaaagtgagcaaacacacccagggaacggcttcacccttcggtccccaatccaaacactcacgcaccaggctgcgcattacaataatgaacagctcgtccatcttcatctcagatggatggcctggagtgttggagaggatcaaccaggggtcattccgtcccacatgagtgatataaacagagagaaagaaaagaagggaacaataagaaaactaatatacagaaaatttaattgagaatgcatacttatcatttgcgataaccaaattcgaggacttggaatgaatcattaataataccttttgtgaatatgggttgataatgttttgtgagggaatgagtatacactttgccttggattagattagggcgaataaaatgggggtaagttataatgatagggtcaggggggtcttcggagccatagcgtaagatttggtccttaacagtatcgtaatgaattttttgaacagtttgtgcatcaagggtgaaccctcttattttcaaatcgtgttctatttcaccggtgtccttgcgttgcagcttcatcccataattcttgcagccagcactaatgaactccaagatattgtggtcggggttttcgacggttagttctccaaggtgtccctttcctgttggtagtgagtggttttcctcggggtgaacgtagatgacgctgtccg

SEQ ID NO: 14990 - DNA, 1039 bp, Heterodera glycines
  misc_feature (30)..(30): n is a, c, g, or t
  misc_feature (57)..(57): n is a, c, g, or t
  misc_feature (1008)..(1008): n is a, c, g, or t
  misc_feature (1029)..(1029): n is a, c, g, or t
tatatttcgaattattttacgtgattaggncaaggagcatgtttgtgtttatgatanaaattaacaagttttatataaagttaataaatattatgcagaactttcaaacacacttatcctcaccctcgaaaaaacatacaatacacacacatacgcacacgcatagacacgcacacacgcgattatgcatacatacgcataaacacacgttcacaaatgcttaataatttacaaatgctatcacacattgcttaattctgcatgcatttttacacatttttgagtaattccttcatttaatcaacatttttcttaatttttgttaaattgtatcttctattccttaataatttacaaattgtgtcttcttgctcttaattctgcatatttctacctaaaaacgacgttcccaaatgcttaataatttacaaattgtatcttccattgcttaattctgcatgcatgttcactccttaattatgcacttttctacctaaaaacgacatgttcgtgcactttttaaaattgtatcttctattccttaataatttacaaattgtaacttctttctcttaattctgcacttttctacctaaaaatgacgttcccaaatgcttaataatttacaaattgtaacttccattgcttaattctgcatgtattttcactccttaattatgcacttttctatctaaaaacgacaagttcgtgcactttttaaaattgtatcttctattccttaataatttacaaattgtaacttctttctcttaattctgcacttttctacctaaaaatgacgttcccaaatgcttaataatttacaaattgtaacttccattgcttaattctgcatgcattttcactccttaattatgcatttttctacctaaaaacgacaagttcgtgcacataatcaaaatgtatcttcaactccttaataatttacaaattgtaacttctttcgcttaattatgcatttttctacctaaaaatgacgttcccaanatgcttaataatttacaaatntgtgtcttcc

SEQ ID NO: 14991 - DNA, 1161 bp, Heterodera glycines
ttatttcctcaattatttcttagttgattcttcattaaattatatttattaattttactaattctgcgaaacgctttacgcccatcatatcaccaaattttattttctcatagcccatcaaaatgctggtaaaattttcaatttcattctgtaaaatctgatgtgaagacggggcaatgtcaatggaagctggaaagaaaagaaatttataaaaaatcaatttaaattttatttagcagataaatgtttggctcttggctatactaacagtttacgcgtccaatcaatggccaccctcattttcctaggccataactttgtttttttacttacattcttggcatcaatcaaaaacttaaagtcttgggaatttgtaaaatgaaagaaagaaaaaaagcaaatactgacactgagaaaaaatttaaaacgagaaaatacgaaaatcagcttctttttttttgaatattcaagattttttttgtctattgtttttaccccagaattatttattaaaaaaaattctacaaattttaagctttcgattgatagccaaagatgtaagcattgaccaagtatgaaaaaaaaagttgtggcctatgaagacgagtatggttattgattgtacgcctatactggaatagagtctaaaagatgccgagcaatttttctaaaaattgccaacaattttattttataaatcagaattttagatggagggaacggctgcacgaaaaccaatgaacgaagtaaattaaaaaaacagcaaatattttatgaaattagcgaaagggaaaaataaattcactcataatcgaaaatggtggaaaaaattcttttagattttttggtcaaaattgggagacacaaaacgaatattaattttttttttaattagtaccatgttgaagcaaaacgattgcccttaggagaacaaattcttccacacacaaattaatgtctttgaaagatttaattgattcacaaaacacgcgaatcggcacatcaaaagtgccgaaaaaaattggagcgaatccgttgggaagggttaatgtttcggcatcgggacaattgacgcagctgtagaaagtcttgctgaacacagcggtcagaattatgttgttgagtagtaaggcagtctaaaatgaataatttattatttat

SEQ ID NO: 14992 - DNA, 1669 bp, Heterodera glycines
  misc_feature (31)..(31): n is a, c, g, or t
  misc_feature (117)..(117): n is a, c, g, or t
tttgggttttagtccatatttggccattttntggaaatttcacaagaaaaatgaaaaaaaaacgaaaaaatacacccctaaagatcaactttttggaaatttttaaaaattacaccncacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaacccataattaacagatttgcagaaaaaatggacaaaaatcatactttttgagtcatttaatcggatgaaaagttatttctaaaaatatttggcattctgtcttttgtaattgtcttaaattttttggattcgaatttcgaaaagcactaaatcaatttctcggttgttgtggtctcggcatatatcatcattttgacaaaaattgcctaaggacaaaacgccaaaaaaccccactaatttaaaaattttgccgagattttcccttgtaaaaatggaagagccgatctcgagttaaaaacacaacttccaaaaaataaacagggattcgatagagggggtcaaaatatgggcctatgcaaaatttcaagaaaatttcaactgcagaaaaattttttcaactgggtgaatatttcaataactttccgacacttttacagttaaaaatggtatccacacgcagtaaaactgataaattcaagaaaatgggaaattcaagtactgaagcaaagcgaaagcggaaggaatggcgccaggagcacgcaagaaaagctggatcaacaccaaaaagtgatgaaattttgataaaatttcatttcaattaaaaatcaaatttttacaggtccacgacaaaccacaaaagctccatcaacaaccggagagggaacatcgaccgagacaatgccatcgactttgaatgccgagccccgtaagtgcaaaaatcacaatttttgagataattttcatttaaggccaagtccacggccactttcaacaacgccgatcaggcgccatgtccgcacgcgaccaacaactaccgaccaaacaaccggcatatcaataatagtgaataattaaatttaattattgctttttctattacaaaaaaaaagcatattataataattaagcattaactcgattaaaatattccttataaattggtactttttttccgattcaacaaaagcacccaaaatttgttgggtgatttatgaaagatgccagcacggagcacccccataacggaaaaattgctaattagttagtcaagcagataagtgataaattaattgcctgatcaatcaatggaagttgccaaattgctggtatcgttttggccatttcaatgcacaaaaaacagtcaat

SEQ ID NO: 14993 - DNA, 1714 bp, Heterodera glycines
taataaatagccttaaaattttcaaaatttttctcgatggcgcctaacggcactgccggactcccattttaccatatttgttgaaaaatggtgaccaaaatggcaaaaatagtaatttttggtgaaaaacggctaaaaaattttagatttctcgattcccgaatcgagaaatttctcgggttttttggggtctcagttctcgtatcgtttcccggggtcatttcccggtctcggtctcggttctcggtaaaaatcatttctcgcacatcctaatacagagactctcgaacagcgctattaactactagacttattttatcaacttaccgtaaattggtcgcactacgtatatcaattgatgtatgaatttcatgttcaccgaagtgtctgtatttacaatttttttggcgatttcattcagttcaaccacaagcgatggaagcttttctgccattatcaattttgttcgtttgtcctttgcatttttcagatttttaatctacaaattaggaaaatgaaaaaaatagatgataaaaaaatatctcggctctgatttttttattttttacatatggatgtgaaataatcgttgtcagccgataattgaccttgaaaatctctgcttgtctacctttttcaaaatttacctccacccaactgtaaaaatgcaaacaatttaaactaaaagcaagggacattcaattgaaacgtgctggcgcgtttcttaaaactgccaatgggtttgaaaacaaaaaatgggtaaaataattaaattaatagtttggctcaaattcaaccaaattaatatttcgtggtatcattcaatagccttaattgtactctattagaatatgatttttcaaaaatttttacttaagtataaaaaaagttatggtcacaaaattgcaaaaaatcttaagtcagcattttttgttcagaacttttttgaaactcaatgaaattttctaaaattttaaatataaatagagaattcttagggctatcgaaatataaattaattttggttaaatttcattttaaagactttaaaattttaaatgtttattattatatatgcattaccattgcaaaaaacatagcctgttcaatgctttataacttcttttatacttaagttaaaaatttaagaaaattatattctgaaagagaacaattaaagctattgaatgataccacgaaatattaatttggttgaatttgagccaagctattaatttaattattttacccattttttgttttcaaacccattggcagttttaacaaacgcgcatgggtggcagtttttaacaaacgcgctagcaccatattttctttacattatttcaattgaaatttaattaattaaaaatattaaactttaaaattattatttttttcttttttaaacagccgaaaaacccacaaattaactaaatatttggtcctttttttgtaaattctgttaacaagtctcactcaaaatcaaaaaatttaagagattgttaatttatttaaaaaaaatccagaattttgggacgcagaaaatttcaaggccctcccccccccccccgatatgaaagtttttaaaaattttccaacgaataatggaaaaattcttcgaaatcatccacaaaacgaaaataaaaaaattttatgggtacatttttgaatataggcaattttcgtaacaaagtgcactcaaattttcaaa

SEQ ID NO: 14994 - DNA, 2175 bp, Heterodera glycines
tactccccgacgaggatggttcagtcatccccgacactttttcggggaatttactccccgttccccgacttttctctccccgagggtcaggaaggtggtatgggcgttgtctttagaggttttcccatttcttttatcccactttctcccacactccgcttccttttggcaccaaaaatattcaaaattaaattattattattattataataagttatttttatttaattaatttttttatttacctctttcttcagtaattctttcttctcatcaacatcaatttgttctgctgctgctgtggatggtgatgctagtgatgattttttgtcatcatttggggcaacattttcatctttttccacaggagaatcgcctcctttggcacagaaaattccgagaaatatttttgaaaaaaataaaaccaaaattaattggcaattattattcattgttcactatttttttaatttttaaattaataaaatgaatggaacgcaattacatttatatatttgcatttactaaattgaatgtaattgacaacattataatgcaaaggaagtggcgcaaaaaattggtaaaaatcgaataaataattattatcgaaaaacggaaattgttgtatttttgtgattttcatatgcattattctaaagggtcatgaattattattaaaaaacatttcaataaacaattattttggaaaactaataagaaaatgcaaaaaattttggcatttttaatggaaatcttaagaccataaattccagcccaaaattttaggtttaggatcccgattttcacaggcaggaattgttaatcaggctgggatgggaataccggactcaaattctagttcaatttgccggtatcctatcatgaaatccttcaaaaaattgggatatggagcaggatcccggataaatcccgacggtaccctgaaccgtcttggctctacagataatgagtattttcagggttcccattttacacctttttattggttgccttttttaataaatatattatactgtttttatacattgtgtaaggagtttgtgtttacgttttgcgtaaaacaccgattgttttgtgtagatatttactagcgctggtcgataccgaaaatttcctgaaactcaagactagaccgagattgaccgcgagaaccgagacctgattttgtatgttgaagagtttgacaatttttgataaacgaaattgaaaatgaaataaattttttattcattatatcaagtaaattatttgcattattaaaacaaaaaaaaaacataattagttattgcgtttaaagcttcacaaaatttaatgcttgtaataatattattaatgattaataaccgggtgtgacgccacccaagtagggatgcacgagagttccggttctcgcttctcgactcgagaaatttctcggggttttcgcttctcgttcacggtctcgggtttttagtgtcggaaaccgagaaatttttagactgttaaggttgactattgcgggcgggggggggggtcgccggcgaaggggaaaagagaaaaattattgtaactttgaataaatttcttaacaaaatttaataaaaataaaaaattttcccatcggcgctctgttggcggcgccggcccccaaaattttactaaaatttcaaaagttgacttaaaattgccatttttgatgaaattctgtttaaaaaagttaaaaatttccactcggtctcggggtcaagtctcggtctcgagtctcgggaaattttcggtctcgagcagcactagttttcatcaaacatcttttgaaaaagcacaccgcaaaaaaaatttctcgggttttcttcttgtttctcgttaaaaacaatttctcgcacatccctaagccaaaatgtattggcttcgtccctaacctattgtagaggtgcaatccagctgattgccatgcttgacggggcccagaacccaagaggctaatgtaaatttgttatttttttaaatttgatttattaagtttttaattggtcgttttttacttggtttctctaaaaataattgatgaaggaatggactgaaaaatcattagaaaaatgaccaatttttggtccaaatttaaatgtcgtatataccaaccaaaacagaaaatggcaaattggcaaaaagcaattc

SEQ ID NO: 14995 - DNA, 3785 bp, Heterodera glycines
  misc_feature (3675)..(3675): n is a, c, g, or t
  misc_feature (3700)..(3701): n is a, c, g, or t
  misc_feature (3710)..(3711): n is a, c, g, or t
  misc_feature (3745)..(3745): n is a, c, g, or t
atcagtagggaatagaattacatggaaatccatattttttcctggactgtgggaggcctgaaacgcacgaaaaacatgtttttagcttggtttgaagcttctaggaaggatttctatatccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatgtccatattttgcgatttttggtccatattttatggccatatttcgcgattttatatccatataattacactccctactcatcagacccccattcttaccagtgcttaatttagtcccgccgggaccgggacctgaaaaaccgggaattcccggctcggtcccggccccgaccagccctagttaaaatcgcatttttgaagctcaagtttaaaaacaacataaaaatcaataaattttaattaatttataatataactaaataatttaaaaaatctgttaatttttgttaaattggtccaaaattgccgcggagtcccaaattccgcgcatcgcgcaaaaaaaaaaccgcggccgcgcattcaaattgccgcggccgtgaccgcggatcgcgcaaaaaaaatgccgcgaattgcggatcgcggtcgcgctccacccctgctgcccatatgtgtcgtctcactcacactgtgtcgccgacaaaatggacttggactcggccgcccaactcgccgagtgccggcaatgtgtacacgccgaagaagacgagcccggttgcctgaaaatgtgatgaaaacattggcaaatgcctaaataattcttcactgatcagtgagtgagtgatcagcaggaacaggccaaggatattaattcaaaactataaaatttctttttttctgtaaccaatagaatttaatttgtttcaaaagctaaaattttaagacttaaaaaatagaaatttctgaatatttttagtaaaatttggaaacaagtattagcccttgagagcgaaaaacaaatcgaacccaaaattaatgggcttgtccttaaatagcacaagattgctgttgaaattgacatgaaatttgccattttgtcaacaatgtccttgggaatttgggaatttccctgatctgttcttgaatttgctttctgctctgatctcctcaactgttgctgaaacataccattctgtggcgagacggacagttcgcattcggccgttttttgacgtgcgccatgggacagtgccgagttgggacccaaaaacagcgatttgtaagtgatttgctcggcattttttgatcagaattaccacctatacaattgcaaaaattgtgctggacgctggcgcacactggtgatagcccgaaaatgggctgtcgttgctgatcagaagcagcagcggaggatgggagacgaatgtcgagaaactaaacattgagagagacaatcagtgacgactgattgttgcttaaactgtagaagtttggttaattattattagggcccggatgggggcagagaccccgcggggattttgcgacggttcccacactcgcccccggactttttggtaaaaataatggggacggagcctccgcaaaaatcggcatttttaaagaagctcccgtccccgcagtttgattaatccccgctcgtccaagtccccacattttcctatacagctagagcaggattaatggcataattagtgattattgccaaaatgattggaaagaataagttcaagagaagccaagtgatcagtaacattcattagagtgcgagggacgggagagaagcgaattttgtcaaaaaaatgatcaaatttaaggatttttaggttaaggtcaagttttaaaaacatctgaggacaacgcatccaccacactgaccaccgccagcagcggcggcagaggaggcgaggccgatgtaatcatgataatccggggattagtgtgctatttgaaaccaaaaaattccagagactcaaaacaaaaccgcggcttgtccgaggcttgagaccgaaaaaatcgaggccatcaagccttttctcgatatcaaaaacccaccataatgggagctattttaaaacattttgcttacagcgccgggttttttttgaaaacttttgtgatttttttttgaactttcgagcgctaatttagacattttaagctatcaaatgatagcaagaaattaaaaaattagttgctttggagcaaacttatgaataatttgatggttttttttgacaatatcattcataaatctgaaaattcattaaaattaacagacactgtccccccgaacgtgcgacacttttgacgatgcctacggcggtggctcatcatcaattgacggacattcggtgggagggaaggggaaaatattgccgtaatgggcacagggggacagagcggtggtccactattaaaaacggaaacgcacacaaatttggctttatcttgttgactcggttagagacaatgtgaaaaaacgcaattttgcggaaattggcacggattttattccattaaaaattcccaaattttcccccagcggcgcttctattagcatcaccggaatctgaatttggggggtcaaaagctgcgaacttttagtgggaacactcactgtccattcaaagggttaaaatttgccattgtaaaaaataacgaacgaccaaaacggcacagatgaccacggtgcactcgtcgtcaaatcggcattttgtcacctccaccgttccgccggtgtccatcgtggtcaatttgtcctcctgctgcaactgcacggccaacaattgctgtcgctgcaacaacagcaacgagttcaagcagttaccgccccctctggcggagggcggcggcggtgagcaatgattggtcaaatgatgcgccggtgccgacagagcgaaacattctcgtcaacattttgtccattgtgataaagcaggggagttcaaatgctttcttttattttcgttttatcaacactatcgctcacaaaatttgaatatttccggaacaaaaacaaggtctaggaaggaacccaaattttctgtccatatagatgggcaggaacttacagaggaatgcatctcctaggcaagctaattccgaaatgttgcgcaaacatcatagaaaatgaagggaataccgattttcagaatatcgcgtggcttcctccgatccagtcgggcaactgtggattcaggcttttagcaaactgaatttctcaagncgttagaatttgccccagaaggctnngtattgaanntgaaacgtatctttacaggtttcgtagcaagaanaagcgatttctatccatccctcgtgcttggtatcaaaaca

SEQ ID NO: 14996 - DNA, 2209 bp, Heterodera glycines
aatttttaataattttaaataaattaaagcaaaaaaaaaaagttgtaagaaaaatttacaataaaataattagaaatattactaattaaaataaataaagattatgatgatttgctcgtcgaagattatcatttttatatgtgatatgaatggcatccgccgatggggggcgagtgacaaagttcgttcggtatcgcccaaccaaacaataattaaagcgcctccccccaaaccgcatcattagacgtcgtccacccccaccaaatcgtcgccaaatgactctgatttttgattgattggatcggcaaaggtggtactgctgctgctggtggtggtggtggaggtgggggcggattggatttgatggggcggcgcggcattgatggggggggggggagcgggggaaggacgaataatggcgcggaagaaagaggaaagtaagcggggggtcaccagcagctgggcgcggcccaccttggcgcagtggaacttatctatgtattttctaaccgatcctagttttattttagaaatttcagtatgatatgtgcccgatttgcataccaatgccaaaaaattcattaattttcaaaattaaaagggggagaagcggagctcagtcggctttattttggcacaaggtgccgaaacgggggatccgcgctaaattgggtggattaatttgagcatgccggggatggggcaggggttggtggggacaagaaactcgtcgtacccccacaatccggcgttgatgaaaggtgatgatgttgtgacctccaaccgctggacgaggggcggggtggtcatctccatctccacaaaatcagtggcggcaccggtggcggagagattagtggtggacaaatgaatgaaaggatggaattaacgggacgaatgtgtacaaattgtgtaacaaaagtatatatatatagcagtaatgattggatgattatgataattcagtgatggacagaatgaatgaataaatggatgacctcctcctcagtgtgtgtgcttttctcaatgagcgaaaactgcggggctgctgctcgagatattttacgagaatttaagaaagatggtgaccaagaattgggccctcccccccccccctccccaaattcccaaatgcgagaccgggaatgatcctgaaactcgagaccgagaacttcgagaagaccaaaaaaaaactcgaaatttctcaactcgagactgagtctctcgagaagcctagtaaactgacccccgtcgccctcccccaaaaaaacaggaaccaaaattttaaactataattaagtatattgatattaccatttgaatcaaaatttgcacgatttaaaaaataattctatcgaaaaaaattggagattttctacatatatctctctcaaaatagaaatgaaatggacaaagaatgcatatatatatatatatatatatatatatatatatatatatatatatatatatatatatatatatatatatatatatatatacgtatgtgtacttaaacaacacataaatatggtaccattcaaaatcatggtcagagcactgaaaggcaaacaataggggcttaaaggaagaagagcaatggttagttaccgatttttgactgctgccatttttaaagtggtggcttaacttaagcacttttgtcgcgagaagaattgagtaaaagcgcaaatgttttgtgaaatagtaacaatttggccatattataggaagggtaattcaaattcatcaaatgaatttaaaaaaaattaatttagaaaagattgaggcctggctgtggcgacagacgcgcgacagggaaatttcatggaactttagttaaaatttcggcggaggggggggggggggtggtagttcagtaccaaaattttcatttttcgaaaattttgcattaattttttggaaaatgtgggtgaagcagattttagaggggttaaaatatggaaaaaatcaaaattttcacagcacaaaatacacaattttcccttaaaatttcgagtgtcctcccccctggggctgtcctccctgctaaatgatagtggacagaggggacaacagcagcagaaaagtgacgggacaagcagcagcagctgggccggggtcaattggtgacacttggccaccaattgggggcggggaggggagactgaggaggacagaaccaattgagaaataccctcaaacgaag

SEQ ID NO: 14997 - DNA, 2431 bp, Heterodera glycines
cccactgatcagtcaaacaccaccgacgaatgaacacacatatacaacactagaaaaatggtctgaatttgagaaggtgtttgtttgttcgtccacattcatcgctgctgctgctgctgtgcgcctgccgaggatgactcaacggttggctgtgaggtggtggccaaaccggcatttttgcttcccggcccgtacatatctgaaaaaggaataaaaagaggtttttcaataaaaaattataattaaaaaagcacttacggacaaatgagccgtcctcattgtacccccggtcattgtcagtgccaaattcggtcaatgaatcctaaaggagcccatttaaaaatgttttaattgtttacaaattagaaaaaatcttctttttttttgttgaaaacgcaccgattccgactctccgccaccgccccaaacgtgtccggaaagtgaacgattcgtctcttctcccctgcaaaaatagttcgtttataaggcagggatataaaaatttcaatgattttcaagatttttataaactgatcgatgccctaagtttagattgccataatcccatgttttttttttgtcggatgaattggtgaaatatctgagttctgatgatcagaaaagattttttccaaacacggactcgctcactttccaaactcctcaaattgacgctctttgggcaacattggctcccgcccgtgcaaccgctccttctccgccaccggatatttgcgaccacgctggtagaccaagcagcacgcaacgcacacacagaacagcaacagcaacaggatgagcagcacagcgagcacccagtagagggtggcacgtcgtggagctgacgatggaaaggaatgaatttttgattgacattcaaattttcaaaaaaaaaattcgataaatttccatttttagtgaaaagatccatcctacttgataattctcaagaactggtcagaaaacaaagaaagcttttgaagaaatgtatcatcatgatccatataaaccttccaaaatgatcaaaaccactaatatattgaattaattgaaaacttccttcaaaatgttttaaaattgaagtgagtgatcaaacggcaaaaatcccttttcaacaaaaaaatgttcaaatgccaatcacagcacttacaaactcccgccgttgtgatgtgatggacacgcgactcggtgctggacaacgtgctgccagcctcgtcccgttgcaccgccacaaccttcacatcgtatttggtgccttgcgtcagaccgtccactgttaactgtataaagaaattggtggtgatcgatgatcagcaaaagacggattaagtgtttcaaacaagaatgagagaaatttatcgtgtttttaggccccgatttcgaactcaagggtggggagttagttattccggccgcaaagcgttcctctcccgaaattttcaagaaaaaattttttcagggattttttgatccgtgatcaaaaaaagtcaagtaaagaactcattaggaatcaacgtttttgcgcacacaactgctggactacctgcagcgttgatttgtccaccggatgcttctcctgccacggcgccgtttcgtcgtccgcctcacggtagcgcaccaaaaacgcgttgcccaccggcgcaccgctggcctcgttgaaagcgcccggcacaaatgtgatgttgaaatggtcttcgccgatgctctccttgaccagctggggacggcttggctctgctgcgaaagcaattggcattttgaaattgaggagtggccaaaacattggcagaaataataataaaaaattataatttggcatttttttaaagaatgcgctttaaaaaaaaattacataatttgaaaaaccttataaatatatttttaaaaattatttaaaagaaattagcaatgaatgcttttgtgtcttttgattagactaaaagtgttattttgcggtgtgagattatataaatccatcacaagattcaagaatatttctgacgcgattaatgcttaatcaggattaacattaaatattactgtaacagaatcgtctcaccccctggattttcattacaacaaacaggcgattttttttttgttgataacagtattaaaaatgaggcaatgcgaaaaatgatttgaataatgcaaaagttaattctctctccatcccgcgcccaaaaaaaggggaaaaagttggaatggaatggaaaatttgaaaaaaagcacttgataatagaaggaataaatagacagacggatggaattgcccaactttcaaacccaaaatgctcaatgacaacaaaatcccctacccattgttataacaaccatttgaaatgttggacatagtacaaggccccagacaataatacacacaatgaatgtgaatgggttttgaataaagaacaaaacataatgatgggaa

SEQ ID NO: 14998 - DNA, 1672 bp, Heterodera glycines
gtcaactgacgacagcagtagaagtaaaagcgagcaaatgggaggggatgaagcacagctgaggatgactgctgctgaccgatggagggggggggggtgaggggataagaaggataagccgcaaaaatgcagaggagtaaaagcaacgagccaacccacagcagtaaatggggggagggagagatgggaggagggaaaatgtggccaacaaacaagcaaagaaatgcgagaaaatgggagaggaggaaaagtgaaatttgtggacatgaaacggaagggggaggaaggagggcaatgggccaagagaaagaattttggggccaaagggataataatagtcctggagcagagcaacgcaggggggggggggattattacacaacagcagcagcaatagaggaatatagaagggacagaacaaacaaattttggctggattatgatcgggaaatgtttgataaactttgaaaagcatccatcggaagtaatttgggagggggaagggtgacaacaaaaggtgttgaaaatgaggcaattgatgaagaggaaaatctgtctgtggtaataatgctgggattcaaaatttatggtggaatggcaaattggatggaaatgacgaaagcgtcgatggacggaacagctgactgacactgaggctttgaaagcttgcgcaaaaaacgtgttgccgcacaaaaatttgcatataagtgtcaatttagacaaaattaaaaaaagtataaagcataaaatattaaatataaataattgtgtaagaattaaatcctccttttaaatctaaccatcaatgaatgcattaatggttcttatgataagactgactcatccaaatttggttaattaaaaagaaaagaaatgttcataagagcaaatgctgcgcagaagcaaatggaaaattatgcataaattacttttaataaaatgacaaagagaataaaatacataaattaatatggcggaggaaatgggaacaaatacataaataaataaatgagtaaggcgggaaagaaaggacgcgcgccatttccattcaaatgacaagtgccgaattaaaggaattgagcagagtgttggagggcggaggagggagggaatggcacccaccacaaaacaaaattggtgggaaatttaattaaaattgacagaaagtgaatgtgccggcctggcggcggtaagtggggggggggggagaggaaataatattaaacattagggaggcatggcaaaccctcactcttgagcattttttggttgttgacccaagaaaggcatttaggtcggattttggaggatgggtggattttgtcaaccatcccatgcaaccaaaaatttcgaattaggctatttaactaaaaaaatatataaaatttttataattttttttttggtgcgccgtttcagccagcgacattttgtcttgcattttttgtttttgttttttatagtaaaatctccatggaaccgatgagtgttcgaacatcacatttgataatcgtgataaaagagaaagagacagcgagaagaaacctccaaaaaaaggcttattgggggaggggaagaagccacaaattttaacaaatttaattgtaaatggttagacgaaggcacatacacaaagcgcccgccatatgtccgtccccaaaaaagcaaagca

SEQ ID NO: 14999 - DNA, 2307 bp, Heterodera glycines
  misc_feature (28)..(28): n is a, c, g, or t
tcttattgcaaattgataaaatcatttnttgttaatattttttctaattcaataatatgtaaatctaggctttataatcgcgttttaatgtacatatttatttttgatcagcgatgttttgacatgctattagcatttttggttgattgagaaaagattggataaatttgtagatattaaaataattttgccgaaaattggttggatcggggttagcagcaggaattgcgagtatttagtccgtgttttcccttgcgggacgggccaactccgtctgagtcagctttgagtcaatataactttgttgttgatcgaatccaaccaatcttagaataattcaaatttataccaaaaaatggaaaattttcttaattttcttcaaaattaataattagggcagcaacttttagtgaaaaaactttttttttgctcaattgttttgaagaaagaagctcaaaaaacgcatttctgcgttaaaattttttcatttggacgtcacttttcgtcactataaatcactattttggcgacttcgtcactaaaatagttaaaaatcactattttggcgtttcgtcactattttttaactatttcgggatttttcgtctctaaaagttctgccctattaataatagctttagtatttttcttcaaaatgatttttcaaactattttagctatttcatgatatttagcttaaattcgacgaatttgaataattttggagaattttcccctcaatttgggaaaatttatatgcatattttttactttttatgtgcatattttgcaatttttggtgcagaatattttgcaatttttggtgcagaatcattttgagtattgagcaatggagtcaaaatacaccccatggacggtaaaaaagaaaaaaaagcgacataaatctttttatggataattacagaaaaaaattggcgttctgtcacaattaatttttatctttacttatctcaattttatgtactatctcttcattcttaataatgtaaaaaacatttacttcatcctgtttaactttttttctgtttgttaaatccacaccaaattttgcatatcgatagagaaaaggaaaatgagcaaactttcagtgttttgagtaaaaattttggcctagaacattactaaaaatgggatgaaaaaaatttgcatttctttttctctccttttggcgtactattttcatgtctctaacacattaaaaaacaccaaattcgaaaattctaataattttggttataagggtacaaaatcactttgaacatttagaatcaatagaaaaaagaataaatttagcattttggttagaaagagctgcctaggacttgagttataacgtgatgaacatttgaaactcgcacaacttttcaaaaaaataacctttttttgcctttttttatgggaccaatgatgttaatgattaccaaattatttcactattcgtctctattttggaatttttactcactattttagttaactatttcaagattttccgtcactaaaaatcgctattttttattacatttttcaaataacgaaaaatgtctgctaatatttctgaaaaggatgaagcattgagcgatctcaactgtctcttcgttcaaatgaagaacaagaagttcagcttcagtttgatgtcaaaagtggcacagaaatttggcgatggtggagtcgccgcaaaagtccttctgccatacgaagtgtacaaagagtgagtcgcgtcgaggatgggattcaatgcgttcctttctttttgcctttagggctgtcgatcttttggcttccgctcgctttgaaattgattatcgcgtggtgatgtacacttttgtttacttttttcttggaagaaatcgcccttttcagtcactttcttcccactttcaaagccattttcctccatctcagttttgacgattggcaattggcgatggaacgtttttttgagatcacagaattgcgtcagactcatcgaggctttccacgagaggaaatgcacacgctcagtcactcatattcggtaataaaacattaaaactgaaacgctttggtccgtcgtttctttcttctctctccgcttttattcttcgcttactaagtttatacctctgaaatgcgtttgtttcagcttgctttgttggaaaatgccaatttcaacaaagaaactgacaggacttctgagtttctcttcactgactatggagacttggccaatttcattgacaattgcttcgaatgccaatgccgtcaattgtcttttctcattttactggagggaaaagcgttgat

SEQ ID NO: 15000 - DNA, 1334 bp, Heterodera glycines
aaagtaagtagttcattttttacattttttaaatataaaacacgctcatgtccatcactttattcagtttatgaagtgcactcccgcgcttctgaagtgtgcaccgcccgtggcactgctcagacaattgcacgaagcggtgggacacgagggacaaaaccttatgcttgtacgattgaagtttggactcacatcgcagtgcgacaacattaagcgaattgtagactttggtcagttgattgcatgggcgtagccagacccttggctttgggggggggggccgaagtcaaaaattaaatttttagggttttgtttttcttttttcattcaaatggtaaaatgggggtctggcgtatacatgaaagggggggggtcgtagcgaaggggaaaattctaaaaatttggctttttcttaataaactcgttagaaaatttttttgagaattttaatgcaatttttgttaaaatagtgctaatgaacggaatgcattttcttgtccacttttatgggcacattttggattaaaattttgttggttttaatatttttttaaggtgaatccagctttagcgttgttgaggactgtgggcccttattcacagaaaaccaattaaagtttatggtcgacgaacaattgatcactcaaacttggaggaattccaatgccatgacagaaaccaaggaggaaaattgtaaatagcaaccaccgtaaatattttccccggttcacgactgactgattttggaagcctaatttgccgttaattcctttccccgcacctgtttttgtttcccagaaaccatccaaagttctcatctactgtatttatatgtgtgaaaaataaatatactgtatttaccatgacagatattgagttgtggaactgtgctagagttctttgaaaataaaacaaaaaatgctcagatcctaagattttaatttcaaaaacaaaatgactttttttgtcgtgacaccacatcttttttgaatttaaatttgaaaaacgagacaataagttttagaattaagcacatttccgaacactgattaaaaataacaatcacagtggataatgtgcgtgatcacatttattttatcctgaagatgaaagtgtgcaagtcttacacaaatggataatcagcgtgtcgaatacatccgtcatgccgaaatgagcagcgatggaagcgcatttgcggtagccggacaaacatttctgacaaacgtaattatgaaaggattattagccatgcagttttgtaaaaaatttccaaaattttttcatatattgtaaaaggaagtaaactataatattgctcacacctgtcttgtgat

SEQ ID NO: 15001 - DNA, 4717 bp, Heterodera glycines
  misc_feature (96)..(96): n is a, c, g, or t
  misc_feature (1990)..(1990): n is a, c, g, or t
tttttggtcccatattttatgcccatatttcgcgattttatatccatattttggatgccctatttatgatggtgcagggaatgagaataagagganaactatagagagatgaaaaagaagcaagagaggggacagaatgaagaaattctgagaagaaattagagaaccgtgagagagagacagaggtgagaggacgtgagagagagaagggaaagagaaggaaagagagagataaagagcagagagagagagaagagagagggcagagaaagcgaagagagagaaagcagagagataaagagataaaaagagaaagcagagagagagaagagagagtaaaagagaaagtgagaaaaaattagagtcgtgagagagagagagagagagaggtgagaggacgtgagagagagagaagagagaggacagagaaagcgaagagagagaaagaaatgagagaaagaagaaaagggagagaaagggagagagataaagagagggagagagagagagaaatacggatagagagaaagagagagagtgaaagaaatagagatagaaacagggagagagagagggcgaagggagagaaggaaagaggcagaaagaaagagaaagcaagagaaagcaagagggagagagaggaataaagagcggttcgctctttctatatattaattttgcagtgtgtgtcacaaattaaacaaaaaatttaaataaaattttgacgcgattgtttttatttggatggaagaaatgaagtgaaaaaacagagataatagagataagttgtattgtaagaaagagtgaagaagagagagagatgaagacagttaggaacaaagagcggagagtaaaggagagagaaatgattagagaaacaggaaaaaagagagagaaagtatgggagtgaatgagacagagacaaataagagaaagagagagaggggggagagagaaagaagaggagcgagagagagagaaaaaaggacagaaagagaaagagaagagggagagagtgagagaatgattaaatcgagagagaataaaaaaggagttgagagaatgagaaaaaggagagagagataaagagaaaacaggaggtagagagagagagggggagagagaagagaagcgagagagagagagagaaacagaagagggagaaagagaaagaaagggagaagaggagagagagtgatagagagagaaaagaagagagagagaaagagagagagagagaagaagagagagagaaagaagaaaggagagagaggaagagagagagaaaaagagaagagggagaaagaaagaaaggaggagagagagagagtgaaaagaggagagagatagaaagaggagagagagagagaagagggagaaagaaagaaaggagagaagggagagagagagagagagaagaggagggagagaagaggagagagatagaaaagaggagagagagagaaagaaaaaaggagagccacgaggagagtgagaaaaagaggagagaaacgaagagagagagatagcaagaggcagggtgagaaagaaagagagaaggagacagagagaaaagaggagggagtgaagaggagagagatagaaagaggagagagagagagagaaaagaggagagagaggaagagagagagaaagaaagagaggaggagagagagagaaaagaggagagagagagagaaagaaaagaggagggagagaagaggagagagatagaaaagaggagggagagaaagaaagagaggagagaagggagagaaaagaggagggagtgaagaggagagagatagaaagaggagagagagagaaaagaggagagagaggaagaggagagagatagaaaagaggaggaagagagagagagagaaaaagaggagagggagaaagaaagagaggtgagagagagagaagataatagtttttttcaaagctcggctagcgcgaggtgcgcgagcgaagcgagcgcgcctgncgctagttttattgaatcaaaagtttttttttttgaaaatctaccattttgcaaaaaattgaaaatttcgtgttaattattttgaacttactttttctttttttttaaattgcttttttcatttttgtttaggaatttctcgaatttgtccgcgcggtgtttgcgctgcgcggccgcagcgaccaatgcgagcggaaacgaaaagccgactctcttctggtggccggcactggcggcggtgcgtcggctccaccgcaacaacgacgcggctccaccctcgtgcgaaaaacaacgattgtgcgcagtgcggtaaaaaaaattgttaaaattttagcgagatttttccggagagacaatgaaattcccatttatggacctgtactgatcactactgatctgccgaatattgatggatcaatctaaaattaatccccctcccctaattaatccctcctaaggcaatgtttgcgtcggcaatcaccgcgcccaccgctggccctgccattgcgcattttgggcgcgcgcggagttcgtcgggcgcggacggtgacgcaatgacacggacagcaagcgaacagcgcgcattggttctgtttaaagtgcgtgcggaatgttgaaaagcaccaagcggcttttgagggttgaaatttttcgagacttggtcgaaaaaacttaggccaaggcatcaaaaaaaaacaagaaatttttaaaagcgagaccaacctaaactcctagagtttaggcccgatgtgcccctaaaaacagataaattctagaaactccaggaaattgtttgtagattaggagaaatcctaaaaaacctgggttttcagtcccttaattacctaattaggtaattaattattacggtgtttttgtcaaattgcgctattatttggacagcaggaattggacacggatgagaaaggctttctgacgaccaacgattttgaacagtttttcgcctgccaacagaagccaatgatttttgtaagttgactaaagcaactgacaaatcagagcaaattttgacaaaaacctttttaattgaactcatttaatttgtaaattataatattttaaataaaatttagtgatataacattttttagaggtttttcgagatcgctgatcacgaatctgcaatttttcaattttactttggttttaccgatggatttcggtttcaggaaatcacaaaaatttattcctaagatatacaacagtcacaaatcaatattgatcattcaagcaaaaaacaacaatttctatgagcacgtcaataattattccataattcaaattgatcaatcatttctcagcaaatcattcattaactgctgcagctgatcacttgggccgggatttgcgtcgaaaagcctaaaaattgaaaaacaatcaatttcaatttttgaaaaagcatcacttacccatcgcctatttgttcatcacgatgcacacgaatgtcaattttgttccactgatcaaaacatttccactcaatcgcttcttcttcccattttgtccatttgctttcatctcgcgcaattggatgacggaccaacagaaaacgatagctgctattgtaagttcttttcaatgccagttgttcccgagtcaattcattggtcagcacaaagggcacaacggaggtatcgacagacgttggacgtatccaaatggaaacgatgaaattgacgggagatgaagccgaggcaaatgtctaaaatgtgggaaaattgactaaagaaacacggaatcaaatcacctttttgagcggctcgatttttgatgcccatttttccaaaactaaatgcaacgtgcatttgaatgtctttggcacaccgtcaggacgaggagtgaaaagccatttggccaatgcttgtccatccgatgccgcggcactgtcatcgcatggaaattcggcgaagaaaccgtcatgaaagagattgaaaaagcgaagcgatggacagtcgtcgagaaatgacggggcgaatttgcgcaaacggtggaaatatggggcaggcgatcgtaagccatgaatgttttttccgagcaatgaccaaatgtgggtaacgagcatatcaaaaatgtagctttttgagctatccatggccacaaaaattggacagacggcgaaaagttggcgaaaatggtggagaaaagtgatgacattgcggtcgatgaaactgaaagggaagtgttgacaaaaaattttgacattggccaatttacgagatgttgatccattcgaatccgatgactttgcgtggcatttgaatttgcggaattggcaatggtttccaacgagaattgacaatttccatttccttggtgccattttctccaattttgcttcgaattcgaataagtgccaatgtccttttgcgcgttttgaagtgttcgtccacgtaaatgtcaaaacggtggctgatcattgcaatgccaaagccaagttgtgaaggcgtaatcaaatcgaacacacaaagccaacagtcgttggagatgaaactgaagaaaaggaaaacaaaatttacaattgaattgaaaatggcattttaattttacattgctttcgccattttctcctccgcttcttttcggttgtcagacattttgttgagcggaaatgattaagacagttttggacgtgcttaaattagcttagcaaagatgaaaaaattatgtgaaaatcagcatttcctttttgaaatctgttggcttttg

SEQ ID NO: 15002 - DNA, 3787 bp, Heterodera glycines
taaaggattaattttaggattgatttatcccattttcccggttcctaaaatctttaaaaaatagtttttattttggataaaagcgagattgaaaaaatgtggatttggaaagtcataccagacgcgtcaaaccaagctaaacacttttttcatatgtttcagggaacattccaggaaaaaaatggatttccatatgattttaagctctatcgatgaattttatgtaatttccaaatgattttatttttttgtgatttttgaattttttttttttttttgaatttgatttatagaatagtttggagttaaagtgcgtgtttttaattgtccttttttggtcacgtgattgattgtcgtcaattgtcactcacctttctttacctttgttaaaattttagaaaagaagtctctttaaagaattgtatttacgtcgaattagtacattaaatgattttatataattttatgatactaaattacactaacagtttaggaattaaaatgagttttatgcaattgtacaccgtttggcttacattattttccatctcatttacttttttgccactgtaagtgcattttttatatatatctcatattttttttttaaatttagtttcgtggtatccgactggaaaaagcgtggatcagccgatgggttttcatctgtcaattttgttttgccagtttttatgtgggtttattattttttttctttgtaatttaccaattgtgcccctccttccctttcgagaaatttttctcaaaaaattctttaggatagattatgtatatattggggtgttcggaaagttctttcatagcggtcgttttatgtaaattagaatttttttcgcacccaaccgcaacctttggccaaattctttctgttctatgggaaggagcacattttgctgcatatgttacgagccatttcattttcctttctttgtaaattgattttttaaaattatcccaatggagcacccaaaatcccaaatccgatcacttttattgtacgggtcaaaactttgctttgatcagttggaaatttattaaaagcagtttttgtggccaaatcaagtccggagaatccaaatctggcctcagatttgatctctgaattgtctctggcattgtactgctccatgtcgttgacaatttgtttttcctctttaggatgagttgttggttcaaacatggctatctcaccaatgacaatttgaatatgcttataaatggtatcaacttgtgcttatttgccttttacattgcggcctttgccttttatcagccaaaaagggtaggcgataaaacagagttacactaaactggaaattattatatttttcaagagcaaaatgagaatttgaaaaattgtaattatttttaagttttgtttaaattcgggattcgaaattaccgggttaaatgtcagaatttgtgattagcgagtccgaaataatggatttcacaaaacaagaaataaaggcacaaatttattaaaattatttcctcaacaattcttcctttggttctgataggcgccgccagagaaaatttcaaaatttttgacgaatattgtaacagattttgcccaaaaaatacctgaactattttaatttatggtggaatttgttatgctttcaaaaataataaaacaaaggacaaatcatttaaaatggatcttttagaaatatttgtgtgttcaactgacttctctggtcattgccctctttactttgttctcttatgtgaacaataaaccagccgaggcccagcccgactcaatgggatcaattgcagcagcagctcaagtagcatcattagcaggtgggggagggaaaggggtaatgccacggggcattaattgcagtaaaagagcacatatccattaattcttttcaggaaatgtctatgatttggtcagtttcgtcttttccttcggttgtctctctctattcggtatttcatttaagaaaagggccattttcgacttgaaaacgaccgaatatatccccgcctcaattcaattcggcctctttgcccttaccattcagtggtccatttttgcacttattgtcggcaattcttatatgctggtgagtttcgaagctctccttgtctttcttttgcaaaaatgggcttttaaggttgccaatttggctggtttggcagttaatctcgccactttggcaacatttgttgcgtatccacccaaaacttggaaagtgccaatatttggtgttggtggagaagagaaaaagcagaagtgatcgctcagaagaagtattagtattagtgcaattcacgagtatatgcctagagattgcccaattcaatgcctccgaaataaacaacaaatagtattatttttgaaatgttaatcatattaattgctgcgcgtatcgataaaagaataattttccgttttgttgattatttctgcaacaatttcgtcttttttgcgtgttccatcgattgtcaaaacgccaaattcccctccgttttctgatggtaattctaaatcgtccaattgtgatggtatcaaattacacttggcgaagtgattgctcctttcggctgttcttttccttaaaattttttcggggaccaaaagcataattatcattttgtttttgccgttcggttgcatccgatccaagagaaataatctgccaggggttaatttgtgacaattaaaacacaaggagaggttaattgtcacttgccggtattttctcttaagcgctgagcaggcgacgacgaatctttcggctttttctccgttcgcccaaattttagaaaccttttccaaccatggcatccgatcgacatcttaatgaaacacctaattaaaaatgttaattagtccatgaatcggttaattttaaactccccccattcgtttttctgtaagtaaattcggaccggagagtgcctcccctctgcccattttcgctttgttttcctccgtatgaaaatcatccgcatcgacgaaagtgtaaccgatttttgtcgccaattcctttccgattgtgcttttcccactcccacaaaaccgccaatgattagaacagaagggagaaccattcgacgagaaacagaacgatatgcactaacagaataaactgataaatgagcactaattgtaaatgaaataactagggctgcgacttttagtgaccaaaaatctcgaaatagttaactaaaatagtgagtaaaaatgccgaaattttgtcacgaaaaaaaatttgggggaagaatttttgagaaaatttagtgacaaaaagtcaaaatagtgatttttaactattttagtgacgaagtcgccaaaatagtgatttctagtgaccgatagtgaaaacagaatcgaaagtttttaatgctgaaatgcgttttttgagctcctttcttcaaatcaattgagaaaaaaatttagttaaaacttaaaagtcgcagcactagaaataataataaataccaacacaatcgcaaaaaaaccgaagccacacaatggaaaaagaccgacatatgcgaacaaaagtgagaagtgttgaatgaagattactgtgattaacaaagaggaatttaccaatttatgcaagcttttgaatttatttgcgacttaattcgcggagcattttgagtaagaacaatgttccaacaattcttttgataatgctagaccatattccctgactttatttatccttttcattgagattaactcttcgcttcctcagcatgagaaaaaggcttgaatttatttgtgacccaattcgcg

SEQ ID NO: 15003 - DNA, 2631 bp, Heterodera glycines
catttctttttttttatttcttttatttttcccacttacctcttcttttttcccactccttccctctcccacacacacgcacgcatccaacagactgctgctgcacaacagcacgcgcctgttcactgtctacccctcccacccaccgctgcccgcatcaacagacagtcagacagtgcactatctccctcctccctctacctaaccacaacagcctgggaagagaaatcttttagctttaactatttcttttgcttttttcttttcctatactatttcttttaccttcttctttttcaaaactatttcttttcatctctttttcttttcaatctctcctcacagcaaatacaaaacgccacattcaaaccatgttacaaacagacaaacactcaactttattatataggattttattgaaaaaagcagagattttcaacgcgattttttcgcacctaacccctaaattgaaatttttcggccatataaatccgctcgctaaatttattttctctcttatcccaaaggtaaaatgattgatttttcattttataaaaccacgcattataatgatgaatgtaacgaaatgcttaatcggcaaccaagaaaatttgaaaacaaactcagtgcatgtggtgatcagaagaattttaaggccatgcttgagaatttcaactctttacgcgttaacaggcaattgtgcgacgtcgaaattgaggttctaacagagcatttttgcattaaaatatacagcacatttagtgccagggaaaatcgcttttggtacataaagttgttttggccgcgacaattgattattttcgcggtttatataattttggaatggtcgacgcgcaggcggacaaaattgaaatcaaagttagtcaaaatgcttaacaattacatcagttcaaagttttcttaggaagtgtcattcataggactaagtcaaatcattgacttcgcttatacttacgaggtgaaaatcaacgaggaaaacgtcagagaattgttacacgcagcaaattatctcggagtaatttttgaaattaaaatattaaatgaattatttcattcgataaccctttttcagcagttcattcactttggttacctatcctttgcttttgagcgtattagttaatacattcattttttatttcatttcaggtaacttttgtgaaggatggctgtgagcattttttgataaaattgatgacaattgaaaactgtctcgggttgcgagaactctctgatcagcacagttgcgaacaacttcttgccgcaattgaggcatttatgcttgaacattttatggtaaaaaaaacattatatgagttgaatttttttcattcaaaggaaatttgccacaaagaagaatttatggcattggattcggtgacaacattagagcgactggcgaaaagtgacgatctaaacataacagacgaacggtttttgttcgaattcctcgtcaaatgggttgagatggacaaaaccgggttacaaaccgccggactaacaataaagaatatttgataattggcatgttcaggttgaggttaaattcgctgactcgcctccttcgatttgtccgtttttttcaacttcccttcgactattttgtgaacatcaagcaactcccgttgatttcccaatcgtctgaagcattggcatttgttcagtctcaatccgaagcttttttggaggcaatttctgcttctggtatttattttgtaaatttttttgcggctaacttatccgggagacgggaataaggcccctgttcatgagtccggcctcccataaacgttagaccttgtcaaacagaattttccaaatcgttgggccgtttgcttgcctcggcctctaattaaagggctctttagttttctgcttttagtttgttcggcttctcattcgttggccgaccaatgtctccaacagcgttttgttggcggccacaaaagcacgctttctggctccgacttgcacatttccagccgttcatttccgaacaaaaatcaaccttccaacagagagtcgtcactcacagcttcaagctgtttgggccagcatcaattaaatattttgtttaaaaagaatggttagaagaacatttattggtttctttatcacttatttccttgtagaagatttgaaactcttaactcgtccaaggaaggccagtgcgggtgttatattttgcgttggaggacggggaccacgactggatccatttcgttcggtcgaagtttatgattggctgcacaacaaatggagacaaattggcgagttgcgcatcggacgaaggcacgtcggcgtcgtttgtgccggccctcgcatttttgcgattggtggtcatgacgggacggaacatttgagttccgttgagtgtttggatttgggagacgagtcatggagcgaggtggcgccgttgaatgtgcgtcggcgtgggatggcggtcggaaccctcggcggagcgatttatgctattggaggtcttgatgatcagaattgctacaaaacagttgaacgctatgatattgagcggaacgaatggactcatgtccaggagatgaacactccacgagggggcgtcgcggtggctgcttacggtgtggtgccttg

SEQ ID NO: 15004 - DNA, 1420 bp, Heterodera glycines
acgacgacagcccattaagcacttgcgagcgttataattttgcagatgactcgtggacagaaattccgccgctttcctgcgcacgcggtatctttacgactttccgttaaaagatgtcccttctaattgtaaggcggagttggcgttgcggcgatgggcgcgcggattttcgcaattggaggccacgacagcaagagctacttgaacacggtcgaagcattcgatcccctgagccaaaattggacagatgttgcgccaattaaccaacgacggtagtgatttatccggtagtgtattttcatgttcatttgcatatttaagagccggtgctggcgttgcatggtcaaattgctttataaatgaactcacgtttccgttgaagtagttttcacaaaataattcgagttttcagatatttttttgattttttccattttttccaaaagattcgcatattatctatcgctgcataaaaatcgatgttcttttagttattttttggtaaaattacaactagaatccttcaattatgccctaaaaacccaaaatatgcattgtcactgatcgcgaataaaacaccgatttcaaccaattcctaccatgattcaaacaaaaagtcgaagccaaatttttcgtctaaaaatagtttaaaatccttttattgaagcattgatgactttccttccctggttcaaaattggtcgaaatgaaatggatatctattcgtgatcatttacccagaaagtccttggaaaatatccaatataaatatggcattttttatttatatttttatatattgatatccgattttccagtggaaaagacgtatttcataaattaagtagagcccggaaattacaaagttgcagatcacacttcggtattggaactaattgactaattttgcggcactggatcccgcaaacccgtttaaatttatgggagaccgcgcgggattgcaggatttttggtaatactgcagaattgcggtcccgatgaaaaataaattttgttttatgcttatctccttgggtaaaaaagggtgctcattacaatctgagctcaaatttgcaaaatcaatgtttttcataaagtatcgtaaaaaaatgatccgcagccaagcggatccgaaccccagacccccgtctcatatgacccatatggccagcaattaaatttcaaaaaatcgtaaaaaacgaaaaacttagcttctccgaacattcagtaacattttatttttatctttcctggggtaaaaaagggtgctggttacgaatctgagctcagattttgcaaaatcattgattttgtctatgactgttcatcaagtacttgattttttccaaaaattttaagaaaattaatcgggcgtaaaatattcattcctagatgtatagagctcacaaagagctttcga

SEQ ID NO: 15005 - DNA, 2359 bp, Heterodera glycines
atggaaaaaatcgtcctgacgacgaccctattttaaccaaaaatagtcgatttttgagtccaaaattttaaaaatttttggggcccggcggtaccgatggatggcatcggcactcaacgggtcgtcatgccgtagccatttctatattttttgttgttttattttgcgttttgccataatggcaaagaattcaggcaaccaaaagaaaaggtgatgccataaatgttttcgaaacgaactttgatacaccgcgttcgaaacgggacactaacgggccaataaatgttttgttgccacagaaatttttttcttggccaaccaaacttggcatcattcaatagatgtacatatccacaaatatcaaagttttggtccgcgtgtcccatactcaaccaaaacgactcccaaattttcaatgaaacatggagaggcgcgtcggtgaaaattttttaaatttactttgttcagaaaattggtttacattgaattaaaaaggtcctagaggttatcaatgttttccattcccacccctaatttgtatgtaaaaactgagttggcatatcgtacttttgacaattgtcgagtcgagcaacagccgtttccatggcacacaaacggtcagttcctccacatatccatccttcagtgaaaggattcgaacacctaaaaaagtgggttaaaaagcagttaactttagatttggggttggccaacaaatgcaaaacgatgaaaatgttccatttaaaaagtcaggtctaacgggtcgcaagaaattgcgatagggtcgaagaaaacgccaatttttgatgccggaagacaaatcatgttccaatgtattccaatgaatgcaaatatgttttaggtgagattgaggagggggtagtttcaagaaattagggaaatttgcaaaattgcacaaaaattggcaaaaaatgcatgcaagtgtccattttgtccacccacccgatgcttccaacgtctctttgatgcactccgaattgagcgtgtgcggtcggccaaatgcaactccaaccggtccgagctcagctccgtcttcaaatattgtcctacatagctaaaaaaggcacaaatttggggaagctttatttgtccaatggcattttatgagttcaatcagaatttaatgagtccactaactatcaataaattttaagctggctaccctgtctatatagctgttattaattaataattatcattttgtcactttctttaaatgttagtacaaccaacaaaaagcatcgccccgacgaagaaaaaacatttttatggctttaaagctttttttttttttggaaaacgggcctgggtgagaaactcggtaatagtggagaattggtgtcccggcgaaaaataaattttaaaaaatttatttttcgagtcttcaagctttcgctttataacaaacagccaagtattggtggtttttttaaatttgtaaatttcttttaatcctcccttaaatttgtttcttaacgtttgtgttgaaaagtgaggggggggggggggagagagggcggaagcaaaaaaaaaagcgaaataatcaaattttattcattttcaaaaatgtctgtgtgtatgcatgtgccaatatcaatgggtgtttcttcgttttttgtgcctctattgattcccgaaaagacggcggaactgaaaatcacaggaattgttcgaatgaagaaaggctgagggaatgacaaaaactcacgaagaagacagagctcgcggcgagttgcgcgagtcgcaaacgcacggcaaacgcgacacgagcaaacggtggacgtccgcgtagttgtgtacagggttaaaacgacgaggaaacggacgacgcacattggagaaatagaaacggcgaagaagaacaatgaccaggattacgcagcaaacggtgccaaacggaacaaaaaaccacggattgaagaggacggccgagaaatgtgaaaactccattttttctatctaaattgaaagaaatgtctctaaaagataagtccatgaatatatgggggaaaacctaattagtttttcaataaaaaaatactgtatttttttaatgaattttggcactttggaaaacttcttgatttatggttacgattacaataatatttgttatttaaagatacgaagaataaatttagaattttggttttctgaaaacagtagacgaatttgtttttaaaaaaacaacaataaaatataatagtttttaatgcataaagcagccacagccattcgttttagcgaaaataaattgaatttgcttgggttccattccttttatatgtagttattcttcgagacattttttacaaatatttaatattggggtttttaa

SEQ ID NO: 15006 - DNA, 4282 bp, Heterodera glycines
  misc_feature (4248)..(4248): n is a, c, g, or t
ttttgaaattttgcaggctaatagagcatgttaagagctttcgaatgatactaagaatgttgaatttggttgacagtgaaaaaagttatagccaaaaagccgctggggccgaactgattgtgagccggtccgtccgtaatcgcattttttaaaaacaaaacataatgccaattttctaagaaattcgttccgataaatttaagacttggccaaaataaaatttgcacaattttaaatcgcgggtgataaataaatttacacaatttttaaatgccttaattaacaagagttaaagcttaccctaatttgtttacatattttagcccaaaaaacaacaatgataattttgtaaccaattttctctttttcctcaaattcggaggcttgtgattaggaattggacaaaatttgtatgattcggaataactatttatacaacatattcatggatggatacatacataggtatgtacattggtaacaatgttgggggtcacacaaacacacactattgagaacattcgcgtcgagatgctggaccaatgctgggggtaatttgggtgcctttgaagaatctgaaggacagctgcagcttcgcgtcaatcaccagcaccgctcccacattcttttcagtcacgtacatcggtgcggagaacagcgtcagcatgtaggagttggcaaagaatgagacaccaaacgggacacactgaaaaagtggggagaatgaaataaattacacattttcggatcacacaaatcccactaattcggccctctaaaaacaggggagaccaaacgcggaccgaaaaattttgttattcattttcaaataacgttttaacgctttgaaaatgaccaaaaaaatcgcttcgataaacagtcagtcgtccatgtgccgtgccgattatccagccccacctgatgagcgcggacgaccaattcgatgttgagctttctgcaaacttcggcgacgacatcggcaccgaacaggatgctcactccacgcgggttgggtgccgtgccttccacagcggttgatggatcagcccacagcaggtcgagctccagggacggaactggcgggtcgatggacggacggcgcagcatgcggagttgctgaatgttggtcatctccggcgcgattccaccatgcatgccttaaaaaaagggcggggggattagagttcgtccgatcgatcagacagccgatcaacggcaaaaaactcacacagaatacagtcgctgaccaatccgacgaacggaagccaggcgaatgtcatgttgaaccgctcccacagaggccgcacattatgttgtccataacgctcgtttatttcgtcatagaacccatatctgaaaatggggggggggattttttttttgctgaaattgagttaaaatgtgacacatgggacggcaccacagcactcacattctgttgatgctggcacattcgtggttgccgcgcagtatatagaattcggtcgggtagcgcaccttaaaattgggggggggagggaaattggccctgcaaaatgatcaaattctccctcccgcggcacgacatttccacccaccttgtagagcagcagcaggacaatcgtctccacactttgattgccacggtcgacaatgtcacccaggaacatgtatttggtgaacggcgggtagcccatcttgttgaaaatcctcttcaggtccacaaattggccatggatgtcgccgcacatgaccagcggtggtttcgtctcgacaagtgacgcctggtcccgcagcacattggtcgcgtcctcgcacagttgccaaatggtcgtcatgctcacctgtgccgttgaaaaacacaattagcaatgtgaaaaaatgccaaaaaaaaaaatttgcggcgcctcacatcatggatgaactgttcaggggacgggcagttaagagttgtcgcgatcagcgtatccaattgcttggtggtcaacggagttgaagtcgtcggcgcaattgatgaaacagtcctcaatgacgacgcgccgtgttgctgctcgccaccgtccgccatttgttgttgatgatgttgttgatgttgaatgacgatgaataaacagaagcagcgccggagagcaataggagaaataaggaggacgaaattatggattaatgagtgtgaggagggaaaacaaagcacttttatagcaaaatttttttgctttttctaccgaaagtttgaaaatttcgaaactaagagaaacattatgtcaaagcttctattttcaaaaaatttttttttgttttttttcaaaagcagaaaatctacaatttcgccttttcttcaaaaaagccttattgtattccggattactaatttatggttggcaattcaattaaaaaataataataatttgccaaaaaaaattttaggaaaacgatcaacaacaatctccggaagaccaaatttcagcggaagcggcaatcaatttgttggccgttaccaccactcaccagcacatttttgggggcagaaatggtgcactttttgtggaaatacggcgaattgcggagcaacaactggaacacgcgttggcaccagtcgatggtacacaaaatttggatgggattttttggctagtgattagaacatccaaaaaactattccttgctagatttctatttttgtttttatttctccgaacgttcagattaccgacaaaaaactgagtggtaaaacgtgtctgttgcagttagttacattaccacaaaatctgtttttttggccctgtttttatacatttgagaaattttctaatccaatgcaaatctattttaaacaaaggttgcttaatttgtttggtttcagttgctggcggaaaatgggagctgtttgtgaaggacggcgaactgcgcatgtacagccgcgagttggaagtggagaatggcattgcggttgacccgttgaaagcgcttcatgtcattgatgtgcgaaaattgcatttttaagcgtaaaacaaaattcaaaattatggctggtgggccgtccagttttacacaaaaaaaaaacttattcggcgccattttggtcacacagttaagccccatcgagcaaaaattatcaaacaccgacaaaatcaaattttcgacatgaatttatcgtttttcagggtgtgtcggctcacgaattcatcgacctgttctttcgacctgaactcaaaaaggaatgggatggtgaggggagagcgaattcaaggcccaaaattcctaaaaaaatctgttttttttcagatactcttgaactgggtaaagttgtggagactctttcgccgcacactgccgtcatccatcaaatccatcgccgggtttggcctgccgcacaacgcgagtcacttttttggtattttccaattaaattttttgatttttttttcaatttatgtttttaggtcccaacggttgaatgtgttgtcggaatgcagctctgtgactgaccatgtgccgggtgaacttcttggcgcttggatggtaaattttggacaaatttaaaaaaaataaaaataattttaggtatgcaaccaatcggtggaacgcgacgatgttccggtgattaaaattttgatttttaagtccaaattttaaaccaaaattctcggcaaattttctttatttttcggtcttttattgtttcgacatttcctttccattcagtgtaatcggataaactcaattttgtcagctttccgacccatccgcggtccgtgtccgtctcacaattgcgatgttatgccgcacagtgttgaagcccggggcggacagaacgaagccccgtgaacaaatcacacgggaggacatccgttgcaaaatcacttatgtggcacaaagtgaggaggggaaaaatacgaaaattcaaaggtgtaccccaaaagcagaattacagttaaaattttttgcatttttttacatttctaaggaaaataaatacctaactaatgccattgtcattggttacatctgtgggacacacagaaatcgggcaagcgaaatacggggaaaaactgaggggggggggttggctcggtcctggtgccgaacagtcaaaacccaaaaaagggaaggaaaatgggtccaaagcagtaggtgctgactttggggaccgaaatgggtacaagcggctgaaggagccgccggacaggaaattggaaagcccaaggggagggccaaatgtgaagcaaacgtgaaatgtgacaaaaattggaaaatgaatgaacgcanaagtattttttttgttggttttatttggtttttt

SEQ ID NO: 15007 - DNA, 1419 bp, Heterodera glycines
  misc_feature (1364)..(1364): n is a, c, g, or t
attcaagattttttttatttttaaatgcattttttaccacatgaattatgattaaatttttgcgtttggaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctaaaatgaaggaaatattcgatgctgtgcgaactctttgtgacccctctctgactctgccaatgcagcagttgaccatttttaccactatttttctctcactcatcgtctgctcgtctctcctttattataagctatttttccaaagcccacgcctttctctcttttttctgtttgttatttctcattgctgctgacggtgtcttcctattttgccatttttggtgcttattttttctcacctaatgcatccatacttttttcattaacctctggaagccatgaaacgcacgaaaaaaatgtttttttggtttgacgctattggcttttttaaccgtaaagaacgtaaatactcggaaaaaaactttttcaatgttttttttctcgggaattttgtttaaaaattttgtgaagataaacaaaatagcaaaaaaaaaaaaattcacgtcatttttttttcttttgaaatcattttaatatcgcatttagccattttggagatgtttttaatatttattgcttaatttgttaaaatttagtgtgtccatatttcgcaatttttatatcccctacatacatattgctctgtcgttttatttttatttatcattttatttattttttggatcgaaacaatttctaatggcaccgcctgtcgtaaaaaagaaaaaactttcatccgtcgttgaaaatcagcagcaacaaccgttgggttcaattgtgacaccatttggaagacggcaaagcgttcgcttagcaaagaaaatgaacaatcgaactttgaagaaaatgtgagccaaatttggcattttttcatggcattaaactataatgtttcagctggatctgtaacgatgttttgatggacattctgccattctttgaccgtgtccaactcggcctcaaattggcaatgatttcgccacgttttgatggtttggtggacacgcatttcgacagtggaaaaacagaattggcacttcggagagaatacattattcgaaaaaacactgatgaagctcaaaagcccatatttgttgttgccgaacacgaaagtgtgcaatttccgatgcccgaccgtccgctgcccaacagaaatcgnttttcgaaggcttacgattgcgtaatttgaactggggccccgacataggtgccta

SEQ ID NO: 15008 - DNA, 1882 bp, Heterodera glycines
ttagggccccgacttttagtgacgaaaaatcgcaaaatagttaactaaaatagtgacgacaaagtgccaaaatagtgacaaaatagtgtaaaagtccaaaatagtgacgaatagtgacataattttcagccaaaaattaagcaaaaaatttttttattcactgattgcagttgcaaatgaagtaaatttactttctaataatttcgtggcaaatattgacatttttaaaccaaaattttgtcaagaaaaaaatttggtggacgaatttttaagaaaatttttctaaaaaattttaaggtcgattcttaggtgtatctttgaaaaaaaaattttggtcgattcttagtggtgtattttttggttttttggcatttttgttaataaattttactaaaaatgtcgaaatagtgaaaagacaaaaagccaaaaaaagtgaattttcactatttgaagtgacaaaactccaaaatagtgatttccagtgacgaaaaatgacgtccaaatgaaaaaattttgacgcagaaatgcgttttttgagctcctttcttcaaaacaactgagcaaaaaaaagtttttttcactagaaatcggtgccctaattattgtatattattttttgctattttccattaggcatttctccgtgccaccaccacttcttctgcctgctgctactttattcattttttgaatccgtcgacgccgcacatggaaccatttgaattgacgaacgaagcgacccaagaaatgttgacattggagaagctacgcaatacaaatctgcagtgtttgaagcgacaacaatgctcaattggggcgaagacggacgacggcgattcgacagcatcaaaaagatggaatttttatgcttcgaacactgtcatctttgatttgcgtcctccaaattgcattgggtgagcagtggggcagggagcagctcgttccccccatcccgagtaatttaaaaaaaattctcaaacaaatttttcatgaaaaatctagaaagtttttctgatccgtggggaatcggcgggggaggggagggaaacgtagtgcacccgcgggacaagttctaggggtatttcgaggcggcgcttagtacgaatttctcctccgttttatccattttgaacccctgacccgaattcgaacatttacacttttgttgttgttgttgttgcaaatgttgcttataaaaccgggacgagtaaattccaccttggggagcaggtcgtttcccctcccccacatcgaaatttttttttaaattttcaaacctagaaatttttcaaaaaaacttataggaaattttctcataagaaaatttcaagaaaaaaattttgaaaaaatttcagcgattttttcaaaattttacgatgaactactaagttttttcaaaaatttttccaaaaaatcgctgaaacattttcaaaaaatttattcgtgaaattttcacatgataaaacttgctacgaattatgcattggctgagcaacaaacagctgcttttccttttttgtttgaattactcaattcaaattgcgttgattttttaggcctttgtctccaccaacggccacaaaagcggggaaaagcagcgaaaagggcgtctgattatttggaaatgaatcctttggcatttgacaaaatggtcgctcattttgaatgaaaattgttgctttgatacatttttctctttaaatgttttttttattggtcggttttttcgacaatatacctatcggagtaagacatttgcgcctatgtccaaactcggattcaaactaaaaaatttttaagtagaagtctaaaattattaaaattaagaaaaaacacagtcaaagagtttattaggagcattaaataatttaatttttcaaaa

SEQ ID NO: 15009 - DNA, 2872 bp, Heterodera glycines
ttttcgcttgctaaatgtttttaaatatttaaaattcctcccgacgcttattttaaaatatgtaaaaaaaaaatttaagcgtctaagagcaaaaagagattttctgattccttctccaattttttcctggttgcaggcctgcgccaccactaattaattaattaatcaatttttttcaacgatttcccacattcatgcccttaatgcgttccaaacgtccgctcatcggcggcgtccacacgtacaaattcagtcccatgtccaaaatgaacacatcacccaaattcaagctttctttaatgcatttgaccttaaatgtgtttttttaaaatttaaattcaactcataaaaaaatggattcacttgggtacagcggacgtttcgcttccctttgcagtggaacagttttggggcccaattttggtaggggggcacaacatggcggaatccggactcggctccaccttccaggtacctgcatttttgtaagagaattggttaagttcaataattgagattggtatgaggtggggggatttcttctatcttttcggagttgaatttgcctattagatgatttttttaaagttggaaattgtccaattttccgcttttcctgtccgttttttgccgtactttacttatattttgaaaatcacttaatatattttcttattttgatcacttctcactctttatcaattgctttttttactttattccgtctttgaaatagctcaggaagagcgaactctcatggtcctggacctgcaaaacattttaattaattaattattaattcaattaaagtaattaataaaatatttttcaaaaacgcacctctctgtactggacaggcagtccgtttaatgagtcgtccagctcaaccgttttgatcgcagcagtgcccatttcatcctaattaatttcctaattgaacacccgaaccaaattatgttttaattattttttatattttatttttcgaaatacaatttacttgagaagtttgttttccgagccagaaatggacatcaaattcagcaatttcacccacattttttgtctaaattaataaataattcattcatttttaaagatattttaattcataaataattaattaacccccccccccccatacattcaatattatgtatgagtctcctgtgtaaaaattgccatactgctcttctggcacatcttcgagagcaaatttctggatttgtgtttaaatttttcattttttcaatttaaaatttttcacatttatgcgccaaatgcgaattccgcgctccttgccaatgcctttcagcttcgggtcgataaccatgggctttaaatatttaaatgaaatagataaataataattagatttttttaaatataataaaaataaaattgaaaaattacaatataaataaatatttatttttttaaaattatttgtctaaaataaattttatggaaacactaatgagtgatgatcatcgtccaaaggtttaaaacagtttgtcaatgtgctccagaaacagcccgagaaccacctgacactttttcaaccgatttcccgggagattcattacccttccacttaggataaagcaaaatttattggccttttggtatactcatggaaccttgaggggccatatgttgtcattttatgttttcaaaagcttaatttattagcccgaccatctggcaaaattattttggatgaaatttgaaaaaaattaaaaacaatttttacaattaaaatattttattttgagggaagagaataaagaccatgtcaaatgtgaaaagctcatcttttctattttgaggtgtgtgtgtgtgtgtgtgtgtgtatgtttaatttagaacaaaaggatggatgtatccaatttcattttttgtcttccgaccaaaaattatgtcaaaaataaactaattaattaaatatattaaaaatattttacaatttaataatttaataaacatctgtgccttgtaaagccttagtgcaatttccaacagttgtggtgaaaaattggtttccaaaagatgcaacagttcctgtgtgaaagtgttgtcgttgttttgaccactttttgccatttttgccctgaaatttttgggattgaaaagagattttattaaaattttgggattaataagagtttttattaagattttttttgccattttttgggattaaaaagagagattttattatagattttcttgccatttttttgggttaaaaagagagattttattttttaccaaaatttttggaattaaaaagaaatttaattagattttttccaatctttttaagtaattaaaattaatcacaaaattagttgctttttttaattatataatttaatttaaaaaactatgaattaaaaaactatcgtataaaaaaagattaaaatgggtgaataaatcaaaaaaggggagttgaaaattagttgctgttttgttgggcccaatgattgagagtgaaaagtgctttttgatttgatgaacttctctttttataccagccaccctcgcatcaatttgtgttgtgctgaaattctcacgtcacaccaattacacgcacttctcttgtgtgaaaaacagtgacacaccataaaattcgccaaaaagtttcgtcactcggctcaaaaactaaattaaaaaaaaatgttaattgccgatacataaaattcttaaaattgccatacataaaattctaaaaaaatttaaattgccgtatataaaattctaaaaatttaaaatttcactcaccaaattgccaaaaagcttcgtcattcggctcaaaaaagcatttaaaaatgtttttttaattgcatagataaaattctaaaaaatttaa

SEQ ID NO: 15010 - DNA, 3067 bp, Heterodera glycines
  misc_feature (91)..(91): n is a, c, g, or t
atcaaataaatcttcatcaattccatcaattagaacctcaccctggagaagaaaataatcacaaaattaattttcaccatctttttagggncaaaatatcgaaaatcaaaattgtgataattgtatattaatattatttattaaaaatatcaatgattgcaattcatatttgctttttaacttgttgattctaaattttttctttcttcattaaattgaaattaccaaatcaattataattagtcatgttattaatgatgaaataattgatttaaaatttgattttataatttccttcccttttaaataatattgaaaaataaaatagagaataaattttaaagggaaattattcggttaagaagtttttgaaggcatgcaatttttttgataagcgtccttcttccaaactttcacccctggcagacaaaatttggtccggacaatccgtcagtggacaatccgtcagtggtcaatccgtcagtggacaatccgtcagtgaaggacaatccgtcagtggtcattccgtaagtggtcaatcagtcagtggacaatccgtcagtggtcaatcagtcagtggacaatccgtcagtggtcaatccgtcagtggtcaatcagtcagtggtcaatccgtcagtggtcaatcattcagtggacaatccgtcagtggacaactcttctgtgaaggacaatccgtcagtaatggacaatccgtcagtggataatccgtcagtgtactattcgacacaaaatttttttgagcaataattaaaaatcttgcttgaatgattgttaaatttaataaatacaatttcttatagattctaacctttctaattaattttaattcaattaattgaccatctcgagaaattatcatttaattcttttaaaaaagattaattcataatttttataaaataacccaaattattaattcatatttttaacgacttaaattaatctcacattattacaaataaatctgagtgatttaaaaataaatttgcttatggattaattactgacggattgaccactgacggattgtccgggagccgggagtcgacccctccctctcccctttgtatgatccccattttaaaagaaaacaacaaaattataaaattggtgttgctatttcaggtatccatccacctatgtaattgcaggttggccacccgtcgtggcggcggttgcggaggcacttttggcttttctggtgccattgaagaagccggcgttgtcgttgttgccgccgccttcgagttgtgttgctgcgcttcggctcgactccgttgcttagtgtggccatttgttaataatgttgatgacgatgggcaggggtcgtacgattcgatcacaatgctttcggtccctttgatttcgcatcgacaaaacggacaatttttctcgccgtccgctttttcctaaaatgaaataaaaattttaattttttaaaaatagaaaaaaaaatgataggaaaaaataaatgaaaaatggaaaaaattatgacgagagtgggattcgaacccacgcctccgaagagactggtgccttaaaccagcgccttagaccgctcggccatctcgccattggagcaagcggaataacttttatataaaaaattaatttttcgttatcatattgaagattaaataatattttatattttattttaagattataattaaatgaaaaatgaaaaaaaattttaataaaattcgtgaaaacctcaaaaataatttaatttttttgtttttgatcaactcatcatttttggttgtttattaatgaaaaaattcattaaaaataaataaaatactcaaaaatcccttaaacaccatagaattttcagaaaattctctaaaaatcgtatatccaaagaaagtctcccatttttcacctgccaactgatcagacaaagtttgcatagcaaatgcccgcacggctccaacttgcagtttttgttgcgttcatcacaaattttgcacaattcaaaggtcgtgcccatctcacagtaaatttggtattgctccgacgaaacctgcgggagagagggcattttttggtttaattaattttattttttggttgagttttacttgcatcattttctacatataaaataattattttttgaacattaaaatctaaatttataatttggcacaaaattcagaattattcagaaatgatcaagcggattgggaaattttgatagaattaaattgcgaatgaatcggtcactgatcagcagggctgcaaaaaatatgcaaatgcatattttttcctggcttctccatgctctaaatagtaggaaaaacacttttttttttgtgtttgcgtataaaaatcgggacttttatttgcatatttttgcatatttgggtttttatgcatattttgtcattttttgtacgtattttcagattttttgcatattttgccatttttcgtcaaatttttcagatttcactatctcttaggaaaaaatttcgaaaatgcctaaaattaaatccaaatctgaattgatgcgcgagtgggtcaacagtgagtttcactgccgaaaaccttgagaaatttttgatttacaattacaaaaacaaccgatataatttatgaggaataaaatttttatttattttgcacccctaatttaagattttttgtgcatattttgcgatttttgtgcatatttggcaattttatttgcatatttatgtgcatattctggtcatttttcgtgcttttttttgcagccctgctgatcgtgccggttgagtccgattaagcaatgtgacaactaaataacataaaccccacctgaactttgcccgactcgggaggaaattgcgacacgtaggacaagtccatgtttttgttccgaccatttgggtaaaggtaaaagccctccctgctgccgtccacctgaacgtcgatatggaaacgtacaacgaacggaggccatgaattttggataaacaaaaaattgggaaggatttccatcgaagatcaacccaatgaaaaagagatatccgcgacaattttaccaatgatggatgag

SEQ ID NO: 15011 - DNA, 1387 bp, Heterodera glycines
  misc_feature (47)..(47): n is a, c, g, or t
agggtccaattttccattggtgtcaaaatttatattctccaatttgntgtgtttatattttgtaatttttcaaaattttattaatttcgctcttttttcaattaattatacattcatttgagtaaatcaatgtactgatattaaatgcttgcattaatttgttttaattattgttttatttacctaattgagtatcacagcctgagactcgaaaattttttgactctaatttaattgaaatcttatatcaaaaaaaaatttttttttataaggctttgcttaattgcaattaatttaggtagccaaaagatttatcatattatattgtcataattcaaaacatagtgagggagatgcgttgagtcccccagacgactcaccgcttaaagaataaatgggaggacgattgggagacggatcccgggtccagggattggtggtgaaatcccctaaatagcgcccccatgttaatagactaattaattttctccggataaatgtaagatcgaactgcttgggcttgtaaaagatcgtccaaaaaacggaattattaaaaagtcagatttacgttttagaaatgtctaaaaatttatcttttgtttagtaattttttcatgctaaattttcgaggaaataagccaatttaaatttcattaaatttttattttcattgtttcaaaatttcattcattttaaatgttaaaaataaatttaggccctgcaaatagaaaatttgttgccattttttactcaaaaattaaaaaaaaatgtgaaacaaatcaattagtgttataattaagaaacagtgagcaatacagcagaattaataataaaaataataaaggataattaaggacgtgatttcgttgttaaatggaaaggctataaaaatgggaggaacagtaaatgtaaaaaaataaaaataaatttttaaatgaattacgcattttatgaaaaagaaaattactcaaaaattaatggagaaggtgagagattaatcattctcttttttaaaatacaaagtgattgggtgcgcaacaaaacaaataaatactgattaaataaataaagtctaattggacttaatgaagctggtccatatcccgaaaagctcaatttacaaaactgagaaagtctcattgtcagacaaaaaattttaaaaaattattctttttttgttccagacaaattcaaaaaaaaatgatcaatttttgtctcagacaaattctaaaatttgaatttattcaatttttgttaaaacaaaattcgaaaatttaattaggtattcaatttttaaatgataccaaaacgaatgattttagttttactatttttttttgagaatttggtggattggaccaacatcattcgtaccgatttgactcta

SEQ ID NO: 15012 - DNA, 1839 bp, Heterodera glycines
  misc_feature (1787)..(1787): n is a, c, g, or t
aggggtattattttgtaaactctttttttccacaataatcttttcatccctcatttttcgcaccgtgaatgttatttttaccgaattttgaccctgtttgagttccttagagtactatagatttaaaattttgatatcatctttcgcgctaccttctcccaggggtattattttgtaaaaagtctttttttacgcaatagacttttcatatcccattttttacaccatgaatattatttttatcgaattctcaaccggtatgagtagattcggctactgaacattggggctttcgttatggatcttcattcattttcttgcctgtttctgctcagacatttctctgtcggacgggcggaaatgaatgccattttgaacaaaaatagcgcttccgttgtcggggcaacattgtgtaagtaagaagaatcgggcattttctgtggaaacagagaacattgttcagacacgacgctttttccatgtgcggaatgtgccaaaatgatcatccaatcgcgcatcagtcgggttgtttatttgagcgacaaaaataccgtccaaatggaggcttcgcgtcgccttttcaacatcacaggcatcaaattcaggtccgtccttccttatccctctcgcaaataaatgcatattctcattttactaatgtgtaataattgttccctttagccgatacgaatcctctcgtcccgaggtgactctccgcttcaaatgaactcttctgacggtgccgtgccttccattttataattttctttgttactttgtcttgttatttgagctgcctgctctcataagggcattattgtatttctgtcctcactttcgattttcatgccaaattccctcactttctctttttaccgaaaatgccttcgattaccctttttccctgtgctttccttttctgtttaattcatttatcgattgtctttgctcgccttcgttcgtttgtttgtccatctgtcctctttcactgatttcttcttttgaccaacttttgcatacctttctttttttcgtttaaatgttggcataagaaatatgggtatttttgtcattccaaaatgttcttttttgtttaaattgataaattttagggaatttctttgttggtttaaattcaagttaatttttcattgtaccttttcggatttttaattattcgactaattgtaattggagtaaggttaaacgttcccattgccttccattaaaaatgtcagcgaaagttaaaacggaggcgtcgtcgccaaaacaaatgaacgaaaaggcggaagagaatgaattgacagagcgtttggagttagactttgtcgaagtgcgccttttttctcgatagtatttggcaccatcaatccaaattgattgctaaaacttggcgaaaatggctaaatttcctgggttttcccgccgtgcagaaaaatttaagggaagttacatttgtcaaaaacttgggccagaagagtaaaaacttgtagagcctcttccgaaattttctttcttctatacgcacctgtttagaatgtccagtttcacccatctttatgaactgtttaggagtcagtcggcgacgattgggacggaaatgccatcatggaatgcgacgacactttagccaccgcagatgaagcggaggaggagggcccactcaaaccgtcgcccgactcgccgcgttcgttgtctgccccgcgttcccccgaagacgaagtggagacaattggtgccaaggaattaattttcaaaactaaaattttttttttgggggggggggnggaatcatcgggcaccaattatgccactaatttgtttcgcttccgtcagatg

SEQ ID NO: 15013 - DNA, 1439 bp, Heterodera glycines
  misc_feature (67)..(67): n is a, c, g, or t
actacgaggaggacgacgaggagcgaatccgacgcacaaaaagggcgcgactcgtccggttgaggtntaatgggaaggagggagggaaggggaagaaaagggcgacacaaaacgaatggttgttgagcaattaatccatgccattactgacatcttactttcattaatcatacatcctcttgttcagggaagcccgctcccgacagattggccatgaatacattccgccgctggccagtcggagaacgtccgcatttggtggccgttttgccccacagccctacttcaagaacccgtcatattatccgcgggacaaggaactgtcgtcttcctctgctcgatccgtcgctgtgccggtgagtaactaatactacggcacagaagtgccaatctctgtctgactgttccttggcattttgagtgggtattgtttcatttgtttgccacttttccaaaggtgcctctcgcgcgtgttgaaccgatgcccggcggccgtcttccgctcgtccagcgccgttcgtctcctccgccgccgtcccttgtgcagcgccgtcgcggcccatctccccaagcgccgcttccgccgttgctgacgaaaaagcgtcgatacattgtggaggaaataagtcacgtgccaagacggtgggtacttttgaattggaattactggtaaaatgatgctgtctcataaagacgttctaaatttggaccggccattaaatcccccatttcgttttctgtgctgtttttccattccaactctcctctcggtctttgtgagtcccattcaatacctatcaattcctcgagattcgtctttctcctgcgcttgcttctccgccttcgcacaaaaaattctgtcgattttgttggattggtggtgaacaacaaataaagaaccgaatagatttagtcgctaacattcgaaacaacgcaatcagcagaagagcgaatgtgccgctcttttgggcttcgtcttttccctccctcaacagctgctttaaaatgttgggtcggctgcctactcaattttattactgccgaatgaaattcgttctcaatcgactcccatttctcctcctcccagtttgggtttggcccagggaacagcctcaaaaatgcaaaaaacaaccattccaacaacaccacagaagagggagggctatgcctatgaatgagagagtcttttcgtcgtccatcggcaaaaatgtgaattaaaaacccaaatgagtggagaacaacacagcaaatagagaaaggacaaaaacaacatcccttgtgtttgtccatcaacaagtttctgtggagggacgacaaaaacattcgccgcaccaaacagccaacaaaaactgccattttccaccatttccattcttccgtcttctcccctccatcctccccgcgattctcacgagatcgcgcactccgccgcctccgca

SEQ ID NO: 15014 - DNA, 870 bp, Heterodera glycines
  misc_feature (835)..(836): n is a, c, g, or t
tttcaagccattatgataaacggcccaactgcgcgagtccgttaaatttaatattaaattgaattttcaggcagacaaaaattttggaaataattattagttgctaaaaaaagcttggaaaatgtacgaccagtcaaacaattgtaaaaatgtcatgtccgatcttccagaccacctgagtcatccgccgccgtttgtccacccctacaacattgacaatgcccaattggttctcattgccctccccgtccgttccaattgtgtcattattatacggaatatcggcatttgttggctttctttcgaactgaaataattatctagcttttaatccaaattaacgtgctgacaaaagcctcataattccatcaaatgtgcaacaacaaaaataaagtttaataaaaaaaaagtcatcaaagttacgacgatttgtaatgactagggatacaatttttaggtgtttacctattttttttcctaagctctccctattgtctgaaagagcataaaattttcaaaaatactcacctaagaaataaaaaatttttctcaaaaaatcgtattcaaaatttatatttattaagttatgcgcctatttgtttttttttctgactgcataaaaatcgttttgggcacggcaccgcacgcactgaccccaaatgaaccggcacaaattaaatttatataaaagttcatgccaccataccatcatttgttcattgttcacagccatacgaatgaatttgaaatgagtgccgtcgttgtttgaacaattttcgctgccgatgatcactttgtaattttttggtcgctccgtcgaattgaacttttcccnncatatccacataaatccgtacatcgcattgatga

SEQ ID NO: 15015 - DNA, 2672 bp, Heterodera glycines
  misc_feature (2648)..(2649): n is a, c, g, or t
ttaccgaacataaattttttcgcaaaattcacctaccccactatattagacccgcctcccctcgtgtactcaaaacaggctttaaaaataaagccgtatggggggggggctctattagatgacggtttggtaaagcatcatcacttcatatcgctgaatggttgttgtcccagacacagaaaatccaatttgctcatcaattcggttgtgcggtacaatttgacgctgttcgtcaagttgtgcaccaattatttcatgtctggccattttcggattgaatttggccttcaatttaaaccaatagccaacgggaaaattgtgaatatgttcaactgggaaaataaacagctgagtggcatagtttggcacgtaaacaaatttgttgaatgctaaatggatgaggaacaaataattttgtatttattataataccctaatgcgataaattaataaatgctttttattttggtggttgaaaaatgcaaaaaaagcgaaaaatataccttaaggaccgctttttgtaaatttttttaaaatactccattataatataaaccgaaaatttttgaactttttgtaagaacttttgaaaaaaattttgtttatattaaaaagtaattttattttagcatataataaaaaatgttaaaaattcgaaattgtatttgtaaagtttgaaaagcaaattttttgcaattgtcaaaaaatgctctaggcattgttttgatgtttttaaggccaaatctgtatttttacacaatttttagcatttttatgagggttaaaatccatgtttggcactttttaaggcatattatcatatttagcatttttttagtgcatataatttaaccctaattatgtcacgaaaaaaacggacaatcatagatgaacccgtcggcaatgagctttttcgatgcggacaatttgtttgccttttgtaccatacgaactgtttcaattggttgaacctcgtcgtacaatttgaaacggcataatttgtgcttgctggggcccgagtcgacaatgtaaatgctttagatcaagaaaagtttttttttaaatattaaaaaataaaataaatttattgccttgatgtatttatttttacagaaaggtcccgggaatcctattcaactcggttcccactctcccgcatcgacggatgggagctttaatgaaggagggtatgtgttaatgatgtgcgagaaaattacccgggaatctggaactgagacctggaaaaaagccccctggaaacatcaatgggatcccaaaatacccggaccctaggggataggatattaatttatttttacagaatttttcccgtgtactgctccgaatcttcctcctcccgctttgccagatcatcagctgctacggcgacatcagcagcatctttgttgagatttcgaagcacttcatccatgtaaggcaaagtgccgagcaaacgagttggatcagcaacaagctgaaaaaggaataagcgttgagagagtgagtgaatgagagatagaggagagcgggagatagaatagagagcgggagggagaaagagatggatagacagagaggcgagagagagagagagatagggaggggatagagagggaaagatgtgggaggagagagagaaggagagagagagagagtggggaaaagagagagaggaggaggaaagagagaaatagagtgatgagataacaaaagaaagaatagactgagtgaaagatagagagagaaataaaaagacaagcgcgaaagatggaattccgtgcccccaaaatttcaggaacataaaattctgaatttcaccctaaaaaatctataaaagtcgaatatcagttgaaaatttccgtacactgattgcaatttttaagcggaaaactcgaaaatatatacaatccagggatgggccaaattgaaaaataaaaagcgaaatgcgaaaagcgaaatttgcgaaactgaaaaatgcgaaatgaaaaaaaagcgaaatgcgaaaagccaaaatatgcgaaaatgcgaaaagcgaaatgcgaaaagcgaaattttttctacaactttttaatagttaaaatcataaagcaaaaatcattttttaaaattttattccaaatttaaaaatcaataaaacgcttttttgaggcgcgctttttccaaaaaaactttttggaagagggggcaggcggcgccgggaaaatttttgaaaatttgattaaaatttgttgacagattttcaccaaaaaatcatcaaattttgtgatttttgtatcatttttctaatgagaaataagagttttggcgcgccgctgcgaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatcaattcttaggggtgtaaaagtcgcatttcgcgccaaaaagcgaaatgcgaaaagcgaaatgcgaaacgccaaaaatgcgaataatgcgaaaggcgaaatgcgaaaagcgaaaccctcggccatccctgatanncatcataactgtgtgaaaagggg

SEQ ID NO: 15016 - DNA, 1731 bp, Heterodera glycines
  misc_feature (1688)..(1688): n is a, c, g, or t
  misc_feature (1717)..(1717): n is a, c, g, or t
tttaaccgtcacaattttaccataaataactctttttttgcaaactaaaagctgcataagaggtaataaaggtcgctgaatacgatagtgttgaaccttcaaacaaacaattttacaatggaataaattttataattatttaaaaaaagcaaagcaattcgtcaatctttacatttaacatatgtctctgcacatgcttgatttgatgctaatcacgcatatgcaacacatgccattatgggaagtgtctgagcatttgtaattaaatagatattttataaaacaattgcaaatgcaaaaataaataagaaggataggtgtaaaatataaaatttatataatacatttatttaaaaattaaaaccaaaaatatactacaatttaaaatagaaaaaaaacacaaattatttgataacacctttggtatataacttaaatgattcaaaagtaaaaaaaacagttaaaaacattaatttacccacaaaggatttgaatataaaaattttaatgaatatgtttatactagagtagagcgggaccgggactaaaacacggacaactgagtacaactgagtaccgaggtcccggttttgaccgggaccgggaccagtcccggggtttttcccgggtttcccagccaaaaattcccggtttttcaacccgaaaagtagagatgcgccgtgaatcacggtcacggtcacggttaccgtgaatttcacgggtttttttactcatggtcacggtcacgattcacggtaccaattcagtgttattccgtgaaaaatttacactggataaaattgaaaatttacgaattacatattgtttcatagagaaatttggtccctttttgggaaatttttgctaagaaacagagcaaaattttcaaaaatttacccggcggcgcctatcggcaccaccggcccaatctctattcctgaaactttttgaacaaaatcaactaccaatattgtgcaaaaacaaataaaaagcaaagtttcaaggatgaccccacttaataaaaactcattaaatttctttaaaaaaactcgctcgaataaatctattttgggcaaaatcagttaacaaatcccaacaaatttacaaaaattttccactataaccagggcaggcagatctgagttaaaaattcgatgcccctgctggacaccctattcccaaatttttggaaaattttaccacgaaaaaaaaacagtgtaaaaacaaaaaattcaccgacaggaaaaaatttaactcaaaaaattcacggtcacggtcacgattcacggtaccaattcacgatcacggtcacgattcacgggttttttcagtcacggcgcatctctaccgaaaaggtcccggtcccggttaagcccaaaattcccggtcccgctctactctagtttatacttatcattaaaattccatttttaaacaatgatttctagttaaacacagaaaacatgcgtagaaggtttgcaaaacgaagacgtcaagacctggagtacaatttgtaataataaaaatgtgaatttaaccagaaataaaaaatccaaaaaataaataaaaaatctatgagaaggaacataataaataagattaaccaacgcgaaaaagataaacgtaactaaatttttttagttccgacaagagattaaagcgatcgctttaacttattcaacaattanataaaaattgcatattttgctaaaaatanataaaaagccacta

SEQ ID NO: 15017 - DNA, 2474 bp, Heterodera glycines
  misc_feature (85)..(85): n is a, c, g, or t
  misc_feature (2431)..(2431): n is a, c, g, or t
cgctcccttaaattattttttaccgggctctaatcttagcacatcatttgatattgccccatccgatgtgcccttccaattctcncaaacaccacgtcatcttcatattttgctttgcatattaattttttcatccaatttattttttggctcagtgtattgcagtttacacccggaatcagatcgaaaattttaaaaatcagattatcaagtaaaccaaaaatcagatttcggagtcaaacaattttcaaaaagtttaaaattagttatttgaataatttacttgttcaaaattttttcacttttatttttcgcctcccttatcgatcgattataacaactttttggtgccgcgtttttcacaaaaaaatcttcgtgacaagggagggagacggattttatccaaaaactatccaaattttatgtaaaagttaatagagataaagtattgacattatggcataagattttaaaataaaaataattataagaaatcagaaaaaaatttagtcagtattcaaaaaaacaactgacgttttgtttttatgtattaaaaagtcgcgtacaaattttgattaaatagacttcagattcaaataaaatgaccaacacttatctcattaataaaaatttaattattattacgcatttatttttacttggttatttatttaataaagagcgggtaactcaaaacctcaacgttattgaattgaatttcgttaaaattttatgaaattctatttaatttttttcccaatttgtaatcttaaagaatgaatttagtttttcaatagtagtaaggggtgggcccgccggacagttgcaagacaatgggtacgggaaacttttctttatttttttgctgttaaccagggcggttgtctttttatataagcatcgtttattctggcagcaattgccttttagggcttgaggtcgttcgtttgacttgactaattttctgagtcgtttaggtgccctgtcgtcttctgcttcatggatggcagtgcgctgctcttcaggtcaagatgggtttctataccgaatattcagaatataattaataatattattattattattgatgaatctttctcggcacattcccagtcaggcgttttttcctgatgtgtcttggagcaatcccaatcaggcgttttttcctgatgcgtcttatcctttgcgcgtttccagtcaggcgtttttccctgatgcgcattatcaattattttcatccgttaaaatcgtttttaacatcaattcgctaccaattatctcacccgttcgttccaatatattgaatgtattgaacattaaatttataagcatttgcgacctataatttaacttacataatatatatatatttttagccttaaattaaaaaaatctcattttcaattctcttattattattgatttttaccatgactatttaacttttaaaaaagaaacgattactgctgaaatttaaaaattagaagggtaagacgcaataaaactttgtaatgattaaaagcaaattaaaattaaaatagaaatgttttttttaattatatacaaaaattgttatgcagaaaatttaaatcaaagttaaaataaaaattttttttatcgagtttggaatatctgtcgccaatttttctattggcgacgagaaggccggtgccaacccgccacggcgtgcgcgagtgctcgcgttcaacaagggcatggacgggcagcgaatcgggagagaattggacacggacgaagaggaccgccatggggactcagttttctcggtaccgaatacgaacccgtgggccggaccctccaagacgaagaaataccgaaagaagagcagaaaggcaactagacgatcgggcggactcccgattcatcaatttctcaatcgctgatttcgatcatttttcctttcgttattcgtaccatacaacaccattttcctattcttcttgtcccatttttacttcacttttcaaattcatttctcatcggctggctaatctccggcccaaactttgtgcaaaacaattttgcacaaagttctttcttctcaatttccttaacttttcacatctgccaatttacattttatttttatgcgccatttctttgttcacatttttcacatcacaatttctgcccattttttgtcccatttttctcatcgcattaccgggccgtctgtcactccgcccattttttcgaattgtctatttaagcggccctgctcaaggggtcgctctcttcgcttccttcacccccccccccaaccattcgcgtttattcgttttgctggacttttcgatcaattttcaccatttacgcatttttaattcgtcgatcgcttcgttaataaattttgtgtcggagtcggagtctcggattcgttttcgggggacactagaaggagggaaaaagnccctcttcaaaagatcacattcggcaaattctcgtgcggggcc

SEQ ID NO: 15018 - DNA, 2836 bp, Heterodera glycines
  misc_feature (49)..(49): n is a, c, g, or t
  misc_feature (71)..(72): n is a, c, g, or t
  misc_feature (93)..(93): n is a, c, g, or t
  misc_feature (100)..(100): n is a, c, g, or t
cagatttatcccattccgagcccggagccgaatgaatcttttatacagnttccaaatttcatttttttaannaatccattttttcgtaatatntggtttntgttaaataacaatttttttcgagatacaatattttaaaattaattctttgagttttgttcatattcggacacagaattgggaaatctgaggtcgattcgatattgatcaacactcttaaaaaccccggaaattggttttgagcagaaaattataaaaaatcgaattaaagacgtaattcttaatcattgactatctttgttaattttgctaaaaaatatatgtaataatctgcataagtatgtagttagttacatatataatagaaattcataacccttacaaataatctggtggatatttaattttaatttcattgaattatgtacccattttgaattgaatttattttttgcgcctatttttccgtttattcaattcaaatatcagtaccttatttactcacttacaattagctctgctgacgttcgccaaggtctctcgcggtgttttgtaaatgcttatttgagttgttattaaaatggatgaaaaaaataaaaataaatttttaagttttctttgatgtattaatttatcagatcaggtttttgaaattgatagaataaaaaagttttattttttgaaaatatttcaatttaattaattcaaaaataattatctggtaaaatggggccgaattcgaattgtttctgtcgtccgataaaacattcaaaaaatcataattctaaaaagagaattacattgaattgttaatgccggattcgtgatcactgataagcgaccccgaaaacacttggaaacatattttcatgacttttgaaaacaaaaaaaaccttcaaaaaaggggggctacaatcgtaactattatcgtgttatttttcctattttctgtttcctgtaattacttaaattcttttcaatttttaaattcttcgcgcctccaaaaaacaattgacacatcgcaacaaatgaacaaatggagttaaaaggcgcatctcattgccgaacaatggcataaaacatcgctgttttggagcactttgcgaagcgtccgttttggaagaccataaagggtccgtcccattggataagagtggtgagtaatcccgttaatcggccctttgctgcttttgtccccccccccccacacacttttattctatgccgaggaaaggcattgtgctgcgatgccgacaaattaaaggcgaaaaattgtgggaacatataaggacaaaaaaaagtgaagagcgcaacagtggacagaaagacagaaaaacccacgggggaggggagagggagggattgttttgagaaaaagggactttgatggactaattgccattttggaagtgctaaccgtgccgatcatttgtcaaaaatatttaaacaccgaaggtgaactgttcatttttatgcttctttgtatataaatgcattttacacccaataaataaatgtaaaagcaaagtcgaatttccaattttattacactttcgtctcaattggccgtgccgttcccttccccggccacttccaccatcattttttgctgctgattggtgattatctgctgatgcgctcgctggatgagttgaagcagtgccaagtgctgctgcgactgttcgttttggctgtgttgcgcgtacgcttcgatcatttgttgggggaacagcggagagggcagcagaggcggcgagtgcagcaccagcgacagcggggaggacagcaaatggctgggcggaggcgattgggcggccaagcagaaaaagggcggtggccgcatgaatggcgaagtggttgagtgctgtgccggcactttggccggcattgtgcccagcgccgccagtgccgcgccgctcggctggcatagcagcgattgggacgaagtcggagctgcgaacggactctgctgcaggcatggcattgactgctgctgcactaggccgtgctggtgattgggccggccttcgttcagccctttcagcacggccgagccgctttttctcagcatgccgtattgctggtggtggtaattgtgcccaattccgttcggacgtcgccgtcgttggagtttccccgtggtggcaccgatgaaaatttcgtctttgaaatcagggtcgagcatccaataattgcctggcaaatgagagtgatgaaaaattctgaggggaaattgaaaaatttagaaaagtgccaattcgaaagggacggattttgcataattcaaggtttttccctgaaaattcccatggttttctttcattgccattttctgttttccgcaaaacaatcaatcatttgtccctctccctcgacttgttatgatcgtcgtaaatttgtgctcggcccaaccaccgatcggctgtcatttacagaatgcttcaatgaattgggggggggggggcgaatgttgggagagaaagccaaggaaatggggacaattggtgagtttggcatgaaaattgggccaagaattgtgaatttagtgccgactccgtccgtgttcaccttttcccgggtcgtcgtatgggcgggggtcctttttgaagcatttgttcagcgacagattgtgccttatgctgttttgccacgcctttcgatttgtgctgaaaacggcaaatttaaattgataaaatcccactcaaattctgaccgatagaatgggaatttgttcattatgtactcgtaaatcgcgtagaaagtcagtcgtccgctcggactttgccgtagtgccaaagggataaggctaaatttgactgtttttcatcatcgccct

SEQ ID NO: 15019 - DNA, 1555 bp, Heterodera glycines
ttctactaaattgcctttaatttcacctgtacccaaccattatccttccgccaatgtccccctccctccccaaggtcccttctccgcgccgaccatggggcttctcatccttgcccccgtcggttgtttccataataaaatgcatttatcccaccctaaatcccttcattttgcaccttcttccatcatccactttcaatttcattttcatcccctccgccgcgccgcactttcacttgccccgtcctcctcccctcactcttctcaccgccgttgtcgtccgttttcatcgccccgcatcatcggacgggggcggaggagtggccctccacttttgctgatgaatgaatgaatggatggatggatgaatgaagaatactcctcctcctctactgctgctgctgacccccaacaaaatgtgaaaatgtgtggaagaaaaatcaatcacaaagcaaccaacaccccacccgaccagcagcagcaaacagcacaaaatgtgttggacttggacgaaccgccggggaaggggggggggcaaatggacgcggagcggacggaagaatcgggggacggaagaggaagaggatgaatgaagaattggacggtgatgccttccttttgttgctgctgatcgtcttgtcgtcttgctgcggtgtgtgtgctttccgcgtcgtcgtcgtccgtcccgttgtgtccgttcttccccccccccccctgtcctccgccaaatttgatgtgtttgttgtctcttcactcacttccatcttttttctcacttcccctctcccccgtccctgctttttattttctatttttttcatctttccacacccacagttatttattgaaaaataattaagaattaatttgattagtaaaataaggaaatatttttttaaaaagttggacattcaaaatttttccaacatcgcatctctaaaacccaaaacaaccatggcacgtagtacgccaattgaaaaaacgtggaaaactttttctacgttgtcggggagaaatttctggcatttttagcaaaacttaccaataaaattgtacatcaccgattggaatcgtaaaatttgagcaaaaaaaaaaagggtcacagatttgcccgttcaaatttattgtcttctgctggtgtgcctgattatacgaattccacaattttccctgcccctctcttaatttgcctaaatccaattgataatacgactaaaaatgccgtgccgttggcgaaccacaatactgctgggcgcaccattattgtttaattgaattgttttagaatttttttttaaattattattatttttttgtttgtttttttaatttcctttttcacaaccatcttttcttagccatctactcgagatttccggccaagactaaacactttctcgactccacagatcgagactctctctagcaggaatatcacaaataaatccgtttctccatcctaatcaatcctcattagctatgacaaatcaattaagtaaaacaacccccctcccctgttggccaatgagtcggaattgcgaaagaagccgctttt

SEQ ID NO: 15020 - DNA, 1710 bp, Heterodera glycines
aagatggatgatctcgagaatcccgaccatcccaatcccgtcttctcatccgaggcatttattacacaaaatgcatatgtatagtataagcataaatatttgcattaaaagtgattattattagggtcgggatttctagtgaaaaaactttttttttgctcaattgttttgaagaaaggagctcaaaaaacccatttctacattaaaatttttcgtttggacgtcactaaaatagttaaaaatcactattttggcgttttgtcactattttgtcactatttcgacattttttggaaaattctttaacaaaaatgcaataaaaccaaaaaatacacccctaagaatcgacctaaaaattttttcaaaaaatacacccctaagaatcgaccaaaaaattttttttaaatacaccactaagaattggaaaaatttttcaaaaattcttcccccaaattttttttcttgacaaaatttttgatataaaaaatgtcaatatttactaagagaattttataaaggaaatgtagctcatttgcaactgcaatcagtgaataaaaattagttttgcttaatttttggctgaaaattacgtcactattcgacactatttcggacttttttcactatttcttcattattttggcactttttcgtcactattttagttaactatttcgggatttttcgtcactaaaagtcgcgaccctaattattatcattatccccctctttttctctcgcttggttttccgctttctctttttctcattatatttcctgattagtgacggttggagagcgaatacgggtcgtacctgtatacggggtttttagggacccgtcgtctgtaacccatatttttccgaatttatgaaactttaaccaaaaaatggcaaaaattattcctttttttgcggctataaattcatgtttttgctctccggcgctgaaaattttaaaataacaccggcgacaattccttttttggcacgaagagcaaaaaaaaaagctcttcggttgccgctcccgaaatttttttctgattacgggtctggcgtcgcctgaaattttttttaaaagaaagtttctttaaattttacaaattattgacaaaaattaaaattatacatagggaaaatttcctcattatctctctttctttcgccagttctgtgttgtctcaattttatcaactatttttccgctctctttcttctcgtccattctcccgccttttacatatttccttatttctcaaaattttttgcctttttcttttccctcacacactctctctcactcaaatttttcccctttcattcgcttgctctcgcgctctcaattgcacacactattcctctgcgcatttctcggctttcccacactgtctcttccccactcttgcgttaccttccgccatttttatccctttttctcatttggggatcgataaacaatggaaaatgacaaaataatccgctcgcctcccgccgccgccgattcgttaatgtttttcctttttaatacttagtacattgtttatgcctttgtgttaatgcgcgatcgaaattcttctgctgattgatcacttttccatcataaaaaattcaaattaatttaattacaaaattcaagagacgaaattgccgttgtcgaaattctaggccggaagtctcggtctaataagaaaaatcgcatttttttctaaag

SEQ ID NO: 15021 - DNA, 2071 bp, Heterodera glycines
agcctcagacctggggacccctgattaataacaagctaattatgagcaactttctgtgattaaacattagggcttccattttttctaagaaactgctaatttttttttttggacctaattaaatttgttttacaataacaaacggacattccaaagacaattttttaaaatgaaatgatattgtttgacctcataaataattctttttaatttctaagattatgcactagttagttttttaatttcatttaatcgcctctctcagtttgatatatttcttttataaattagttgacattcttcctttaaaattaaagaagaatcggcacaaataataacccaatttgatatttaaatcaattagttgatcattaattaatcttctatatatttattaataaaaagtatctattctatttttcattctctgcaaaaaatttataaaatatggaaatttttgccgagtttaccatttccgaggaaaattcaaaatacctaaaaaatattaaaatattttagcgaggccctgctcgacagtttttggctgaaattcaaagatgtgggaaacgttcttgaacaaaatgtgccattagcacaaatcattttatgggcgtgggacgacaacggggcacaagtcatcaaagaagtgattaccgaccaaaatgctgtttcacaaaattcttaatttagtcagtgatcctgaaaagcggcggaatggtttctttaccggtagatgcaatttcatcgccttcaattgtcgtccgttttctcaaaaaacgcgaagactcagaaaagtgaaaaatttacttcatttgtattttggttttcccctaattttttcatttttctccagtccttgccctccgctgagttcgccagccgatgatttgactgtgcatattggagaccggcaggtaataaaactgctaattgctctcttttatataagccaactttataacaagtcggcaccgacccgtatttgaaaactctatttttagacattgctaattttttccaaaattatttcaccggttatcgaatttggtgttaaatttggtctccaaactcactcccaaatagaaatgattcctaggatctcgagcagcaattctcggtcccgggatgttttagatagaattattcattttcaagcatgaattgttgtgttgtgtcagatcactgtgtccgcttcttggcttatgtctctgtctgtgatggtccgtcgtatgctaagtgtggaaatgaaggggtttttgcccaaatacccggacccgcctaaccctagtattaatcaacaaaattccacaatttccaaaaaattcgggattgcagtttggatcccaaaaaatcctgcgcgggacccgatcactcacgtttttctgtgcatgaccatttaggctatcataaccatggaacggatttatattttgctaaaaaacgcatattttctaaaaatgccaaaaacccttctcaattcgattttcttgctgaattttaatttgtcaatgtatgagcaacggaataaagcgatcatattttttcaaacgaaaaattcataaaataacatgaaaagatttcaaatttcatttaatcagtgcttggaactttttaaaaaaaagttattgctcaaattttaatctgtattaaaaataaaatatgtatacagaatgatttcaaattttcaacttttatcagttcttggaagttgtttagtaaaaattttagtttacaatattttactgaaaaatggaaaactaacttgggaaaaacacacaatctctaataagcaaattcaattagaaatattagcaataaaatgacgaacattgtttacctatctgaactcttaaaaatattaaaataaacacaaaaataaattttttttaaacacattataattaataaaggaaaatagcgcacggtctgcgaaaggattcacaaaaattcggatattttttctgtattttgagtatgttgatgctctaagtcagttttctgtctgtaagtcgaatcgtagacgtcagccgatcacgtatggaagtgaagtttaccttttcgagtgtgtaca

SEQ ID NO: 15022 - DNA, 1484 bp, Heterodera glycines
ttccaatgataataagtgattacattgtgctgataatgcgcttttgtcagataaccacggggtccaatgggacgccgaaggtgcggccaacaaatggatggacgcgcattcgcaacgcgcattcgacagaatggccaaatgcgtggtggacgagtactcgcagctgtgcccattccctcccgatggcattgttcaacccgcgtgcattgacggagacaaaactcaggcggaaaacatcgccgacaacggaggtcaccaaataaacggactcaaatgtgatctgcttttgccttcaaaggtctccacgccgccttccgtgcctatcgctctgcgctcgaagtggacggaccaagcaaagcgttaccgggcaaattggtcggccgcttcaaccacgaccagctgttcttcctgtcctttgctcagccgtggtgtgatcagcccgacgatttcgagacgtaccttcagctgatcggcgattctcattctcccgcaaagttccgcgtgttcggctccttgcgcaattttcccgccttccgcaacgctttcaattgtccgttgaattcaaaatacgcgcccgaaaagcattgcaatgtttgggtgagccccgtgacgtgacaaaagttcaaacggagaaccgaatttggattaacggagattaaggacgaaaaacggatgcaaagcccaccaatggaaaatcactttattagcattattgttcaactaattgttttgtttttttgttggtattcaaaaagaataaatcaccaattaagtcattaaattaattattattaattcgttttttgttttatttatgaaatgccaatttaaagtgaccaccgccccagtgaactgatcatttaggtttttgtttttcttttagaatgttttatcgttccttttttagtacaacaaagcacccactcctccactgccccctccaatttctgccatttgctcgctgaaagtgaaaactcgttcgctgacctacattttggctttgtattagttgatcaggctgatcactctgcaaaatccaatgggttttcctgatcggtcatttgccgtcagttggtcgaatacaccggcgaaaagcgcacagaaaacgcaaccgacgaaagtcagtcatctccaaatggcgtttcccttgtctcttccgcgagtgtttcgctgttttttctgcgtcgttttgcttctctttggtaataacttttgccacaaattctttccgttatttacccatttttaggcttttccttcgttttgacaaagcccgtcgaattgccaattcgaattcccttttgccccgttttttcccgcgtaattaggaggccggacggagaggcgaggaaatgtcttccgcaccagctgaatctctgtttgaatgcattggacgaccaatcgctggtcattttttgaaataaacaaatcaatttaaattggagttgacagatcgatgccccggggcgtatgctgctaccata

SEQ ID NO: 15023 - DNA, 1783 bp, Heterodera glycines
  misc_feature (21)..(21): n is a, c, g, or t
ttttccttcaaaagcatcccncctccccccccccccccaggtccgtcctaccgtaatgttaccgtcgtcattcacaacaatttcccgcaaagtccgttcccggtaagtaaagcaatggaagtgcatttgcaaatatttgatcttttttacaacactatcattaactaattaattcaggtgcgctctttccatttccggaaaggtttgaccactgaaattgaaagtttaccagcggcaaataatttcaagaaaaactgaccgataaacgaacaaaaaaaatcgaataaataaagcacaaatgaacattaatttgcaaattcaaatagttatttgaattatttttgcgattaaggagaaagtccaatcaatcggcatcatcaaaagcatttttactaattgggcaaatgaaaagaaaacagtgaaaaggcaaaaaaggaataaacaaagtggaaaaagaggagcaacgacctgcaattttatccgttgcaattctgagtaaattttataatttgatgaaaaaggtggaaaatgtcattttaaaattgcgtggggggaagatatttcgaaattcaaaaaggaattcattttatgatgcattaaaatgtttttaattcacattaatccaaaatccttgcgttgccattggctaccaaacccgagggatttgtggcagataatgcttaacgacggaacgtgccaaggaaaaacgatggaaaggcaaaggcgaggaggaaacctttcgggaaaacgatgccaattcactggctaaagtcgaggagcgcttggaaaaatgttttttgtgggaagactgccgaaactttagttttcctaatgcattttaaaaatttttggcattgtccacacttcttggcattctgttcagtgtctcttccaattcccctctctctcctccctgctttctcttccgtttctcccccctttcccgatgtctcttccttcttccgatcatttcgccctcccctcctccgacccgcgcccctccaccctttgggaggctcttcgccacgcggtgaccaatcgtcggctgatcgcaatgtacggactgaccttcgcattgtcacttaccattccgctctttgtcactttggtcatgagaaaatggcgggaaagaaaacatcggcggaaactgaaggaacgcgaaggtaaagcggacagaggcgacgggcgacagcccaaaccctaatttttcccaacggaaatcggcgttgatcatcggacgcctcgtcggtcctccccccgccccccccccctccgggattggctaaagcctaagaaagggagaaacaaaggttaagccaataatagaaaatgtatccggcatagaagaggaggaacgaatggccaatgaaacgggcggaacattcaacaaagccattctgaactcattacgccattttgagatgaaagaagaagatttgcaaaaggaggtgggtgaattaggtagcgaagtagaattttgaaataaaaagaggggggagggagataatatacgatttaaattaaattaacccaaagaagtgccaaagtgaacgactccaagcaactgttgtggacgccgaaaataagcaaaagggcagtgaaaaagaaggcgaagcagcaacgaacacaatgttggaaaaggaggaagggaaaaggaaggtgaaggaagaagaaaaaaaagaggaggggtgagagagagagagagaagtcgggggagggtgacaaatagaggaagggtatgagagacactatgggtcaagccccagtgttagacaaaattact

SEQ ID NO: 15024 - DNA, 4752 bp, Heterodera glycines
  misc_feature (14)..(14): n is a, c, g, or t
  misc_feature (793)..(793): n is a, c, g, or t
aatttttaaaatanttttcgaattaaaccgaaaaaatggtttcctttttgttgaattcggaaagcacacaatcaaagttgagataagactgcccaaattcttttcatatgccaatttgaaagcgctgtcgaaaagtgcgagcaattcgtgaaattcgtcgattcgttcctaaaaaacaaaataaataaaaaaccaaaaaataaattcgaatttttgcctcattgtcgtaaccgtagccaaagagagtacagtttatgatcgatccaattgaaatttcgacgtctttgatcagattgatttcgctgctttcactctttgccaatttgcggtcgattcgttcgaacattcggctgagttcgaccaaaatctttaaaattgaaaattttatagtttattacttcgatttttaatgctcacttttttctccattaaattattgtacagcccaaagttacggaaaactgtggacgcaaattttcgttgttctgaataaaattttaatgtcagtcaattaacttaaataaattaattaaaaattaaattaaattaaaacctttccaaaagtcgccgtttatgaagaaaatgccataaatattgcctaaagcaaattaaatatttaaaattctttgcttatgtttggcttgtgcctctgaattcgcgcgtaaaatccacaaaaatttgtcgttgcgtaaattcttcgccgcctttgcggaaaacttcgacgatatttttgtagtcggcgacacaaacgacgggctaaaaggggaaggaattaattaattaattaaattanattattttctatttaattctaccatttctcccagccaataagtgtaaattggcccgtattttcgcttccattccaaaaatgcgtcttcgcccggcttttttcggatgagtgtcaaaatattgccgaccaaaggcagcggaattgggcctaaaataaacggcggaaatttaacgaaaatggcaaatttaataacttaacctggaggaagttttctgcgtttgtagtaaaagttgtaaaaggcgaggaaaaaagagaaacaaagcacaaaaatgggaaagacgaacattttgagggaaattagcggaaaaaataaaaataaaaagtagcacatggaaaataaacaaaaattaattaggcactaattaaatttggcatcaattaaacggtcgtcgttgtctcggtccccccaacctgttcctttggcttttcctctcgattttcgagactttttttttcatttttttaaccgttcgttcgtttgtttgtttctttctttttttgtctcgaatgagagtgaattcatctcaatttcgtccgttcttaatctgacaattcgaattccattcaaaggaactttttcgctcatttcgcaaatctttgccccaaaaaggcctttggcctccccagtggcatttttctttcacaatttgtgttcaacaaattaattgtacacacatgtgatcgaaaacactaatagatttgaaatgggccttggtccgccgtcccctatttcgtcccccctcttttttcccattttttccctttttcccatccgttcgctgaatttccatttgttgtaaaattaaaccggagaaagttgctcttcccttcccttctcttccattttcttctcttctcacagtgacgtgggaagtgatcactttgggccgtccaaaagtcgaatttcgacaaaacaaacaaaaaaaagcagaaggaaggtcaaacggaggaaattgcaattttttacgactgaataaatgccacaaaagtatttaaatttggtaactttttgtaaggggatgagaggaaaattgggaaattacaaattttggaaataaaaaaaagagggaaaatggaaaaacggcgggcgaaatgcgaacaaataacaaaatatgagcaaagaaaaatggtcatttattaattactcgttttggccactttctcggaacgaataaataaataaataaataaataaataaatgttctcttttcctttccttcctattttaatgcgcaattattttgtgtaaatgttttttaacataaatatttacaccgaaaatactttttaataattataatcaatattatttaattatttattcgctattaatgtgcatttctgaatttaagcaaaatggacaaagtgactccgaattttaaagaggagaaacgaacaaatgccatcgttgttcccccaaaggatgcaattggtacaaattaataattaaacaaaaaatgatttaaataattattaaataataattgaaattaatatttttcataaatttcagtgaaacgaaataataaaactgctgttattgcccatttgcacgtcttttaccaaaaatgggctctttttgtggtgaaacatcgcactttaataatggcaatttgctcaattctttcgactttgggcgcagtgaaaatattcaaaacgccgtaaatgaaaattaattaaataataaaaagttaaaaatgagtgctcatttgtcagctttgtgaatgatctcaacggatggaccccttacggcgcgcgttctttggccgaatcggacgcatggaacgaatttttcaacgacaccggcacaggcagcaatttcgccattttcgtgctgatcaaaccgaaagtgatcggcacaaatatgctgcagagcaaaatgctggaccaagtgatcagagtgaggagaaaagcagccaaataaaatcataggaaaataaaaaatagagggggaggaaagataattagggcgagcgggggtaattaacggccatattgatatccataatggcacaaggcgcgaatctctggttcgtctacaggtcgatgacgggagagaattggtacatctcgatacaatgtctagacgaggatgtttcggaagcatttaaagagatggggtacaacttttttgacattaatatactcgtaagagtcggaatatccagttccgaaacaaacaaattagaggaaggcttctgtatttcggtaaatttaatgtggaattattccttccgggaattttcgctcgtaaaagacggagtgtcctggtccggaaaaatgtatagaggaaggagttctgggttccggaaatttaaggtggaattgcgcgttccggaaatttatgctagtaaaaggcggaatatccggatccggaaaactgtatagggtagggagttctggattccggaaatttaaggtggaattgcgcgttccggaaatttatgctagtaaaaggcggaatatcctgatccggaaaactgtatagcggaaggagttctggattccggaaaaatgtatagaggaaggagttctgggttccggaaatttatggtggaattgcgcgttccggaaatttatgctagtaaaaggcggaatatcctgatccggaaaactgtatagcggaaggagttctggattccggaaaaatgtatagaggaaggagttctgggttccggaaatttaaggtggaattgcgcgttccggaaatttatcgctagtaaaaggcggaatatcctgatccggaaaactgtgtagaggaaggagttctggattccggaaatttaaggtggaattgcgcgttccggaaatttatcgctagtaaaaggcggaatatcctgatccggaaaactcgtgtagaggaaggagttctggattccggaaatttaaggtggaattgcgcgttccggaaatttatgctagtaaaaggcggaatatcctgatccggaaaactcgtatagaggaaggaatctgggttcctgaaatttctatacattccggaatttaagaaactatttatgtgaattaaaaatttgtttcataagtcaaatgtaaattacaataccccactgacgcattttttggaggcattaaaatcaaatttaaataggttgagtttatataattggcgaagtgttgcgcaggtctttttttacctcctcacccatttgcagaattggtacatcaccagcagcagcagcaacttgccaccagtggcctattccaacgtcaacaacaacaaaatttttatgctgaaagaaccagcaactcctcgtcggttgttacgaccgcgctgctggcacaacgtaattagtgtgccaaccgtctggtctcgagagtctcggtatcggttcttgaggccaaaaaacgatcggaatttttggagacttcatgtcatttaagcagctcgagagtctcggtatcgaatctcgagcccatgaaaaatattcgggattcttagatacggtatatgttggtacagtcactcaaaatataagacaaatgccatttatacatataggcacattgtaattgtactctcttcagatcccctggttgtcaacatggacaccaacaatgttgctgttgctggcgatgataatgatgttgccatagttgaacaacaacaacaacaacagtgtcggaatggtggtgttgctgctgatgagggagaaaatgctgcagcaacaaaaatgacggcaacaacgcccgtggttgttgaagcagtagcagcagcacacgaaggccagcagcaaccgacggagccgaataaggtgggttgtgttatgttgcagtaccatccatgacatgaatcgtgtactgcttgggttggatgaaagcgatgtgtctcctcgataagcaaatgttttttttcaaaggtttccgacgtcgtcgactcagtggtggccaagttgcgcaaaaaaagctttagcacaaccagcagcaatgccacgcaaca

SEQ ID NO: 15025 - DNA, 3860 bp, Heterodera glycines
ccatgccaatgccaacagaaagagggaccgacctgtgagccgggcatggaccgcttctactgtccatgtccacggcaaagccaacgaaaggaggaccaatcgcaaaccaatgacgaactcacgacggaatacggccagaaaaatccacgggggaaaatgcggacaaagagcagcagcaacaacagacaaacacaacaacaccgacacgttcacgaagtggcaatgggaaggggggaggacgaagggaggaggaaatttgcctaattggcaattagcagagcagaataatgaccattcttatcaaggaaaaacttgatttacatggtttaaaaatgcaaattaaaattaaaaatgtaaattaaatttgatcgtttgtctctctgctcctctgatcactcgtctcttttcctttctccgtctgctgttcttcctccatcttttgctttaaaagtgtgaaaaggctcttaaatcaaagtaattaatattttcgcttggtttggctttctccgacctccgtcaaatgttcatgtcgaacgatcacttcgtcctgaaattctcttccatcaaattgaaaatgcctttccatcgactgacttcgtcgtgcggtgccaacaatggccgatcactttggtacccggcataaaccattgagaaaacgtcgaagaggcggtgaagcggccgaacactttcgatggcggaaaagacagccgaagggaagggctaattaattgtaaattggaaaataatttgcaaaaattgaaaaacgaaccaaagcgaaaaggagggcagcggaagccaaaagagggaaaagcgaaggtttataaaaatgggagaacgaagtcagatcagacgaacgaagggaagtgaccaattcacggaagggactcagctgttggattcggtctgaagctccattaattgcccaattagtcaaaaatatccgtcaaattgccccccccctttttcattccgttttcacttgccaaaaagagccggcattggctcgtcataaagcattttcagcttgccaagtccgctcccggggaatttatgctccaattggtcggctgttgatgaacatcgtccggtctttctgtaggaacagtcattaatggaaatgtttcgcttcttcgctttgactaacatcagaatccgctctttgtttctggccattattttgtcctccttcagaacgttttccaaactcttcggctcgcaaaaaaattccaccgcttcttccaaatgccaaaaatgctccgcaagtgaagccaacgcgtgaacaaattgagcactgagagggcaattaacttaatgagggggggggggggggtaaagggaacaaagcaaaatgggacaataattacaaaaaaggcttttgagcacttcgaagtttatcatggacccttccgcgagggcattccgtcgccgttggcggtcaagcaaaaagtaacaatatttttggactgcaaaagccttaaaacagaaaaatatataacaaatatcataaaaagaaagaaaactgacggatggcttcagaacaatggcatgccgatacaaatccatcgtgtcataatgatttgactgttcggcatgaatggcctaaagggatgggcacgaggggtaatcaagagtaaattgaaagtaattaaaacagcaattaagggctacattgggaaatacttacgtgtggaagccaagtttcggacattgacggattgatcatttgcgcattgttcatcgcctcaagcgcttcgtcattctgagaattttaagtgtttaatttattgaaatattcgggaaacaccaacaaggccaagttggaggtagagaaaggaaaggagagcccacgcgatggcacagtgccgattcagctgaatggcacggacgaggcaatgttgggcccgggaggcatttccctccagcaaataaagtcgagctaaatcaacgaaaattggcaatttcaacggcaaaatcggtaaacaacccattaaatatcacccaaattgcaaaggtattccgattttttgagacttgagctcgaaaaacgaacagccgcttgaaaacaatgaagagcactgaaaggaaaaaagcggaaaattaacggaaagaaataaaaacgagagagcacctctcgagaaaagtgtttggcttggatttcttgccaatatttaataaaaatgtgtccaaaaatgcctaaacaaaatgttaggaaaataatatcctgctaattagttaattgacctttcctaattcgttccacgtgtcggacgcccttcgatttgcccgcagcacagcgaccagcgaacgaatgcgcgcctttgccaactccgaacgagaacagattgcccacccgccatccgacaaaggtttgctcaaagccgatgaaaggaggaatttgcgcatggtaagctgattaaaactgaaatgggcaattggataggttaattgaatgagatgagttcagcaaccaacccctggacaattttgaatgtttgtgccaaacagcgatggagcaaaacagaggcggcattttccccttcgtcgagcagtactttggcacgtgcaaaaatgtgtggcaatgtttccaattgggttttaacgaagttcgagcgacgcatttcctggaattattgtttgtggtctgaattgttacattgctcacttcggaatcgctaacaaacagcacgagggactgaagatgaattgttcggaagtgcgcgaagagaagggccggcaacgcattcgactgatcgcattcggaaagcccatcttcgaattgttctccaagggcaattgcatcgcggaaatgacccatggattgctgaagttggataagctgaaaggaggaggagccaattaattaagaaaggcaaacgcacggacaaacacctgcaatttggccgtgtgattggcttcgtccaattcgatgatggcacggcacgcgcggacagccgactgcaaattgcccttctgacgatacgcctcgctgagaaaggcccaaatggcacaaatttgttgtcgatgctcaatcttggcagatgaagagttcaaatcataaattagcaaaatgcaatcgaacattttcgggtctctcgccaaatgtatttgccatcaatcgaatggaccgttgacatttgtcaatggcactgtcgaatctgcccgcgttaacatccagaattgctgtttggcgcagtgcccacagcgaagttggccgattggacagaaactgttggagagcattgaaacgaacagcatcagcagaattctgcaaatgaaatgcaaaagagtaaaaatcatctccaattcaggaattgcattgtgcaaagacccccccccccccatctccagccccattctgtcccccaaaatcatcaacaattgaacaataagccgattttcacgcttgcctggacttgttttcgcaaatggggatggatcaggtaggccacccccccccccccctcactcttaatgtgtctcaatccaacagagagaacaaagtctttcgtagacattgcgcaactaacccaaattctgtgatttttaatataaaattttgattccgaaaacaaccaagtatagttttgagataagctgtaaatgaagcccaaatgaagtgtccattgacggacggatgattcccatgtcctaattgaaaggatccgtgtgtccatgagattttggagaaaaaaacggagggatatttaggtaaagttgtatttgtatttgtgttgttgtttggttagtctccctctgattgactttcttttgaccttctccgatcggagcagattcaatcccatccgccggtagcccaatcacctcaatttatttcctggtttttcgcatttcccttcatt

SEQ ID NO: 15026 - DNA, 1505 bp, Heterodera glycines
  misc_feature (25)..(25): n is a, c, g, or t
  misc_feature (103)..(103): n is a, c, g, or t
  misc_feature (181)..(181): n is a, c, g, or t
  misc_feature (222)..(222): n is a, c, g, or t
  misc_feature (226)..(226): n is a, c, g, or t
  misc_feature (1319)..(1323): n is a, c, g, or t
aagatgcgcaaatttttgagaattnttatcgcggcaattcgatgaaattattttcttttccaaagccgcaaaaagaaaaataaaattcccatttggtgtcatnttgtgaatttgttgttctattagagtaaaattatgtgaaatgttattatttttgtggattgttttggcttacccttanttactgtatttttaatttttgaatcatccgaaaacttttcnccanccgttttcgaggatttcgtccagcagtttcgcgcacagttcgcttttcgtattggtttttcgcgcgtgttccacacaaatctttgccttctccaacattccaatcgccagcaaattctcggaaagccaatagaaaacacgccaatcattgggtgctaaaatttgcataatttattcgttggcctattttatggtcgttttattgcattttccgaataaatgtaactgtccgtccactcgccttccttcgccgcgttcaccaattgagtgttcgccaattgtcgttggcctttggcgatgaaaatttgtgccgaaatgagagtgtcctcaatgtcagtctccgcaaaagcaatcgcctgaaatttgaaggcattttaaaattggaatgaaactgaaggccaatgcctttcttatattggcacgcgcattttccaaatgtttgtccacaaatagatgaaaaagcgccaataaatgatgaaagatatgcaaagattggtcatttttatcggggaacaacgcgtcaaattcactctgaaaggaattttttgaaaagaatggcgttttttaaaggaaaaggcacctgtaactcataggaagtgccaatttcacctgccctaatcagacatttaagcaacaaagcattccgaaaggactcctcgcaatccgaagaagacaaaggcattccctccgccacattccctccgttatttttcaatttttctgataattttttggcatcgaattcattctcaaccaaaatccattgggcctccaattcttgaaatgacattttggcttcaaaagtaaatttaaaattaaatttttaaaaataaataaaaacggaatacaaattgattaagtcaaatccgtagaaaaatacatgccaacagtcagcctataatctgctttattgcatggacaatcaaaaaacaatgaccgaaaaagcaataaacggtggcctaataatcgtatccgtaatagggtgtcggatgcgcacttccggaaacagtcaaacggcgacctctggtccggtcccaccacagcatttcgcccttcgcgcactcgtccttacgtttctcctgcaatttttacannnnnctaacccaaaatttaaatttattccatccgattggaaatagaattacaacaactcttttgctgtacctggatttttgaccgggaaacccaggcccatattaaaaaaaacagatccgggccaggttaggcacgtaaaacctggaattcctggtggataaaaattttgaaatttgttatttttg

SEQ ID NO: 15027 - DNA, 2976 bp, Heterodera glycines
  misc_feature (2840)..(2840): n is a, c, g, or t
  misc_feature (2958)..(2958): n is a, c, g, or t
atcagcagttgatatgtgtgaagaaatggggaccgacccaattgatcaaatgagcgaatattccaatcaaaatgttatcaaaagtgatcaaaatacgaaaatggaaccaaatcatcaacagaaaataaaaacaattcaaaaatttgaagcaattaaagaaaagttgaagcaaaaaagaaaatataaactgaaaaacaattcaaaaattgagagaaaaactggaaaaattttaggcacaaatcgtcaaaaaatatacaaatggaaaaaataattaaatttaaataaaaagaaaacgatggaaaagagttattataaaggcaaaagaatgaattcatcgaacgatttggtgaatttaaaactttatatgagcaacgcaaacagaaagaatttgtgaaggaattgggcattggaataacaacatttataaaatggaaaaaagaattaatgccaacaaaatattacaaaagtaagagaaattttcattttcatttttattttaattttaaaattaatattaatatttttaagcacatattcaatattccaatgaggataaaataaaaaagatgaaacaatatttcgaaattaaagaaagaaatgctaaaattaccgacaaaaaattgcaaaaaaattgcaaattggaatttcaacttttagagagtggagagagaaattttcttcaattttgggaatatgattacttttattggtaaatatgttttttcagtaattattagagaccggacttttaggcaccaaaattttttaaaataggcacctaaaataggcacgaaaaaggtgagaaaaggtataaaaaatggacaaaaaggacaaaaaaggcacgaaaaattggaaaaaggcagcaaaaagaaaccttttttagacaacatttaaaaaaaaaaattttattaaagatttttagagagcaaaacacgtaaaaataaatcaaaaaacttacaaaggcatatgccttaaaaatccggtctctagtaattattttctattttatttttattttttgtcaaaaaagcattatgtacaacaaaatgattcatagtgccaaatgggacaatttttgcgaaaaaattaccatatgtttgcgttcattatattggtcatgtcattcgcttccatttcaatgcttttggtaagattttgcgggttttttttaaataaaattgtgttattatgtcccaataagataggctgaatgctaaataacataagtctcactaatttaatattctgaaaatgataattaaatttgaaacggcttttcatttactaagcgttagtaaatttattattccatttacgttattgactcacatgaattgacagtacactaccctttttaatgttttacgttaaatgttttattaaatttaaaataaaaaataaattaaatttaaaaaatcgagattttcttaatgcagtgactaatagaattatctgtttttgtaattcaaaataaaaattctatttaaaatcgaacgagtttgaaggctaaaattaatacaagtaaaaattcttcatttattttatttaaatatttatagaaaattaaataaaaattaatataataaaaatgatttctgccaaaattaatacagaaaaaaaaattcttttttatattgaccttaaaatgaagaaattgaagattgtaattcattcagcaaattatttataagaaaaaacataaatacaatataaaacaaataaaataataatataatttataaaattattttttatataaaacccagacaatcctaagaaaaatactttcgcttattcaccaaaatcgcattatcagagcacatttcatcaaccaaattggatgtcaaaaaagggaaacaatggtagggataaagcggaagacgggttttgctaaatccgtgtcgcccccgcaggctaattgggatgtctttttggctggttttgtgctcattgtttattgtttggcccgtgtgacccgctgatgaagaaacagtaaagtggccgtatttaatgggagtttcactaaagcattttgcaaccccaaaaatttggcttaattgttttagctagtttatcatcttttgtgtaatttaattccattcttcaaatgttttccaatttttgtattttaaattaaataaataaatttttgtattttaattcaaatttctcccatatttttttttattttaataaaactttttccaatatttcagtccaatttactaaaaacaaaatgtttgccattcggccatttccgttgcacaacaattgcatgttgctgaactgcttgatcttcatgctgatgacagtgatggtgctgctgcccatctctgacgctttcctgttcggtggtggcggtggctgctgctgcccgccgccatgtccgcctccgccggtgcgttgcgcaccgctttgcccaccgccatcatgctgtgagcaaccgcaatgccagccgccctgtcccgcgccgcttccgccaatgtgcgactgtccatcgtgttgcacatatttgccaccaccgcccccgccgccatgctgctgcggtgagttttttggggggcgtaaatcacaaaataattggaattttttattgagcaatttggtttttaaatagaaaaaaattagtctatttacaaatgtttcaaaaaaatattttttaattttgattctttcaataaaaaaaaaatattttttaattctgattctttcaataaaactttaagctttatcgaatttttcccgaaattttcaccgaaaaattcttctttattattaaaaataattttattaaaactattttttcactcgaaaaaattattatatatatatttgattanaaataatatgcgagattaaattcgaaaatgaatatttaaattttcaggtggaggaggatatggcaaataatcaaatcaatgccgtgccctttttgatataatccaatttgggatatgntacttactgtattttttt

SEQ ID NO: 15028 - DNA, 3223 bp, Heterodera glycines
  misc_feature (1698)..(1698): n is a, c, g, or t
  misc_feature (1700)..(1700): n is a, c, g, or t
  misc_feature (1731)..(1731): n is a, c, g, or t
ggggacctctagagtcaaaatctaattcaatttgcgacttttatggaagttaatttccgcagtccactcattttttaatttaggtcattggcataacttcacttttgaaatttttcttaacaaaaagcaatttaaaccatttgaaaatgaataaaaatgttttcagctgatttggatacaatgttcagaaggatgctaaccaaaacatacacaaaacagcaaaagcaacaaatggccaaaatggtgaaagaaatgcttgaaaaaaaggttaatcagcatactgtacttcactgctgtagttacaattcaattttaaaatgaacgatttatgtacataaaattctcgtgtaaaaatctcaaaccaatttccaacagcagatgaaaaaggaacgtgggactggtaaacaccaaattcatggacaaaaactaagtgatgatgaacaccagctgagagcgttgccgaatgacggtggatttttttttttattttagattttttgctttgggacgattttgtttttgagattaagagttacctatccgttcgggccaagaaaaataattggtaaattttatttaaaaaaaagtcgggaataaaaatttaaaaatcttagttttcggatttaaaatgaaaattattacaggaaatcataaaatgatacaaaaaccccaacgattagcaaagcgaaattaaattgggaaaaattaagatagtacattaagtattaaaattaaccgattttaagcttttgtgatcgaaaagaaaaaagaaaatcttttaattttaaaattttagatttaagatctgccaatttgaattttggaaaaattaaggctggcaaattaaatggagtttctgagggcgttttgacacgaaaactgagttaaatcttttcactttttggcatttttctttgttttttaagctgattttctgaggaagaaagtagcggctggtggtgaaaatggtgaatttaattatgctttttaatttaaatagttgatattgtgaatttatattaattttagattcgtcaaaaatgccaattgtgctaattggccatttggacccggaacagacaaacgcactcacaaaagcagtcataccaattggccttgaaaagctggcctaatttatgagaaatctgaaaaaagagatactattgtgatgaaattactactaatatttgtcatttgatatttgagaataataaatatgaaaattcatttttaattatagatacaggcaaatcttgatcagcatttaccagggctgtcaaaaatatgcaaatgcatttttttcctgaattctacgtagcctatgaccaattgttactctttagttagtttggcccctcctgcttttctacatttttgctttacggggggcggtccctttgtactctccccgccccttatgactccgcttatttaaactcttccctttgaactcccctttccacttttgtcggatccggatcccgaccaacctcccctttcccgttacgagttggagaatcacaatgatgtatttaatttcagaaaagaacattggaaagtacgcacaaacgaatttggaaaaaatatttaaatgcgtggcttttgggacagaatttgaatgtttttgaacaatgaagctgataagattctgttgggaattcgtgaacatttctaatttaatgatgagtgactttcgananccaatggggaaaatgagacttattgggaaanagttggagaatttaacggccaaattttagaacttcaaagaattcccgaaatattaatctcccataatgaaagcaaaattgaaaataaaagggacaatgatcaaaatggggatttaatgcaaaaacagagcataaatgctattactgaaaaagatttgttcatgagtatattcgatttaaatgaagaaattaataatgaaaaaggagaaaaaacaaaaacgaattaaaaattaatgacaaaaaatctaatgaatgtcataaaaacatggattttataacaaaaagttttagcagcgagacaatggacgcgccaaaagttccagcggaagagccattcaatgaagagggattgatcgccgaaaaagtgcgacttttgaatgaaattgaggatttaaagcaccgattggaagaaacagaaaaaaggaaggcggaggcggagaaaaagagaagtaagaataatgagcaaaggccagtagatgaaattgtcctggatatggacgaggaagacgaagaagaagaggaggaagaagaagaagcaccccaagagtcaaaaagggcacgtttggaccctttggccacaaaggaaatagtgcaaaaaaccattaatgaaaaatgggaggcttcgggattgataatgattgacccccgaccggtagattcaaaggaagcgccgaaaggtgtggaaagtcgggattgggaggactcccgccgcttgctaacgagagaagagcgagacagagggtggagtgatttcgtttcaacaataagaaaggaagatcgattaagcgtcattggaaaagtcggacttggatttaacggccgacgtatggccggtaattgcataagaagtgcggaaaagagcattttgcagtcagagatcattcaacctgaaggaatgaggaaacaaattccagtccggaacgaattggaggcaaaagaaacagaagaagagttggagcgaagaaaacgcttcgcagcaaaaacaccggcaacccaagggcagtttgccaattgtgtttgggaggaaacagcacaaaatacaaaagaggagaaaatgaagaaaattgagaacagcatttgccaaaaaataaaccaaattcaacaacaaatgacagaggcgtttggaggattaaaagaattagccaaagaaatggatgaactgacgaaaatcgccaaaaaagaagaaatggaaaaagcggaagaatttcatccgaattcgaaccgatttgccaacacaaatacgtcgacttggcgacaacatgacgagttccgctaccgtaatcgtgggacggtcggcagatgggtcaacaacagccgtggacgcgggcgacagcgcccataccaccacaattggcgcgggaatgaaggatggccagaaatgatcattcacaatcagaaccatcaacaagtggcgcatttaccgttgaccaaagatcaatttaaaaatgattcgaataaataccgaccatagaatagtgatgatggttaatatt

SEQ ID NO: 15029 - DNA, 3567 bp, Heterodera glycines
cgaagagatcttagctcaaattgtggcatttatgcctccgaaataattttggcgcgtagtttttacaattctacgcgcccgctgttgattttttaaaaattcaaattttggcctcaaaacggaaaagtacctttttcaattcataggggtgtgttttctgaaatttttttcaggccatttcttagggatatactttcacgattttattgcatttcaaatggaactttccgaaaaacgccaaaaaggcaccaaaacggcaaaatgccaaaaaaggcatttaaggcacgaaaatcccgaaaaaggcaaaaaaaaaaggcataataaaagtcaacgtagaagtctttttaagaatatttttttttgaatttttttttgtttgcacatgcatatttttttcctggactgtgggaggcctgaaacgcatgaaaaacaagtttttagcctggtttgaagcttctaggatggatttccatatgcatattttgcatatttgggcatttttccaaaaaacttctattagaacggcccccatcagctaaattggcctttttaccccaatgaacggaaaatttcctcaaaaaatcatattttagcaaaatttctcgaaaatattagtaaaaatacaatttttttcaaaatttaaaatttatgccaaaaaatgttaaaaaatagaaaattttcgattttttactcaattttcttcaaaataaataattttacttttattttgtatttttgattctatgatgatttttcataccatatttaaccattttcgagattcttagcttaaatttagtgaatttgaagaatttgggaaaattttgccctcaatttggaaaaatctatgtgcatatttttcactttttatgcgcatattttgcgattttatgtgcatataattctactccctacctatcatatatttttttagaaaatactcaataattaaattccattttcttcattctcgacccactttatcgatgccttacgtgaacgaaagtaagacgaattcaattgtatagggctctccatcttataaaaaatttaattctggcggcccttaaaaaattatcactttttcagggggtgagatgcaggacggcgctagcttttcaatcgtccggtcattttggagcctcgtctacttcttagcattcttgtaatcattcgcagcccattttaacaccattaaactcaatcattttactggtttaagttattgtcggcaaaaagtttattaatgagcaaattttttttttgcaaaaaatggaaaatttagaacctagcgtttttcaaaaatttcgatttaaaaattgtatcattggcacctcaaaaaacgatcattttgtttgcaacttttttgtcataataaattatatttgcggggattttctggatcgctcagtcacgaatcagacttctattcaaaccaatccaaattcgaaaccataatttactaattagaataaaaaaaaatttttattcgcgttcgggtttgagattgatgtcaaaaaatggtgttagattcgtggccagcaaacccccgaaaaacactaggaattaattcacccgatttatttttcccggaattaaacccctaattttccgtcggacattttctgacatttctcaaaaaaaaaatcagggccccggaaattttgagtgaatctgggccttgtccgggctttacaaaaaatagcatttatcagacccaattttgcatttttgtcagcttccgttcgttggtcggtccgctcattgacagtgcgccgcgctatgacccggacagcgactcgcggcatcggtcgctgcgcggcaacggcgggggcggcggttggggtggtggcggaggagggggaggaggaggcggcggttggagacccggtaacaattcgggaacattttgggcacgttcagattgtattggacctccaaattttttgaaaaaatccaaaggggaagggacctttttgattgcaattttttccaacttataacttaaatttgggtaaatttgaacaagaaaaaacggaaattcgaaacaggtcaaaaatagatgtcagattcgttatcagttgactccaaaaaaaccccgggaacgagttttcaccaagtatttttacaaaaaaaaattgtaatccaaaggcgatagataaccttttgttttgttgaaccttttttcaaattctggaccttaaatttttgaaaaagcttaaaggggggggggggccctctgcaaatttttcatgataataagtcataaaaatttgtttccgggtggtttcctaaacatgaatctgacctctgtgttaaccaaatgagacttgctaacctaaaatcgaacaagaaaaaatcctaaattggaaagtgcaaattttcggcgtttttcaattgcaaaccaaaagggtcccccctctttggttttttgggagccctgttttccccaaaatttaaaaggtatccttttggaaatacaaaacacaattaaaaaacaatttttttcaaaagatttcatttttcaggtggtggcggcggcagtggtccccggcgtccgatgggtcggctgaacactgacgggccgtcatcgatgccgagctgtccgagcggcggatgttgtcgttgatttgagaatgttcgagtgatatgaggcttcgaaggagtgaccaaacaaggaaagattggaaaaattccctcgaattttcaaaatctgtgaaataaaaatgctctccaattccccccgcgaaaaatatctgtccgatggttcacggaaaaaattttacctttaatgcgcacattttattacgagttttcggccaaaaatttacgaaattataagaatttttcgtaaaattttgaagctaattcaaaaaggaaaaaaacaaattccaaaaatcgtttttcatctgtcaatttattttccgacgcagaaaacccttgtcccttccgaataattggataatccctccattttctggtgcttttccaacatcttccaacatatttgtgtaaaaattgtagaataatgacatggaatttggtgcagaaataattaatttgttgcctttgctgtcacttttttttaaattacttccattgtcacataaaaaaatgtgaaaattaacttttcagcaaaaaatcgggaattttttgacacgaattgcagcttttaattatcgcagatgactgttgttgtaaccggtgaagaagagacaaaaagtgtgaagaaacacaaggagaaggatgagatgaccaaagttagtttttttttggaaaatttaaaatggaaatattggacccaagaattcgtttaaggagccttagatttttttagaaaggcgcctcatctacaaagaatgattttcggaaaattctattagtaaaattataccccgtttcggcataaaggtacttgtaggttttgtcacaccctgaaaaatttaaaaaaattttctaggcgaaataaatgtgcttggccataatgtatttccagcgatttacgtgaaaattcacatgatggaaaaaggaatggtaataattagatggttctccccattttggcag

SEQ ID NO: 15030 - DNA, 3999 bp, Heterodera glycines
  misc_feature (2053)..(2054): n is a, c, g, or t
  misc_feature (2138)..(2138): n is a, c, g, or t
  misc_feature (2144)..(2144): n is a, c, g, or t
  misc_feature (2208)..(2208): n is a, c, g, or t
tattattattcaaaatttaatttaaattttcagttgccaaaaattgtcaaagcgttgttggaccaaattgttgcggaaggcgaagaattgacattcgaagtgcaagtggcaggcgaagtggaccaaattcgatggctgaagaacggccaaccgctggacaaagacggaagagtcaaaatgatcaaagtggacgaacaaacgtacgtcgttgcttttgctctgatcattcagcaatcttagcaacaatcgcctcacactgacatttttccttagcagttacggtatccgattgattcattcgggccaaatacagtaccattatatatatattgattattggacagcctgtaaatctgattccgacctgactgctgctagtggacctctaataagctagcatttttaccaatagtaccgtatgctgagtttgaatttgttcagctaccgtatgacaattccaagtgccgcgctgtccgatgccggcgagttcgaagtgcaggccatcaacgacacgggcaaagctgtgtcctcagcgcatgctgaggtggaccaggcaccgcgcattgtgcaaggcctcgtcccagcagacatcgccgagggggacgagcaggtgttccgtgtggagacatcggcaccaattcggacgggttgaaattaaagataattaattaaaaatccattcgccttatttagtcaaatggttcaaaaatggccgggagattgaagcgccgccgggtgctcgcattcggctgaaggatgtgtcgccgaagaaatacgaactgctaattgatgacgcacagcttgacgatggggcgaattacaaggtacagaaaaaagagagagagtgagtgctacagtaattgtcggaaaagtaatggttgggttactgtattataagggtaacggattatggtaataaacctgcaccggtcaatgggcgtatattggtacttgtccttttctgttcaggttgtgctgtccaatcgtgctggcgaatgcgaatcgtccgccgatttgggcgtgtgcaaaccatcggtgttcaaactgcgcagcggactgcaggacgtgaccattgacgaggggcaaccgctggaattgatggccgagttggacggcgaaccggcggcggtcaaatggttcagtaatggcgaagagataaagccggacaaacgcattaaaattgtaagcacttaagttagcattggccttggcatagtgatcaatcttttttttcaaattatttcttaattaccccctcctaattaccccccactcttcgcaaggtgtccaatccgtccaccggtgtctattccctgagcattccaagtgcgcttgcctctgacggtggtgcgtaccgcgtcgtgttcgagaacccgcgcggcggagagctgtctagcggttcggtggcgcatgtgcgggccaaaaaacgcgcgccggagacgaacccagcagtgtttctgagcccactcgaagacgtggaattgccggagggcgacacgctcagcctgaaatgcaaagtaagtgtgatttgtaagcatttaaaaaatgtatttttaattgactaaaatgcaaaaaaaaaggttggtggacagccgttgcctgaggaggtcaaatggtaccgtgaggagaccgagctgaagccggacggggatcgaattgccatacgactcggcctcgacggcacggccacgctgcgcattcgcgaagtgcagctcagtgaggccggacagttcaaggtaatgaatgccatttgaaaataattatcttttttaattttaaggctaccgcctccaatgaagctggccaagcggagacaaaatgtcaagtgaaagtgctgacgcgtgagccggaaccgatggcaccgaagttcgtcatcccgctgcggagcatcgaaggcacgcccggcgagcgtgccgagttcacggtcaaagtgcgcggagtgccaacgccggaactgcaatggatcctcaacgacgcacccattgactttgcgagagaaccgcgcttcaaattggaggatatgcgcgacggcaattgggcaatgaccattcanngtaaagcattaatttcgtatcttggatatgtaccgtatacccataccgtacatccactgcatccccaattttataggatatccnagagancgactttggcactttgcgctgtgtggctatcaatccgctcggacgcgatgagtgcgagcccaanttcgacccagcgcggactggttggcagccaacccaagaggagggggggcccccaggttcatggggccgttggggaccaaacccgtgcccagggaaccccaatggccttcaaatgccttggggacccaaacccaaagggggaattcaaaagggactctcaaagggaaaaaaaagggaaaggaaccggcccccaaaatttgggattggaaaaaagggaatgggcaaatcccaaaaaaaaaatttttttataaaaaaaaaaaaaaaaaagggtttttccccacaaaaaaaaacccaaaaaaaaaaaaaaaaattttaaaacccaaaaaaaacaccccaaaacaaaaaaaaaaatttttttaaacccccaaaaaaaaacacccaaaaaaaaaaaatttttttggggagaaaaaaaaaaaaaaaaaaaaaaaaaaaaaaatttttttttttcccaacaaaaaaaaaaaaaaaacaaaaataatttttttttttttttttttttttttttttttttatttttttttttttttttttttttttttttttttttttttttttttgtgggagaggaggggagagggggagggttttttttttttttttttattatttttctggggcgtgtaatatttaaaaaaaaaatgggggggaggaggaagtttttatatcaaaaaaaaaacaaaaaaccccccttttttttttttctaaaaaaaaaaaaattattttcccaaaaaaaagaagggaaaaaaaaaaaaaattatgggagaattttttttttttttaattatataaattttttttttctcccaaaacccccccaaaaaaatttttttttttttttaaaaaaaaaaaaaaaaacaggggggggaaaaaaaggggggtgaagaaaaaaggggttttttttttttttttttgttttttatttttttttaaaaaaaaaatataaaaaaaagagtttggggggttttttttttttctaaaaaaaaagggaaggggttttttcaaaaaagggggggggggggggggggtttttttttttataaagggtttttccaaaattttttaaaagggttttttataaaatcccaatatttccaaaaaaaattttttttgaaataaattaaaatttttaaacaattttttgaaaaaacccataagtattaaaaaccttatttccgttaaacctttccaaacctttatataaaattttttatataacaacccgaatttaaaagaagaataaattcattggatcatttttaaaaatgatatgaaaatgaagtaaaattttattgtaaaaaatcaaattttatatatttatattaaattttgtttatgatattactgtgaacgtactaaaaactttatttattaattcttaaaaaaacaaattttataccggaattaatgggaaaacgaataatggggtattaaattgtacaaattgtattataaattatttaattttatacgtaaatatgacttttgttagattaacgaagaacctgacgaaattaaagacaaaaaggaaaacaaatagaaattttaaataaattttaatttcaattaattattttattgtaaaaaataaaatattaaaaatctacaaaaattaattttaaattaatatccaaaaattccaaccacaacatgtatgtacattcccttgattaagaaatgaagaagtatataaataaatatttttatttgaaaacaaaaattataagaaattattcgtaataattacaatttattctataatataaataatatttttaaatcattttttataaaa

SEQ ID NO: 15031 - DNA, 2327 bp, Heterodera glycines
tttttgcttttttgactcgcctcctttttgtcatccttcccaaccaaaaattgaacatccggatattctccgttgtccaacacttccttcatttggtctgccaacgaattgacaatttgtccattgctggtgccttaaaattcgaaatttattgaagacgaggatttacataagcatttcatggaattgggtaaggggcaaagccagcggaattttgtattttaggaaattctttagaacgccattttcggccctggttgaatgattgttaaattgttggacaatttcaacaggaacttagagaaagttcagtaaatatttacagatttacctgctttatctttttgcgccaatgcttttacatacaaattggtaaatgaatttattaatgggaggcatatatcctcgcttcttcatatgactgctaaacatttctaatcctaagttagggaattccgcttatttccggtaatttttagagaatttagtttacggccctggttgaatgatagtaaaaattcagaaaagtacaataaattaattacagatttacctgctttatcttttggcggcaatgcttttacatggaaattggcaaagacggagaatatggtaaaataatgagaaatatatttcattttgacaccttaaattataattaaatgttcagttggtcttccaacaaaaaatgttgtggaaagaaaaaatgttcaatgtgaagtgggtccagccatgtaaaattaaaaaaatgggggaaatgaatctcggaatggaatctattttaatatgaaaaaataatgaattttaagcgataaatcaacttatttatatgcccagtttgtagtggttgtatacatttatagggaaataataaaagaaaattccggacaattttaagaagcgatcattttgctgggaagatacaattccaaggacataataaaagaagactgttaggggcagcgccctttggctttcgagtgtggtcaacataacgccacacgcaatgccctttgacccaatcgatatttccttcccctctgttcgtttgttatttaaattccccctttccctcattcatgttcactcttccctattcagttcactttttgtgcaattgacattattgttcttccccaatttctcttcatttattttcttctaaataaattgtattgtctgcacccaaaataaatatttatatttgttgaacactaaacattggcttagcacccattgtgtggaccgaacaaaattggcgacgcccgttcggaagcagaaaaaaatagaggaggacaaataaaattgcagcttttagcagcaattcaacaatttgttgactcaaagagaagtcaacaaccaccgcaacttttcaacaaatttgtcatcccttctatacagcttggcgctgttagcagaagaaccggcattcagctagaaagctttcagcttttagtgtgaaagaaatattttgcgctgctatttatttgtctaggcgacaaaaacttagctcaaccacgcgcacccacactgatagcatccaggcgctgttatcaatagtgtggtgaacaaccaaaagaatggcacaaccgacggcacaagagcttttaaagctgattgccgaccagcagacggcgatgacacaacagcagcaacaaattgcacagcttttagctctgcaacaaacgcaaaaggctgatacagtgctcacactgccggatgtggccatcttagagccgagtgatgacaaatcgcgaataagcgaatggctaaagcgcgcacaattcgcaatcgattgcgtgtctccaaacgcatcggacgctgtcaaggttaagggattatgaacaaactctccgaggcggcattcagcgagtacaccaaattctgtctgccagagcccgtgacaagtttcagcttagacacaacagtcaaaaagcttgagaagctgttcgtcaagcctcaatcgatcttcatcgaccgatttgagtgcttgatcgcccgcaaaggaaagggagaggacttccgatcttttgtcaaccgtcacaagcgtttgatcacggatttcaaattcagcgacttaaaagaacaacagttctatgtcctgatgttgctgacagcgctcaaatcgcacggcgatgcaatgctaaggcaaagaattctgtccaaattgaccgcggatggagacaacatcacgtatgatgcggtggtggaggactgcatgaagtttatgactacaattgcggagaacaaagtcatcgagtcttcgtctagtggaagtcaacgaagaaaaccgtaaatgcagtccatccaaaacgagaaaagccgaa

SEQ ID NO: 15032 - DNA, 3603 bp, Heterodera glycines
  misc_feature (54)..(54): n is a, c, g, or t
  misc_feature (70)..(70): n is a, c, g, or t
tttatgaatttttttaattaaaattcaaaatccacctccattaagatgggaagnccttcgcgctcaaagnatctgaaactttctttttctccgtcaacaaatttaaatttttaaaaatgttgaatttgccaacttttgcagccatcccaacgggtccttctcgtagtatcggagctgttgttcttcttcgtcctctccttcctcttctgcgtcctttttgttctccgtttttcccattggttgtgccttttctttgttttcttcttctttctgttctcttttgggaccaccgcaaacagtgaaaagacgtgaactgcctgaaaaacattgccaaaagttgttcattcaatttaaaatatttaattccgacccgctatttggaacacaaatccgttgtgcaatgggacgtaagtgcgttttttgagcggctgcttgttcagcctcaccccgtgggtgctgttcatgtcgaagatgaacctggaaagagaaaacatttgattggtaaaaccccttttatcctccatcttttaccatcccggtctcccctttatacattctccgtattgtaaaatggcgtggaaacgagaaacggacggatgctccaatttgatgtcacacggctcaaaacggccaatggaccaaaatgatttttggtgggcgctgtcgtggagacggacagtcccaatgacagtgccctcttttataatctgaaaaagagagtgaaaaaacaaatttactttccaaaatgatcatttcacttcaagaaagtattcctgtttgtcttcagcagggactaaagcccaaaatggctgctgatatcgcaaatcactgatggttggctgctgttgctgctgctgagtttgttccgtcgctgtcccttcgtcgctctcttccgattttgccggtttcagtggcaaatttttctgcggaagaaccggttctgcgaaaattccttcaccttgcaaagttttctcattttccattgtttgtgttgctgccatctaaaaaattaatttaaaaaatgggattaaattcttttttgtttaagccgccagtgaaattttaatttaatttcgaaatgccaaatttaatttacgaataatttattctcttataaatagggatgatatttataggcactaaaaaccgccaaaataggtaggctctaggctctaaaaaacccccaaaataggcactaaaaaatggaaaataggcactaaaaaaactcatttttaggggtgtaaaatgacaaaaaattattcaaaaaagtaaaaaaattaggccaagtcagtattgagataaataattttttaaagcataaattcttgtcaagaaaataaataaatacattttggagatgaatttttggaaaatttttcatttctgagggggtttatttttagaaatttttgggtcgattcttaggggtgtatttttaaaattcccaaaaaatcgattcttaggggtgtatttttcgtttttattgcatttttgttaacaaattttggacaaaacgccaaaaatccattttttgaaaagaaatgcgcgggatgaaatttcttttggcatttttaatagtaaaaatctaaaaatagtatttaaaaacaaaatactactaaacaaataagcataaatgtgcaactcccgtttcattttccaagattcctttattctatgtaaatattttcgtttttattgaatttttgctaacaaattttgggcaaaacgccaaaataggcaaaaataggctctttcaaatttttttaggctttataggcgctaaaaataaaagcctagaaaataggcattaataacttgaaaagtagcttaacaaccgccgaaaaaaacatgtttttcgtgcatttcagaccatagggagctcaggaaaaaaataggcttttgcctaaaaatatcatccctacttataaatcagtttcagcttgggcaagcaaatgttgaattgttttctggacaatgactcaccatttaaattttgatcaatttctccaagttcatgagccccaattgttggcttctggtttgcctgaactgttctggaaatccttatacaaaaagatatccaatcaggcaatttgaactcaaatacctaaataaaaaaaacaaatatttttagattttcgatgcaggaaaatattttgaggttatcatcgaagaaagcgaaccgaatgaaacaatttcatcgcaagtcaaagctatgagcgaattgaaaatggacgacccggaaaagtcattcacttaaaattgttaaagaaaatcaaaaaagagtttagtgtttttctcattgaccatgcgtggactttccgtccgaatacagcacgttttgcacttcaacaagttgacggactgaggaagagattattggacatgttcaatatcaaagtcaacttatatttattaaaaaaaaatcaaaatattttttcatgaataggcttggtatgccaacaaagaatgtttaaaggacccttttgctgatgatagcgcagaccaacagcaaaagtgtgctgatgccgtagccactcattccgctgattgtgaggactcggaagtcgcatcgccatgcggccaaaatgtcgaagaaatatgggaaaagcattgcgaaatggacgacctaataattgacgaaatgtggaaatatgcaatgacatattcaattcgaatgctcaatttggtcccaaattttattccctttaataggccataaaataaattcaaaagtaaatttaattaattgtcaggaaatggacgaacaccaaattcctgtttggtatgtcatggacgaattcggtgttcgaattggccattctcttcagccaaacgtaaaaagcaattaaaactgtctttggtttgcatttatattcccgttttaaaggtcaaaatggttccgtttctcgacttttctgaaaatatggcctacagtttgcttttccccgtccaaaatatttcagaggggggttagtttttcttcaaattattgttttaagctattttatgtgcaattcttaagacactgtgactcgcaattatgtcgatacgcaacttctcaaaactcatcccgattggttggatgtactgctccatccctggcaacccttccccaatttcgctgctttctcaatttgtcacgttcccaagcgggacgaatatttcatggtaaaaaaaagatttttacccattttctaagcaattgtccgtcttatctctcctcatttgtccctccaattcagtccggtcgtctgctcgacttaatcccttccggggaccaaatcccaacggtcaatttccaaaagtctatggatgacccggacattttggtgtgtgcctcggatttgcaactcatcggacatttgcgccgattccgtgtgcaagaaacaaacgatccgatgaaagcgcatatcatttggcgtcgtgaccatttcaacgattttaggcactcattttcactgatttacattttcattttcccttttgatcagatcgttggcgtaccaaatccaagcgctttgatcaaccaatttccgtttgaatccgttctgaccgtcaaagatcttttcgcagctgccgtccaatcattcgtcgaaaatt

SEQ ID NO: 15033 - DNA, 2413 bp, Heterodera glycines
  misc_feature (18)..(18): n is a, c, g, or t
aaaatattcatcaaatcntggtttttaaaaaaaattaaccctttctttttgttgtttttgttttatataagtattaaaagcaaattaacaatcaaagtccaaaaaaggttaaaatacctaaattagaattaattctcttgatttttaatattttcaatttcgtaacaattattacatattactataaagaaaacaagaataaaccaactttggttttctctaaaataagatgttctaagtagttcattctaacattaaaaaataacatttaaactatcacttaataaaattgaccaagaagatttttttaataattgaagaaaataaaattaaaaagatgaataatttaatttgtattttataattgcaaaatcaaaacttcattattaaatttagtatcctaaaatttacaaaaaatttacttctttcttaagaataatacaaattacgtactcagactgcaaatcatgagaaaaaacataaatgaagaaacatttgaagaatataacaagcattatttaagaaattaatatactatagaaatatagaaccattcattaaaaaataagaaaagaacttaaaatttacaattaaaatccaaaatatcaaatctgtttacaaaagaaatcaaaaacaataaaatataaatgttcgaaatttctctgttaactgagacacaagtatccaaacatttccaaaaattggcaatatggccgcacccaatttatgctgttttttaccatgcctattttatcataatcagtattttttagcaccaaaattaaatttatttttcaaaaaatacctttgagctaaggtgtgatttaaataaaatttgtcataaaattgcctttcccaagggctaacgggagattattctaattgttagagttgtttggatgtgcatgatgattttttaataaaatcactcacattagcccttgggaaaggcatttacatgataatgtttttttgattcacaattggggcgcaaatgttcgggcgcaagtgtaggtgcgcaaatattcggggcgcaaatgtagggacgcaaatgttccgtcacccgacaatttaaggccttttcgcacaatgaagatgatcaattttccatttacccagcaaaatccccggcagagaaaagaacaaaaaaatgtgagtggtagggggggggaatagacgagagagtgtcagtgtgaagaaaaattatgtgggagagagcagagataaggaaaataattttgcaaaaaatctacaacaataaatggcaaaaagtttccagaaatgggatatgtgggctaaactgaaatttcataatccataagtggaaattccattaaatgagaaacgcactaatttttcgaaaaacgcaaagctgtcccatgagacccatcataaaataagttaatcgaaagcgatgcaaatttaccttttccatctgaaattgtgtatccaatcccaaattgcttagcatttttattttgctgtatatttttggatttctttcttagatttttatttatttttaattggcaacaatggacgaaaaccccaaaaagaattttatgcttattcttgcgaggcatttccctctgcttttgattcatctgccaattcgtattctgttttgtttggcccgtaggcgtttaacgaaaagtcaaaactatcacatatgttttcttccgctctccaaatagcctaatgatcaaactcactcagcagaagaaaaatggagatgaagcgacagcagctgtttggggggggggggggagataaagtggagttggttggtcgtttgacggccaaaaagtgaccaaagggggagggaaggaaccttgcgagaccaataaaagaaaattcaaggccactataccgaaaaattccagattgtaaaaataaaatgttcttttacttctgttttggattttacttttaaaccctttacacaaagattaataaacatgccattgagagtcatcacgtcgggctttgacatttgcatcataacctacgccgtttttcgcagttgaaactattgacaaaaatttgtctaagtgaggctaaatttttatttcaaaaatcgtgaccttgaattcaggttaataaacgacgtggccagtaagatttcccattgctgacggaataacaagcatttaaaaatacttggtatacaaaaacgaaaagttataataatgataatatataaattatctaataaaaatgaatggttaaaagataagttgacttcaattgtaaaaattaagagacataaaaataatttttttaatattaaaccatttacaccatttaaatttaaagctaactagttgaagataacttgattaattctatagattgtaaacaataactgtctgcaagaaaccaaataaaatagtaatgaacaaacatcgcatta

SEQ ID NO: 15034 - DNA, 1287 bp, Heterodera glycines
aaaaacatttaacttaaaaataaataatataaataatttctttctctattttttataatatttattagtttttgatttactaaaaatattacattaaatgaacagaaatctaaagatcgagtattcatgatacaaggggcaaaatacagcgagagactcgatgctcagagaaaatgaagaaatgctttattgtagacaagaaatataaataccaggaaaattaaatataaaataattttgcaaatatttaatgcaatgcacggaaacagtgggcgaatttgaatcgcatttttcccataccgaaataaataaatttaaaattcattatgtacgacggaaattaaaaacaaaaattattatgaataataattgcttaaaatataatgataaaggtttaatattaaaattgtaagaatttgttaattactttgtcaaagatttaaataattacacaaaattcctaaaaaaataaacattggaacattaggtaattaattgatataagcccaaaataataaaagctgataataaacataaaaatatagcaatatttacaaaactttaaccaaataaagtccgttaagtggccagtaaaataaaaataaataaattcataacatgcctttaaaaatgcatcattattaaagatacatgtactaatggccatatgtttatggttggtatcaaaaaatagttgtccaaaatgttattattttattgcaaaaacatttaacttaaaaataaataatgtaaatttttttcttaattttttataatatttattagtttttgatttatctaaaatattacattaaatgaaaaagaaagctgaaggaagagtatccatgacaaaaatacttgtttaaatctcacattcttttgatattcaaaatggcatactttttaaatttgttcaaaaatcaatttaattaattttcaaaaaatgccaaattaggtctactgagaatttgaagaagcttcatttataattttataagaacattaaagatctcggttaatttaacctaatttcataaaattaagctgagcaagagcttttatttaagcaaaactataaatttattatatactaatttaaaagaagaaaaacacaaattttttaaaaacttgatactaaaacttcaattgaaaagataattaagaaaataggagtaaaataaaatacaagtgaaaaaaataacaaataattttttataaagctatgaaaatttcaacagaagcactcggagcgctaggtacagatatcctcactctcatctttaatgt

SEQ ID NO: 15035 - DNA, 5355 bp, Heterodera glycines
tcctccgcctgtcatttgtgcttgcttcacaccgcgccactcactgatcagccactgactgatcagctttggtgataagcttaagcggcggttcgcctcggtttcagtgcattcgatttgctgttctgatcagataatcaccaattgcgcccaatccgttgcgacttttgctccccgtcgtttaaatcacttttgctgatcactcgctgactcactttcattttgtcaattctctttccattttctcattttccgtttgctttttcctcctcctccccctgcgtttgatcagcagcagacggattctccgcaactcgtctcggataagcaaattaatttgatcttcaacgcactgttaagcaaatgtgcacaaatttaggctaatcatctctttccatttaatgaatgtgaatgctttacaatttgtttacgaaggctaaaggaaaagcatcgtttggttttgcgcagcaaattaagacaaaacaaaagtgggtttttttgcttcagcaggaccaaacgcagcgggaaaagccacacattttgatgtactctttcttatcattagcagagtcattctgttaatggcgtttatttttctcgcgcttcaaagagcgtctttttacaatttgtccatttttcggcttttcctttttcttagctgattttgtcagctttattcccaaatttttttttcaattaaatccaattggccttcccattttgggcgttttctttcttttcactttttcatagcattctaatggggtttttatccgtctgtttccttttctgcgctgtcaaaattttgagttttcccaattcgcgttcctcgccataatgccaccaaaagcgacaacaaagcaaatgcccctccccccatatttcctatatgttttgtcatttgtccaccatttgcgcaattgttgggtcgggttgtgtgctgctgctggagggtaagagaagtgcggcgagtgcaactccacccttacctccctcttttggtcgtccccccccattcccacaacaatggacccaccgatcgacccacccccgttcgaccgatcattgttgaagcggcgggtgtgtgcgtgatcgcgtgatcatccaccccatgtccagttttactttgtctgctaaaagcactcccactcagctcatatgcaataagtgggctgctgcttgctgttgcttcaacgtagcaatttctgattggaactgactgatgggtccgaatctgagcctatagatggactattacataatatattccccgttttgccgtaagaaagagtcttaaatccggcattttcccgaattcttctgcagaatcccattcaagcactgactaaactaattggcaaaaagtcgagagtttggattagttcggaatgcttggtttctttacaatctctttaaaatcattttggcacagtttatgccctccttttccccctccatcgttttgtttccccgtttcccgtttcaaattttactttttcttcctcattaatcccttttattcattcatttatttattcattttcttccattctttgctccttttcttctccatttcctttcacttcttcttcttcgtagttcgttcatatcgctgcttttttcgttgcgcgcaagcggaaactccgtccgtcgccattaaatgttatgatgttttttgttgttgtccacctttgtgctgttttctctctctgtgcacttttgagtgtatgcatttgttcgggaatggcattttcaaaagcactcatttaaaattattccctaatcaattaaaaattatcaaatgtggtagcatttttttaatcagaaataatcatttgtacatataaatgctgaaagaaaaaatcgttgactttgaacggctaccagacatttgcggacaatttcgggaaaaatattctaaaatatttttaaaaaatctcaaaacatggaatggagactgcaaaactaaataaaaatttatttttggcttttaaaggaatcatattttatttttacacttcaaagaattaatttcactggccaaagtgagatgctgttccttaagtgattaaagaagagttgatccccaacactgttcggggaattcgaacgtcgtctgtttcactctgtcgggtgagagtgctttttttatttttagaaaaatatttttttctatttgacgaccaagtttttgacccccccccccaacatttaaaatttttttagccttatacataattctcggggaatttgataccagttccccgactttttttcccaaatagtaggggaagaaccatagataactcttgctctcgtgatcaattggatagcatttcgagaccccaaaaattttcggaaaggaaaaccgaacggactaatttacgaactgttaatttgaaatagtgaaagtaaattttgttcatgattaagcatatcttcaaaatatttttttatatctaaaattagaagaaacgttctgatgagtccaaattttgcattgcattttaaaaaaaattgttcttttataaatattttttattttttcccgaaattgtccgcaaatgtatggacgcgctttgaacggtgcaatgacattctcaaaaaaccaccaatggaaaattttgacgcaaaattattaataacttcgccaaaaatgaaccaaattttaaaattttgatatctttcgatatccctaaatatttttttattatcctgctgccttttcggcgcccgagaaattttttggaattaatgcgatttattaacagattttgaccgaatatgataattttaaggatttccatttagatttttttggattcaaaaaaatatatttttagttttcaaaatatgttaattttgtcaaataaatatgggtttggagaggaaagactgaaacacattcttttcattaattaaaataaatgcttatttttaaatttcatttttcaaatgtccgatggtccgattccccgcgataacattcactcattaatcatttttaaacaaataataaataaacatcgttcattcgcatttcattttgcattttcatcattttttgttcattccaacgggcacaaatattaattccttttaatcgaccaattaatgaatgttttgcacccgcaaaaattgtaaaaaaacgaaaaaaaaattatttctcatttaatttgacgggcgatggggcggggtgggtaaaagcagagatcgcaaattgaattctgattttacccattcaattcattagcggagcaaaggcaaatgaatgaatgagccttgaccgccgcccctcccattttcccacgtcttcgaaaatgaaaaatgaatgactgagggggggggggggcgggaatgaatgggggcgtttcgggattttctttttttttgaaagaccactaaattcgagagtaatttcacttccttgtttatttttcttaatcgaatttacttatttttgctttttttcaacaaatttgtgcttcaaaaaatataggttttataaactttctgcttttaatgattttcaatattaacaaaaagtcttggattgtggtttaataaattgaacaaaaaaatcaaaaatagtaattaaaaaataattgcatcaattttctcatgttgctaatcattggcccacaaaaaggccattttaatgactttaaattatcccaacgcatttagtttgctgtgaccgccaaccaatgaaatgaaagtgaatttttttgagaaatgcctaaaaatagtttattttattgtcttcccacgggcaaaacttccatttccgtgcagtttcaccacccaacacattccaatctctcccaaaggaagtgaaaacagccgaaatttccatcccatgccactcattcattgcccgccgagggcacgaattcattcagtgcctccggcgtttgaataggcggcggattttaagcgtgcgccgatggcgcggggaggggggggggagttgcaactgttgcaaaatgtgcgtcagtcagcgccggcagtcacagagattggctggcagatctgctgctcggctggtgccgacccgatcggtcgtcgtcaattcgttggaatttccccccgggggttggctcccatttccccccccccactcatttctcatcattttcttgttttggaagcgctgcgatgaccgatgaccaaccaccccacccacctcaacaaattcctcgtcaaatgttgtgtatttaccgccacaagcacataaaatgtgtttgcatattttgcgcatctgttacgtaatgagcgaatgacttcaaagtgatctgatcaaagagtcagtcacaaagtgtgatctacggaatgacaaatgaccgtcggcggagtgcgcgcgacaaattccaaaagtccattttggcgtgcaaaatttgccccattatcaagccgaggggggagcactgatcaaaaggaatttgaccctccggcatttcaaaataaaatcaaagaattgaaaattaaaatacataaatgttttttgcattatatttcgagtgcacaaaaacaaaacaaaaaaaaaatgcatgataattccctcgtgattaatgagaagggaaagagaagggaatccaatgaatgggacacaaatgccaatgccaaaatggcaataactgaaaaggacatggcactttttgcttaatatacaataaatgaatccggttggtgccgaaaaaccaaatgaatgagcagagaatggcattttgtggctgttgagttaatgttaagcaaaaagtgtatagcagtatttttgtaaaagcgcttacacttttctggcttaatctttttcaatcccttttttgaattcaaattggctctgtcatttctcattaatgcatttgcgcataaattgaaccaaatagaggcgaattgggctgctgctgctgctgcttttggagatgatcttttgtccggctttaggaagaggcagcggtgcgattgggtcaacaagccccccccccttaaatctcccccatccctaaatccatgccccctttctcccccctcagtccccttattattatatcctctccaattcttccaattcgtttatttattcaaactgactgaagaatgaatgaatactattctaaattatgttttgcaggatttgcgccagccgatcagttggtcggtcagtcggtcctcccccccccccgcgggcgactgactgtccgttgattggaacacttttggagaagggaattattaattaattagttcgactatttacacaaaataatgtaaattcatcgcccgcatgaagagaattgtccgggctgaggctcggaggagggaacggagaaaaccgatcggaaagtgatcagctga

SEQ ID NO: 15036 - DNA, 2044 bp, Heterodera glycines
  misc_feature (1815)..(1815): n is a, c, g, or t
atactcaaaacagtgaaagggcatgccaattagagttggaagcaggtccatcaacttcgacggcacattccacaccggcgggtcatcaaataatatgtttgaacactcaaaattcggattcagaaaaggggtttggaggtacagtaattggtgtggaaactgtggcaccaaaggagaatggtacggtagatcagagagtgggtttggttaaaattcgaggtgaaaataattcaggatcagcaaatgcagtaaaatgtcacacactgatttgccgccaaaggcaaaggcacaaaggggtttgcctcaaaatgggtttcaatttgatgcccttaaatgggcccaggtgcatcaactcatacccccgcccactgtcttgtaccccaatccacagatattgcgtactgcggtggtggtgcccattaaccagcagagttgttcgagcagttcagttaatggtgtacaattgatgccaaccaatggagaaatgatcgtaactccatgccaacagcagcagccgcaacatcaaagccaaccagaacaccaaaatcatcagcaacagcagcaccaaaaccaacagcaacagccgcaacaccaaattcaacagcaacaccaccaaatgcatcagaatcaacgccaaagggcaattgaaggggaaagccgattcacaccgcggcgttttggcccgaatcgctctcatccttatggaggccgaacaaccgcttcccatcggttcattagggaacaacgggaaacacaactacctatcaattggccatggaatccccttccccgaattcaaattccagtcgaaattcgtcgtgtcctcttgcgccgattagcacaggagcgggagcatgcctttggtcttgctggagtcatgcgccaatggaatccaccaatggcccttttgttgctgtcaatggaagctttctacagtactcttttggcatttgtagtgaatgaaggcgagccggggccatcacttccccaactttaattcgcgcggccggagtgtcatcgcttcgcagagcgatgacgaagcacggaaaaagaaagaaagaaatgactaatcataaagcgaggacggaggccaaattgactgttatttaaccgccaccattttgccttttctgtcagttgaagcataaagagcaatttgttgggcttttcattcaataggcaaataatttaatattgttcatttaagcttgtaaaatttcgggttcctctggcggctataccagagaaggttcacttaatttattataacagtaaataagacgtaacaatttgatttaactcactaaaaaagtccaaaaatataaataatgattactctgaattttggcaatgatatgtaaaatagttttaattattttatgagaaaataatcaagcttaaatttgccaaaatatcgagaatattttttatatttccaaaaattaattttttaatatatttttttctaaataaattttgtgaaaaggaaaaacaaaaacgattaacagcaaaaataagtttgttaatgtttgatttcaagaatacaaataaaagaaataaaaaaataatgatctataaaatataaaatagaatttaattaatttttaaactgaatgctgttattaattatatatcaaaaacttaaaaatgcaactttttcttgaattattatttatcaaaaaataaaattttcatatttaaaccagaattaaatgtttatttttaaataatcaataacaacaataaataatttttaaaataatttatagtaattttttaatcaaaatatatcaccggcagcgccatatatgtatntacgaataaacagatcgtacatttgaaaattaaaaatctaaattaaatgataaagaaaaaaaataaaataaaattataaccttttctcatgaaaattttggtaaatatatcttccataaggttacacattcaataaaacttaaatgaaaaaaaaaaaataataaaattaatccttttatcctttattttaggcatttatttatgggaattccaaaaattatgttttggg

SEQ ID NO: 15037 - DNA, 1687 bp, Heterodera glycines
ttatttaaatgaattagaagcttttaccccaataaatccattcttgttaaaaaattcattcaactttttgttcgaattagtgtccggtattcggaattaggtaaatccgagttcagatccgtaatcagcaccctcgaaaacccctaaaaactggttttgagccgaaaattaaaaaaaaatttttgaaaattatagacacccattcttcagaattgcccaaaaaatgaatatataaacggtgacttttgcctccctcccaacacaatttgcgtcccaacaataatgactttctcctcctccgtcgtcttattactgcccgttcaacttctgctggttgtcatcggcgctgtgttcatcatcctcagccaatgctgtggtggcggctccaagaagaaaaaggtgccaccgtttttgatcaccccccccctttttcacaaatgaattcattcctttttcagcccaaagccggagcagcggtgccaacgccacaaacatcggcagtgggcggaccaccgggagcagcggaagcgccctcgtcagtgtcctgcgcgcgtcttggtttttgtggatggcctgcgcgctgagacacgctccacgacggtgcacacaatgtcaaatatccaatttgttccgctcgcccaatttccaatttgccaatgcgtccaatttgcaatttgttctgcgcgtccaatttccgatttgtcagtgcgtccaatttccaatttgtcagtgcgtccaaatttccaatttgtcagtgcgtccaatctgcaaattgtcagtgcgtccaatgtccgatttgttcaatgcgtccaatgtccaattgcgcgatttgtctttgtccaattgtcggcgtcaatttgtccaatgtttcccgattgtccggcgcaatggttgtccgtgtcaattggtcgcagtggtcgaattgagtcaaattcccttggtgaggtgagaatgtgatttgacgaaatgagtgaaaatccaaatgccaataaattggtaaatggttttccgcctcttttcaaaaagtttgtgatttagttttgaagcggaaaatcacttaaaacctccaatcccttgccttccgttgttctcaaaattcgaggaatttttattgagcaatttgatggaaatgcgaagagcaataaaaatgttttaaagcattttaaattgtgtttgtcgaagtgaagtgatgagagtgggaaagaatgaatggcttaaatatggcggatgagaccgccgtcaatttacaagagatgtgtgtcggagataataggagaggaaatgagaaatagaaattaacaatttaaatgattgaaaatgatcgaaaaacatttaaaattaaaacataattaatgcaaataaaaaggagaatttgggcaaaaataaaaatgaatgtccctgatcatcgaattaggtgatagaaatttgtccgattggcaagtcctcccaattcgccacttcctcctcatgtcctcctcactttcttctccctccattttcgccattcctctttcgttccgtctgcactcgctcaactcgtccgagccgtttcgccctcgttgaccgccttgtgccaaattcgccgatcgtttccctccgccaagttgagattggcttcgttgtccaacttctcttggtttgggaaatggtgagttaattggtccgaaagatggggaatgtttcggac

SEQ ID NO: 15038 - DNA, 3224 bp, Heterodera glycines
  misc_feature (3192)..(3192): n is a, c, g, or t
acactccctaccacttcaagcttcactccagccaaaactttattgatttgtccaaatgctacttacaaagtgaattccgaattcgcaaagaaaatgagcatggtcagctggttgacctcacagcagacgaagttgctccgatccagatgatcggtcaaactttcatccgaaacatcaaaatgagcataaatggacgtgaagttttcaactccaattcactaatggcctacaaaacatacttctcacatgagctgtcctattccaatacggcaaaggactcgcatttgaatgcggcgggctattaccgtgacattggcggctcgcttgagacaggggacggatgcattgcgcgacgcaacctgtttgcgagaagcagaacagcgcaattcattgccaaaattgacgccgatttgttcaaccaacctctctacttgatcaacttctgtgagctggacattgaaattttacccaacgacaacgactttgtcctaatcactacgcccgctgttgcccagggtgctgcagctgctcctcgttaccgcttcgaggttgtcagtttgaaaatgtatgtgaaaaaagtctcattgatggatggactggcattggacattgcgcgaaaacttgaagtgaaaccggcacgatatgctgtgaggaaaacgctgatgaaatcaatgttcattagtcatggacgtttcgagtttacagccaatttgttcatggatcaaattccccgccgtatcacaatggggttagtggctaattctgactatattggaacaatttcgcgcagtccgttcaattttcaaccgtttaatgtgcgcgaaatctcaattattgctaatggccgctcctttccccaagcgccatacgacttggactacccaaattggaaatatgttcgccctttcaatgacatgaacgaagcagtgggattcgccaactcattggaaagcaatggaattagctatgaacagttcggaaaaacccactgcatttatgtgttcaatttgaccagcagtggagatgatcaagctgcgctgtttgacctgataaagaacgggacaacagcggtgagcatcaaattcaaccaggcagtgcccaccggggggataatgctggtggtgatgggcgaatgcgactctcttgtgatgttagacaaaaatcgatcaattagcacagacattactatttaaggctgtcattttttgtatgccactatcatttgaataaagatgaattacaaaaatgttggaattattttcttcatacttcgaattaatttcgatgttgtgtccagtcaaacaaccgaggtatcagcatcatattccgaatatataaaaagactaaaaatgggctggcccaaaagcagccctcaacccagtacaacgcgtgtcccagagtatctaagacgcaaattattgacacgacttcccagtacaacttcgacccggctggcaagtccagcaaccaccacaacaacccatcctcaacgccctaagcaagagaagctgatagatgaacaagtgtcctcaattttgcctccactgattcaattgtgcaaagactcctcaaaggaaaataatttcttccaacaaatcatttgctgggcactgttggctctgtatttgatgcttatcgtcagtttggtcctacaccaattgtgctctgttttttggttgaaacgtaatggacagcacacaaatcaccaaaatattgagagaaaaccaacggacgtcacaaatttttcgaggatgtttcgccagtgaccaattgcctccacctaccaccctacagtatcctgcggcactcattgtgaaccgtgacccccatcacaaagggggctcccattggtgtgccatttatgcccgggacttggacgcgccagtgatttactttgatagccttgcccttcccataccaccaagtattttatcatcctttttaaataaatttcccaaaggtttacacaaaaacattgaagcctaccaatctccattgacatcaacatgtgccccccattgtattgtgtttgtttaccacatgtcccatggaaaatcattcgataaatttatacatattctcaaaacttgttcaaaccctgacatgtattcattaataatattaaataaaatgttgaacagttaaattatattttcaatttcttaattttttcaaaattgtgtcttccacctactaattatgcattattctacctaaaagttacattttccaacgcttaattattttcgtactttatttcccattcattaattatgcatgcaataaaataaaaaggggcggagcttaaccatttgagttggaacaccggtataaaagccgctcgaatttcttcattcagacataaaaaatctgaaatggttctcgtcagcgaattttgtgctcaatttctctcctgccctacaaagtcacttcgcgatcgactgaaccacccagaggaccgagtccgagttttgcagcaattgattgggaaaaaggtccagacaacatacaaggatcggaatggaatgcgcaagtgttttttcgttggtggaatgactgaacgaggcgcggcatttgaaccagcatatggacgtctgcgtaagccgttcaacattaacgtggcagcgcatttttacgctcgtcaccgtgtcaaattgcactacccctatgtgccatgcatcattgaaggctttatccatggtgaggaccgttattatccgatggaactgcttgaaattgtcgacgacaaaaagggagggcgattatttggtcgattgttcactgaaattgaggagcaggaggaggaggacaccaaaagtgaatgttcacactcttcaaacacttctatttacaatgttacggtaaaggatgcacatggtatgaaagcattgacgaaattgccaccactgggcgtggtgagtgcagccaaccatcatcatcatcatcagcacacacgtactggtgaacacatacacacaccacatacccccaaatttaccacaaaattcattatttttggtaattaatattttcactttcttaattatgcctttttctacctaaaacatatactcccaagcattaattatgttaagcttaaaaaacttgtatcttcaaatccttaaatttttaaaactttattttcaaatccgtaattatgcatttttcccccctaaaagtaacatcctccantgcttatatattttgaaatttattttccattc

SEQ ID NO: 15039 - DNA, 1577 bp, Heterodera glycines
aatattaccatgccatttcaatctcattcgcctctttttctaaaagcactttcattcctccaacaaaatccccttttgccgtcattactctctctttggaggaaggcaaatcaacacttttttaaaattagttttttgaggagaattgccattacttttgtacccaaaatctcaatatatatcccactcaatttgggtcattctgctcatttgtaagtgccattgttttatgcccttgcaattcccttcccaataataatttcactgacccatccaaaatgctctgagattgtttgttataatattgatccaatcattcccacggtttatgctgcgttttattttttccattcgttttcttataataagtccttctcctagaaaggggtaattccaaataatctaaagccttaaatccggaggtttgatgggtcggcaacaataaaatctatttgcacaaataattttaataaacaattattatgtaatatttttgttttgctttattctataaaaagtcaatttttaaacaaaaatacatgtttatttttgcttaattatatttaatttcctagtctttaaagaataaattctgctcctctattataagcattactattgctatggacacatttgaagaatttgttattgtcaacgaaaaatcattcaccgatattttactcacatttggttataatcgaggcggtatcagtgagatcaaattcagtgatgtcactcaattcgctgcactgtaattaccataattaatttaattacaagaaaaagaaagttctttttaagcgaatttcaacttgattatgccaaatcattggaaatcaaacacattggcaaaacggcgagggaaatcttgccattggcacaaattattcgctggcaatgggatgagaagggctcacaacaaatcacagatgtgaattaataaaaatatttaaattaaaaaaaatgtcagtatttttagacacaaatactcacgacggaaggaagtgttcggtttcattgcctcgattatttgggttccattgttgtacgaattttgaagaaaaaggacgactcacatacagcggaaaagtaaaattcatacaattaaaatttgtttaattaattaattaatttttttgtttgcttttaagtccatttcaatctctcaattctccggacgatgattttatggtggaaatcggtgacagaaaggtgaatattattaatttgcattttcaatctgtcattttattttattttttatgatgcttcatccgttttttaggtggctttgtccgcttctcggcttcgctgcttctccccggtgatcgatcggatgctaagcgtggagatgagggagaagcagcagcgatcagtcactttgaacgaattgagcattgacatggaccaatttttggattttcttttgtacatttcgccaaatgctctgagccaaccaattcttcccaatcgtaaaattgaaaataagaataagttacaatcagctaatattttactgtatgattcaaataatttaatttatgaaattatagtataacatgtgcttactctgctca

SEQ ID NO: 15040 - DNA, 1395 bp, Heterodera glycines
ggaaatcggtgacaaaaaggtgaatattattaattttcattttcaatctgtcattttattttatttttttatgttgcttcatccgttttttcaggtgactttgtccgcttatctgtttcgctgcttctccccggtgatcgatcggatgctcagcgtggagatgagggagaagcagcaacgatcggtcactttgaacgaattgcattgacatggactaattcatggattttgttttgtatatttctccaaaggagattccgttgatcgaccgagttaatctaatcgaaaaatatgggcttacaaatttgaaagttctttttttagttttgtcattttttaaattttttttctttcagaatttctttttgaatttcaatgtggacaaattgcgtgcctttttcaaggaaaatcatgaattttttttggcgacgatcagcaaagaattttatggcgaattgatcgcgcgaatttgtggttgaatttcaaaatgaattttatctaatcaattctttcgccagcagatgtgttaattggtacgtattgaagttaattataatttttggattgcaaatcgaataaattttttattcctttccaatgataggaaaaaataataataattaattataaggaggtcaaaaactcattttttagggctgaaaattatataaactaaaaatgaagatgttttttgtgcttttccggccaaaaaaatttttcttcagtgttatttcaaaaatttaggcgctttaggcgaaaaagcaggaatatgtagtagggtccgtaccccgtgggcgggggtggcttttcgcgggggtcagagtcgcggtggcgggggcacgataatttcgcccccgcggggacgggggtttacttttaattagctccaaaaaatctcacaaaaaaataaattttatgatgatttgtttggctccacattccttaagtcgatgtatcgcctcgattcactattcattttggcataaattgcacagattttgtctaaagattaaccaaatttagggattttaggctaattttttaagaaaaataggcttcttcgtgggccggcggtgccgataggcgccgctgggcgaatttggaaatttaagcactattttctaacaaatattcaccaaaaaattaaaacttttccgataaatttttgtttttcttcggtttttattttgtaattttgaaatatattaaattttcctgatttagtcaaggaaaattgcactttttaatttcaacgaatttttcatccagcggcggctggcggagccatcaatttttttttaaaattgagtttaatttgttaacgaattatgccaagaatggtcaattttttatgggtgtttttgtacattaatcataaaaaaataattcaaaaga

SEQ ID NO: 15041 - DNA, 3497 bp, Heterodera glycines
  misc_feature (82)..(82): n is a, c, g, or t
  misc_feature (526)..(527): n is a, c, g, or t
  misc_feature (606)..(606): n is a, c, g, or t
tcgggaccaaaaaaatagatttttaacaatttttttgtggcgcatttttcgaaaatttgagtgcaatttgttaacagatttntgtcgaaaaaagtttccaaatcttgtgattttaagccaattttttaagaaaaaattggagtttttgagggataatttaaaattttgaatgcactttcataataaattttgtccaaaaagcccaaaatctgcgattttgaggacagtttttagaggaaacaaaaatttttagggaggcgagccgggaaattttttttggaaattttggctctttttgtaaacagattttcataaaaattggaattttgtaagaaataaataaattaaaaatataaagtggaattttttttagaaaatattcaaaaataagacaatatgtactttacatatctctttcagaattttaagcgcaaataaaaaaaaagtgccaaaatctaccttgctaaaacggtaataaaggaatttgcccacaattattcataatttatttgtgtttttctatatnntgtttttgtttttctattaataataaattttaaaaatataattaattatatttttctctttaagtttcatcaataattntgtttaaattcatttatttttttctatcttcatttattattttaatagatattttaaattttggggatatgatatggttagggctgggatttttaggtttttacctatttttttgcggcttagttatgatgagagaagccgaaaaatagcattttctcctaacaatttccgatttagagcgactttttagcacctaaaattacctaaaactggattttcggtcaatagcacgtattttggcatttttcgagttttagcacgtattttggcctttttccagaaatttcatagcaaaaatgcaataaaattgaaaaacacacccctaagaacctgtccaaaaaattgtttttaaatatacccctaaagattgaccaaaatttcagaaaatattcccctaagaaacaaaaaaattttcccaaaaattcgtccacaatatttattatttattttcttgaccaattgcaattgtgtgggcgaaattgataaaaaattagtcgcttttggaatttttgtacataaagacactgatttttccaatttttaacacctattttcgcacctattttggcctttttgtgggtttttagcacctattttgcactttttagcacccattttagtacctattttgggatttttagcacctaaaaatcccagccctagatatggtcgtaaatggtcattgtcgaaatgccacagttccgtccggtcagttccgtcccagttcttttgggccgtttccgtaccagttaaatgttgacaaatgaaatttatttttaattaattgattaattatttagggaaattcaatagtaatttttaaaaaattttatttaagaaattcccaaaaatcttagttacaaataaattttttcaaaatcccacaaaattactatatgatgcaaatctttttaaattctcaatttttctccagcggcgcctattagcgacaccgacgccaagaaacatttctccacgtgaaaaatcccacaaaaaaagtaaccactccactttgcaacaattcgtgtggctaatgaaccattaaagcgcattcatttttaattgcttcggggtggttggtggacatggcacgggaccatctcatacatcagctaattcatttattgtagtcgagaaatcagctctctattattatatgtacgctcatcgcgcattctatgtaccataattatggtaattaaggctcccgcaacagtcaagaactggttggttcatgaaagaaaacccaacaatttaccgcacaattagtgaggcggcgaacgcacaaagcgcccacccaaaccgcaacaatcacttaataggcataacaatcgtcaagatggggaggtgatcaaacgagaccaaaatactcgttctgcttcttctactgctgctaagctaatgagagtgattagtgccgcgacaaattgattttgtgccgcgccggcgccgcggaagttgccttttttcattttgttacatgcgtttgctcgagtgctaacagctaacatataaaaaagcttatgtgcgcaaaatatgcattttgccaggcatatgatcaacatcttcaccattagcattagcaattttttatgccacaatgtacctaatttattcaccaattaaaaatttttatttacatttttctaccatattttgcgattttttccaaaaacaaatcgtgatgaattaaaaatgttttgtcccaatttggagagtatgcatggcttccagcagaacccccacagtaattggatactgtagatcgcactataattagatgcttcacgagcactgttagggtactttaggagcattattgtaggacacaattagaccgctgcgggttctaccataatatactgtcatataactactgtagcgggttggaactatagtcgactgctaaggggcactctaattttgatactgttgcggcactactaacgaaattggatactgtagctggtgtggccttttatattcaccgctctgttaaaaaaatgcggtggtccgtcttcattcattaccggttaaccaccatcaccaacacaaccaccatcatcgttatcatcagcagcgtgttggcggtgctggtcggcaagttgcagtgttgccaccctgaaggagcaggaggaggggcaggaggtgacaaaaacaaaagttttttttttgaaaatttcctatagggttaggtaggcgcccctggccgacccccttccaaaccacatccctgtcaagaataactataaaattgtgaacgggaggcataagtattagtgatgctggaaactgaaaatttcccgagactcaaggccttgacccaaaaatccgaaattctctcgagtcgagactcgatgccgagactctcgagcatcactaataggcgtgcccgaaaatactccccatcttcaaaattcttctgacaacggcactgtgccgtgcccctccccatcctgcccgcctcaccactgaagattccgtcgaaaatatattccgtaccccctaattcgtcaaagaaacgattttataaaagccaaaaaatgttttaaattttttattagttttcatttgaattccgttttaatttttagccgccgacacaccgggtgcaaccgctcctggcgctggaggagccccacccgcgccgccactcgcgcctgcacccccaccgggaactgaaggaggccaaccggttccccaacccgcgcctgcacccccaccgggaactgaaggaggccaacccgttccccaacccgcgcccgcacccccgccgggaactataggaggccaacccgttccccaacccgcgcccgcacccccgccgggaactataggaggcctacccgaaggacccgcacccgcgcctggtggtgctcttgtgaacacga

SEQ ID NO: 15042 - DNA, 2035 bp, Heterodera glycines
gggaatgggtggaagataatcatgatcattcactgcattcaatggaatgtaattgcgaaccatattcaaaattcgtctatctgctgccaaatatttgcctcgctttttctcaggtgacaatccagcgatcgcagaattgtatttgtggtcggcaattttctgttcacgtcgaagaacatcagtgaaatgccacaacgatggatgacgacaattgaacgcgccctgcaaacggtggtgttccgcttttgcgttattgttcgtcctcgcatttccatccaatgttcgttgatagacgttccactggtccgggcggaacagtggttgcgaccatgtgccattgggacgaggacgcccaacataattgtccaaaagcctaaaaaattattctaaattgaaaataaaattttatttctgaccaatcaatgagaggtcgaaaagccaccaaatttccaaattccatgtcaagtgccgtcactgcattcctgatatcacaaagtggaacgaatgcgactgatgtaagcatccgaacattcaaagcaaacaccggatcagaacaataacgcttaaaatttgaaaaaaaattttaaagggaaatttacctgccataagccttgctgcttcactttcttttgtaagttccgtacaaaatgaaaaaagcaaaaccggatctggcatccgggaaagattgtcgtaacggcatttgacatggccatttcaaaatccacggaaaaagaaatgggagcaaaatttggccacgcagcacgcaaaagtgtaaacattctttcgtacgatgtttgcgatttggaagtcattaaggcatggcacaccgggaaaatccatttttcacacctaaatatttaatttacaattttgaaaaactgaattaaaacaaacagactttgccaagatcgtataaatctgagaaaattgggctggtgccaatgagaaagtttcgtcgccaaaacactcattcattctgtccgcaaaacgcccgaatgaatcgcgaccaaacaataaaattctgagaaaaaaagaatttcgcattttttttctaaattaccgttgcggggtttttccattttcaaaataaacaccggagtcgcccaacagaaacagctcctcaacgccttccgtggacgtgtaggtcctgtatgcttggttgatctcaaaattcagattggtcgggactgctggtggtgcattgatttcgtggcgcgcccgtttgattaactaaaattagtttgcttgttatttttaatttgttaaaaaaattctcgtacgtcattcgcagccctttttgtcaccaaaattgcggctggtgatggcacgttctgcaatgcttctgaacgaatgacagatggcggttccaaggtagtgatggcacggagtttgattgtagttttgacttgttgagcctcaacattcgaagcatttgcgggacaagtgtgtggcgttgaaagacgaatgaagtgattgtttaggtccgtccaaagacggcctttacatttgttgacgctgtctttgaattcgcacacccaaaattttattgctccattcacactcattttgtcgaatatgtaaagatgtccttcgtgaggaagcttcacttgttgtttttttgtttcaatttttgaagccatattcgatgaaattgattaactaaaaaagttttatttttgttttttgtttgtagattttaaccaagtatttgaatttttataattttttttggcgccgaaacgcagtggacccaaaattaattagtaattttttatttctcttggttttacgttttaatatttaaattattatttctttttgcactgctggttccctatataagaataatataccccagtttcaagcttaaaaactaatttaagactttctagcgagttttacaggtcgagcgtggggtcaatcgacgcagtttttcaagggttataagggaaaaatagtgcggtttcgatcggttaagaactgttcgaactgtgttcgaaaaatgactcaaaaatagcacttttttgggattgcc

SEQ ID NO: 15043 - DNA, 1402 bp, Heterodera glycines
  misc_feature (26)..(26): n is a, c, g, or t
acgaatctgttgcacgtcacctccgncctttgttgctcttcaatgcgtccggcacgttgtacttcttcagtttcgtcgttccacgaatctgttgcacgtcacctccgcctttgttgatcttcaatgcgtccggcacgttgttcatgtcatctttgtcaagagcattcttcagtgtcccatcctccaaccgttttggttgtttgcacgcttccttctgctgttttggactgtacatgtcatcctcctcgtcgtcatccatctcatcatcacttcgatcctcctcatcatcagcactcactggctttcgtcgcggaaggttcttcacatcaaactgtatctgtacaatgggctgatgcgtcggcttctcttttggttggacgtagacttggatcaacgttccaccagtcggaattgttataacataagtcctaggccgccgttttaacaaaaatgctaaaattaatcattttttattgattctaaatgtccatagtgtttttgtacctttacaatcaagattattataatttgtgaatttctatttttcatgtgttagagacatttaaagctggtatgactaattgagtttttcatttcattccacttttcatcaaattccatattttattttaaacaaaaacatttttaatttttcagaaatttattgaattcacttttttatttggtttcgtccgacaacaagaaatggtaagttgtaacggaatagcattcctgataactcaattaattcatattcaattgcttaggcaaagcgcacaaaaaaggtcggcattgtcgggaagtacggcactcggtacggcgcctcgttgcggaagacagtcaaaaagatggaggtgtctcaacatgccaaatacacatgtgcattctgcggcaaggtttgcataccgcacattatgttgcaatttgctagcgacaagaagacggatacaataaaacactaatcaaaagatggtaaattccatgggattgtcattctgtttttagcggttttgcgatgtgctcagagttattcgaaaatgattatcattcatctgacattaattttggaccctaaatttgtgaaataatttgcttattctcaaaattaccatccaaattgcttattgcatttaatacattgtcaaagcgtgagttgtttttcgataacctgaaattacattgcagaactgctcaaaaacatcacatatatctttttgtggacgattggaattacccttgaaaaagtcaatgggataagaggcacttattatgtgcaaaaagacactaagtctgtgggttgcaaacgtccaagcccagaaactatcattttgtttaatcattgcatcgggaactcaaatatttcatgaccaatctccaaaataaaaaacaataaatttatctc

SEQ ID NO: 15044 - DNA, 2581 bp, Heterodera glycines
  misc_feature (2015)..(2015): n is a, c, g, or t
  misc_feature (2087)..(2087): n is a, c, g, or t
gcctatcggcaccgccggaccacccgccaccccctcccccaaaagttttttggaaaaaaacgcgccgcaaaaaaaggtgggttgaatagcaaaaaaaaaaaaagatcgtcgccggagaaaaatttggaccttcaccttcgtatgaaaaatcggtcccgaaacaccccccttgtcccaatcgtctgtcgttgggctgagacaccccttgtatatgtatggtccattaattaattatctcttaaattaggttctttttattccatttcttagtacgattaatagaatttgggatagtgcagttatcgcaccacaattttgccatgcatagcccctcgaaactaggcaatcggtataggatttggtccatttttgtctggtgttcaccactttacgccttttttgccctttcgtgacttttcgttcagatgatagcactgctcaattcggagagtcttgacgaggccgttgagttcgttaagcacttgcaggaaacggatccttctccgtccgttttacccgtcgtcaacatttccctgaacgatgctcggcgaactttgtacttgagaagcgacttttcacgtgaccaaatcagcgcaaaaatgaaaattttaaaggcctaatgtttctgtttattttgtatacaatacaatcaaaagaaataattatttatatttatatatttttaatttatgttttgtgaatataaagatgaaattaagtcaagtacagtttttcagtattttaagtcaagttgcaaatttttgacgacgatttttattcaaaatttgtcaataattatcatgagaatgtactaataaaccaaagtgttcgctaattgtaaataataaatttgattcgatttggaatgattgtttcaactggtaaattgcttttagccaaatgtttcccgctaaatacaaagcctttcgactggaaaataaagtcgcggtgatcacagcagcgacaaatgggtgagcaacaccggcattctgaagggcactcaatcgatgatcactgataggaaaatgccatacaaaatgggcctattcacaggattggattggcaattgctgaacgattaggccacgagggagcacgtctggtggtcagcagcagagacgaagacaatgtgaagcgggcgatcgatcggctcgtctcttcgggactgaaacgttcggaccttgccgggtcgtcacttttgcattggcttttcgtccgtccaatttcaccttcccccccccctttcttttcagttgcacttgccatgtgtccaattcggaggaccgaagtcgcctgctgaaactgaccatccaacggttcggaagtgtgcacattttggtgaacaatgctggcatcaacccaattttcggcgatttgttggacgtggacgagtcagcctgggacaaactgttcgacgtgaatgtcaaggcgggcttcatgattgccaagctgttcgcgccagaaattgaacagagcgggtcggtcaaatgttcccggtttttgaaaggataaacgccgttgacagaatagcttcgaaattgtgccttttattttaattttccagtggagggtccatcgttttcaactcgtccatcggcgcctataggtccccccagggaatcgctgcttacggcatcacaaaaacggcactgctaggtcttaccagagctctggcagaatcacttgcacccaaagggattcgcgtgaatgcaattgcgcccgggattattaaaacaaaaatgagcaaagcggtggggatggaaattaaaattaaaaaatggaaaacactgttttaattagctttgggaaggcattgacgaacggagcagtgccgaagccattggcacacttatgggacggctgggaatgccggaagaatgtgctgcactcgtcgcttttctctgctcttccgacgccagttacataacgggcgaaactgtgccggtcgccggaggcgcctactcacgattataaaagggacagacaaagaagaaagaaaaacaaacatctattanaaaataaaatacaaattgttgcaaagtagaatattcaaacgaattttaaaattttacattatgtaaaattanacgggaaaattggaacacctaccgtaattttgaggatcatctccttaacatttaccgtaattttgcgaattctctccaatctcttcgccttttgtgccgctttttatgcaattggtaaataccagcaaaaatttttattccaattacaaataaaaatttttgggctgatattacgcaatcgcactcaaatgcacccaaaatcaaaagcaaattatctgatcggcacgagaaaagtcaattttaagaaggaattgggcggtgaatcattaagaaatggatttggtgatctgtaatttaagaatttagccttcaaggaatgaattaaaatgcaaaatgaataatgaaatggatgaatgggccaagcaagggccatccttccccctcccttcccttttgctgttggtgagaagaaactcctccccctgctcttctccgccctcctcccactctatcggtccattcattgtacagcaaaagacggcaaccattccccc

SEQ ID NO: 15045 - DNA, 1012 bp, Heterodera glycines
  misc_feature (55)..(55): n is a, c, g, or t
  misc_feature (121)..(121): n is a, c, g, or t
  misc_feature (168)..(168): n is a, c, g, or t
  misc_feature (219)..(219): n is a, c, g, or t
  misc_feature (966)..(966): n is a, c, g, or t
tttgtcaattttaaatgagcagcacaaaaattcacgaaaaaacaccatttacacngctcaaaatatgcaacattcgcacaaactgtggacgcacaaaaaaatacaacaaaacaaaatatgnatcagatcagtcggagagattctcagaaaacgatattttgtacagtntaaagttgatttgctgttttgaaaatattaaactgcgttcattttaatgtntaatgttcgacaaaaaaattattcagagtgtgacggatgtctttccctttcgaatttttcgtcccccgggtttcgacatgaagccattcgttctgtctgtcccgagtctttattggctctaggaaaatccgacaccggaaaatccgacacaagcagaaaatccgacaccgctggaaaatccaacacaagcagaaaatcagacactggaaaaaccgacacgacaccaactttaaatttaaaaaattttgattgtttgagttaatatctggctaagtttatcaagttttcgaattgaattttaaagaactaaattggttgcgccattcgatgggatattgctaacaaataataaaggggttgtcgattgttgcgagtcgcataaatcctctgtgagatccatgtcttgctccacgtacacttgcttatgcttcatgccctttcctctgattccatttgccggattgtttacaaattttttgagatgattaaaaaagggtataggagtaaatatggttattatatgcctatcttaaatagaatttatggcaataaaaatatttattttaaaaaacttaagtatgcaacttttattacgtgtattttaaatattcctaactcaaacaatcacaaagtattttttaagtttaaagttggtgtcatgtcggattttccagtgtcggattttccgcttgtgtcggattttccaccggtgtcggattatctgcttgtgtcggattttccagtgtncgattttccagtgtcggattttccggcgtcggattttccggctccc

SEQ ID NO: 15046 - DNA, 1845 bp, Heterodera glycines
  misc_feature (1750)..(1750): n is a, c, g, or t
actagttttgtcttacagcacaagttgcaaaggagaagcccccactgactgttgttggggatgttggcggcaaaattgccatccttgtcgacgatattattgacgatgcacaatcctttgtggcagcagctgaagtaatttaattttccccttttaatataaaggccagcaaattaactatttgcaggttttaaaagcgcgtggtgcctacaaaatttacgtggttgcgactcacgggttaatgtcactcgacgccccttccttactcgagtcatccccaattgacgaagtcggattaggacacaacgattattatgataaaaattcaacggtttagataattgttacgaatactgtgccacacgaaatgcaaaagttgcgttgccataagataaaaaccgttgacatttccttgctgctcagtgaagcgattcgccgcatttataacaacgaatcgatgggccctcttttcagagaccttacaatcgatgattgatcaagcatcgaatcgtgcataacctttctgtgtcgatatttttgcaaatggctcgtctttaatgtgattttatcatgaaaaatataaagcgttcaaatatttaaagcagtgtttctaatttaggggagggggggatgcattttggaaatacggtgtattacctttcttttctgtaagcattttttgctttttttccaatgtctttcacttgtcgctacatcaagtgctctaattgcacattatggggcatttatccacaaattcaaaacggacataatgagtgaaactggtgtcgttaaaacattcaaatattttccaagcaggcaaaggtatagattattggtcccgaaaattattttttaaataaagtttaagaaaattatttttaaggataatctgaggcgccgagcacgaatccggtcttattttggctcagtctcgaatcccgaacccggactcgaacaaaagttcgagaattcaatttttcgtacttcgcagttttagttcaaaacccggctatatacgtggaatcaaacaggatcttattaatacgtcaataaaagattatttaaaccattttgaagtaaaaatgtaaagtttgaaaaatttaaatttttgaactattattcgaatctgggtcaggggttcgaatttggtcgaaattgatgtcagaatcggatctccgaccctgaaagtgtgctcgacgactcccggccaatgagaaagtgtgctcgacgactccggggcccagtgatcagcagcgggatgatgaatgatcatttgagaaaatgtcgtccgctgactgcgcggaagtgaatttaatataggtatttgagaaatggtcgatctcatcgcattttaaacggatttggtgctctaattttctctgatcagaaatgttctatcacttttatttgtttatttttttcgaatattaatcgtttcaattgacaaattaaattgaattacttcaaattagagtgccacgggaccgggaatttttgccaaaaccgggaccgggacctcgattttttttcgggaccgggaccgggaccgcaagaaaaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttcaaacaattatcatttttggactanatcatcgaatattaatagaaattcagatttgattttcacatcactttttttcggagcgctttttcaaaaaacttttcaaaacccgggacccggga

SEQ ID NO: 15047 - DNA, 931 bp, Heterodera glycines
  misc_feature (13)..(13): n is a, c, g, or t
atgcttaataatnttatgggacgcgtattctgcactagaaacaaagaattacctaaatgtgcaagttttgggagttactatatgttggatttctatagcaagaattatcgttagaaggaaaatttcattaacgctcgaacttgagccccattttaattttaagtgcccattcattttgtttactgataaaacctatcagaattttaacatctttttatcaaaccaacaacagcaataacgaacaaagacattttcttaaacaacaaacgtcggtcacatcagaaaaagaaaccgagaattttccctcccacgtgttttctacgtgcctcctcgtggtccataatgccagccgaagtggtgagcaccaaaaaaccgaactgacgcgatggaagtaaattgctggtccatttctccaagtcggccattcgaatgtcgaaacgaggactgaaatcgaaaaataaaataataaagtctttccgcctatgattaaacgaagtcatttgatttcaatcaaatgtctattgtattttgcaatattgtgaaaaattcagaaaattaacgagatgaaggcatttggaatgggaaacaaatctacagaatttgtttaataaatcccataccagtaaaaaaatatttgggtgggagtatggccactctttcttttcatgtaacagaacctgatcacttggcatttgttgatccgtccagtgagattcaccacaattttgccggcacgatggtcatcaacaatttcgaattcgccaatgtagccgtgtttcatcatgaccgtgaggaaacggatgatcacctttgaagacggtcggatgatcacctgtataatattaatggaaagagttcgtttactacgcttaggatatttggcgcaataataaacggctctagtgcactttatgagtcccaatcgactttt

SEQ ID NO: 15048 - DNA, 2478 bp, Heterodera glycines
atcgacaaaatcccatttggaacaacgccaatttgtgccggaatcggtcggaatttgcgtgttgtgcgccatttactttgtatataattagcaatgaaatgagtgaaacaaaaaattcgcgtcacttatccattagcgggaggggttaagagaaaagtgaaaagaaatagagcgaaagagagagggaggagagaaggcgagcgagggggagaaaaaagagagatggagaaagagagaaagtaagagaaataaataagaaattagtaaaatagagagaaagaaaaacaaacagagagcgagcaaatgagagagagagagaggaggaggaggagaaggcgatagagtgtgcggaaaacaacagggcagacagttagatagtgatggttagctaattagatgctgtatgtgccctgcatatactccatttggaagcatttacgtgacaattcaaaaaacacagttaatgagcacgtcaatttccaatttcatctttaaaatttatcgattacttctcagcaattcattcacttctgtcgataactttggccgagagctgcgttagaaccagggctgcacgcaattacggattacggattgcggaaattacggggttttgggagttacggattacggatttttccgtaattttgatccgtaatttgacttttggattattttttcgagacgatttcttgtaagattatttttataaaaaacaaatttttctattttttatttaaagggctacccgtatttcgatttatttaagaattaaaatagatttataattttttatttgttgttgttaaggctatttgggtatttttaaattttgactacaaaatggcaaaaattagtctttttttggctaaaaatggttacaaaaaaaaattttttggagtgttttgggaccgctgatcaagaacacgacatccattttgcccaattccgaaccctcacccgaacttgaataaaatcaaattaaaaaacgcttgaatttttaatatttttgatcattttgtgattaaacctcatttcgttatattttggacttacaaaaaaatgattggactcataaatatttgattggactcaaaaactcagattgctttccttttcagatcaaagtgttcatgaaggaggtgcggatcatgcgacagctccaacaccccaatgtcgtccagttcatcggtgtggcggttggccaggagcccctgatgatcgtcatggagttggggacggacctccggcgctatttggacatgagcaagcgacatcggctcaacgctcgcgccaaactcttcatgtgcctcggagcagccgccggactggaccacatccactcgaaggacatcatccattgcgacatcgctgccaggaactgcctctacgcggacggcatggtgggtgagaacatgatggacgagggaggggtcagaaaaattggataccaaaatttaaggaaattgaaaaaaaattttgagacttttgcttttcaagagtgaagtgattgaaagagcatgcttttcaatcgaatttaatttttcttttttttccttccccaattttttatgtaaatgaattctctggttgactattaattttgctcatttttcaacaggtgaaaatctccgacttcggcatggcgcacaaagggacggtgaaaaggtggacaacaacgccaagctgcccatcaactggcgccgttccccttcgggggtggagacgaaaaggcattgagtgaaaagtccaaaaaagttcttttttttatcatttctcccttttgcagaaaatgaagggccagaggatagtcttcccccggactgcgccaccggagttcgtcatgctgcacatctgggactcgaagcacaacaaccgttactcaatgggcgcggtgtacgactggctgaagcgacacaccgaagaaggaggaagaaggacgaggagagcgcctgaactagtaaatatgatgatgtgtgtatgtatattgtatatgtgtatattatatatgtgtatttgtgaaatttctgtatttttcatgtcaccgtttagaaaaagtgggacggggacagcgggacaaacgccacaattaccggcccaacaaaaagacattcaacatggacaccagttttggatttgtgggtttaataaaaaataaaaataaataaaaaataaatctaatataaattaagctcttttttctgttagacctgcagctcaaacttcgacaatttgttctgttcattcgcgtcgacgatgcggaagaggtcgtccccccccccgtcattctctgccccccttcataaatattaaaattttttattatattttatttttttgaaaaattccgacttccgacatttttggggtcggacttccgacatttttggggtcggaattccgacttccgaaaaatttttgggctcggaattccgacttccgaaaaatttttgagcctcgaaattccaactcccgaaa

SEQ ID NO: 15049 - DNA, 2156 bp, Heterodera glycines
  misc_feature (18)..(19): n is a, c, g, or t
  misc_feature (30)..(30): n is a, c, g, or t
  misc_feature (36)..(38): n is a, c, g, or t
  misc_feature (41)..(41): n is a, c, g, or t
  misc_feature (49)..(49): n is a, c, g, or t
  misc_feature (56)..(56): n is a, c, g, or t
  misc_feature (58)..(58): n is a, c, g, or t
  misc_feature (61)..(61): n is a, c, g, or t
  misc_feature (73)..(74): n is a, c, g, or t
  misc_feature (101)..(101): n is a, c, g, or t
  misc_feature (116)..(116): n is a, c, g, or t
  misc_feature (122)..(124): n is a, c, g, or t
  misc_feature (135)..(135): n is a, c, g, or t
  misc_feature (142)..(144): n is a, c, g, or t
  misc_feature (147)..(147): n is a, c, g, or t
  misc_feature (159)..(160): n is a, c, g, or t
  misc_feature (166)..(167): n is a, c, g, or t
  misc_feature (170)..(170): n is a, c, g, or t
  misc_feature (178)..(179): n is a, c, g, or t
  misc_feature (184)..(186): n is a, c, g, or t
  misc_feature (189)..(189): n is a, c, g, or t
  misc_feature (197)..(197): n is a, c, g, or t
  misc_feature (204)..(206): n is a, c, g, or t
  misc_feature (209)..(209): n is a, c, g, or t
  misc_feature (221)..(222): n is a, c, g, or t
  misc_feature (227)..(229): n is a, c, g, or t
  misc_feature (232)..(232): n is a, c, g, or t
  misc_feature (240)..(240): n is a, c, g, or t
  misc_feature (246)..(248): n is a, c, g, or t
  misc_feature (251)..(251): n is a, c, g, or t
  misc_feature (259)..(259): n is a, c, g, or t
  misc_feature (266)..(268): n is a, c, g, or t
  misc_feature (271)..(271): n is a, c, g, or t
  misc_feature (279)..(280): n is a, c, g, or t
  misc_feature (285)..(287): n is a, c, g, or t
  misc_feature (290)..(290): n is a, c, g, or t
  misc_feature (294)..(294): n is a, c, g, or t
  misc_feature (303)..(304): n is a, c, g, or t
  misc_feature (309)..(309): n is a, c, g, or t
  misc_feature (314)..(314): n is a, c, g, or t
  misc_feature (317)..(317): n is a, c, g, or t
  misc_feature (319)..(319): n is a, c, g, or t
  misc_feature (323)..(323): n is a, c, g, or t
  misc_feature (343)..(343): n is a, c, g, or t
  misc_feature (2074)..(2074): n is a, c, g, or t
ataaaaaaaattccatannactcataaaanaccatnnnacncataaaanttctttncnacncataaaaaaaannccatcaaacacataaaaattctttaanacacataaaaaaaantccatnnnactcataaaanttctttnnnacncataaaaaaaannccatannacncataaaannccatnnnacncataaaanttctttnnnacncataaaaaaaannccatnnnacncataaaantccatnnnacncataaaanttctttnnnacncataaaannccatnnnacncacncataaaacnnaacanaaccnccnantttnaattataacttttttcattntaaccaaatccaactttcttggtatcattcgaaagccctaagtgtctctattattctgaaaaattgcgaaaaaatttcatattttgaacaaacttatggccaaaagtacatcagaaatcagattttcgaactttttagcttaaccctatgtacgagttgcttgtgtacgaaaagttacagcctaacaaaaacttggtactgaagagactgagtctttatttatcaagaaataataatacatttcatttgtcagaaaatatgttcttgttttttcatgggtttcaattaaattatttctttgcagtgctttttccgtacattcggaagcgtttcgaggtggagtcttagattttatctgctagagtttagacaacaaacgtcaaaccatcacttttttaaaatgtttttgatattttgacaacggtcggcgtccgactctttgtagaaactcccgttttcctctctctccacttcccttgctctttaaatccccgtctttttctcattcactttctcgtcgccttccggtctctcctcttcctccgttctttcccatttctttcgtcgtaccctcccttctctcaacgaccttcctcctctcatccagcagcgttctccctctcccgcaaccgtttgcttttcctcacttccgctctcttccccctcactctttttcctaccgtatttttctgtcgttcttttccgatattctctgggccaaaacatttccaattcctcgccctcttctttgcacaataagctcagattgcgcgtccatctccgtctttgggtgatcagcaacatttgcggcccatccacggctgggattgtctgaagctgttctttgcctttgccattgtcatcgtttggcttggcattttttttgttgagctgtgcaaatgtcggccaatcattcaccggttgctctgtttctgttccctctttggcctttctatgggcaatttatgctccccccccccactagtccttctcaatttgcaccttttcccaaattcggcccccgaattttttctttcttttatttgattgtcggcatccgacttattttagcttatttgttagtcgtatttcgacgcattgatgggcagcggtcgaaataatgtgattatgtcatgtaataaaagatggcgtttcagttaaacaggaagcaatttactaaaaaacaggcctcagacagccaagggtttgtcttcaaaatatgattccgatgaaacacggaaaaagtcatcacaggcccaaattttctttttcaaaagaaggatataacaatttaaacaagaaaaatcattgatggggtgtgaattggtcagtgttttcgttggctgctgcgttttctctcgttcctctcttctttctctacttctctctctcaaatcccctcactctccatcgaaacgacaaggaaggcaaagacaaataacaaccgactgcctcgcccccaggccctcccactagcaataaatcacaatgtcttcaaagcgtaaaaaagacaaaaaattgctttggaatgctcactattttctgcgctggcaataaattacatggtgaccactgaattttgatcattactactgtaaaatgcactattcttcagtatttttgtgacaatgaccgaaaagtcaccacaaaagcaaaagacttttggctatttttctaataattcatggggtagtcccaggatttggcttggaggaagtgccgccgcccagngcgaccagctttttttttttttttacttttcacatcactttttttttgcggcgttttttttctgaaaaattttcgaggaatg

SEQ ID NO: 15050 - DNA, 2252 bp, Heterodera glycines
tcggtctacgtcagtggggcccccacgtttgggccccagcatatttttccactataactttcgataacttttttctttgtcatcgaaatctaataaacttggtatcattcgaaagcttaatatatagaagctttttctaagctattgcttcgcgattagacaattaccaaaaaagttatacaagaaaattgcaaaaaagtcaaaatttttgaattttttcttaataaatttttttcacgcttgaaaatcttttcgctttttgtaaggctagtagagcatgtgaagggctttcgaataatacccagattattggatttggatgccaaagaaaaaagctatagtggaaaaacatgctggggcccaaacgtgagggcccaactgacgggttccgacctcatttgattaattcaaacatgaaaataattaatttattgtttttcataaaatttaacaaaaataagtaaaagaaaaaaacatcatttcaataatacccaaaaaaaaaataataataataatgataataataataatttggagagaacgaaagaaggttatttgtaaaaaacacataacactgaacagtcataattgctcacagaccttaaatttaaaaataaaatttgaatatttgccaatttacttttgtccatttgtccgtttttgtccatttgtccttcctctttttcactgctgtcaaaatgcccattttggtcaaaaggctgcaaaaacaactcatattccaaggtaaattatttgaaatacaatatttattttgtgtttaatgtaccatttcacttttgtccatttgtccttcctctttttcgctggtgtcaaaatgtccattttgcttctcaaaatgccaatgttcagcatttccgatttcctccttttttttttaccgtattcacttgcattgtaccccccttttgctgtgatttgtctttctgttcacaatcctccgtatatttgatcactccaaacagtgcaaatgcacatggaattgcaattgcgacggcgaaaagtgtccaaaacagagaattgctgggggagggaatctcagggagggggcggtacggtatgaggggtacgttaccccccccccccccccctccccgccaaaaaatgggtaaaatttatttaggaaaatgaaataaaaagttcaattggccaaaagagctgtgcccatctccaaaggaatgccttcgccttttttacctcgtctcttcttctttccctgtgtcagtcttttgctgattggcattgatttttacgatggcattttccgtttcttttctttttccatttggctcaaattgtcgttcatcaacggaatatccgcgcaatcgcaacagttgcacgatggaaccattgccgagcaaatgaccttttgtggtaaggaaggaccgattaatgagtgagagtaataaagctatttgagagaggagagagagagaaaggaaagggagagagtgtaaagagggtgaggcgagagaggaagagtgggagggagggagagagagaggagagtgggggggggtgagagagagagagagagagaaacgatcggtcctgccaatttacttattccaaaagcgaagaaagtgcgcttctgtgaattctgttcaatcaactgaacgattctcgcaatccatcgttcgtttctgcggctaaatatgtccgaaatgagtcgtttgttcagctgtaagtgacggaaatacggactgaataagtcgtccgcccctttggtcgctcacttcgcttaatttctccgtttttgccttcgctcccggggaaaggaatgctcggccgattaagtcgtcctccgcttcgaactttccgcaattgtacagtccgatgctcgtcctcgttgaacttttcttcagcaattcgtcgtccgctttctccgtcatttgcaattcgtcgatgagatggcttatgccaaattccaactgaatgttcgtcctgaatggcctttttgggtggtgtcgccacctgctgacggccaagtgagggcaaataatcgcaaagttcgggcacgtgctccacaaatgccaattgcttcgcgcccttttccgcttcttcccttagtttcgagtccatttcaatttcacttccattcgctactgaagacaattcgcgattggacagcacatgaagcatggaaggcagaagccattcggccggcatttccgcccattccatgccgaaaagggaaggtcgttgtttgttgtgacggaaaactgcaaaataaa

SEQ ID NO: 15051 - DNA, 1506 bp, Heterodera glycines
  misc_feature (1456)..(1456): n is a, c, g, or t
tttctaatgatcattttatttaatttatttattttttgctattcaaattgcccttttttcttacgcttttgccgaatgattcgcggaatgagtcgcggattcggtacagaatgcgtgccctccccggccgcgtttgtttgtgactcaacggcatttttcgccgttcgcgtcgctccatcgtcggcggcaggccaaaccgtttcaaatcatgtgacgacgacattgaggaggagcagcaggagatggaattgcgcgagtgggaaggcgtcaccccgcgactgatcagcgaccgaaacagcggcggcgctggcacggcgacggacggagttccattgccaagctgatcaaaggaagccgagggacggatcgcagcaacagcagcatcagaagcacaagttggagaaggacaaccagaggaatggccgatgggcagcgaaatggccgagttgcccagcgacgcctgaaccaccagcgaagggttttgttcctctgccgaatgtgccgtacatccatccccgctgctctctggaatttcctccccattttggttctgatacgtgctgaagatcgtggtcgcttccgccgctgtttctgctgctgcatctctcccacagttgctcggctcctccattttggtcgaggacagctccaaaatgtccatcagtgggacgtggttgagcaagttcagctgctggttgttgcagtgcgatttacatcgccatttggccgaattgcaaatgcgcaaggagggcacagtccgggcaatggaccgtttgaacagctggcggcgttcggcactcgtataagtgacagccggcggcaaattgtcattgttcggcaagcacaacggatgcttaaattgggataagtctcaattctagattctgacggagagcatgcgaccgcttttgcatgccttaaatgtatgtgccgaagtgcacggattgttggcggcaaaacggatgagtcggctggaaatgatcacatagcaaaagacgagcacagtaagtgggccgtagaacacgaggaactgcgaatttattgtacatatagaccaattaaaaaataatgggataaacaaatgaatttaaaaatcattgaagccaaagcgatggaaagggagcaaaatatgaaatttttaattttttaaaaatgcctttttttccaagaatggtgttgaaaattattcaaaacttttataatttctctcactaaaaacaaacttaattagattatactttttctggttttcgaattctgttcaaatttcatttcttttaccctttttaaatttatttttaaaattaaaaactctaccaaatggctgagttcgtaaatgttttggattaacggcttcaaaatgagtgttgttgaccaactgttgctgttctgctgacttccttccgccatttctgttgcatttttggacatatttttctgttccgacaaatatcgnctcgtagcggtcaatgctcccaatctgaaaaatttatttattataaaata

SEQ ID NO: 15052 - DNA, 2080 bp, Heterodera glycines
tctagagtcaataggatttaaaaaagttcaattaaatccataatcattcattttctcgaatattcgtgtcaattaattgtgcgctttgtcttacgtccgtgcattggacccatccgtgggacgttgtgtctttgaacggattgtacgttgtccacacgaacagctgaggcagtgagaagagcagagagaatgtccaggccaaagtcagcattagccggaccaaattgagctaaagcgacaagacactaattagcaaatacgacatttttgaacgataatttaaagtttgaagaaattgttaattatatttatgccagaaaagggcatatttgtctgtctaatttgtgaatataaataatccataataaggaatcagagatggccaaaatccaatgtatattggaataaaaaaacaattaattatttttttgttctcactttttgctgtcccaagtccatccgctgcgcggtcagcacagtgaagaggcggtcgagcgcgatgcaaatcacaatgttggaggagaggtacagcgtgaacatggacaacaaattgaacaggcggcacagcgcgtcgccgccccgccaatcgtaagtgatcagccagccgagcttgccgctggcgtggatgagcaggatcaggatgtcggacacgttcaggttcagcttcagcagcagaaaaccgctctaaagaaccgcagacttttttttgtagccaaccaattaattagcaataattaggcccatttcagaatttaaaaatccgtaataaaattgtttctgcactaagtccggtcaaaactcttttttctgtttgggcttcgcttttcccggcttttagtcttgaaattaggcccatgatttttgcaaaatgttcatttgtctgctcctttttcccaccatcactttgttgctcctccgggctcgccttcgctcaaccatcagtcgtttaagcacggaaatgttcagtgccaagccggcacagatcaccaggcccagataagcgatctccacgtagtcgctgaacaaatgctgcggtggcatcacttctgtgccgttgtcggcgtcggcaagcgaatcggtggtgccattttgagcaatgccttcattattcgacacatcatttaatggcatattttatagctaaaataatgcaaaaggaatggacaaaaatttgtcacaaaataaaagaacggaaaaagggaggaaaaaataaaaatattattaaacaagtcattaacaaggatgaaaatgtaaaaacaaaaaataaaatataaattcaaaaagaaaaaaccagttagaattaattatgtttgatgggaatttatttttgcaaattgttcccacgtgctccaaagtcgcttaacagtcaaaaatgtgaaacttaaaccaaataaaatcagcgaaaataattttgttaaaatctcaaaattatttaaaggataaagacaattaattgtgaatattttcacaaaataaagtgagccaatttgtctgctgtagttgttgataatgatgaagcaaaaagcgaaggcgaaggcgaagtttggcaatgaaaaggaaaagcgggcaaaaacacaaatgcgtgaccgccgtgccaatgattggggacaaacagtttaagcttaccttcccccccccccctcccgccccccgcgcggcctctcacgcggatttgggttttacgctttaagttgctacggcgaccccgcggctgcggtggctgctcttctgtcttctgtagctcctcacaaaactcaattccatcgtttccttcattattagccacttaagttttagcgggctgtccccccccccccccgggcgggggtgcttttgttgcattttttatggtggcaaattgcaccacagtttttgatgaaatatttgctatctttttttaataaatatttgccgtataacaattgcatggctctcactcttttgtcagctgattattacttggacaaaaatacttgaaaaacaaaaactctcacataaaaatgagtgaggagaaataaaatccaatcagagagacagacctattgacatatatttgagaacaaaataaaagaaattaaaa

SEQ ID NO: 15053 - DNA, 2093 bp, Heterodera glycines
aattccaatgcctactttctcttattatttgacaaaattgcttaattgtgattgaagaaaatgaatggctgttgaatgaccttcccatacccttcaatactaatcgcacattcacatcgtttgattttttgggttattcccaaaactcatcaatttatttgcctattttcctttttctttatatcggcacaatctgtccccctcgggacggcatttggcattactgatattgatctcggattgactttgacttcattttattcaaatatttggttcttttattcctttgatcatcaatatatttagctaattactctacgacataattattctgagctgtcgtcagaataagtggttttcgttcttctggtgtctttttttcattttacttgtaaattaaaaattaaacttctaacaaatactaggtccattcacgttctatttaaaaacatatcaaattgtaataatcattgtgaatatctgctcgttaaagtaaaaattagataatcgaattaaattctaaatttcaatatatgctctattttcttactcattttctacaactattatcggacctttctctgcacctcaaatcatgtagtctttcttttattttttctttaagagccgaaatttgcagtaataattccacaaaaaaaatttaaaaaaatttttgtttacagttttaaaatacaaatataaagccggattattttaagcttccgaccagaaacgtatcggattctttaatgtttttccagttctattaatcatatttctccaataattaagaaaaacttttaattaaaaggtattgttatacattattttgtctttaaattctttaatattaatggattaaccaaaattatctatttgctcttgtttaaaattatcattatttaatagaaaataatttatttaataaacctttaaataaaatattttgaattaacgaactaaaaattcttttattgtataattttaagcttatatcttcattatttaaatattattttataagtgctagtggggagcaaaagataagaaaattttttcttaatataagtttactaaattgaagtttgattttttcttttaatttaatcttgaacttaaaagtcaggttttcacaaaataaaatttctcttcgaagaatatgttttattttgtatttcactttttaccgaaagattggcgattacaggtttcgacgatcggtttatgtgccaaatattatttgaaattatactatttgttagttattcaaaacaatttaagatgatcaatttttttaagttttaattagttattaaattaacaccgattattattgattttgtgcgtttttatttattttttcaattaaaatattacgcaaaaaaccttttacaaatctaagcacttttcgcgggtttaaatcttggtccagacatgtaatttccatttttataccaattcttttattcctttaaaatatgtataacccgaagatatataaattatgcttatattagtctcttttttataattttgatgttaataagaagaaattttgcaattttgatctaattacttttgtattaggtataatattttatcatttctttgactcgttgactttaagtttcgcggaaacaagctccttttatagtccaaattgtcagatagttttttgatatttctttccatttaattattttaattaaaacattattgcttattttcattcatagattttttatcatatttaatatattcgtattaaaaatttagagtgaatttataagttatgacggtaatatatgagtagtataagggccaaactcttgttccaaattttctggccctccaccacccccccccaaaaaaaatgcagaattttgagcgtatttagccaattgcccgagaattctcaagagaaatgtaaaaaattttcatttttccccgtggaattacagcgcaaccgtacccccccccccctgaaaaattccggcccaaatttggccccaaatcaatttttcagatgtgtcaggctgcgataccttgatattaatttatttgaatgacttaccggacacttctggctatga

SEQ ID NO: 15054 - DNA, 958 bp, Heterodera glycines
cggacttcaccatgcagaaggagtcgacgcttcacttatctctgactttgattggaggagcacgcacgcgacgtcagcaatcacaagaggtggcttaatggggtttttctctttttgctcgccggaaggcgggcgttttgctcgccggaaggcgggcgttttgctcgccggaaggcgggcgtttgctcgccgtaaggcgggcgttttgctcgccggaaggcgggcgttttgctcgcgggaaagcgggcgctttgctcgccggaaggcgggcgttttgctcgcgggaaggcgggcgctttgctcgccggaaggcgggcgctttgctcgccggaaaaatcgtcatcgtttataccaacagcccctcaaaatttgaaaacgatttgacatgtgagaaatttccaccacttgccaaaatatccgagtccgactcacagactctgtttaaaacagccaaattgacaacagagtggtcgcagaaggaaacagtagaattatcgggcagctcggctgatttaacacaatggctcgaatacaccatgaaacctgattccactacatattaatacactatttaaacaattctttaattttcgtttaaatccaagccagaagcgacggttgtcacaatacgcggactattacagggccatagcacgcgctcgcagtgagaactcagctcggcaaaaacttcaacaagggagcggaattgcccttggtgctattcttgtgcctgttctcagcgttttagctcaacacttgcttgaaaaaataacagcataatgaagcacacaaagaaaatggtcatggttccggaaaccgaatacattgcgcttatgaacatagtgaagagtacgggtagccgaggcgatcctatacaagatgaaaaaacatcattagactcaaatataacataaaaatttgaatgataaaacaatccgaagctgatatttaaaagaaa

SEQ ID NO: 15055 - DNA, 954 bp, Heterodera glycines
attattattaatatttgatgtataaaatattgaaataaaataaaaaaagccatatttataataatatattatagatttttatgaaatttccattatatgggtgatagcaaattttatttacgttatttgtgggcgtatacatacgtatgctaatataatttgaaaaatgttgacactcgtaatgacactatgtagatttcaaggtcgaccaaacttgcacttttagtcagtcgattcaccacggatatttaattttctaataacataataaaatctattttcgttacataattttggatttaatgattatttattccaaaatgatgaggataaacattcccgagtagaatgttatatttgtttatcaatttaaccttattaatggattgcaaaatatgttatggcatattcattttacattgtttcaaagaattgttttgaataaaattcaatcaaactaccatttcaaaaaatgaataatgaatgaactctttgattattagtacctaagaagtaataatgttgaaaatctttgactttcttttttttaatgtctatttaataattatttgtcttatttgttatttaaaaatttaaataattaaaattttttatatttattgacctatcttaaaccgtatttcttattttgttgcagcttaatacgacttatctgaatatcgttctttaatttttaaaatttcattatttcaatatgtgtgttttcaatagtttcttaatcctttttagtatgattttgacttaaataataatttatttttgtaatgatggatccatatttaaatagtatattttatatttaatgatgaatgaacaattttttgttaaatataaatttatttgcattatattatttgatcagtttgaaaaaaatttcatttatataaatccgattcgctcctgtaaattatgattatgttgaaaatgtatgat

SEQ ID NO: 15056 - DNA, 1686 bp, Heterodera glycines
aaattcgattgctgtgctataagtaataaaatttatatcattggactagtttaatgcctttttataattacaaagttactgaattattttaaaatacggtaattgtccattctgaactcgttttgcatattcacaaatttaccaagttaaaatttaatttccattacggtacttatccattctgaactcgtttttcccaattcataaattttttaatttttgggaaagtattacaacccaatacgaattcactgatcggacagtacagaaaattggcagagagtgcgtgtgtgaaaagtgattgttagattgttaccaaaaaaggataagattgacaagtgaattgtggtccgagtgatcacgatcaagagaaaacagtaaaaaaattgtgcagaaaagtgagtgtgcccgctgaattgtgagtaatcacggcatcatttggcaaacaaattggtgttagacagagagtgtaccgtcccgactgatcagagagtgatcagcgtttatcatacaaaagaggccgagagggcgatacaattacgatacaattactgtgtaaaatcagtcagttccgaccttaagtacaccgcgggtgaaatcagtgaccaagtgatcggagaggcatttttgccgatcaaagtgtgattcattgatcagtaaggtacaaaaaaggggtttttacgcaacaattgttccgattcatataactttggcttaacattttaataactaaatcaaaataagtcacactcctgattaccttgaaaggcgtttcaagcaaaagccaataagtgatctcgagcgggtaagacggaagcttgagagagaccgaaagaaaaaaagtgaagaaaaattaggagaaaaccgaaatatggctgatgatgatttagaagataaatatgtggcattaaaggcaaaggtccaagacttagaagatcgtttggccaatcgggtcccgaattatcttcccccgggagttaaattccgaaatatgatgcgagcggtgattttttcaagtttttaaaagaatttaatgtgcttgcgacagcgagcaactggcatccgccggattgtgtccgctttttacctctgtttttggaaggggaagctaaggaaatttaccagaatatttcggcagataagaaaacaaattggaggacccttactagtgaaatagcggaactgaccaagaaacttgatggaccaatgtgggcgagaaaaatgctgaataagacgaaaatgggaataaatggatcagtaactgagtttgcgaataaaattcgtgagttagttgagcaggcaagcccggacccgaactatacagatgaggcaagagaaagtgagagcgtgcactattttttgaatggattaccaaccaaactaaaacggaaattatttgttatggaaaagcccgatagtttaattgaggcaattgcgcaagcaaaaaaggttatccaagtgaatgaggaaattgagaaagatgaaaaaggggatgaaatgaaacaacaaatagctgagctaacggaacaagtcaatgcgatttcgttccagagtaaagtgaataatgagagaaatggtcatgaaaatggtcgcgaattcgtgaatccgacgtggagaagggatgacagaaacacagaaagaggaaatttcagggggaatagagggaatattggagaagcacccaaa

SEQ ID NO: 15057 - DNA, 2762 bp, Heterodera glycines
ccaaatttatttccattgggacaaaatcggacttggaatggaaattttgaaataatacggggagatttgagaatttccgaccaaagaggggaaattttgggaatttccgagggaattcaagaggaagaggaagtgaaaggcaaaaatacaaaataaatgcgatttcggatgaggcagctcagccttcggcatccaactcccgaaggtccctgaccccgacaatgacatttttgacaatttcaatgattctgtgctcatttttcgggactatttctggtcaataccaattatgttctgatcgggttcccaccacacccatttggttaccaaacgtaacggaatgttcagtaccggagtgccaaaaagctgaagagagaaaagttacactttttttacctgtccgaatgccaaaacaattctcagtttataactgctatcagaaaatgatgaaaatttgtacgggaaattttctttttttctggaaagacataaaaattctggattcgtacgtgaagggagtaagtcaccgagcttgtcagggatttaaaaataacatgggacatacaatgaagagattgacagagaatttatggacaactgagaggccttcaaaagttgaatatgcatggattggtgaaagatgtgagacaacagtgaatgatttcattgaaaaaggacaaggcggaattctggatttttatttggtaacatcgtttggatataactttaatccgtacaacggatgggaagaaggacaaaaatggacatttatttgggaaattccggaaccaagtgaggcttattgggcaactcatttccctgtcggtgattttgtggcagaagtaacggagaacgcaattgtgttagaaagcgaacaaagcgtgttttattttgaaaaagaaaagggcgatgaaagagagggtattgttggcgtaccagacgaggcgtataaaatgtcaaatgacgttttcattctaatacacactccgagtccacaaaaagcaagagaaaaaagggaaacaaagcagaaaagtgaacctcagagaaaagagcgaccagcgaaacaggaagtgtttctgaaaatcaggccggatcaaaattcaaaatttgagaatttggacccagcgtccagacccaaaagcaattggacacggacaactttgggaccaaaaaggaacacaacggagctaataattttgagtaccccggttccccagtccacaagcacagtggggagtacgacaaaagtaaccatggcaattccgaccaaaattattacaacacggttccaacgactataaggcctaagacagaagtcaaaaaaccaattttcgagaaaattcaaataaaaaatgagcaaaaattcagtcagtatacaaggcagttgggaaaaaggtgaaacaattggtagctacgacaactaaagctccttttacaacgactaaaaaatcgaaaattgaaaacacactgaaaaaggcaacaccaaaaccaaaaattgtgggtttgaagagcacaacactgaaggttcttagcacagttagaccaagcactaagaaagtggtcagtgagctttttccaaagtcagctacaactccgagtacattttggtagtaaaaagcacaaataattccaaaaaattttctaagcatgcgctggttaaaaaaccggaggttgaattggaaaaggccacaacagcaagtctatttccaaagacaattaaacacaaacaatgaatgtgacagagattccagcacgtatgactccaattcctccaaccactcaaaaaattgtggaaaagttggaattgccgaaagagaaaggggaaaagaaatcagacagcattaaagctgaaaagaaaatgaaaagttattaattccatccacggcaattacggttgtgaagaaaattgaggacgaaaaagtaagagatgtgtcggaaaagacagtaaagaataaaaagagtgaggaagaatacagtcaggaagttgaagctaaggtcattgagagcttagctaatgatggcaatgaaatggaagaattcgaaaattcattcgaggatgaaagcgatgaggaagttagtgtggaattattcgatgagaatgaaatcttcgacatggaacgaagaaaaagaacgacagttacaacacctgacgcccggtggattaaaaaagttgagaaaagcaaagtgtgaaataaagcaggacaggaaaataagaatttgaatacgcgagtcaattatgcattgtatcgactaaatgaggagaaaagaaggcaatacgatcatatttataaacaagcgtgcgaaaatactaaatttcagctacaattggccaaagcggttttacaaattaatccaaatgagggagtcaaaaaatatttaatcgagacgatttagtggcacgatggaaaggagataatttggaagttggtttttgtgcgccggttataccagaaaaaatattctgggatagaaaaatggggagcgattgttacgaatggataccaattttcgcagaaaatacaacattttttattcggccgggtaccagagaattgagcattataggcaaaagaatggagtgtacagaaatggaaaaaaccaataatatgaacaatgcgacacaaaaggaaattgttcaaaaattaactgaaaatttgggaaacattaaaccgaaatacagaaacatacaaaatcctttggtcctgagagcgggagcctttttgaatcggacagcttacgtttagaagaagcgatgcgggaat

SEQ ID NO: 15058 - DNA, 1433 bp, Heterodera glycines
tttcattgcggagagtgaaaatattatctattatttattttttcaaaaggaggctttttgaacttaaattaggcaattaaaaattttcacttgacatccatgatttgagcattaaaacaaatatttttttttctaatgagcaaattaatttttgctttttttatattattttgcctaatttttgaataggttccgaaaacctggcattcattcctttttggtggttttgccaattttactgtttttcatttaaatgtcttattatgtattggccctttacaatgggcacttttaaattttatcccaatgtttcttcgtcgtttcgatgttttataattttgcattttttgccaaaaaaattcttaatgaatttttccactattttctttttcttttttctgctaaacttcaattcggttcaaccatgtggttggctgaaaaatgggcccccacggtgattcaaaggccaatttggacagactcggcaagttacaatggcctggtcagtaaatgaataattttgaattttatttaatctaaattatggtgacatgacaattcgtaccaaagcgtacttgcgccaatggtgtttcattaattttttaaaatttttatgcattattttgtatgagttgatgttgaccccatcttcgtggcatggcgcatgtgaaattgttatttggggacctctatatttaataattcattttaactcaaattgacaaagttttaaattaacttaattaatctcaatcattgaaaagcaagaatgattacattacaactgtcttagattaagatttgcttgtttttccttttgtacgggtgttaggaggttgctctgccaatggtcccatttcataccattagaacgcaacgatgaccgagcagcactttggcattaattgcgttgacctcgaattgccgatggacatttcacaattcaccgttaacgtctcagcaacactttttgatttatcgtgtgaagaattcctaaaaaaaccggaccttgacgaactgccggactattatcttcaagtctcaaagcggtggcaacttgatgcctgtgaaatggttccaacagtcatgagatgcaaaaagtagagtgattctctggttagccgacatttgtcgaccgaattttgcggatgattagtgaacaaaaaatgatgaattaataaataatttataattgaaatagaattttttaaaaattgtcatgaaaaaataaaacgttagcagcagggcactactgtattgctctgtgatggcagatttgctcgtttttataaaattatccaaaattgaaatcaaaatcagctttaaatttagcaaaattataaatgaaaaaactaaataaaaaggaaattaaaaaatatttttaacctaaaaaatatatttttaaaaatttaaaaattaatttattttttaag

SEQ ID NO: 15059 - DNA, 1690 bp, Heterodera glycines
  misc_feature (10)..(11): n is a, c, g, or t
ccttcaattnnaggaattttggtaaatttataggcggtgcttagctcgtgacttttgccggctgtccccaaaacatcaattgtaacccgggccgaaacccaaaattacgccttttttgccaccatcccctgactggaaacaaattttcgtgcaagtgttttgacgaagtggaggactgtgcgccaatttccaatgcaaatttggaatgtgaagtgttaattgtaaaagaaaaaaaaataattttcataaatattatctgaaaggagttaaaatattaaaaataaataaataaattttaaatgagcgcaaaaaagtttttaattttcagctcaacggccattaccgtgaaatgaagggagagaacgagaacagcaattttgcctttgaatgcttggcaagtttttttaatcaactagggtgtgaatttattgacttatttttggttaaaacagcatttttgtcaaaaattatatcgaaaaaagaattgccaaaaaattttaaattaaataattttgaagaaattttttcaattacctaattgtttttgccataatttttaaatgtttgaaaacttccataattcagcaataaatcacataattaatcacttacttaattaatattaatcactcttactttccccccccccccaattaacagaaacgccaaggagactcatcgccattttgggcatattggaacgacaaaaacagcaatttgccaattcacattgacgatttgcaatgtttgcgttatgaggatgtgggcattgatggaccgccaaaagaaacgatggtcaattatttgctgatgaaacgcattcattacaaccgccattcgggtccatgaaaggcgaacgaaaaaacattgggcagagtgagtgccaaatttacattgaaaagataaatgccaaaatactgtttgtatggaaaaatttgtactacaaattaccaattaaaagtggcaataaaatgttaagaatacataaaacgggattttgattttaaaattaattttgcataaaattgcttcatatttattgcaaaaaaaaaaatcaatttttaaatcccacaaattcaaataactcatgctgaaaagtgagttttacgaaaattgcatttccaataaataaacttgagtagagcggtaccataattgccggtgttttttttggtaccgatatcgggacccacgcgcggtcatgaatcctgccgctacggtgctggcccttggaaagctcacgctacgggggcgcatcagagtgtatgtgcggtgtccctgcaaataatgctggacgtccttttttcgtaaatgcttgatactttttcgcgcctctttccacagcgcggtaacgcccgcgaacgccgcgggcgatgatgaactgttatacagcttgtcaagcgttgcgttgatcagctccattttttcgggcgaaattcctttttgatttttggtgccgtccgagtggttttgctctgtgacggtctctttggtggagccgtccatgaatacagaattgggtcctgctgaagcctttcttccaatatggccgctcctggtggtctaatggtggggcggcacgctcttctgtctattatatatcggatggccattcgcaaattgctatgcgccaacggcttgccgtttgcggtgttaattgtacatggtcagctgatttgatggaatggca

SEQ ID NO: 15060 - DNA, 2327 bp, Heterodera glycines
  misc_feature (16)..(16): n is a, c, g, or t
cgtggtgtgacatttnggggatttgcaacttggggacccgacatttggggaccgaacgacatttggggatccgaaatttagggaacccgacatttggggatcccgacatttggggacccgacttttaaggacccgacatttggggaccgaacgacatttggggatcccgacatttggggacccgacttttaaggacccgacatttggggaccgaacgacatttggggatccgacacttagggaacccgacatttggggacccgacttttaaggacccgacatttggggaccgaacgacatttggggatcccgacatttggggacccgacttttaaggacccgacatttggggaccgaacgacatttggggatccgacacttagggaacccgacatttggggacccgacttttaaggacccgacatttggggaccgaacgacatttggggatccgacacttagggaacccgacatttggggacccgacttttaaggacccgacatttggggaccgaacgacattttgggattcgacacttagggaacccgacatctggggacccgacatttggggatttaactaaaacaaaaaaaaatatttaaaatttaattttatgcccaaaattagacaaaaatacgtctgctttagccagaattaattccattgcaagaaaaaattaaataatatttttaaaattaactctgtttccggactcaccgcgaggaggtagcaggattttgagcccatgctaaccacaacacaatagacaaatcacaatatgttttatgttcagtacacctctctatttttttttaaacgcctttcccaagggccacggaacagaaattcgtcaagggcattccaaaagttccagacgactttgctgtctaattgcgtacagcaacaaaatgccggaggtcatcttttctgttttttatctttcgggtgacactgtcgggtgcttttaattaagttttttgtgactcccttgtaatttaaatctgaggccgaatatttagatacatccaccactatttcacttaaaaaaatttcaaaaaatttgatcgtccataaataatttgtaattgatcaggggctcaccaaattttgcagggatacgtatcggaacactacaaatgcttactaatttttctagattttttaaacccggtgaaaattttttgcagacacccaccactttttcacttaaaaaaatttcaaaaaatttgatcgtccataaataatttgtaattgatcaggggctcaccaaattttgcagggatacgtatcggaacactacaaatgcttactaatttttctagattttttaaacccggtgaaaattttttgcagacacccaccactttttcacttaaaaaaattcaaaaaatttgatgaattaattttgctaaaaaataaaatagtgaagctttaaaaattaataaaaaattttaaattcagaattactggagttagcatcatagctgtgcttttccttgtctttttgatgccttcgcaaaatctggtgcgcttctgatcagttttttaaaaaaaagttaagcctaaaatttttcgcatatttaaaaacaattaaaaatttttagattttttattcatctccctttttgatagagaaagcatcagagagccttatttaacatgtaaataaaatttggtgcgtttaagagcactttctgaaaaaaataattatgaattaattttgcaaaaaattggaaaagtacgcaaaattgcaatgtctaaaatttttaaagaaacattatgggacagttaaataattatatgaataagcattattctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgaaaaatgagtgattgaattttcactaaaaagttaagcctaaattttttggcctgttttttcttgcaaccaaggtactgactcggccgcttcgcggcctcgtgggggggcctccggcccccccc

SEQ ID NO: 15061 - DNA, 2019 bp, Heterodera glycines
tcccggtttccatggtttcgacctcagaattttttcttccacaattttcgttacttttgcaaatttattctgcttttcagggcatcattttttaaatgcattcactttggtatacggtaactttacactattgtattgaaatttgaatcatacataataaatggtgcacagtacacagacagcaattgactccggcacattttgacgtcgctccaacgggatggaatcaatgtcgagccctgtacaattgaacagacgttcatactccgaatggcgcaaaaagaacagttccatttctgtaaaataatacataaatgccgtaacttagaactccatcatatattttaataacagattttcttctgacgcattttgtgccaatgccaaaaattaattgtcataagccgaaaacatcaaactgaaaacaaattataaaaagagagacaacaataggaaattacttaaatccccgtccatttttttttaaaaaaaatttaatattttcgctcccatatttgggtggacttatgcaatggtttgatggttgtgctaatacgtatgttaaagatcctttttattatattttttcactaactttttgaaaagaattccctaatttcctactaaatccgaacataagatcgatgaaatttttttattcgaaaaaatgattgttttttgctaaactaagcagaaaaaatccatggaatagctaacatttatcttatgagaacccctatattccggtttgcgttaaaaatttaagtgatgcgaatcaaatgaaaaaaaaagtttcttaattagtgatgccgcatgggacggacacatgaaacgctgggccaaaacgcactttaaacgaacagaaaacaatttttggaaattgtcgaaattcgaaattgaaaattttaataaatataggtagtcatgaattaaaatcagaaaatcttaactctaaacttagccgaaaatcggacaacttaaggacaacatttgggagccccgtcaccttttagccatttaaatgttttaacaaaaaaaaatttgcgcgatttatgtctgtattagtgccaaatttgtgttcagcgttttgccaccatttttcagtcataaaattctcgaaaattttcaggtgcacgcctaaagaaacaaataacatattaagattttaaaaatttttctaaaatatgtaaaatgggtaattttgtactgcaaaatttgaatttcgcctaactattgtcgtgaaaaaatattaaattaaaatagaataacgtgaaaattcaatttcatttttgtttgacaaattaattaaaaagaatgatgaaaaaaatcacctgccaaactgattagtttattgacaaattaggaaaatgccttcgcacatgctgcttcaattaatttaattagttttgcacctccgactctcgggaggggggggggggggggggaagaaaagtcggggagaaattactaaattcattatttttaaaacaatctcattaagaattatgaaaacagatttagtaattgtcacaaataaagtttgctaaaaattaattaaaataaatattttttaagcaattttattggatataggccgaaagcttacgcactttggctcaaatatttagtttttttatgagactcctttttttattttaatttcttgggatttttaggttttttgaaaactattggcattttgtctaagcaattttaatcaatcgtttgactcaaaaacttcatctacccagtttttaatacataatggcacaacatttaatttggcgaatatttcaataaaataaaaatcggaggaaaaatgagaagacaattaacatcattaatcaaaaacaaattaaataaagaagtaaattctgagagaaatttaaaaacgattaagaaaagtgcttttattttctactaaatgagtccgagtggtgagttatgacgtgccaaacgttattttatctcaataaattgaattaattaaatatgtgagttgaagttaatttcggcatt

SEQ ID NO: 15062 - DNA, 1538 bp, Heterodera glycines
aaaaacgcatggtgaagtttggctgtacctgagaaggtatgcgctctctacattgcgaaacctgggcatgggccgaagccgactgagtgatcaagtaagtttttggattattatttttttagggtttgtcccagacccgaggcaccggggttttttttgccgtttttcttagccccaaaaaccgactgtctactcctgtcgataatatccttaacaaatgaacggcataaaatattcaagccgacctcattaaccctcattttccaacttcgggtttggcatatgactgaccctgattttttttttggcatttgtaaccctaccatgccgttctcaaatgatttcaaatgtcgttagccgaaataccgaagcgtctgggaaatgcttcatacaaaggggcggaatgcaacatgcttttttctcttttttggcatttttttcacggtctcaaataatttctaattacgttagccaaaatccggaaccccgaagaagcttcctacaaaagggcggaatgcacttaaattaaaattaaattttaatggtttttagatgctaattggtctacgtgaagtgtcggctaaacttcgttccgacatcaaacagaatggtccgtgcaacattgacttgagcaaactgatcagtgtgctcaacggttcctccattagcatgcttttgtttggccacccgcttgaagaggcaaataattagcgttttttctaaaacaaatagcccataatgttgctgattaattaattgattaattaacaatatataattattagagttggacagtaatagactccagcatattgaaaaaggcaaagaatttcaaaaaatccaggtccaggtctggatctaggtcacgacaagccttgctttttcctggatttttgtccaagaaatccaggtccagatttttttttaaatttttgtgtttaggaagacatggaagacttttggaaagtcaaagagcaaatcaccattcttttcaggatgttctcatggtaagtgaaaaaacatatttttgtacaatgggtagagaactcatgtcaaattttgaaatttttttgaaatcacaaacaaacatataccctaattaggaataagatcactaattacaaaaaactgttatttatttaaggtggacgacacaaattgttgcttcatcgccactttggtatggaaatatgactagacttgggaaattgaaatttttcaaatttctgcactgttttttcaacaaaattaatcaaaattagctatttttgggacaccatttttggcataaattttgcaattttcaggtggcttcgccatttcccacctttctcagcaacatttaaactgatcgatcaaacattgactgcagcatatgatttaattgacaaagaaattgccaaaattgtgaaacggcgccaatttgagtcgaatttatgtgccgtttcgttggtggacgactttttggatacaattcaaaacagcgatcagcgcaaaaagaatggcacaatgccattggcgcaggacaaacattttca

SEQ ID NO: 15063 - DNA, 2819 bp, Heterodera glycines
aaagtcgcatagacattaaacatgcacaaagatccgcgaataatgttttaaataagacaaaattttttaagtaaaaaatttttttaatgtacctatttagttgaaaacaaaatttatttctaaatttaaaaaatatggacacttaacaatttgtttttaagtgtatacaatttttaaatttactcatttattaaataatatttttaaaattatccctttttcaggggacaagtacactctgttggacaaccatgaccaaattcagtggcgcgtgcgcggcatggacgacgttgaggttgttcaaagaaaaattcagattttgttgtcctaataaaagttaattaaaaactttagttaaaaaatggattttttaaattactattttaatttcaatttaataaagtttttctgatttttttggttcttaataagtttaattaaaaaatggatttctagctttaattaaagatgaagacttgctggcgtttctttttaattataaatgagatagtgatcaatagtgatcagatttcgaatttgatgcttttgaggtggtgtcaactccgggaacaagcggcgccacgggtgccaccgctgtgtcacaactcattgaaggtactaacgcttgtctttgacacttcataaaattaatcgtaattgtgaccaaattgaaatttagaagacgaggaaaaatgtgcccgttgtgccacagcatcagccactgtacgaaggattgtaacaagcgttgaatccaaagaattattttattttcatttgtgcgtttgttttgatgtgttaagcataaaaatttttcattttttcgtgcctattaaagtgcctttcacgatttttggtgcctaaaaatttttgaaattcttttttttaaagggagcccactttggcgattttttgaaaaatttggttttttacaaaaatgtcttttttggcactcaaattcggtaatagtatggtttacaggtcccacaaaaaaaagaggcaaaaggggggttttatgcaattcttcaaagtcctttagggttctcgagggcgctgatcacgaatataatattcatttcgaccaatttcgaaccccgaacccgaattcgaacaatttttttgttacttttttttgacttaaaatcaacgtcaatattgaaaatttaaaaatgaagaacaaagcaatgtcaggcacccaacgcaatttgctgccgggttatatggacgaatacatgtggcgccaatttaatggaaaaaacaattgcggcctatgaaaacatttttgaacaaattgctcaattttatgttgtcaatgcttgagtttgtatgcatatttaaatgcacacggcgattcaattttgggctccaagtacaaataagtttattatttatttagtaatcagaacgccaaaactttgcaaaacttaaaatttattggggattttcccttaaaataaacttgaaatcgatagagggggtcaaagtatgggcctatgcaaattttaaagaaaatcccaactgtagaaaaaaaaattcaactagacaaagttttttctttttctctcattttgacgcactatttccatgtctctaacatataaaataacacatggttcatttttttgtcaataaacaattttttttaacttttgactaattaagaaatattcttcagaattttccctccaaaatgagcataaaatggttttatttggtctattattgaaaaagttataagctaaaaaaaaatcataaaatcaagggtaaaataaaatgtttaccttttattgtttgtatttgttcttttggcgttctgtttttattattttttaatttatttgctttaaaaaaatgaaatttatacacaaacacaaagaggatttgaacctgagacccactttttggtgactaactcacagaccactaagacgaaaaaaacaacttaattgtacttggagcccaaaattgggccgctgtgtacagaattgtgtgttatattccttatttgctaatctgaaacaaaaggaaaaaacttttcatagccctttaaaaagcaggagagccttaattaaaagaacttttatgaatgggtcaaacaattcgctttgaaattgcattgttttcccggctctagtgcactttatgagtccaatcgacttttatgagtccaatcaatgggttttatacaataactttgttcatgcacgaacaaaccctgtctttggtatcattcgaaaatacaaagtctaaataatgtaataatacgagaaaacaagaaaattctaacatttcaataaagacaaacgaaaatgatcagcaattacttaattaatcatatcttctttggtaagtgtctaaacgctgcaattttatatatttaagcttcgttagactgtgtgctttcgaatgataccaaaaaaataggtgttgttcaaatgaacaaagttattgtataaaaaccgagtattttcaattgattggactcataaagtgcactagagccgttttcccttccaaatatttctcaggtcgcacttcgaaaggccccacaaaacggcgccgtcggcttcaaacaggaagtgaacacaagcagaaatgccacattcaattgggctttaatttccccaaatcgttcgcaggtgaacaaatgggtcgtgctggtcaaattgctcatcggcgaaatccccgagcgcagtctcttccgcacggccgaacttcgccacgtgttggcgccgtatttgctgctgacccaaagttggttttatgcgcggcgaatggaaacgcacatttggacatttgagtccgggttgtctcataattgt

SEQ ID NO: 15064 - DNA, 869 bp, Heterodera glycines
ttcataattgacaaaaattttgccaaagtgatcgcgccattgccaattcaataattcactataattattccaaatgaaagtgatcacgcaattgccaattcaataattgacaaaaattttgccaaagtgatcacgcaattgccaattcaataattcactataattatgccaaatgaaagtgatcacgcaattgccaattcaataattgacaaaaattttgccaaagtgatcacgcaattgccaattcaataattcactataattatgccaaatgaaagtgatcacgcaattgccaattcaataattgacaaaaattttgccaaagtgatcacgcaattgccaattcaataattgacaaaaattttgccaaagtgatcacgcaattgccaattcaataattcactataattatgccaaatgaaagtaatcacgcaattgccaattcaataattcactataattatgccaaatgaaagtgatcacgcaattgccaattcaataattcactataattatgccaaatgaaagtgatcacgcaattgccaattcaataattcactataattatgccaaatgaaagtgatcacgcaattgccaattcaataattgacaaaaattttgccaaagtgatcgcgcaattgccaattcaataattcactataattattccaaatgaaagtgatcacgcaattgccaattcaataattgacaaaaattttgccaaagtgatcacgcaattgccaattcaataattcactataattatgccaaatgaaagtgatcacgcaattgccaattcaataattgacaaaattttgccaaagtgatgccgcaattgccaattcaataattcactataattatgccaa

SEQ ID NO: 15065 - DNA, 2802 bp, Heterodera glycines
aattcaataattgacaaaaattttgccaaagtgatcacgcaattgccaattcaataattgacaaaaattttgccaaagtgatcacgcaattgccaattcaataattcactataattatgccaaatgaaagtaatcacgcaattgccaattcaataattcactataattatgccaaatgaaagtaatcacgcaattgccaattcaataattcactataattatgccaaatgaaagtgatcacgcaattgccaattcaataattgacaaaaattttgccaaagtgatcacgcaattgccaattcaataattcactataattatgccaaatgaaagtgatcacgcaattgccaattcaataattgacaaaaattttgccaaagtgatcacgcaattgccaattcaataattcactataattatgccaaatgaaattgatcacgcaattgccaattcaataattgacaaaaattttgccaaagtgatcacgcaattgccaattcaataattcactataattatgccaaatgaaagtgatcacgcaattgccaattcaataattgacaaaaattttgccaaagtgatcacgcaattgccaattcaataattcactataattatgccaaatgaaagtgatcacgcaattgccaattcaataattcactataattatgccaaatgaaagtgatcacgcaattgccaattcaataattgacaaaaattttgccaaagtgatcacgcaattgccaattcaataattgacaaaaattttgccaaagtgatcacgcaattgccaattcaataattcactataattatgccaaatgaaagtaatcacgcaattgccaattcaataattcactataattatgccaaatgaaagtgatcacgcaattgccaattcaataatgactaaaattatgtctaaataaaagattccgctcaacatttgactataataatgcgaaatgaaagtgatcaattaattactaattcaatattttactagaattcagccccataaaaaggatctcctgcagatggtgaagcaactccccacatttattccttcatcctaattgtccatcctttctttctagtcgccaccaaattgtccccccccccaaaaaatgagtcattttggcgtttcactgctcccgattggcatagggctaatcataatgctcatactcctgataccatcatccacggatggcatgaaaattacactcagagtggaaatgggtgaacggtggatagtcaagcaaatgaaggacaatccttttttcacctttgaggtggagggcacggacagtgtggcaacattgaagaagaaaatcaaggataaaattaaagaatatactgggaggagcttttcactcgctctacaaacactgagactcaacaaatttggtcttgcgcttgaggacaccaaaacaatgcaagaatatggaattaaagacgaccaaaccatcattgtttgtacgttgggtgaatttcaaattgacgtaaagtatggcaagaaaaggcattccgttaatgtgaaagacacggacactgtggcaacattgaaggggaggatcgaaaacattaaagaatttggaaacattccgcacgaaaaacaaatattgataggagacggagttattgtgtttaagaatagtgaaacaatggacgaatgtcgcattaaaaaaggcgatactgttaccgtgtcgtgggagaaatttgaaatttcagtgaaatacgacgaaaaagaaccgatcaatgtagaggtcagaattgtcagaaaaaaaatttccaaaggccttattttagaaaaaaaaatatattgaaattaaaagttagggggatgttaaatatcaatttgagggttttttcgaaaataaaacagaaaattctgacaagcaacatatatatgtatctcaaaagcttagatttgagagttagccttatttccgcccaaaaaccacaaatgagtctaaacccgcatttgcgtatcttcggacaaatttaatattaaggtgaaatttggagagaaagagtggtccgttgaggtgaaggccactgattatttgtctcagttgaaggagaagatcaaagatttgactggaatttcaatagaacggcaaaaactgcacttaaaccgaagaatgctttttggccatactatgatgttcaatgacattgtaaaaggcgataccattttcttagaagatgtgtttgaaatttccgtaaaataccaattctccattccttatagtgtatttgatttttgcaaagttgaggtgaatgccggggacactgtgaaaattgtgaaggaaaagatcaaggcgatgatcgaagaaaactgggaacgctgtggaaaattagtggaaatggagctgagaaagaacgatagatttggtgaagttttggacaattacaacgaaacaattgagaaagctggcattaaaaaagaaggagatacaatttatgtgaagtgtgctttccctccgaaatcggcttaaatataaaaaattcgacctaaagatgttatgacgaacaattgaacaatttttttccgttgcaaaacgatcatccattatttcgttacacaaatgtcccccatttttggctatctgtctttcctccaatggttcgcttttattttctcaataattcaactcataacagttatttattattttgttgaagaatttttgtttaaaaaaattatttaccgtttattctcaaattatcaccccgggggaattatttttcaatctccttagaaaggtgggggggggggggaggggtaattatata

SEQ ID NO: 15066 - DNA, 888 bp, Heterodera glycines
cgtcgacaaatttttcctgcttaatcccctctcccaaatgggactcatcgctgtgcgtgacaaacgcgccgagcgcatcagcggatttaccagtacggcacttttccgccatttgcaaatgtttcaaatcttttcatcttttattaccgcgaattgtgtccataattaaacattcattttttaaaatattctccccgtttcctcaggttctgttcaatttctgctcgaatctctgcaggacatcagttccaccaattgtggtggtgaattctctctccaatctgtcctccaatgcgctcttcactctttccaggcttttcctttgccttttccctttttaaattcgttcgctttttagggtttgcccgcccattccagcaaagagtgcattcttttgattgccagcttaaggtgataattttgcttttgattgtgttaatttgcgtcttttttcgttccgtcgatgcgtcccctctccgccacactttcgagcagctcaaaatgcgttccgtccgctgctccatcgtttcatttggtgccgaagtgttcgcatttaaacgcctttgtgcgacaacggagggtaattttttttgaaaattttgcaatgatttgacactgccatataattgtaaggcaaatacagcgttgccctggacgaacagcatttggagcttctgcttgacgaacatgtccaaccgccgcccgtccaacgccgtccgggtcagcaggactcaatcgtccgcatgggctttccccaactccgccgcgtgaccgaaccgtccttttgtgcgtggtcagtggggggcggcgggggtatttttagcaaatttttgaagaaaccccgcgaaaagagacatgctaaaattaagaaaaaagcgataaaaactg

SEQ ID NO: 15067 - DNA, 1496 bp, Heterodera glycines
tgccaagaattgccccaataaaagtacggtagcaaaagtacagtaaccgcgtctctttcttcaatttttctggccatccgttgcttttctttctcttttgacttttcctttttcacctgccgaaagtcggccctgcagttggtggtgacgatgattttggtggccaatgcgattcgcattttgcgcgctcggctcgcggtcaaaacgagcgcaaattgggccagcgacagagtccacgcgccgagcaccgccgtctgaagcgtcggatcggcgcacactgcgcacgcgttgagcagcccgacgaactcgagaatgtccgtgacgacggccgcgtaggcgagcagaatttgggtgagctcttcgcggctgagctccgcgcgcggaagcagccaacgcgtgaggagaagcgcaaggaacagcgaatggccgagcaactgcttaccgacggtgtcctcgcgcgggttgggctgcagaccgaacgacggagcggcgggggccgcggcacagagggcggacacgttcaccggagaaggaggaagcggaaggtgggaaaacgctgccgtgggacacatcgacgcgtgcaccaaccaaagcgggggcacctaaggcgggggacgggcggtcaaaaagtggcgacttttacccgcccccttttttatggaaccgcggggccatatttcaagaaaaaatgcaaattcaaaaatcacacacagtggcgaacagatacagcagcacggcgggcgagaaccatttggggtcgtcgcccgcccggacgaccaccgcgtaaaacccttcgccgaccaaacagacggcgagcagtgcgaaggcccacactgagttgtccccttgcgtttcggctgctgcccaaatgcacagcagcgagtgggccatcagcagggcgcggacgaacagtgctcgtgcgatgttcaccagaatggcggaggcggacgcgttgccgaccgctgccgcggcggccatttcgcccagcgtggaagtgcggtgctgcggacggtcgccgccgggcgaagcgacgaacggaacgccgagaggagcggcgctcaaacttctgatgaggggctcatttgctaacaatgcggaacgtcagcgactctacgcactttctgtgtgttccgccgctccctttggacggtgccgccctttcggccgtcggtggaacgccgctgccgcccgtccgactctcgcgtcggggcgcaatttcatccgccaattggctcagcgacttgcggtgttcgcctgctgctgtctgctgtcgttgttggtggtggtccacgcggaaagagcccttccgctcgatgccgccacttccgcttcggctgccgcggcgtttgtctgccgcgccgccaccgccggcggagttcacctgctggtcgagactggtgcccgagaaatacttttccgcccaaaaatactgcaatttgaaacgataaaattgagaaagataagttgcaaatgtttaaaatcaccatttttggtca

SEQ ID NO: 15068 - DNA, 2880 bp, Heterodera glycines
ctataggcaccgccggttcctaaaaagttttttgaaaaagcgcgccgcaaaaaagtggtgtgaaaagcaataaatggtcgtgtaagaaaaaatttttgagtattttttgaattttattgcctagaatttataataaatttattataaacagggttcccagatcaaaaatttcaaaagcctcatttggcagacgaaaaagcctcattttttaaagtttattaaaacacgcttaaaattttcaaatgatttatttttgattgtccatgatcaatttgagcaattttttgttagaaataagcattttttgggattctaagcatgaaaaaccgaagtagatttttttgcggcgcttttttcaaaaaacttttggggcgcaaggtgggccggcggtgccgataggcgccgccgggagaaattttgtgatttttaatacgatttgttaacagatttgtcgacaaatatggccaaaaacttatgccaatttatcaaaattaatcaaaatttaaaaaatctgacgaattttccccaaaaatcttcgaaatttatcaaaaaaccacaaaaagcctcattttgaaaatttatcctcattgacctatcaaaaaaccacaaaatgaggctaaagcctcagatctgggaaccctgattataaatcttttagctttaaatattcaaaatttgtatttttatggcggccccacaaagtgtccaagccacgaaatgtccaaaagagtaaaaacccacgaaatgtccaaaatttttcaaaatttataaaaacaaaatgagtttaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgatttttataaatcagtttttatcgaatatgaaaaaaatttaaaaaaaatgcgtatccgtatacggatccgtatttttcctggatacggatttttacggactacggattttccggatttttagtccgtaatccgtatgtgtgcctagtccgtaatcccgatcctgatccgtatcttctcaaaattccgatctctatttttaagtgaagaaaatgtttcaattcatgcaaatttttaaaatcaagctttttaatgccatgcgaatcatcatttatgcagggctcggatctgtccttatttataagatttgtccttatttggagggtccaaatcttacaaaataaaaatgtccttatttgtaagatttgtccttatttcgggctattgttcttatttcttaaatatattcaaaattttgaaattttatggcagaatgtcactattttatcaagaaaatataaggtttgcgcaaaatttggttattttttgacaaaaaactgttagcaaatcgcattaaaaattacaaaatttttcccggtggcgcctatcggcaccgccggaccatctccccacttgttccccaaaagtttttgaaaaaacgcaccgcaaaaaaaagtatttttaaagacaaaaaatcgccgcttggcttttaataaaaaaattggccttttttggtgaaaatctgttaacaaatcagaattaaattacaaaaaatttttcaggcggcgccggaccctctcccctcgcacttcccaaaagttttttggaaaaatacgccgcaaaaaattgttaaaaatctgatttttttatcccgaatgcactaaaattttatgatttgctaatttcctccccaaaattgttaaaatcattaatgggagaccaaaaatatactatttgatacatttttgatcgaataaattttaaaaataactgatttgaagcaatttttgcgaaatgttcttatttttgaccctaaaatcttattttttggccttgatgttcttattttgaaaaattttcgatccgagccctgcatttatgtgacagttacgtaataaattttacatttcacaataaattttttggccattaaagaaattgcagggcggtgactcattctcatcatttccctcccttcccatcgtttttattaatgtgaaaatacattttctaagtctcgagaaatcaatacaaattcttggaattactcaaaatgaaaaaatatctcccttcctacaaaattttaataagcgaatttcaaattagcgcatgttttgattttgacacagaaagtggcatttgttttcaaagtttcataatttaaaaattaaaattgcaattttatataagaaagattttgttggtttgcctcgcagaatcgatttccaaatttggaaaaagtaaatttaaaaatggtcgcactccgtgcacaatttgaggcgagcaatgatgtcggagttttctgtaaactcaccaatgcttattgtctggtgggcattgcttcttccgaaaatttttacaggtgtttgctaagaatagaacagccgtttttggcgatatattctttgaaaattgctgtttttaaaccgaaatgggcgtgtaaatccagaattattgcaacaaaatcggtgatgggatttggttacccattttattccggtggattgaaaatgaaaatttccttgtttttttagtattgtggaggctgagttggccgacgtcatcccggtcatccattgcacagttgcgggctgtcggattgttggccgtgtgacggccggtaatcggcacggactgttggtgccgaacgcgaccacggaccaggaattgcagcacatccgcaacagcttgcctgactcggtccaaattcggagggttgacgaacggttgtcagcgctgggcaatgtaattgcatggtctggttggttgctcctaaatttggatttaa

SEQ ID NO: 15069 - DNA, 855 bp, Heterodera glycines
atttaaaaaatgagaattcatgcgagattttctggaaataaagcttaattgggcctagttaaactgtaaaaaaaattttggggcgatttgaaagagaatagaaagaaccaggttcgatgaaattttgttaagccaaaaaaaatccaaacatttaaaaatctataaaaaatttaaaaatgagaattcatgcgagattttctggaaatcagcttaattgggcctagttaagctgtaaaaaaaatttggagcgatttgaatgagaatagaaagagccaggttcgatgaagttttggtaagccaaaaaaaatccaaatatttaaaaatctataaaaaatataaaaatgagaattcatgcgagattttctggaaataagcttaattgggcctagttaatctgtaaaaaaaatctggggcgatttgaaagagaatagaaagaaccaggttcgatgaagttttgttaagccaaaaaaaaatccaaacatttaaaaatatataaaaaatttaaaaatgacaattcatgcgagattttctggaaataagcttaatcccccccccccccccggaaatcagaattttctgaaaaaaaaatttttttttgaaacatcgccggcataattttatttttaaatatcgcgtttatgcaaaggaaacataaaataatgcaatcaattcaatttaaaaaaaaaacacgaaaatacacccctaaaaatagaggtttacaaaaacgaaaaaatacaccctaagaatcgactttttgagttgcccccccccccgaaacgaaggtcctggctacgcccttggcgtatgcaatttattgatgagaaataatttcgagtaaataaattagagcaattt

SEQ ID NO: 15070 - DNA, 2220 bp, Heterodera glycines
  misc_feature (149)..(149): n is a, c, g, or t
  misc_feature (162)..(162): n is a, c, g, or t
  misc_feature (2145)..(2145): n is a, c, g, or t
  misc_feature (2191)..(2191): n is a, c, g, or t
tctgtcggcgaacgcgcgcacgcatcaaatgggcgacaaaagaattggccgaattgacttctctctgtgctcaaactttgactttcttcgctcgctgaattggatcggcgcattcgcagcagctttacggttggctaaatgacactttnaatttgccctttntaatttgcgctttatcttttgctttgcttttccctccctttctttggcactctctttggtttcctcactttctctttccatccgttcgttttcctttttgaatttgcttttctccctccctttctttggcactctctttgatcccccactttttttgtccctttgcttttgcaatgccatttctctttagcttgtcgaatttcgtcgcatcgaaatccaaattgaggttgttgaaacgctgactttggtggcacaacggcgacgtctgcgcaaaagcgcgaaagggcgggcggtcggtttttccaatctttgctttggtccttcgtttttggttgctaacaattcggcttttttcctcgctttaattttaccgccaatcattcacaatttatttgctattggaacttatgaaacaacattagttacattaattatgatcacttattgttaaagtaattattccttttgcagaactttacgcaacccaacgaatttgaagaccaaattggccatcaattaacctgtcaatcaatcgccactgatttggcccatttgcaaattgcgatcccttcgacttcgaatgtttttgccgcaattgaacagcatgaacttagcgttgttgaggcggcagaagacgtcactttggagcggattagctcgttgaaaagtcggctggccaaagttgacttggacacggcacaaacggggccaagcagtactcaaaaagtgggcaaaaagaacgacgaaacaattggcactttaattggccatttcaggtggatctgtgggcactgctgaagaagaaacgcaccattttggctagggatgagagttctgaagaggaggcgcgtgcctcactacgcgaaatggcactgatcgacgacgaattaggcgatgagctcaaaggcaatgccgaatttgaaaaattgagccgacaatggacgagcaaaaaagccgaattggatcgactgatgattctgaatgaccaactgaaacgaatttgtgggcgattggacgaagggcagggcgaagaagccaatgccgaagagttggagactgaattggacgcgttggcccggtcattggcaacgacggcactcgcccattcggacaatggcacttctgctgccggtgattaggaatggctttatccattggcattttgaagcttatcaggccagctgacttagcattctgccattggaaaagttgacagaacaatgtttgcatttttaagcatttccgctgcatcgtcaattcatccgccgagtcgaaacgatcaaaaagcgaattcatcgccgaatggcggaggagcaacgccaacaacggcacgcactcatgcacaaaatcgaggcgctgaaaatgagtcccgagggcgatttgccagttgcgttggaagtggccgaggtgggcaaaaagaaaattattttaataataattaaaatttatttgctgtaatttaaatatcctcagttagaaagcatagccaaaatttccaaaaattcctcgctgttccctttcgagcgaagccccccccccttaattagttgaattaattccctctaattagttgaattattccctctaattagttgaattaattgctcgttctctccctccgttatttccttttccctcgtgtgttttattatttccgactttcccttcaatctttatctgttctgtgtttacccccggggggcgaatgaactcaaaaattgtgtaaaattttattccgcgccgttagtcaaaatgcagccgaattgaacaagtgattcgcaaatcaatcattcaattcattatatttcgtgttcaatttgagaattctctcctcctttttgtttttttaaccgacacttttccaatttaaaatttcaaattgctttttccaatttaaattataaaattcacttttccaattggtccccctttttcaatctttcacttttgcaattgttttttcttatgtttttgtgtggtcgntgccctcagtttccctccatttgtgttatttctccattcattccgnttcgctttgccttctctgatcaactcttt

SEQ ID NO: 15071 - DNA, 1019 bp, Heterodera glycines
gaacgattggagcggacattggaggaaatcgaaagggacaacggcggatgggacgtcattttgagtggacaggtcgagggaatctttggatttggccccaccaatcactcgcccttcccttaaatgcttttcaggtcgaagctgtgctcggcgtgttggccaattggctgaagcagctcaatgaccaattgacaccggaacaaagccaattggacacactttttgctcaaaatggtgacaatttcatacaaagcgaatctgaaaggatgggacggagaatggacacagtcagagagaaaatcagcgaactgaagacagtgatggagcacagacaggtgaaagaatggagggagaaggcggaagacagagacggacagacaatgaggcaaataccgtactaagggagcggttgggttcagtgggcttactgtacttcttttatcgatcaaaataaatattttttcttctttttaactcatttcttttcctaattcccttatcattcctcgctttttgcagatgttccttatcaaaatgtgcgcttttaaagctctctttgaaaaatgtatggaaaaagcgcaaagtgaaaaacaaatcgaaggaaaagagacgaaaaaaacggtggaaattcaaaacaaaatgaatttaaatccgtttaaatccgttaagcaattggaattgaacgcgttaaaaacacaaatccttggcgcagtgcccgaactttttgaagcgcaaacaaatgcacggatatcggtccctgacattgacttgcaacgaatgctcgaccaaattttgggcgattcgattggacccgtgagaattttaaagcaaaaaatgttaaattattgtcaattaagtcgacttctcctctccctccgccgttgtcatctcgtgcaaatgaattgctgaactcatttatgactttggcctcgcaattgcacaattctcttgacctttcgttggagtcttttcagttcggcgcagtctctccctcccaattgccgacagaatttcggtat

SEQ ID NO: 15072 - DNA, 2253 bp, Heterodera glycines
  misc_feature (1296)..(1296): n is a, c, g, or t
  misc_feature (1308)..(1308): n is a, c, g, or t
  misc_feature (2200)..(2200): n is a, c, g, or t
  misc_feature (2218)..(2219): n is a, c, g, or t
  misc_feature (2246)..(2246): n is a, c, g, or t
ggaattttataattagagacgcatacaagccgtatagaacaacccccggtggatgcctcagtattaataggggtaaatttggataagataattcgctaatttttaatattaaaacaactgacaaagtttgacgaaagaatgtcaaagcagagttcacaggtgttcatacgaggaatgttataattagagacgcatacaagccgtatagaacagacccacggtggatgcctcggtattaatagtggtaaatttggataagataattcgctaatttttaatattaaagcaattgacaaagtttgacgaaagaatgtcaaagcagagttcacaggtgttcatacgaggaatgttataattagagacgcatacaagccgtatagaacagacccacggtggatgcctcggtattaatagtggtaaatttggataagataattcgctaatttttaatattaaagcaattgacaaagtttgacgaaagaatgtcaaagcagagttcacaggtgttcatacgaggaatgttataattagagacgcatacaagccgtatagaacagacccacggtggatgcctcggtattaatagtgtaaatttggataagataattcgctaatttttaatattaaagcaattgacaaagtttgacgaaagaatgtcaaagcagagttcacaggtgttcatacgaggaatgttataattagagacgcatacaagccgtatagaacagacccacggtggatgcctcggtattaatagtggtaaatttggataagataattcgctaatttttaatattaaagcaattgacaaagtttgacgaaagaatgtcaaagcagagttcacaggtgttcatacgaggaatgttataattagagacgcatacaagccgtatagaacagacccacggtggatgcctcggtattaatagtggtaaatttggataagataattcgctaatttttaatattaaaagcaactgacaaagtttgacgaaagatgtcaaagcagagttcacaggggttcatttgaggaatgttataattagagacgcatacaagctctctgttaataattttttttaatgaactctcacctttcctcttttctcttcccctcacattcttttttctcaggctaatagtgaattaaagagatatttcataacactaacttagttaatatcaaaaaattattgctaacaacgcagaaattaatggcgccgaaatggttttgattaattttttaatggtagaaatctataaaaaatttaaaaaatatttacagaaagaaacatntaacaaaagttntaaaacagaaattttcacgaattattataaatggtttatttcaaacaaaaatattccataattgaatcaagcgttaaaaaaacacaaattaaaaaatttaacagtttttaaaaataaataaaattattttttgacgaaaactctgttgataattcattttaacacgaattattttaaaggatgtgaatatattatggatattcaatttctgttaattcataagtaattgttttatcgttgtgtcggaccagtgcagactcgtcataagaagtcaatgtcaaaactccagctgcaatgaaattaaaagggacttatttaaattcacgcatgcatttttttaataaaaatattataataacatagcctttttcaaaccctcattagtgtccgcattcgctgtaaattcatcgccgacttcaaatttgatcgaattgggaaaaacaaattgggttttgttgatcccatcggtacaaattgttccatccaatctttttataagattgtatgctgtcggcttgcgtgccacgcataagcggatacgaccttgtgttttaaaattattaaatcaatttactattagtaaggatggaaatttcaggcataaaaatcgcgaaattgctacctttaaattacaaaaaaaatcactcaatcaaaatttctatcaaacaaaaaaatttttagaaatttttgagaaatgtttccaattcctaatagttttttgttggtgttttttcaaaaaatccaaaaaatacgttcctaggtattaaatacaaaacaaaagtaataataaaaaatattaaaaatcattgtagacatcctaagcaaagtgtaaacctgtttttcgtgtttaactgtgcatattaagtacgtaaaaaatttaggcttttgccanaatattcatccctactannataagttttttaaaaggtttttcatanaaaacaa

SEQ ID NO: 15073 - DNA, 1663 bp, Heterodera glycines
  misc_feature (29)..(29): n is a, c, g, or t
actgcgcaagaattgctcaagaaacgccngagatggatgaaagtgatgaagaggagggtgaagctggaaggagaacagaaagaagaacaatggagttttgagggattggggaggggcccaagaagaatgaacgaacgaacgaatgaatgtgttcaaagggacggatggaagaattatccaccgacagacggaagggatgaaggaaggagcagaggagggagaaaagagggacaaattatacacactcatccaaaaaagttggaggaagaaagcattgacgagagacgggaaggaagccatcaaatttggaaaagtatagaattggtccgttaaaaaaaagcaaattgcatcattaaatgtgactaaaaggattctattaatgaggaaatctgtgggaacatttagggacatcgcgtgaagtgagaagttagtcaaagcaaaagcattgggaagaaggaatctttggtagagagagacacgaaaaaacgtcagagagagagaggagaaagaatgagtcatcccaagttaaattcatttaattatgctaagtaagttagcaacttctgctcaagtttctaaagtcgtcgtccgaatttgaatcttaaagattcaaataatgaaagtcaaataaaagcatttattcgaagatgaggcaaaagcattcattctccatataaaataagctttgaggagagagtccaatggcgaatatttgcagtcaaacggattaaatgagcaggaaaacttttgatcggcttttggacgggtcggatttccaaaagatagatcaaaggagcacaagtgcacccatctgggcaataagtcaaaactgatctgatggaccacatctgcaccgatggaccaacaaattgagggcatatgtttaagggggggggggggatcagcagtgagcttttgggtatcccatgccgtcgggttgaatttggcaaaggattagttgccagaaaacgattacgggatttcatgatacagatggcaagcagtttgctgtttgagtttaaccgaattataaattgtataaattggcggcgttaaaccaaaataacgctttataaaggaaagccaaaaaaacaaaacaaaacaaaaattcaaagccctaaaaatttaaattgccttccaaaatgtgataaggtggaagattaggagtatcagcagttatcatctgctggtcatcagaggaagtcgcatcagttagaaggaattctttttctttatgtttagcagcgacataaaatgaattatcggattgatttagtcgaatgatcgcgctgaagaatgatagccaatgtacaagcacagaatccccctccccaccgccatcattctccgataaagttttcgcaaatattgcggagaattgaattgatgggggtgaaatgggaaatggtgggggggggagggtggcgctaggggggacattggctctgactgacggcgtccgtcgtccatcatcactttctccgcactccccatatattcactcatccttcatcatctcttcgcagtggacgataaataacattaggcccatcccaaggataaatgaatgggagggggaattgtcggcggaatgggcccacctgcccatccatcgccgcttctatcgccgcaaatgcatcttctaatgcttccatcatcaaaa

SEQ ID NO: 15074 - DNA, 3130 bp, Heterodera glycines
  misc_feature (107)..(108): n is a, c, g, or t
gatactcaattcattagaggatcattccaaatttatatttttttaaatcttgggcaaatctattttttatttttttgcttgtgtgaggctttcctatttttattatnntaaataattaatgtatttactttttaagtctacatatacattgtgcataagcacatacaaataattgttaaaaaaataactttttttttgcttattctttatttggtgatgttatgagtgcactacaggaaattctggaaaaggtataaatattaaaaaataaattaattattctcctttaaatgcttcgctatttggggacaatatctgtatttttttagggttatgtcgaccccgaactccttgaacagttgggcgaggaacagaagcaaattttattcattaaaatgcgggaggaacaaattcgaaaatggcgtctttacgaagcggagatggaacagcgcgagaaggacgagggacggaaaagcggtggcaaaaggcggtcgcaagagagcgacggaaaggacggcggagttcgccgagtgcagtgaggggacaaaatgttgaaaataaatgggagaaaagagcatggaattgaacaccgaacaataaatttgacattttgcttccctgttgtttgtcttatttttaattctgacagatggctgaacggcaaagacggcgatgtttgggtttgggtgatgggagaacatccgaacgacatgagcatcgagcagattctggacaaagagtccgaggagaaagcgcgacgaatagccgagaaacaggtcattttcatttgccatcaacaaataaacgcacaaaatcccattttacaatcccttgaggattttcgtcagatttttgaaatccgatagtaattaatggtgggtggtaccgatatacgcctccataaaattttttagaaattcatggtgggttgggtcgatgaattaattattcaagctcttaaaaacttatttgaaaaggggcattaccccctgagtattggtctgcatttatttttttagataattcaaacacttcaaaaggccgacaatggagtaacacgcatttttttttgtacttattgataaaaggaaatattttagactatccaaaagcttcgtttgtctgacgacttgccgaatttgttggaacgcgaggaagcggagttgaaagcggaattggcatgtatggaactgaacggcacggagaagagcagcacgacaacagacgaaccaaaggtggcgagtgtgccgaaaatggcgaagcaaagcaattgccaaccatcgcaatcttaagccaaattcgcattctccctacgatgacgtcgtcgaaaaccatcgatttgacatccattttgagtccaacggtccttctgtccagccaaccaccagcagtgccgctggtgccacaaatcggccgccgacggacggcaaaattcgtcaaattgcgtcatttccccacctcaaacaatcaccctttttgagcaatggaagagaggaacagctcgaattctatggtgcatttggtcagtgatttatttgttggtgtttttccttttgcagataatgtcaattcattttgtccatttgaatcaaatggccgttcaccaaacaatttgaattataacgtaaaaaacggacgacaaacagacgaccggccaacgccaccgccggtgccggagaagccggcatttttaagacggacggtgtccaacacgatggtgatgaacagtagcaacgacgccaacaatagcagcaaaatcattggggtgagcactgcgaatgctttgcccgcgttaggaatgttcgctttcaatgtgctcttcatttttgacaaaatttaccattagaattttaaaaatttaaaaatcggtcttcaaaatttgcttttctgtttaccgttgcttttgatgactctttgattctctctgctttttcagtccatccgaacttatattcccgactctgaggtggagaagcgccaatcccaaatattcgaccagttgcgcgagcagcgtgaacggttcgattttgctttaattactgtatatcagtgaatgttgattttgaggttggaacgcgaggcggaggaggaggcgcggagggaacagacgcaatgggaggagcagcagagacgcgcgagggaagcggaggagtccatccggcggattgcccaaaaggcgcggtaggcctaactcgccgaacccaaccaactcggccactgtgcccttaagggagcagcaccggaagtgtctgcgcacctccgactctctgctgccgctgttccaacgcaacggctgtcaatttgccggaacggcgcagtcaatgcgcgaggctctgagggcactgccgaggccgccgaagccaaagagtcgccaaaacgtaaagggggcacaaataattcaattccatcggcacccaaattcccccttttcgggttcagctcttctcccccccatgtttccctccggaaaaatgtttaaacctagaaatttttacaagaaaaaacagaaaacttaaaggaaacgaatttctcaaaatctaacaacaaaatttcacaaattatctccaccttttggttgtgagaccacatgacacaaacttacattctcagatcatccaatggtttcgttcgtcggagttgggccaatgggcacaaaagaaaccgcctctttggttccatggtatgaaaaagtgcaattcactggcactaattgcaccatttgcttaaccattccctagggatcatctcccgcctcgattccgaatgtcttttggctggcaaatcgtctggtgcatttttaattcgcgtcactgaacgaatattcggctacaccgtttcgtatcggactgaaaacggaccgatcaaaaactttttgattgagcgaatttccgaaggctatcaatttatgggtgagaatttaaaaacaaaattcacaattatttttggtttcgtgcgatttctttgcacaaaatcggttttgtttaggtaccaatcagttagtgcacgcgtccctcgtcgatttggtcgcccaccaccaaaaagtgcccatcaccgccaaagggggcgaattgctgcgcgaagcggtgggccaacggacgacggacggacagcaggcggactatgcggaact

SEQ ID NO: 15075 - DNA, 3512 bp, Heterodera glycines
  misc_feature (97)..(97): n is a, c, g, or t
  misc_feature (3353)..(3353): n is a, c, g, or t
caacctaaaaatcgacttttcaaaaaacctcttacgaattttaaagcccaaattaggtatgtagaaatttatcaaattaactgtttaaaaagatttntaatatattttcatatgttagtcgaaaaaacattttagcaaatgactgcacggagattggcatctgctgtttggcggccatctcctgattctgttttgaatccatcacatcctttggtaagttaaagaaatgcttaatttaagaataaaaaaattaattattcactttgtgcaatggcttaaatatattttaaatttaaaccctccttttgtctacccgctttttctccttaattaaatgaccactttttggtttcattttcaacatgtgaaaaccaaaaacatccattctcactttttggctctgattacttttttatcgtttagtttaaggtgagcgagagattttgtacgcatttgtagccacttttgcctttaattattaaaaattaatctcttcggcggctgtaccccaatttaattaattatatattctaatttttgtcctcctcacttttatcgaaacgaatgcctcctcttcttcaataaatatgctgaaatttagaatagcacgtattggcccggacgctctctcacgaatacaataattgcttactttgataagaattatacccaggtgagtgaacgaggggggaaaaagttcgaacttggttttggagattttaaatcgcataaaaagccttaaatgtgttttaggaggtgattttattcacgaaataaaatttcattttccaagtccatattttaaataagcatttctattttcaagtccttttcacaacaaataaattccccggcttccattcagcagcatcgtattttttcttagtgttcgtaagactcataaccccttttttggaaatcagttccttgtgccaatgtggcccggtcacttcaaaatatgttttatttttccattcacagttggagcgaaatagactcgtcggtgcggtcggacggaaaatggtactagaagaaaatcgagcacaagacgcaaaactatgggagaaaaaccaccccgaccccagatataagtgtaagcccgacatcgtccaagaggtggaaaattgataattaaattataaattatggttttgtccaaagcctgcgaatggtcagccaaagcctgcgaatggaaagccaaagcctgcgaatggtcagccaaagcctgcgaatggaaagccaaagcctgcgaatggtcagccaaagcctgcgaatggtcagccaaagcctgcgaatggtcagccaaagcctgcgaatggaaagccaaaggagttcattgagatcaagtcgattacggaggggagtaaaacgaaacccaagtagagaacattattttatgaatttttaaatttacgatcgaattatataagatgcggtcactctttttaggtataatttttttttacgtccattttgactgccatttcgatttacagcgaaaaaatttggattttccatattttttgtaaatattttggcttttttcatataaaattcagaaattctttaacaataatgatttttttgatgcgattatattttttatcgatttagctttgaaacgtggcattttctgtagtatattgaaacgtcatactgaaaaacataacgaagccttcctcgataatttttattttatttgacagacaaaattttttatataattattagagaccggtgggatcggaactcccgcgggattttacgggagtcccgctctcgactcctgttttttcggtgaatgggatttttaacgggagcgggatttttacgggattcccgtttgggactcccgtcccggaaaattttgaactcccgatcccgcttccggaaatttttacccaaaaaacgggagtaaaaatgcacttgtaagaattgagttttttttttggtaaaaataatgattttctttgaaaatctgttaaatatatagccaaaattttacaaatcatttagactatctggacctcagaagcaagctgtaaaggacgggaagcttaaatccgtaatcaagatgtaagcaaaaaataaaaaaatctgaatataaaaatttaataaaagtaggcacaaaatcagtttcaaaatctcgattttcactccgagatagcaattagcactaaataagtaccggaaatggttgcacatgatacttttatctttaatgaagctgcctatcgggatcgcaggcaccccaaaaaacctaaaaattttgctcaaaatcgaaaaaatttataattttagacaaaatctgttatagatctatccaaattttcaaaatttttcccggcggaacggcaccgccggacccccttctccctaaaagtctttagaaaaagcgcgccgcgaaaaaaagatgctttgaaaaattttgggaacaagggtccggcggtgtcagtaagcgccgccgcgaaaatttttcgaaaattagagaattagaatgcaatttattaactgattttcatcaaaaataaccaatttttgactttgagtcaaatttttttaagaaaaaataagtttggggacccggcgccggaggaaaaatttgaaattttgactatttttacagattttcactcaaaaattgttcattttaaaaatgtcttatcgtttttaattaattctatacaaaaatatttatgataaaaagaaataaaaaaagtacataaacttattattattaataataaaaatttttaagctaaaataataaaaaaaatttgactatatggtataaggcaaaaattgaaaaaccccgaccccgaaccatttggtcaaccctgaccccgaccccgaacttgctgaccccgacgactccgaaccccgacttttccgaccccgacggtcgggggcccaaccctaaatatcaccgtaaaaattgtttatgtcaatgtttagagtgccaaagaaaaatgtcgccactacgtccctatcacgaacagaacaacatggtttaaagggaaaagaaagatctctgttggacgctgctaaatggggaagaagggtgcttaaaggattgaatgttgtcggagtagtttcggactgtggcaaagtaattctcgtctgcaaagaaaaaggactatcggaagcagctgggaccactgttggaattgttgtcgaacggtatgtagtactgttgaacgcttttaaaaatggcaaaatgaaaatgggtcgggcacatttgtgttcgttccgccgttctttcttttagcatgttggaattgggaagggggggggggggggaaaatcgaaaaagaaaagtttctaaatcttcacttgagaattggcttactgtngtgttttttgtcattttcaatgaaatttataaatttggttatttaggtgaatttatgtgttattttgccattttttgcccttttatttataccgtacttacggtattttaaatccgcccctgtattagaacccccctctatattacaccccctttttga

SEQ ID NO: 15076 - DNA, 1142 bp, Heterodera glycines
  misc_feature (1084)..(1084): n is a, c, g, or t
tgtaaagtctcaaaaaactttttgtttttgaaacaaatttttatcatttgcgttatatattttttcataaaatttcgaaggctttcggagcttttaataaattagcttctgaaaaaattaatatttttttgttattcagcagaactgcattcatagagagagttaattttgtacagtaatctataaaaatgtaaataatttttacggtattacaatttttaatttatttcttctcactctgtttgatcatatgcttcgatacacttggaatgacgaaaagcattgggatgagacatgttcctgtaataaaaaatttttgtgaaaaatatgaattttgaaaatcaaaaaaattcgaccataaatgaaaaaagagagaaaaacaatagaaaattatacaaaatttcaagaacgtcgtgaatggcacgcggaatgaccatcattggcacggacagataagcagcgaggcatggaaagcaaacttttttgaaatcggtgaaacggtcaaaatattaaattcataatgaataatttatattataaattattttgtaaacaattaggccaaggctttgacggcggcgaacattcgggcacataattgacgatttcaaatgttcaaatgaaaaacttgttgagatgaaatcgagttggtaagaattgattacttaagtaaataaataattaaatacattgtgtcccaaaagtttcttgacacatattttttctcataactttcttcagaataaaattagtgaaataaaacaacataaacaaacagagaacaaacatatcagggtacaataataatcacagtttttaaagctgcccatttcttataataaatttaatccataaaaatcagaaatttgaagaaatatttttgcctatttttaaaaaaaatgaaattaaagccttttttaatcttagaattagacaaaaattcaagaaaaaatatttaaaataataatattaaaaaaagaatttgtatttataaacaaaaaattaatttaaagacaaaaattataaatttaaaaataaataaaataaacttcaaataaaaaattatgaaaatgaattatattanaaaaacaaaaattattatttcattatttttgttcaagaacaaagacccacccatcggg

SEQ ID NO: 15077 - DNA, 1564 bp, Heterodera glycines
gttaattaaataataattcaataagaatacaaaaacagttagtaccatctgggagctgtattttaatttaaaatgatatgaatttccaaaaatttaaagtaatattttttatctaaaagtgtgggagcaagccgagagtgactcaaaaaagggaaccaaaaaatgacaaactgcgaaaaaagattactaagcatttggagcaaaattggatcaacaaaatatacgattcggtttgctgtcaaaatggacagaaaagattataactaaaacttattagtagggttataaattatatggacaaatgaaatatggacataaaatatggactaaaaactcaaaaatcagttttttgatccggaatacactgaaatttattatttacttatttcctccacaaaattgttaaaaccgataatgggagactaaaaatatataatatttaatagattttcgatcgaataaattgtaaaaataactgatttgaagcaattttttgcaaaatgttcttatttttgaccctaaaaacttattttttggccttggtgttcttattttgaaaaatttccgatctgcaccctgaactagagccttcgaaaattatttttttggtttcgcacaaccctgatccgaattataattatgaaacacatggaaatggtaaaaacaaaaaatgtttaaaattaaaatcttcaaatttttagaacccttaattgccgttcatccgaaaattcgtcagggaattgctgaggtggaaaaataaaatacattcaaatagcaaataaaattcagaagttttccattccatatgataattttttggatgtcaatgcttgtcacagtgacctcgaaattttttggccccaactgtttgataattaattacaaaagcgatggaagtggtaaattttgaaaattttaatgaattttatacaatgattagttaattattctattttaaaaggttgtcgttctgtgttcgcaaaacatcctattttctgcagtgaatccgccaccatttttttacttcgaaatgaaaaccataaatgtgaaaaagtatgttgaaatgcaacaatattgcatttcatgtgaacatttgttcagcagtgaatttttgtctgttgtggcattaatttggccactcggcggattattttcacaaagaatggactttgtttgggttggttatttttttattattaaattgttttttaacaagtctttgtctgaccttttttactatgaaatttcagttatgaaaaaagaatagtaagcgaaaaaaatcagaaatttgaagaaatatttttgcctattttaaaaaaatgaaattaaagcctttatttaaacttagaattaagacaaaaattcaagaaaaaatatttaaaataataatgattaaaaaagaatttgtatttataaacaaaaaattaatttaaagacaaaaattataaatttaaaaataaataaaataaacttcaaataaaaaattatgaaaatgaattatattaaaaaaacaaaaattattatttcattatttttgttcaagaacaaagaccaccccatcggg

SEQ ID NO: 15078 - DNA, 1378 bp, Heterodera glycines
ccgttttttagcttgataggacgcttcgcgacctcgaacggacgcttcgcgcccgttttttaaattttgttgggcttatacgggcgcttcgcgcccgttttttatattttttaagctcatacgggcgcttcgcgcccgttttttagcttgttaggccgcttcgcggcctcgaacggacgcttcgcgcccgttttttaaattttgttgggcttatacgggcgcttcgcgcccgttttttatattttttaagctcatacgggcgcttcgcgcccgttttttagcttgttaggcggcctcgcggcctcagtcgggcgcttcgcgcccgtttttcaatttttgttggccttggacgggcgcttagcgcccgttatttaaattttgttggttcagatgggcgcttcgcacccgttttttaaatccattgaactcatacgggcgcttcgcacccgtttttcaattttttggccttggacgggcgcttcgcgcccgtttttaaaatttagttgaactcagacgggcaatcacacagggattaagagatataaaagggattaaaagaggcacaacagtgattaaaagaagtaaaactatgataaagttcgaaatttataatatagaatatttattgaaattgaaaggaattaatttctcgaaaattcaaattaaataaaacagttattcatcagaaaataatttaaaataaattaataaaacaatttaaataaaaaaattaaataattcaaaataccccttgagatttttcaaatattcgcccaaattcccaagggccaaaaaaagtttgaaaatattttcgaatttttaaaaattctaaaatgtacaatgattgattatttattgtatattaatttgttgacaaattctaattaaaaaaaacaaataaattctttagtttatcaattttaaacaacagtgattaaaagacgtacaaaagtgattaaaagaagtacaaaagtgattaaaagaagtacaacagtgattaaaagaggtacaaaactgaattaaaagaggtacaacagtgattagaacaggttcaactgtgattagaagaggtacaacagtgattagaacatgttcaactgtgattagaagaggtgcaacagtgatcagaagaggtacaactgtgattaaaagaggtacaaactgtgcttaaaagacgtacaaaagtgattaaaagaggtacgagagtgatcagaagaggtacaatgattagaagaggtacacagtgatcagaagaggtacaaaattgttagaaaaggacaaaagtgattaaaagaaggacatcatggtttaaatgataagaaattgcatattggatgattataaattatcaaattaaaaaatccttttacttattaaa

SEQ ID NO: 15079 - DNA, 3573 bp, Heterodera glycines
cacaaagaagaacattgatatcccctgaataattcatggaattcggttttatttagtattagctccctccccaattcctgtgtttgtatgatttttgggtaatcaatcggccgagttctgtttactggtctcacctctgatgttgtgctttccttggggattttttgcttctccgccgaacaaagctaaagcaattgcctgcttcacttctgcatggccataaatgttgggcgcgacactgcagaatatttgttgagctatttgcggatgttttgccaattcgtggattgctttgatgtcctcgtcagtcagtgaatccgactcgatccgatcctttctcgttatgtgattggctatgatcactgtgttgaaaacgggaaaaccctggcgcgaatttaaggaaccatcataaccattggaataaacaccagtcaattcctaaacagaagcagatgagagataaagcgatgaccaaaatcacaatttcatcgccaggtttacacgagtcgcacaagtcgcccagcagaatcacttcctttgaacgggggagtcgcccggccgcaaccaaattcggactttcttggatgctcacgcgttgataattgtggtaaattgtctcttctgtgttcaattcgaatgggcctcgactttgacaagagggacaagtgctcggctttgtctcttcgtcctgacgctgaacaaacgggccgagaacataagagcaggacttgcagtcgtatttgacgatcccaagttgtggaagaattccggtggtaatggtcaccacaccggctgtctttatgagcatgttcaaatgcacttgacgcaacatgcgaatgtcttcctccatcggaaggtttttgatcctgactttcacctccgtagtgatgcgatgataccacggaaagattgacactaccacagtcgtggctgcgcgattcaaacattcgagtacctttaattctcaaaatattatgtcatacgttaaatcaaacttctgttggggcctcgggtaagaaataagtaatgtccggttctcccgattcgtgtgccaggtcattgtaatccacttcaagtgattcgcgattctcagccaccatgtgtttgattgactgtatgtaaaagttttgtttgttcaccgtatctttgaaaacgcgcaaaaatttgcagaatctaaaaaagcaaacattttttgtagcttaaatttgtcaaaatgcctcttctcaatctccttcgctataacttcgtcttttatgtgctctcgagttggtctcccgcgcgggttctcaatgatatcaatgcgaatgtcctcttctgccggctctccagctaatgaatgttcgtcggcagaggataaaccgcgttgcttcctccgtcgcattaagtgaattgcctcatcatcgccatcctcccaataaatctgataaaatttccattttatattaattttcgaatgcatcaaaccgcgtcatcaacggtcatttggtcgcgtcttgccatgtccaactctgcgcggcggcgagcatcgattgagagttcagtgatgtcagatgtgtcatcaattcccgactgagacagcgcatccaattcaggctgttcacgataatctctgagaaaggaagcagcaaattaggattatgattttcgtaattgcctcatcatatcatctccatataagtcttctccttccacgtcatcttctctctttaagttggtcacgttcatccccgtaaagttcagctattgcatcctcatcatcctcattgggatttgctgatttcttcctcgttttcactgtgaatgctgtcactgtcactcattgttaatttgattttttttcttaatcaaagaaaaatttttgattttttagttatggttgggggtttgaaattggtggaaatagatgtgagattcgttatcagaacccctgaaaacacctgagaacaacgcaaaattgcataaaccccctttaaatcttttttttatgggaccattaaaagtaagtatctaattgtctttttttctaaatcaaaaaatttaaatttaatttttggcgctacaagaaaaaacaaagttgtgaagaacgttcacgggaattttaaaagttgctgaccgaagtggtcgcgaatcgaacattcattttgaccaattatgtatctcaaatacgattcgcacaaaaccgaaatgaaaattcatctttaaagttttgtttaccaaaccaaaagggttttaaaaatttcactactacgaggctatggtagtggagtagtaaacaaaaccattaaaaacatttttatcatatcagacaaaatgagttcgacaggaataaaagtcattaaaacaaggcctaattatttgcttaactttcgtaaacgcaatctacatttttattttgatttacacagatgttcccgtctaatttgttgaagaatctcatttgccaagttccatttagacgatgctacggcacattgattcaaccaacaccttttatttgcgaaagaatgcaacatgatccaaaattgaaagaaaaagtggaaagagtccagaaagaatatgaggtatatacatttttggcaatcaaatttggttctgattggttttatgcgttgcatgccaaattatgccccccatggtttcattttgagtactagtacaaatatgggtactttttcactttacgccacataaaaaaataataatttttttgtatttttctggggttttcatgggcgctgatcacgaatatgacattcatttccacccatttcaaatcccggacccgaaatcgaacaaaagtcgaaaaataattttcaccaaaattcatatacacatattgtccaaaaacgattcaaatgcactaaatggccgtgaatctttattttttattatattctcttctatttgaatcggttttgggcaataaatgtgaattttggttaaaaaataattttcgcttttgttcgatttcgggtccgggatttgaaatgggtggaaaaatgaatgtcatattcgtgatcagcgcccatgaaaacctcagaaaaatacaaaaaaaattattatttttttatgtggcgtaaagtgaaaaagtaccattaaatctgcttttgaatattttgccaaagaaaataaactccaccttaaatccaatgaacaagggcagctccaccttgaccggaaagccctcaggcaaacgcgttttgcacagcccgcgcaatttggagaagcggggcagcagtggctcgaatactctcagcatgtcctgataaatttaaaattttattgcccattcaacaaagaacaataggaaacgaattttacaagcctggtcataagcctttttatacttatattaaaaaaatattaccaaaagaacgccgaagcgcaatggaaaagacgcactctgcaaaaaaaaagatcttatcaagccttatttgaatgataaattcacaaaaccattgcgacgatcccttcgaacttcttggcggttgtcgatgccttgaatggcttgccgagtgcttctttgccctaaaattgttgtaaaagtataattggcaatatcgaaaaattcat

SEQ ID NO: 15080 - DNA, 2338 bp, Heterodera glycines
atttcctccttcggatcggtatggaacgccatgtcaaagacttggatgcccgctttataatttccatccttaaaattttaaatgtttaaatatttcttgttttaaatcattgcccaccaaaacaaaggcatcgcccaatgccatcagacaatcgacgcaattggtgacaatgctattgacggacttaaaaccgattgaattgggagggaaaggacaaaacgacttggaggagttcaattgcggatggatagtcgccgattcggagatggacgagcccactttggagtttggcagcacttaacaaaagggcgtgagaatgccaaaaataaaaaacactcacacgcaattcggccgtcgcttcaaatagaggcgaaggcactgctgcgactttaacgggtcgccccgaattctccagtaaaaatgtgcataataaagggccaattcgcgcgatttttcgtcatttgccgtcagtttttgtgcaaggaaaagccccaaatggtgcaattgctcctcacttagtcgtgccaattgatactcggaaacgaacgaacggaattcctaagataattatgcctaatgaatgaattgccaaggcgaggaatacctttgtcgtgctcacttcgttggcttttctctcttcggttgtacccgtcaaatgggcacagtttggttcttctgacaatgattgttgagaattgcccaactcatcattcggaaacattcggctgagaaagtccattttcagtgtttctgtcgtcgaatgaatgctaaaagatttttctaattttttttttttttggtctttacattgattcttttccaatcacaaatttgggcataatgtcaatgggataagtgacaacaaaattctccgtttgcagttccatcggtttgctccgtacacagtcctcgtccgtttcccgcactttcttctcaatttcggggtcatcttccccatatcgctggtcaatgttagcctttgttgaaatgtaaacaaaatttatttacctaacctggcaaaaattgttcgtacttgtttatctctaatgaatgttctgatcgccgttaattcccgaatccattccaattggcccaaaaggtcgggaagggaatgaggctgacggatttgaaacggagaatcggactgaaagaaacaatttgagagaagtccaggcaaattatgatggatgggtactgaccacagaatcaatggcaccgctttgatggttggccaaaaagtgagtattggcaaaacaaacgtaaaggaaaaaattgggaaaaaataaaaaagcgaccaaagcgacggaaggggcaattgtgaagatcattggccccgaaattttttaattttatttttttatcttaaaattttttaacacttttctaggggtgttttgaggcgctgagcacgaatccggcctccatttcgaccaattccgaatccctaatccgaactcgaacatttttcgagaattaaattttaaaatttcttttaaaacatggttcttagtgttttcggtgccggaccgggtcagtttagtctggccgttttagtcagggggtcgttttagtctggttagctgttttcacccacaaattaattactttttataaaatatcattttttgtcgagcatatacatacatataactggaaagcgcaggctacaattcgtgcgcaagtcttgcagaacacaacaacaccaatgttagctgcttttccgaacaaagctgcgacaaaaaggtcaacttttcctaatttttatgccaaaatttgatttgttcatttattttaggttataaaacgtgttcgccgtgacgaatatgtgccaccttattttttcaaattacttcaaattagagtgccacgcagggctggacgtaattacggattacgtattacggaaattacggcctttttggagcttacgggttacggatttttgggatttttccgtaattttgatccgtaactggctttttagattatttttcgagacgatttcttgcaagattattttttataaaatgaatttttttttctatttttattaaaaggctacccatatttcgatttaatctgacttattcttggtatttgtagtattattaacatacataaaggggggggggggaggctagcaaaggggaaaagaggaaatgctaaaaatttgccatttttaacaaaattcgttaaaattctgaaaaaaattttcctcgtcggcgcttatcggcactgcccaccccaaaaattcctaattatttttaaatattagctccaaaatcttagtcatttttagacaaaatcttatagcaaattgcataaaatttttaaaaat

SEQ ID NO: 15081 - DNA, 552 bp, Heterodera glycines
tccacaaatcctatcccccaaaatcccacacaaaaaaacggggaataattgttatatatttgcgcatcatccgcccgtccgccccagcggattttgtggtcgtccgtctttcgcgcgcggatgggttggctcatggtcatcccccattgccctccaccgccaccaacgaagacaattttctttgtaattcgcaccctcctccgcgcccccttaaaatcgccgggggaaattttaaaaatttgggtgcaatttgttaacagattttcaacaaaaaaaaggttggtttttgcgattattaagctcaattggtaggattttcatttaaaaaatgataaaatatgtatcaatttaaaaaaaactatgaggaatcatattttctttataggaaacccacgagtatacaaaaaaaaaattgaaaataatgatcttcacaattgccacggaaggcattgaaagtggaaaaattaaaaatggaagagccaaaaaaacaaacaatgggctattcatttaaattaaagtgtatggcgctaaattttaaatttaacttaaaaa

SEQ ID NO: 15082 - DNA, 3846 bp, Heterodera glycines
  misc_feature (3690)..(3690): n is a, c, g, or t
  misc_feature (3715)..(3715): n is a, c, g, or t
tttttaaattatgattttttgttcaaatttagattaggaaatcggaattgatcaaaataattgaaggattcgtgatcggggaccccaaaaacccccagagaataaatttttatgactatcacaaaaaaaattttgcaaaacaaaagggtccctccttttgaaaaaattttcaaaatctgtcactttgcatatagtgccaaatataatataatatttacaaaattcgcaaatatttaaaataaacaaagcccaaacttctgaacccaaaaacaaaaatgttcatttacatgaaattttcagccctaattattaattttttttttccaaaaatatttacctatatttattcatacatataagcaaataacattaatatggccatatcagacaatcaaaagcaatgctccaaacgaaataaaggtcgaaaaaacgaatgctgttttctgactgacgccgcccgatttcatcttttttggtccgccaatgtctgcagcagagagacgatcacgacgaaattttgctcgaaactggaaggaaataaaataaaatagcatttaaatttttactaatacgtcttcttccgctgatgtgggagtttgaacgactgtataaattaataaatgataattaaattggaattaacaaatggtccaaaatcctaacttgttttatcagctgcttttgcaaaagccgaacctctgctgttcagtgaatcaactaaaagcgttgaaaaaataaatattaatatttttgaaaatataaattaacataattttttgcaattacccggatagtttggcaacggtgaaacggcgtagggtaaaggcggaataataggataatttgttgccccaacaggtgggtaaataatgcctggatttcttggcatcgttgggtaatagtttggcattggaatgccaggatagtttggcatgggtgggaaaatggctggaaacttcggcggcatcccaatcggataaccaccggtgccggccaaataaggcggaatagggcaaggctctgttgcagaacaaccaccactgtgtgtgtacggaaagcatgatgacggtggacaattgcagttgttgtttggacaattgatgatcaatgaaagacagcatggactagatgaaagaaacctattaatattttagatttcgatgttttgagaatttatagaaatttcttatctgctaaaaaaactgattttaatttaattttctttaatattcctatataagaattttaataatgtgaagtgttccttacttgtacggatgtaatagcggatttgtaaccggtgtactgcttgatgttgtggttttgggggttttatccttggtggttgtagtcgtggttgtctcttctgtgggctttgttggtggtactgtggttgacgttgtatgctatgtatgaacaaaaattaaatttccaaaaaaatcattttttttaattaccgttccaccacaacatggcgggcagctcggccggcatggacaactgcgatactagaattggtttaagaattaaaaaaaaatagtagatgctttaaaaggcttaaaccccatgccaaatgacaaataaatttatacttgaaatattttcaattgataatccatcaatcaatgctccttattttgaagattcaaaactgaaaaccaccaagagattagaaaaacatcataaataagggattaatctcgcttttttaaattgttttttcgagcctgtgacaatattttttcaatttcttggtgtatattattcatttgccaattttttgttttctaagagattaaaatacataaaaacatacggcagaacaacagcaacattcacatgccgttggactcgttgtgccagcaaaaggcgcttgcggcactgttgggtaagaaggtggcacaggcggctgtggtggcccgattgggtagcttagcgatggcatagcttggccaacaggttcaatcgagtacgatgggggttgtgccggataggtggtgaagctggttgtagaggtggtaaaacgacgatgaatggaccgattctgagcagaatgttgctgctgatcaaatatgagtgaaggcaaaataattggcactgagtttggcagaatgtcatcgtcaattcgctaatttgtgagtttggcgaaagtaaaatttaaaaaaaatgtaaatttaaaattacctttgcatcggtagtatttccatgaataaggtccgatgcagccacagaaacttaaaaaagaaaaaaattaaatattttaatttattttatttttttaccgataatgaaaaggtgaagcaaaataattattaaaaacatttgtttaagttattaatctaaaacctaagaaaattgaccaaatgacatgactttataaattacacataagtgggtaatattagtcaaattaattaatttagtttatgggttcttgatccgtcatatccaagatgaaaatttccttattgaatcatatgtgtatacacaaacattaaatagtttttttttacacttgattttccaaaatagaagttaggtaatacaaatgtatgaacaaatgaaaattcagcgtatttatacagaattttcagtgtaataaaaaaaattatcaaagaaatgtaaaaaaaaaaaacgttttaaattggtatatttcaatggacatttgatgggtggtcaaaaaagccgccaaccgattggatgaaaaattgcattgttagttcacctcaaaataggcaaactattgtaatattagaaattttatttatacaatgcaatcagcagacagaggctgacgacaaatgtaacaattctttcaaagaaatggaaattttttacaatatttattttatgttgctgcttaaatttcttcaaaaaattttcattttaatatttgaatttatttaattattctggtagaaaattcttttatttattttttttttgatttaagtaaatttcaattaatttaattattaattcagttcctctacttttacgcaaaaaattaaacggttatttttatcgaagtactaactaattacgttttttaagttatgatctttgataaaataaaagtatttatccatccgtaaaatcatagagaaaatcacaaaaaaaaaacacagaaattaatcaatttcaccgaaaatcacaacagtttgaaccacgtataaataaagaattaagatttaaaaattaaaaaggaattgctaacaatttagcatcaataatagaaaaataaaacggatatattcaatttggtgctaaaaagataaaacggttcaaaaaccgttgttaattctgattgaaataacggaacgattgggattgctaacaccaatttaaaacaggcatgtacagatatattttttgactaaatgtacagagggataccaattatctttgaccagcaaatcctgggccaaattatttataaaatccaagttatatttggaaaatttacatatatctgttagattatatccatctcatctgcacaagcctgaattctttgaatgcgcacatttgaaggaataataaatgtgggtaatatcattgtgttttgcttaatcactcatatggcataaattataaatattttatactttctttttctacgggatcaataaattttgcgacgacaataaaaggtgagaatttgaataaaccctacaactatggaattanaaataaataaaataatgctattagngtattgattatttaaaaatggctgcttgatgttcggatcagaattgatgaggttcgatcacaaaaaaaatttccaagtggaaagcagcggggagaagagaggtgtacaatttgaagaaatccagacaacag

SEQ ID NO: 15083 - DNA, 1349 bp, Heterodera glycines
agcagcagttatactgaattcattgacgatgaagaaaaaaaaacaattcagcatatgttttagcattttggcataaaaacaatggcaaaaattcattttcgctgggacgtgaaacagacacacagattaattttcgaaggaacaacatatttgatcgaacacatactatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaaatctaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccattttatagagcacaaaattctctacaatattcaaaaaaccgcatgtctctatgacttataccggctgaggtatgggcacttcaattttgacgtagtgtaaaatgcactattttcttaagaaatacagtactttttataggcaccgaaataaaagtcgacgtatctcagcgggcctaaatcgtagacccactattccaaaggcttgcggatcgacttttgcggaccgacattatcgtttttgggcaataaaggtgtattctggtgaaaattgaattttcgacttttgttcgagttcgggatttgaaattggtagaaatggatgtcatattcgtgaaccccgaatacccctagaagatttttatcattaaaaacaaaaaaaatttttatctggtccaaactgtatgtacatgtaccgaatgtttttcaaaaaacccgtaagaaattaaacagcattataccgcctaaacacaattcggagctacatattatatgagttttaaaaaaatttattttaataaatatatcgcattttgtaaaacagacagaacgaacatttgaaatgtacaatagtgacacacaagtcaataaatacatagcgaacaatacgaaggcaggcacaattaagtggcacagattctcttttttattggggaaacaatttatgaaatgattgatcaattctcttcgcgtggctttctctgcttgaattgcctctcacaacgatttggt

SEQ ID NO: 15084 - DNA, 2831 bp, Heterodera glycines
tttttaccccaaattcatttaagatttttttacagaagattaaaaatttttgaaaaaatcaagtacctgataaaaagtcatagacaaaatcaatgatttttcaaaatctgagttcagattcgtgatcagcgtatttttctactcagaaaaaatgctttttataattttactattttttcccatcgggaccacaattctgcacctttgcctttttttgactatatggcataaggcaaaaattgaaaaaccccgaccccgacgcttccaaccacgaaccccgaattttccaaccccgacgtcggggtcgcaaccctagtctaacccctagtatggtatggattcaggctatttttattcttttggactattcctgcctttttgacgttaaaggttcgagtaactgcacaaaaccaccaaacacaactacactaacaccaaaaataatttatcgctatttttaacattacagaaaatttcattgagtgataattaagatttaagtgagggaatgtgcacaagctcttcatcattggggtatttgatggccaatttcgaagacaattggcgcaattgttcttcagtgagaatgggcaattccgagtggaaatcactccttcttagtttcgcggtcggctccccactttcttccttctccaaaaggcgttcaatcgtttgctgacagttcggcattatttttgtgtctttttgctggctaataatgccttcagataacttaagcatttcgctttgaagctttttcagaataatggtgttcggttgaaactctcccgttgcttttccttcttgccatttttcatctgcagaggaatgtttgatttttttcgatttgtcatttgccgtggctttttgttcacctgaaatgccttgtaactttgtaacgctgtccttgcacttccgcgcttccttcagtttcatttgagcctcgtaaccgtacagacggagaagtgacccccacgttgaattctgagggatgaaagaacgacgccaattaatgcaagaaaaaatatttaactcttttttattccaaaatatttggagttattttcaaattccaattctgttcaactcacattcggatgcaatttcttcagcatcgcttgcgccgccttctgtttcccctcgcgtttgttggtggacacaacgcgcactctttcgctgttgttgccgccaacactcaacgcaaattcatgcctttgatggcggagacggcgcgtcgtcagttggattgttgtgttgccataagttgagcatcgtttcagatactcctgaaaaggcgttgcatggcttctcctttcaaactttcaacaatttacagtttcgattccctacttcggacacccacctgaaggataaggtacggtgaaggctgcccggcgcgtgccgacagttcgggaattcgcgtgtccgttatgctcaaaaggtcgaaaatgtgcagaggatcttccgaagccgtcgcattctcttcgcacttctctttgtttaattgagtattttcattgctaaattaaaagaattgtccaaagatggtaactaaatttggataattcggcattaccctctgctgctcactatggcaatgccttcctcatcaaaatcgattcctggcaccaattttagcagtgcgtttttggcagcgatcagtttggcatttttcttgcccgctccaaaaccttcaccaattgcgatcagctgatcgtttgagccattatcatttaattgtaattgatttctgtcgcttccttcatccaactgtttcttttgttcgtttggcgttggataaacgccaatttttgacgcactaaatcacttgtcaattggtcaaacgaagatgaagacggcccagcagcagttggagtgccggagctgaccaatttagcaacgcaatgggaagggagtggcactgctccttagatgatcaaacagtccgaatttgagataaatggacgataaaactgacctcgtctcgttgaagaagtaacgaaccgtacatttaagcaccttttgaacaaattcttaaaatattcactacaaaaaggcaataaatgaaggcatgaattaccatgtaaaatgctaactgaagttttgccctgggggtttaagtaaaaagtccgttggtagggttttgagtcggcttccaatgcgggcacagtgattagtttaacggaggagggaagagctgcaaatgcgaaacaatgaaattgtacgaaacagaccaacagaaattatggcagacccaaaaacatcatcaattggactcacatggccgcgcctctctggtgcttgcgccgttttgcgtcgattgattaagcgttctgcgagcttttttttgcttataaaaattgcgagcttcggaccatttccgaaagcgtaaaacgcaaatgtttttgaatttgaagcaattcttggcgtattcgtacaattgatcggcatttaattgcgaattgtggaggtcaacttcagtctaaaatatccagacttcgttagtgttccttttcaatataaattacattatttcaaataatttaattaaacattcaaatattctttggcctcagtttcgccttaataaggaattaccttaactttaacactcggtgcactcaatttgcataaaatattggcatctccttccactgtgcgcgaaaaaacagggatttttcgttaagttataagcttttacgttaaaaatgtatggaatggaataactcacctttagcttcttggttgtttttctgctgttcagttttctcaaactcgctttgaattttaagcggaaatagacaaggaatggcagattcaggaacccttaa

SEQ ID NO: 15085 - DNA, 3043 bp, Heterodera glycines
cgtctcttccgagtcggatgcattttcctgaatttctttgcttttccgtcttcccgtcccccatttccttacctgttcgtactttttccgcttctcctttttcctctttttgctgctgctactcactgcactgtgatagtgtccacaaatgtcctgcagtgatttgacaaatgaatcgaagaatggccgtttcaattgctcttcctccgccgtcgtctcgagttgtccgctttctttcagttgttcctttatctgctcccaatcggaatttggccctaccgccggagaaagcgaccgcagcaaatcccaaaaggccaattccgcccttttttgctgaaatttattggcccggtggtgaatatttcctcaaataaaaccttttttaattcgtcacgttcagcctcctttttcttcatcagaattctgtcacacaaatcttcaaatttcgattgtttatgtaaataaaaaaagatttaaccaaaatctaccattaaaacagagcttcacattcacagggtccaactgatcggaattcggcccctctttaacccattgtcggaatgcatcaaaagtcgttgactcgtcaattgtaattttcttaaattcgaggaactccttgatcgtttttctgtcctcgtggtatttcgtcctcaactcatcaacataaaatttgaaaaggtccagtgctgttgaaccattcgtaagaagcttaaatacaaaattatattttaaaacatttcttcggcgatttttcattattccctccccaatcgtttcatttacatttaaacttaaagaaaaaagtaccatattttcgaatcgctgatccgcagatatcattgggtagagttgagcccagctactggcgggagtcaccttttagtaacaaaataagtttttatggtgaaaaagtatcactccgtctcattttttcatttaaatgcctttatcggcctacaatcaagggcgtagccagacccttggcttcgggggggggggttgaacccaaaattcgatttttagggggtgtttttcttttttggaaatccgaattcgggagtatgttttacaggaattttaatagccgtttttcgcataaaatgacttgcgctcttacacataatcacaataagttatccgtataccaatgctctgtcgtgcaatccgtgcagcagttggatgaatgcttctctcgtcttcctttcctgccgcttaattcgcttagcttcgagttgcttttcctttacgtattgctcctcagaaagtttgatgtgcttttgaaatacaaccagagcatcttccttgtccatcccttaaaaggagacgttgactaattgtaagtgtcaatttcttcactctttttaccctgtagcgtcgtgtccttagcaaagcttggattttcgatcagaattcgctgtgcttcggcccacgtcgttctgtagtcgattttgtcaattccgtccagaatgtcgctcagtgcctgtcccccgaatgcctttcctttaaatatgttttacccccccccccccttcgtcacttttatgtttctctctttcaacgcctttttttgctctgtgtccttttttgccaatgcgattttcacgtcttcaaagatttctctcctctctggttcagtgacagctttccattgcaattccatggcgaaaatcccctcggctttatggtatctcagagtgggtttcattctctgatgagccatcagcctaaataattgcacaaatcaaaacaaccgccaaaagcactcctttatttaccatttttccaagccttcctttgccattttgatagcaaatcttcgctcgtcctttgggaatggccaattaaagtattaatccattggccattaattaccctctcttctttgtaccgctgtgtcttccatgcgttgaacacttgcttcttctcgcttactttggccagtattttgtagcgcggatcattctgaatgtattttgacgcctgttcccaattcatattcgtgttgattcgcttctcgttgcacttaaatgcttgttaaatgaatgtttgtccccttccattgctatggctttgccttgtcctgcagcatttccctgaatttttccacttgtcttttcttcagattgtattcagaatcgtcctcctcctcctttttttgtgtaatttctttcgcttcgatgggttcgtcgctcttcttcacaactaaggtctttaaagtcgcttccattgccttttcaatttcggaattcgatgaaagatgaaccaaatcgggctttgattcgttcgctgcatcgctttcttctttctttgtttttgtttctgaaaaaagataatatcgttctgaaaggaataaaatgactataaccgagctaaattttaacgacacttaaattgaatgttctgggattacatctatgacaatcattaagaatatgattttataaaggtttatttttgcaaaaaagcactaaagatcgaacaaatcaacaattgattaattcttggtcagataaagcattccataatggagtagatgtttggatctctaagctaaaagttgttgtgcttattagaacattcgcacaaaggaatttgtttgaacttattaaccatactctgatcaaattgatgatttcatgataagaacccttagaataggttttgtgctccagagcaaaaaaaaaagagaatggacttaactttgttcagcgcttcgggctttgaccatgttgtgacctttgtttgggtgttgtaataataaggctttccttccggtgttttgtactccttccatacagaaagctctttctaaacaatccaaagtatccttatgaatttcctcccatcaaatgacctcttccttggtctttaaatcgtccggcttggtccaggaagacacttttgttgccttattgtaatagtaacttctgccatcatctgcggtgtgttgggtacaaactgaagttccgttactcacaccggcggacgactcagctttcatttcatttcaaatattcggtgctatcagcatgagctgtggcgg

SEQ ID NO: 15086 - DNA, 3013 bp, Heterodera glycines
atgaaatgcccggaaagtgcatttggcaaagcaaagcattggggggggggattaagagaatagaaatgcactcgataatatgctgctgatatttatgatctttgttgattttttatttttattgttgggcagcaaaaatggagtttgggtttgaataattttttttcattgaaaataattgtaataatttgtaaaaaaattaaaaaatgtaaaagtgagaaaagccgcaaaaaatgtaaattaaaattaatggaatggactttgtgttagggcttcaaaatgccctgctgatttctcagatttgcaccgacttgggcattctagtgaatcgaaaatgccttttttaaactgattttatgtcgaatttgactcaatgaattgaaaaagttcatcaagaaaatagaaatatccaaaagcgatcgttgggtcaatagaacagaaaacggccaaaagacaattgggagaactgcttgtgcttgcagttgtgggcactgatcgcttcactgacgtcgacgacgattccctggaaacgcacctccatgaacaccgattggaccacctcctccccggcacagtccaagcgatggccaatgtgctgtccctggagatgaatgagtgcattatgttcagtgtggcgttctgtccgcgtcgtcctccaccacctgttcgatgtgctgcttgccaagcgcgagggattcgcggaatcgcgcgttgtaaatgcgcacttcgtagtccgtccattttcccgtgccaactacaaatattccttcgttggcacagcccgaatagctttgcgagttgctcgacgcactcagccgcacgcgaccgatcacttcgccttcgatgggactgaaatggcactttgaaatttcgatcgttcaataattgtgccatcacctgtaaattttgggactcattgtttgtctgttgtcactttgttcaggcgattcgcccgacgaattcggctcttcgggccgaacattcggacaaacgatttcccacccgcgcactccgttgaaacggcttaacaaacacgggagtcaacactgatgcttcttagtcagtcaatttcgcactattcgacctgtcaaatttaaatgggagtccctcgagggcatttgcgcgatttgtctcgcaaatttggccggtgcacatgcctaaaaccgaggggggtatttgacataatcggcttgcgtacagtcgatcagatgatgggttgggtcgatgggtttgtcctctcggaagagttccatgcgcacgaaattttcgtcgcccctcggcttgggccgcgtcccggcacattccaaatctcgtgccacgccaattctttggcccgcattcacttcgccaccaaaacgaaacagctggacggaactgatcagcgcgtgatagcctaatcagtagggagggcggggggagtgatcagccgatgattggctcacccttccagttgcccattattgacaattagcattgattgacccacggtgcccatcctgccattatccccaccctggcattgacactgttggctaaccctgccattggcctcggccgtcgatccgaactccctgatccggcacacattcgccctttgtcccctcctgcgctcggctccctcccatcggacgataagccgaaatttcgccatcgaaaggagcgcgcaccacggcgaattcggggcaactgaggtcgaccgcctcgacaaattggtcatttcgcctgacatttacaagtaaattttggggcggggcgggagagaatggcaccgcaaagcgcgaaaatggccacaaaaagagtcggaagggcaacgaatgatgcgattgatggcatgggaagagggggagggaccgccggcggcacaaacggcggacatacagccgagggcattggcaaagggacgatggaggaggaaaagcaaaagggagagagggaggaaaagcatggcaaaacgaaagtgagaaaaggaagaagataaatcgagggtgcaatggcaaatttcacaccggcaaaatttattaaagtcacatggcccgaaggattcttaagcaaaaattaaactttttttggcgaattgaatgacactaattgatacataagggcccaaaaattagcactttcccattcccaaaatcaacaaaataaaggaattgagataagaatcatttcattaatggtggtgtcccctttcatcttcgcaaaaccacaaatactaatataaatggggtccttattaggagatgggaaagaataatattagaacagaacaattggacttaatactgtattttctaaaaaaaatcaaaaattcattggataataataataattctgtcaaaagcaaataaaccgtacttttgagagcatgaaaaattaacaaataataatgttaaaaatgagggtcaacaagttgaacaaagggaattcattcattcagtgcataatgtacgtgttgtcctcgtccaagtcgcacaaatcgccatggaaactgatctgaatgcgaaagtccaagtcgcgtgggttgcggacgttcgggacaacgctaaaaacgccatggatttcctcgtttttcttcactgtcagcgattcgtaaaggtaaaagactgaaaaaaagaatttccggtaaaaatggaaagaatcaccaacctgtctgtttccaatgctaaaaacattgaaaataattcaattaaataaaatgttgttttgctgtgcccaactgaccgtgtatttgcagtccggagctgtgctgaacccaactcgtttgtgacatttggtgaattcgacggtgaagaaagtgaccaacgcttgcacataatcgtttcgaatgacacgcaaagaaaaagtggtctcaaaggcaaggtcggacacttggacggtgtacaagtcgacttcctaaagcaaaaagcatttcaaaattagcctttttaaagaaatctttttttttaatttttggtttttgtttatctgcagtggaggaaaatttttttttaagtttaaggcaagagagaattca

SEQ ID NO: 15087 - DNA, 2075 bp, Heterodera glycines
  misc_feature (1955)..(1955): n is a, c, g, or t
  misc_feature (2007)..(2007): n is a, c, g, or t
atcatttttatggctttttcctaaatgccattcagcgtcctcgcaaactgcgcgtggatccgcacttgtgcgagcgtgcgcttgcgcaggacggcgacttccccgcctatatggacacggtcggcacacgcatttgtacatcgacaaaagtgagcagaggggtggggcaacgctaactccacgaactttttcactcaaccctccctcacatcgacacaccccaattttccattaaaatttttccaaggtattggccattttcaccgccggaaaccaaccattactaaaaatttttttaattttaaattcccaaaaattcgtcattttgattattgttagtaaaaaaaaaaattatgtcgagaaaatatttcgaaaatttaacggtaaaattcaaatttttactgtctttaagattgttgccaaagtggccagtgttctcacggatgagccctttcggttgccgaaacaatgcgtggttagcacatttccattgaattttttatccgtttttttaaatttttataataaattttatataacattttccggttagaactggtgtattattcattcgttttttgtatttttagcacttttctcgtctcattctcttcgcttattttcgcgaggcgtccgtcgcattttgtgagggcgaaacggcggcggacgcacaaaaagacgctttttgtccgctggtcagacggacgaaagcgtaagggtcaaaaaaaaaaattttttttttttgcaaagagacaaattgaagaaaagattccctttttcggagccaaatttggcacgtcaataaaagccaatgttttgaaatgaatgttaacggcgtcaatgctaacaattactagtagaatagttgggccatgtacaataaatcgaagacatttacgactttttttccgttttcgagtctaaaatacctatcaaaaagtactcaaaattctattgcataacgtaaatttttatgttatttgctccattttaagcgaaatccacaagcttcgcaaggagcgcgaagcgcaagccaaagagcggcgcacgcagcgccgtcgcgagcgcatcgagcaaagcaccgtttgggagcaattgacacgcacattcaccgtgggcattttcgtttgaacattttcaaaaattgatattttctaaatcaaaaaattctcgtctcttgtcagcttttttgaaaattattttttcgctgtgctttaggccggcagtggtgacgacgattcggacgaggacaatgcggcggagggagccgcggagcggtggaagatggagccgatcagtctgttccagcgggtgaccaccgcactgtccaccaaagcggtgaacatggtcagtcgggacaatggtggacactaatgagccactaatgggtgtggtaatgacgatgaaaattaagcaattaacttggtcgtttcgtccggtggtgccggcagacgcggaattttgcaaaattaacgaaattgaaatgaaaattgaaacaatttaaaaaactactaattggaattcaccatttgttgtccattggttttcattttccaggccgccatgctttacctaggcatcgatttgctgttgtgcatcgtcttcttggccgtccaaatggtcggtgcccattgggtgcaattgtctgacattttccggtatttttaaaacatttatgtatatttcctgggatctttaattttggggtacttaactgtttaatcttctactcattttttgaaaaaattatttttcatgaaattaaaaaaactactacctctttagcaatttcaaactttattttccgttttttcaaaattttaaaaattttttattttttagggattgccgattaccgatatttttgagggtcggatttccgattcagtcacgggattcatatttccaaaattttgtgggcctcggaatgccatcccttcttttcacctatgttncattttccgagcaacaaatgtcttgtaaccgcaccgatggggatggtccccnaaagtgaactgaactcaccccggtttttctgggttcctcagctttttaaccatctccccccatttcag

SEQ ID NO: 15088 - DNA, 1645 bp, Heterodera glycines
atttcctttttcctctcttccacagattcagtccagctccgagtcgttccgcgtgctctccttcctcgcccaatttgttggcattcccaagtccattcagacggcgccattcaaacatgtacagagatggcatagccaaataattaatgtagaacaattttcttttagtacattctgttgttttcgattatagggaaaccaaaggcattaaaaacgggtcaaacgattacttcaaagaaaaattaattcagtggttttccagtgctgccagaggggaaattcttgttttttaaaaattggttagaaaattttatacctaaattatcggactattttaatttcggttatacttttctcattcgaagttttgttcatttttcccttgcaattattttaggttctcttccgtttggtgtacaatttgaatttgccctgtgcgtttgagcgtcaactgagtgcactgctcgacgttcttcccccgccgctgttcaccgattatggcgcacaacggctgggcgccgcaattccgatgatcgacaaaaagtacataattaatcaaacagacaaaaacgaatttttatcttctaaatccttcgaggattaaaaaaaaactgaaaaaatcggaatttcaaaaaaaaaaaacttaaagaatattaggaaaatccattttgtatgaacttttcttatatctattcctggctaattaaaataaacccagtgaactgctccaactccttctctccgtccccaccggcagtcaggggccaaagggtggcaaccgctctgtcggtttcatcacctttctgcgctatgcgtttggtcaaacgcaacacgaacgcggcaccaacgcggaaaacattgaaattttgaaggaccgacggcgaacggtaatttggcaatggtaaggcacggaattgccacggcattttggacaaaaataaatatgtagccacaaaatgggaacggagggcctgcaatttggtccattaacaaatgccaaatgttctcttcaggcttccaatgccaagcgaagtgaacgccgccgcgttggttctgtttgcgatgaaactgttctttgggcttgacggggaagaagacaagcagcagtcgcgcgatggcacaaagtaaacaaactgaaaaacagagggtgcacttcctttctttaccttctatgaaaattttttgatttgtgggagggtaacggatacactacacccccccccccccgttccgaaatttttaaaatttatggtgaattactaacaaaatgtttttttttaatttttccaaaatcgctgaaaaatatttcaaaatatatttcttcaaacttttcgtataaataaatttcaaggacaaaatttttttaaaacttcgaggggggagaacgacgggggaaatgagctgctgccgagggcgactagggtcagaggcaaacgacctgctcccaaaaataaaaaagtttattttggaattaaacattttcagcgaagcgactcaatgcgccgacgatgacagtccgtcgccggtgttcagcttcgaccattggctgctgcaacttcagctgcgcatgcactgctggcagggcacaacggttcagaaggtgttggacaacacgtaagtggtggtggccatacatgcacaaggg

SEQ ID NO: 15089 - DNA, 2788 bp, Heterodera glycines
ccttttcccttcacaacatacgcatatttgctcaattcttccggcattttcaacacgcgaatccatcgtcccgttgccgtcgctgttggccaaatttgtccgttttggggtatttctctgtccacccattctctaaattggtccatcatcggccaaatcctcgcccgaatcactgccaccgcgtgttcatctccatcccccattctccgaacttccgcgacaatttccctggttttatggacatgcaacggacctttgacacgcaccgaacaattcgcgaacattcgtaaggcatcattcgacccattggaattgagcacgacgaaacggaaggactgatcggaagggaagggcagacggagcagttcaaacccagctggggcatcttcgctgagacgatcgatcagaaaagtgcgcagagagagagaagaggcaaaagtggaggatggaagagaaggcagagaggaagaagagactacagcagaagcagagggaggggagggacgaaagataaaaagataggcagaaaaaaggcaaaaactcacaaaaaaacaaacctggcattctgtattcgtctaaggatgtgccctcctttaatttttcttcttttctttctatctttcgtttaccacttccttcttcttttacttctcctcctctttctcctccttcccctcctcctctttccctttctcttcctccctcttcttcggcctctcctccttttcttcctctttctccttctcttcctatttccctttctcttcctccctcttcttcagttcctccttctccttttcttcctctttccctttctcttcctccctcttcttcggtccctcctccttctcttcctcctctttctcttccttctcccccgtttcttccgtttccgttttgctccttcctcccctcttttttgtttattttatcttccactactttcgcctcttctgtttcgtgttccttcttccgcccctcttttccccctcttccgcgtcccctcttttctcctccccctccctccgctccatttgcccccgccccgatcacttccaattccaccgtcgcttcgttcgccctcctcgtcatccccgccccgtccctcgccttcactcgcactttggccacttctccctctgccattggccttttcaagcgaaggttggcccaacatcgtggccactggcactgctgagagtccaatgcgaacatttcccctttctccgccgcccctttttcgttttgcgttttctccaacgaaaagcgacaaattccgccaattcctctgtcaatgtcaatcacttccaaacggcgcagaaggaaaccgggggaagagagctgtaaaaagcgaaaaagaaggctaatggacaagaaaactgctgccggggaaaggacttcggggacgatcacttcggcggggaaagggccgccgaagaagcggggagcattgtcattgacatcgaccaattgtacttggacagacgcgtggtcaccggtgccgtctctctcgaaaagcagagaaaatgagggggaagaggatgggggaaaagcatcggatgaattgggcgaggggaaagggggctaaagagggacaaagcatttcattaagtgatagaccaatccgtgcccaacacacgtccgcttccaacggtctgttcagcttcagggtgaaacaagtcccgttggtacgcacgacgctgaactgctcggcgttgtccgactttccgtttccatttccgtgccggaccaaatgaacgccggtcaactcagtcctgtcgtttcctttttgtttctcaatccgatctctgtccatttcagtttcggaacatattttgacgtccaattccttttcgactggccaatcttcgtccaggaaaagcactcggggatgtgccacgagttgggtttgctgttgctgcgcttggttttgggttaaatatgccaaaagacggaatggcactcacaaaagaggggaagacgggagagaagggccaaaaagaggcaaaaacggagcgacggacagatttgaatggggaaaaggaccatttgatgggattggttgagaagtgttcgcaattgtcaaatgaattgaaaagttcttccgacgagcgaatgaatggccacggaaagcgacggactgagccaatgggtggccaatgcttttccttggctctgcgcgaagcgacccccgcaaaatcggcccgtcccccccccttcgcttcgttttgtcctccgttatctcggatttgcattgtttgttctattcttctccgctggctaagctttaattaattcgttagagaaacaatcatttcgctaatcgaacaacaattatttcaatccctcaaaatgttgacaatcagcggaattattttattgttttaatccattcccacttaaattgtgcgtctatgcagtttaattgctcatttagccgggattatcctcttatcctcccgcgtggtgttcgtccgtcgtccttccattttcgttttgccatttcttccccaatctgtccaaatgttcctcttcttccttttcccctttcttctccaattccgtttcactcttcccaatttgcttaatttctcttcgttctccgactttttgatcgcaaatcgcattaatttgagttcggttggaagtgccgaacaaattaagcaaaacgaccaaaacaaaagctttattggcttgtggaacattgagcagatgtcccgctgcagcctcaaccgaagtgctgaactgacgtacaacggatacggatgcttgtcagatgggggaaatg

SEQ ID NO: 15090 - DNA, 1497 bp, Heterodera glycines
  misc_feature (40)..(40): n is a, c, g, or t
gttggatcgcatgagtcaaatttcatgcctcaacagagtntggtgctggtccaggctgatcagttcttctgccagtcgcaagtgcactaaaagtgatcggttggcattggcattccgtcggtttgccattcattcgctgctcactcacattgttgcagttctgccgcactgacccccggcactgcccatggccaagacggactcgtccaatccgctgacattggccaccgccaattccaagtgccggcagttcagcgaaataagctgcagttggcgcacaatctgtgccgaaatggcaccgatgtgctcctctctctgagacttggacagttcaaaattctcctataaaaagggaaatggcaaatgaaaaaagggaaggaaaggaaaggaccagaaaagtgtccatttgttgctcccgtcctttcaactcacgaaatttgtcacttttgcccccggccaacatttcgaattcgttttgcatttcctgcaattcctcctgtgcctgtgccatccgttctttcgtctcttgcagtctcaaaatgccaaactgagtttcttcaatggcatttccccctccccccgcccggcccactgcgtttgcatctgcgcaatttcctcgttgtcgcgttggattcgctgtgcgaaatggtcgcgctgcgcctcgggcgtttccttcgcgttcaattcgcttacaatggccgccctccgctcgcgcagctcctgcagctgttcctccagcatcacttaagctccatcccattgtcatttaagctcccccccccccactggtctgctgtttcagcggtgagttggccaatgccatgtccaattgctctttcctccggccaatctcctcaaattgggcctgtctcttggccaattggtcggctaattgctccgcttcgctcgtcactcttccgaaattcctcctccaactcatttccctcaatttctttgtcccttttcctctttccccccaaatgccaaccatttcgttcattttcgtcgcattttccgctttgattcgtccaattcgttcttccaattcgctcgccgtttcttccttttgcttcctctccctgaacgttttctccactctgtccaccatttctgaacgttttccttttccccgtattatttttgctcaatttgccctgattcgttcgatttgcctccaaaatttcgccctccaatgcccttagattcgaatcggtgttttgtcggtcaataatctgtcggcatttgcttttgctttgctcatttgctaattacttgctaattaccgtgttgtaatccgcgagtgttccctgtaactgcttcaactcgttggcctgttcttctgctctgtgccaattgttctttttccctcctttttccttcttttaataatttacctttgttcgtatgccaataaattctcttttcctttttccgccttttccaattcaaagccaagcgaaacgacctcattctcaagtgcgtttaattggttgttca

SEQ ID NO: 15091 - DNA, 567 bp, Heterodera glycines
  misc_feature (425)..(425): n is a, c, g, or t
cacctttggatggcccaataattaattagttaattaatgttttatgtattttcaggcttcaaaatggcattcatttgcttggactgtttgcattgcttcttaaacggcattgttgctgcccattgcgcaaattgaacatttaattgccatagtaattaaaaagcattgaaaatgacaaaatacccaattcggcggcgaaaatttaaacaatttttcgatgctttataagaatttttggtcattttgtttgtccttttctctgttttttgtcacttttttttgcggaatttgtcgaaaagtgtgaatttaaccgcgtgggctgtgccttctttttcacaactcattcattactttcccaccaacaaaaattcactcattcgttcgtcaacgtcaaacaaacgacgaatctttctttttcggggggnggggggggggaaaaatcccatcaaacaattccattgattgaaaagtggcgtaggggaaaaaaacccccccccccccacaaaaacaccttcatcaaagtctccctctcccccataattttcaactcttagtcacattctattt

SEQ ID NO: 15092 - DNA, 1337 bp, Heterodera glycines
aacagattccccacccccccccccccccccagggcggcactgttcgagaatggcggtaccgagacgagaaaagtctcgaattgtgggagggtgggggtggcggcaccgatgaaccgtctgcggttgataagcgttaagataaagattagtgttaaaattaatgaataagtattatttaaaaagacagaaaattgaaaaataaattaaaatatttaagttgtaaatttactcctattttaatgccagaatccccagacatgtgttagtatttaaaaaatttctaaaaatttaattaggttcaagccaatgaactgcatctgttttttctctgacctgacttcaggcccagagaaccaggcacagaccgaactttataaagaaatatatttaaatgatacatatgaaaaagcattggtattaaaaatgaatttttgaataacgagaaaaagtattgcccgaaaattagtgctcaaaaatgtacatcatttaattctctccaatatgctaaattatgtttaaacgcaaaaattccacgtgaaaaagtgttgccaaggggaggcaatggagagaaaagaaagagaagaaaaagaaaaagagagaaaagcagaatgccaatgccaatgccaatgccaaatgcctacggggggagggcgaattggcagtgccattgccaatggttggatttttgtctactcattcatcactaagtattgtgactttacatcaaaaaaaaaataatgcacagaaaaattgaaattagaattgtccaaataaaaagattaagattaaaaaaacttaaagttatattttttaaatttttaatggttattttaatatttaaaagtggtttagggcctttttttttgatttttttttaatttttttttaaaaagattttttgataattttttttttaattttaaaaaaattggtttatattccagttcttttttttctttcgtgttgcgacacttgcgccgccaagcaaaaatggacatttgcgctgctaattgtaagtcaaaatttattttaaaaatttcaattttcaacgaattactcaaaccacaatgcaacaacaaagaagcaatttaaaaaaatgcaaaaaagtaatgaagatttaataagccgcattcatacatgtaaattttagtttactaaaaatttttggattattttaaaatctgaatgaacggtgtaaatgagttttgtagggcggcgcaaatgttggtacaccgttgtattaatggatgataattatttgatcgattcaattggcgtgccattccttcgtcccccacttttaatggcattcattttcgattcgcctgcactaatga

SEQ ID NO: 15093 - DNA, 943 bp, Heterodera glycines
ccgttcggcaccgctttaaaagccttcccattcaaaaccttcattgatacaccattaataatgaatgatcctacccttggtcgttctacaaatgacaacaaaattttttccagaatttacgcgttagcatgaaagatgtctgcccgaactcatcaccagcatttgatggtgccaccaatgttccgttgttggccaatacgcttaatccggccaccgccgacggcaccggcgcgtccagcacaatgggatgctcaatgtgccagtcgtaggtgcgcggagtgtacacgcggaaaatcggccaaacggtcagccattcgccgttgtccgtgttgcattggtggtaaacgcgcaggtaaaattcgggcctatcaaaagtataaaatttttttattttttagtaaaaaattcacgtccagacctttgcctgggtttttgcgtaccgcttatttgttagttaaatattgaaaaaactgagcaaataagcaaatttgttaaatatttaaatgctttatataatttgcttgaaaaatttaatttacttccataatattattttaagccaaaattatattataaatacaattattatgcttaactgctccgtttttattcaacaaaaatttgattaatatccaaatgacacccaatgtttaagctttgacaaattttcattaatttctgagggtcaatggcaactcgtataatgttgtaaaaggaaactcgtattttaaaaaaaccataagcctacggcctaagcctaaagcctaggccaaatcgaagcaattgtacgagttgccagttgtacgagttgtcatgacaccatttttgataccgattgatgctaaaccaatcatgatcagatgcgcaaccatccaacttccataagccagtcgggtcatccacctctgtgaatgtcgccttgtcgtctgagtccagcggattt

SEQ ID NO: 15094 - DNA, 2305 bp, Heterodera glycines
  misc_feature (2284)..(2284): n is a, c, g, or t
ctttttcgcaaaattttccgatttggggtcaaaatcccaatttagctgatgggggccgttctaatagaggttttttggaaaaatgtcgaaatatgggcataagccaaaatatggaaaaatatggaaatatggacataaatcgccaaatatggaaaatatggatatagaaatccagcctagaagctttaaactaagttaaaaacatgtttttcgtgcgtttcaggcctcactcagtccaggaaaaaaatatggatttccatatattcaggccctagtcataagagattgattggaacatgtttttttgcggttttttagcgggcccaattctgcactttttcctggccgaacagccctacctaaaatcccaatagtcggcatcaacaatgctttttatttatcaatctctttttcacatttctccaccatttcttatgaaatttctttttcttttttttcctctaaaaatttttccactaaatttttctcgtaattttcatcaatttccaggtcccggtcccggttttgcccaaaagtccctgtcccgctctactctaatcttttttccacataatttccgctttcccagaaactttttcacatttgtttcatcaaattttgcttctttgttaattcatcttttttcatttgcatctcttttctctccttctcatctttttccgtttgttctttacgtcgtttctcttttaattcgttaatttcgtttgttttttcttcaatttcttttttgtcattttttggcatttttttgtttctttttgtcctccattagttcgccctccttttctccttccattggcttttaacaaaaacatttatcaaaaacaattacggtgaagtgtacgaattggcgctatactttttcgtcagtaaacattttcgtcagtgaacgatttcgtcagtgattttcgtcagtgaacgatttcgtcagtgattttcgtcagtgaacgatttcgtcagtgattttcgtcagtgaacgatttcgtcagtgattttcgtcagtggataatttcgtcagtgaacgttttcgtcagtgtactatttttatttatttcactgttttccattttttttcgtcagtgttccaattcggcagtgaatattttcgtcagtggctatttatatttcagtctcatttttttatatataattttctttgtgtaattttattttaatagttgagaatttgttttattcaaaaaatgggcttaagcaccataaaatgatatgatttaattatttcaccacaaaaaaaactaaatatttaaacgcctatttaatttcaaacaaattcgacagtggacgattttgtcagtgaattccttttttttaaaaatgcttaattcaattcaaaagtgcaaatggtatgcacaggcccgaagatattcaagcggatcacggtttccaatgtcctgtaaaagagcatttaaattgttgtcttgtctgacatatttcccctttcttgctgcgtgtggcccccttattccatcagcaggcgcaatctgataatcaataattcgctgagaccacatctcatcttcttcaatcattttccggacaaaaccgctgagtcgctgatttcctttaagatgggcattccaaatggcatgccagccttcaagctgtaaaaacttaaaaatccgatccatattcataaattataaaatttaattcgacaaaaaaataaccctgtagctcagctgttggattgagggttgacaccacaatgcaaaagtagttataaacgaggccaataggaacaaatgccaatgcttgcaatgacctacggtgaaataaggctactcataaacaaacaaattttacaagcgaatttttcccatttttataacagtgtttttgactatttataatattgtcctagccctgacctaatgcttcgttggaactcaatttcctgaaggtattgggtgtgtaggttttggagcctttggatgcggcggtaaattgcctgcccaaagtgaaaaaggcagccatttcggattgcatttggaaaaacaattcgagcagaatgaatggctgccgattcaaagtcactcattagcctttgcggcgaccaattgttgccaatgctgtctctgattgcctcaaagaaacgtacatatgttgccccctccttatttggcaatagcccataaacgcatgggactgaacaatggtcgatgattgcgctcattgtgtacaactgagcaaatccccgcgggcatgactttaacggttaaaaaacagtaattaaagaaaatgngtaatatttttacttcaaatg

SEQ ID NO: 15095 - DNA, 483 bp, Heterodera glycines
atttttccatttttgtattaattttctatttgtgcctaataattttgcaatttttctctcaattttgctttgatttttccattcaaattttcccgtttccccaacttttctttaattgcatcaaattttgaacaatttcgctcttttgctgatcagtttcattctttttataactctgatcacatttgagaattttttgatcatccgaattgtccatttgatcaatttgatcatttcccatttcatcaccgtttggttgaagaaaatgaataaattccaaattttcattttgctctttttgttcaatttttactgtttgctcactttcttttttgtccaatccgtcgccaaatatttcatcaaagtttggtcgaattttggcggattcaattttataaacaaagaaaattatggaaaatatgaaatgccataaaagcatttttgtggaaatcaaatttattgctgtaaatgattatatttaat

SEQ ID NO: 15096 - DNA, 3608 bp, Heterodera glycines
ctttggcatccatgatgatcagccacattgatccccaaaatggtccgcaaaagtcaatgtgtattcgtttccacgatctttccagtgattcccacctgtgcaatggcactttctgctcatccggcgcctcttcttggcaaactttgcaccttttttggattatttcgattttcttatcaatgcctggccaccccatctttttattggcatgaaaaattaaatttaaaaaaataatatggaaacctgtcacccttaatatttagtcaattcttaaagctgtctaaatgtatggttatgcgtgtactatagttttagtttgtgtttagaccagaataccatgcttatatcaactgaaaatatcaaaatccttctaattctatttaaatattaaatgatttcctgatttttcacatatgtttctgatttgaaggcaatctttttttgaaaacaaaaattttccgctcactggccagctttctctaccggggaatttcttgtgaatttttctatgtttttcaattcatcgacgaccctttttttgttttcataccacttttttttcgtggcgtgcttttttcaaaaaaatcgtttaacatgaagaaggggctagctatcctagaatctccaaaattttctgttttccgttgatatttttctttttttttctcttttggtttttttttgttatgaaatgttggtaaacttttcaaattgaaatgtaattaaattcatcatattaagaatgttaattaagactgtttaaatccgacaagagagccgattgtttttcagaccgtctttccaatatgtttttaattcccacttttgacttccgggacagtttgacctcaatgaaatgttggccggtgcaagcagcgccaatagcagtgaccaccggaattcggtcattattggattttattaattcacttttgaagctttaatgtaagcaattgaagcattcgaaaattggaagtctttgtatatttttatttgttttaaaaatgctagaagaaaaaagaaaaaagtaacaacaaacagaaaacaaattttaattgaaaagccttaataaattacactcataaattacaaaattgaaattgttaagcaatctcttttttcattcgataagcctgtttttgaaaatatgtcttgatttgcaagcaaacaatttaaatttatttttaaaaaataataattgagaaagatcagtcgtaaactgtgagaatttccatcccaaacaataaaataaaaaataaaaattttttttctagttttcatttggttaatatgtacaaatataatcttacaaaatgacagaagtaaccttttaaataacagaagcgattttttttatgtaatttcgttcattttacgaaatgttcaaaatgaaaattttcgagattttctctaaaatgacaaaatttctattctttttttcaagaaccaacgatcagttttctaaacaaattcccttttccatattgtctcagtgttgcgccgcatccaattcctaagtttttggcaattattttgaaacttcgccaagacataaagcaggcgcaaaaaaatataaaaatttttcaaaattctagaaaaatttgaagaaaatttttaaagcttttttaaaacctaggtattacttaaaacaaaatttgtagaattaagaaatttaaaaaaaacatgaaaaagttgcaatccccaatacaaattgtaaaccgtcaacaatagtcctttattgggtaataataaaggggtacaactggaggccccagcccagaacgtcctcgggaacagaggagcgcttgagggggtccctctcgcaaagttggatcggccaaatcccaaaagtgatcagagaagaacgacggggggaggataacaattgaagggaccgccccgtttcgccccagggacatttgttaatgatagattagggggaacaattaaatgtgttaaatgagtaaatgatcgtatctcagtttcttgaatttttttaatcactgtgatcaactggtagcaaattctcttttccatctggtcagagttgcacttccaattcccaattttttggcaattatttcgtcagtcacttttgggttggcttcttttatttcaaaataatgcttcaacttttttaatttgttctcttctgaatagaaaattattatatgcttaaaaagaaaaacccttacttttatgatcatttggcatcaattcctttttccattttaaaaatgttgcttcagaaatgcccaattctttcgcaaattctttctgtttgccttggccatataattctttaaattcatcaaatcgttcagtgaattctctctttttctcctcataaaaactctttcccatctttttaattatatttaattcttttttccatttgtatattttatgacgaccaattcctaataattttgcaatttttctctcaattttgttttggtctttccatttgtattttcctttttcttttaatttttctttaattgcttcaaatttcaaaattatttgtcttttttgttgatcatttgggtccgttccattttctccaccaatttgatcaatgcccgtagtttcattttgctccttttggtcgttttgttcaatttttattatcacaatttcttcactttcgtttttgtcccatctttggccaaatatttcttcaaaatttggttggattttgccggatttaattgcaaaaataaagaaaaatataataaataataaatgccacaaattcatttttacttttggaaattgaatttattgcattaaatgaatttatttaatgttttattcgcattaaatgttattacgcaattatttttcttttcaacaatattttaaaaattaatatgtgattcacgacgtaatttatacataatatggaaatcaattttttactcagattttttaagaaataattattgcaaaaaataataatttataaaataatttattttatggaaaaaataaattaaaaggaaagtgtagcaatttactcaaaatgatttttttttgggcacataattcaaaaaaataattaattgaccataattggcttcatatccaacaaatgttgtaaattgcttttttaattaattaaacaaataaaattaaaattttcctttaatttcaaaatattgcttcatctttttttaatttgtcataatttgaaggtttaattagcgctgaaaataataaataattttaaaaagttagaaattcgcttacttttattgtcttttggcaacaattcttttttccattttatcaatgtcagaaatgcccaattccttcacaaattctttttgtttgccttggctatataattctctaaattcatcaaatcgttcaatgaatttgcgctttttcatctcataaaaactctttttcattctgttctttttctttaaatttaatttgtttttccatttttgtattaattttctatttgtccccaataattgtgcaatttttctctcaattttgctttggtttttgttttcatattttcctttttgcttcaatttttttttgattgcatcaaattgtaaaattattctctcttttgctgatcatttatattc

SEQ ID NO: 15097 - DNA, 2045 bp, Heterodera glycines
  misc_feature (1443)..(1444): n is a, c, g, or t
acacagcaacgccaaatcccaagcagttcatcactccattcggccaattcagtacttgcacagtctagaataaatttattgtcagtattgtgacgataaagaggaccaaattatggaaaatttgtgagggatggttcgatggcaatcaatggagtttcattttttttactttaaattaaaaagggattttttctctttaaaatcctaaaaaatattgtttgctaagttttcgctatttttcaagtttgttcaagatttttgaaaaaatcaaacaataagttttaattgaaaatttgcaaatttattttgtttttaaatattttttttgccgggagggatacacgtttatccacctaaaatcagttcaaatggtccctctgcgaccagttgttgctttgcatccttcgcgcgatagtccaccgcttttgcccccaattcttccaccaattgcatcctgaaaattgcgatggctcttgcattatttatagactcaaaactttttcgctgaacatgtggcgaccactttttcgactccccaacagcgcagcatttgaattgccattgtgccaacgccaccggcaccgccatggataagcacacgtaaatgttgcgccttatttgggtctattctgcctgtctgaatggtgattaactttttaaaattcatctccgccgttccgtggtcaccgtgacgagtgcagcccaagcagtacatgcgacgtacggcaaagcggcagactctgtgtggctgagtgacgccggtttgggggcgacagcgtttgtgaatgagagagcgaattcggagtgacatccttggcaatggggagggacgacagcgatgacctgcaaatggggatataacaaatctagtaaatttaaaataaactttcgaactgacttgatctccgacatccaaatcctttaccgcccgtcctttctccaccacttctccgctacaatcgcggcccaaaataagagggaattgatcggcttctcccattctcgaaaaagtttctccgattgtttgctgcgtttgtaagaaatccatcctttttggtagacctcggtcaactaaaagagaatttacaaatgccgcagaagcggtgtcatggcaactcgtacaaaaaaaatttctaagaattttcaactaaaacttagaattttcagattaaaaaaaatctaaatggattttttagtctagaaaaactttttaaaacacttaaattttcaaaaaatttaagaaaataaaaaaaaatcagctgaaaaattaaaaattaattttcaccaaaattcacatgtttgtccaaaaacgattcaaggcttcagtatgacgatatgtctgcttatcttatttttctttgggtggctcgaaatgggtcaaaacggatgccggattcgtaagtgttctatccgactgaggggggggggggggacaaaccatanntatacacaaatttccggggcgctaatctagacacgattctaactgccataatttttcggaactcggaattccgtgccatcccccagtttccggtaatcaatatattaacaattaagttttaaaaggaaagaaattaatacagaatttattacaagctgaataaataacgaacaataaaaatttttcaattcaatctagcatcgcttctacgcaaaagcaaacccctccgaacattcgcgactggccaaaagcagcattttgtgaagagtttcgtaatcagggtattcgggcaagtccagctggttgaagcacgtgtgggcggatgggagccgactgttggaacgcgtgtccttttgtatacttaagtgcgtgtttgttagagaggaatgaatttgtgtgctaatgcttacgtgaatttctgtacaccgttcattccctcgagatgcgcgaaaccctgcagcggaaccttcgaagtccctgtgacaaattgaagaaatttggccttgtcctcggcatcgaaagctttaagagcgcgccagaacctttaaatgtatggcaatagatatttaatttgttcaatttgttgcattaccattgaatt

SEQ ID NO: 15098 - DNA, 1362 bp, Heterodera glycines
atttctgtgttgaaattttcttgtattcgctaatttaaatctctttcgaaatcattagccaaggtacaagcaaaaaaatcgaccttcaagaaatcggtcccaatcccggattacactgctttactttgtgtatttgaaattttaggctgatagtgtgaaaaataaaaattggactaaaactttattttaaaaaaatgattggactcataaaatgttattagactcataaatatttgattggactcataaagtgcattagagcccgagttgccattgaccccgcagaagcagattagagttaagtggagaaatcatcgaaaaatcatttggcacttaccgaattcagtcaaacatttgattttgcttagcacttcatttccatagccttcgctcattcgcacgtcaattggatttactgaagcagcctaaaacgaaaaagtcgagacaaacacatgaaaaacgcatacaaacttgagaattagctattaattctaattccaaataaaaatcagccaccttaacacggatgatcacttggttgtcattttggatggttggcattggaacattgctgagaacaagcggtgcattgaatgcgttcactgcccatgctcgcatttgatttgcattggacggctgtgcttgtgctgctgcagttgcattccctgcaagcgaagcccgacaccgacgggcaaagcattggaaaatgcgcaaaaaagtgaaagacgaacgggcagaaaacatcagaataaaaaaccaagagcataacttcaaaatttaaatgaataattattgttttattaacttgaaccagcaaaacactgttcaccaaataaaatttatatcggtataaaaaacgataaatctttaactctgatgtaacgaaatttgatcgtttttgaaaatgtgtctaaattctttctcgagcaattcgtgtagcgtaactccatcatgcttatacacccaccggcctttgtcgctgaggtcgtacctcaaataaattttatgggattagcgtttaatgaatagtgagtgatacctttttggaccagaaactggcgatgaaagccaaatttgtttgttcggagtttgtttattgatcacataagtgcctattcgtgggctaaaattttcagcatttactttcgttaaataaacaattattggtacttgtcggttatctgcgtccagattttcaaaaaagtttaggtttttggctataacttttttcttttgcatccaaatccaacattgttggtatcattcgaaagatcttcagatgctctataagctttacaaaaaaacaaaaagattttttagcctggaataaattttattaagaaaaaaacttcaaaatttcga

SEQ ID NO: 15099 - DNA, 3037 bp, Heterodera glycines
tataaaaattgtgacataaaaataaaatatataaaatctttctattgtactatatcaatagtttaagaattaatttatattttaaggccgaaagaatcaataaacaaccatttggctgcttatctattttaatcctatttatcttcgcctttatctctttcatattacaaattattttcttcactttttgctttgtcgttatagtttattaattgaaaaaaaatcttccaagcttttaattcttatcataaattaaatgtatttttttcaggacagatacttagtttgggagtatttttttcgtaataaatcataaaaatttcgggccaggacgttttcgcgtggccattttcgcgtggttgcatataaaagagaattcataactcacattatattttaccaaaatttgtttcactcttttttctaacgagtttttattttataatttaatgagtttataaactaaattaaggctttttaaattatataatatggaccagcagcaaaaaattaaaacaaaacgaaacaaagttatgttagaacatgacggcgcactctataacgacatcaataacattcacctcccccaaaatgatcccaattatgccaatgccaatgtgaatcccgaaaacattatcaattttctcactggtgtttcccgaaaccatgaaatgcgaccttagtttgttctgaaatttgttattttttgttatatttttataaaattttaaatattttttccgtttgacgcacatccgaccaaactgacaaattactgtagaagatattagccgcaagaaataaaaaaattaaaaagttaagaaatttgtccgaatgcgggttcggattcgaaacatggatgttttgcacaaatccaaccaatttcagtcctaaacagctactcacgcgaaaacggccccgaccgattcttagagggtctaaaaattttagctctatttgtaataaattgtttgaaatttgccggaaattccctgagaaatttaatgatttttttaaaatcgttaatgggatttggggaacaagctgtgctcctgcaaaacccacgccacaacataaattttttgcctatgtaatcgaatgaatgcatttttctttcgaaaattgtgtagttttcaggattttgacggggatttacgacatccattagcaatattagcaccggcaaaattaaaaagtgtcgatttgctgctgttcctccctcttttcagcttcattctcttttcctcctctttctcccctccttcttgcttcgaatttttcctttttctctctttctcttccgtctctgctccttccccaatgctattttcatccttttcttcctctttctccattccttcttgcttcgaatttttcctttttctctctttctcttccgtctctcctccttccccaatgctattttcatccttttcctcctcttccctcgtttttccatttttgctaccaaaaatgttggatttggttgacaaagaaaatttctaaccttttgcaaatgaaagttggataaaaattatccgtccaattgattatttgattgattgatttgtgggtggggggataaggtaaaacgcccggcaaatggtaccatcaattgtagcaattttttcatatctttacttaaaatcaatcaaatttttaattccttatatcattcgatagttctagatgttttctattagcctacaaaatttcaaaaagtttcgttaagtttcaagaaagttatgagctaaaatgttgtaaaaaacttgggtttttgagcttctcaagttataacttttttgaaacttaacgaaactttttgaaattttataggctaataaaaaacggtttggcctttttatgtcaaaatgtttccgcgccttccgtttttgtcaatgatttttcgcctcccattggccattggcaacaatttaagacgaacaaaattcaaaaattgttgaataaaatgtgattttcgttagaatttttggttttccgcttttctcattatataaaaataaagtttccaaaatttggaggaattacagaaaaagttggtcgaaatggatcatcagcagaaagaacaacagaaaagcattgatcagatggaaaaggtgggaaaatgtgaaaaaaggaaaatgaagcaaattgatcagcacattttgaatttgattttcttttttgctaaaatgccgtaaaagatgctacagacgaacgctgatgccgaaaaggagaatgatgacaacatgaaaaataagaaaagcttgagaaaaatgtcatggcacaaattgatgtgaaagtgcagacgaaggaagttactgtcaaatagttaagggaaatgagcaatggttaattactgtacctaccgtaacattattattataattactgtcaaatattaataggatttgttccaatttaagttattactgaaaaggcaattttgattgaatcggtgaattgaagggacaacaaaaacaccaaaagcagcaaggggagaaggggacaaaaggcgagttgtaattacaataatcgatgtatccatctttcaaatatactaatgcgtttttttaaatgccaggtattacaataagcggattttttcaatttacaatgtattacaaacaagcagattttcaaaaatttttatgtttttcgctataacttttttctttggcatccaaatccaagattgttggtatcattcgaaagctcttcatatgctctattagccttactaaaattctttaaaagtaacactgcccaagtgtgcaaatggcctaatggctagtctccttgactgtcccttcttctttcccctggttcaatccctctacagaaattagattattttcaattttttttcttgtatactcgtgggtttcctataaagaaaatatgattactcatagtttttttaaattgatacatattttatccttttttaaatgaaaatcctaccaattgagcttaataatcgcaaaaaccaaccttttttgttgaaaatctgttaacaaattgcacccaaattttc

SEQ ID NO: 15100 - DNA, 877 bp, Heterodera glycines
ggggacctctagagctctttatatattttatatttttaattttagctttcttgtctcactgataaaatggtcctttgtttctgccattttcggattttccttttccgcattcttcggggatgccatcgccctttttctaccgatgacgccctattttgagttttctcttctgctattattccagttgttcccacaatgcattattctgaggaggatttaacaaattgattttgcttttcatgatagcaatgtttcttttccgatactaggcttttcctttatgcttactcccatttttgaggaattgcattgaccgacgtccaatcacgatgcactcccccgattggtccgtcaaaaccctccattgactatggaattcgtcgttcgactgtctctatgcctttggtgatcagaattgaggacggaatgccaaccatttttgtgcgtccctcgcgggcatttaatttccacagattgaatcgcttgcaagaattctggcaccgaaatgaagtgagcggaagaaaatggcattttcagagggaatttgattcaattggaatttaaggcactgagaagattgacccaaacggggaacagaccatgaaatgatcagcagagaaagaaaaagaaaagaaatcggatgatcagacaaattgaaaaggaaggacggaagacaaacggacaaaattgaccacacacatttaatttgatctctttcatgcaatttggaatatttaataataatgttaattaaacattaaaatttgttttcataaatccaaaataatttggtaataaaacacaaattacatcccttcattgactttgtgcataaattggtcattataacccctcattatcataatgcaaacatttt

SEQ ID NO: 15101 - DNA, 2826 bp, Heterodera glycines
  misc_feature (16)..(16): n is a, c, g, or t
ctgagttgggcctganattcgggcctaaacattgggaggccttggagccgagtcggggatgacatttaatttcggaaagggtggctctttcaacgcacaaagtaacaatcacaatggaagccaatcaatccattacgattcaaaaatgccgtccaaattttcaggtggcggaggagtgctggtcggaggagacaaattcggcaccaactcaacattcggtgtggacaaaaaggggctggtggcggacacggacatgcatttgctggacaacaaaacattacatgtaaatgggggggggagagaaagagacaaacagtgccatcagtcaaatccatcatgttaatattgtaccttaaaaatatgattaagggcggattaggcaaggagaaaaacttcatcgacgatttggccgatttgatacggcaaagaaaagaggagaagcaacgacagaaggaacagagaatcgccgaaaggatttgaaaaaaacgatgaacgtggaaatgatccaaaaatgtaccaccaaagaacaaatggataaatttattactttacgacaataaaaattaatccataagggaaaaaagagcacaacacactaattgaacataattagccactttatgcccgaggcgatcattaattatgtatcattatcagaataattggtcatttgtttaaaataaacatgccatccaaagaagtcattccggtgactgctttcaaattgcccaatcttcagtttctttggccataattttgactttttcgttgttatttctttcttaatgtcagtattttttcttttttttgtatttatgaattcccgggacttaaagctttcgtctgataccaagaatgtaggtattgcaaaaataagaaaaaagttatggtcaagaaactgaagattgggcgcctaaagtgcattagagcccaaatttgtttttggttaatagatcacttcataattatttttaggataaaaatcgctctcgattttcgtttttcaccacgagaaaactgttttaacagaaaattttattacggatttatagatttttcaaattcatttatccctttatatttaaatttttaaaaattgacgtcaatttttttcctttctatatttgtctacatttacatatctttataaattttaagccattttctgctccctttctgtgtaacaatggattcgccgtcaagtgtgaaagcgggcttaaaaaaatcagtttttttagcgattaaggtcatttattttagtggcattctagtgggcgcgcaacttcaaaataaaaaaaaagtcaacgacaagacttattgttaatttgatttaggggacggatcgtttgttgcgagcgaacaacgcaaatgtgcgaccgcaactgcaaggagtggacaacgccaaagactgtttgacaccgtcgacaacaggcaataatcaaccgacacgagaacagccaaaactgatggacattgacgaaaggattgggatggacgacgaagacaacgacgacggggacagattcggagaagcagcagaggtattgggtggaggagacaacgctaaccgagttggtggtgagagagtcgtgggtaacagactgcggaaacggcgctccgtttcctgtgagccgacagcgaacagtccggccaaaatggcaccgcatcagccagccgatgaccaatccgctggttgtctgctgcaggtcactgaacaatgatcagaacagagtctccactagacaaaatttaaaatacattttcagtgtttttaaattcaggtttcacttttttttctgtctctcatttggctttttactctttgcttcagcgcacccaaagtgtcaatgccttcgctgttccctctgctcatcaacaaaatgccgtcgtcccaattgcctcttcctcgcgtatttcgtcgagaatgccctcctccgtctccatttgctcatatgccaattctgaagtcagcgcgcggaaacgttcgccctcgggcgacggcagtctttgttcaaaggctaaagcatcgcttctttttgtttgtttgaagttgactttttgtaggaggagcggagtttgtcgttaaccactccaaaaattagcatttccatttgcggaaaggctttgtatgcgtgcgcaagtggtcagtttttgagaattcatctccggcaaaaagagcggagtgattgagcaaatcctttaaattttaggtcggttggacgatttggcagctcttctcaaggaacatgtattactcccgttcaaattcatttacaattttctgtcattctcagcccgaattggtcaactaccaatacccgtactgctaccgttacagctgcctgcacatcgccgcaaaagccggcgactcggccattgtccgattccttgtcaaaaacggggcgaaactaaacgcaaaagatgtttgtttttgtctttataattaaggtacttttccgattattattagcacagcaacttttaatgacaaaaaatcccgaaatagttagctaaaataccgacaaaatactgccaaaatagtgacaaaatagtgaaaaaagtccaaaacagtgacaaataacgacataattttcagccaaaaagtaacccaaaataatttttattcactaattgcagctgcaaaagagtatgactgggatttttaagaccaataaacccaatatagatacatgaaaaaattttcaccattaaaaatttttaccaagaaatcagatttttgactatcttatttttcatttcataggaatatatgttgtaagataacaaatcttcaaatatagattacacgcactgaaaaataaccca

SEQ ID NO: 15102 - DNA, 1990 bp, Heterodera glycines
ccgtttggtgccattgccaaattttcccgcccgccggcggcgcctctttagtgcagcagggggtgaaatccgaccacttgtttaccactcacccgctcattttatgccattcttcgtcattgctttggcgtgccattttacaccctacccccaatttcccctttagcaaattgctttttccttgtcgcccctccgccgtttgctgcgctccgtccaactgagtacggccggcaaagtccttcttctgtttatttttgcgctgtttccgttgcttctcacaattgtgctgttgcaccaattgatggcaaaaaccaatgccaacaacaacaacttcaacaactccatttgttgttgtccccgtcgtcgtcgaagcggcggcttttcctcttcccccagcggcggtggcggtgacagccgccgaagagcaaaagcatttcgaacagccaatcgccgattcatcgtgtcgggagagggataaagagagactgatccgatcgatgaaagtgctaatgatgatgattatgatgatggggatgaggaagttgtaagaatgattgatgtttttgatgtgacgggccccgagaatggcgggagggaggagcagtgggggtgcgatgcttaagagagtggtgccgaagcaaatcgtttcacaaatacttcacaattggcgttccgtgaactcatcaacaaacttattttgactaaaataaatttcgattttcctttcttagaagcaattagtctgaaccgggaattttggcaaaaaccgggacctcgacctgaaaaggccgggattctccggccggtcccgaacaactcaaggtccaagtgttctcgatcatttagcaaaattcaatgaaaaaattgttaaattttaaatgactgagactttaagaaattttggttatttatcttttggaaccaataaaataatttttgaaatttactaactgtaaaatttagtaattgtaatgcatgtatgacgtcagcaaggtcatttaatttggcttttactctttttttgtcaaagaatacccatgctagggaattttaagcaacgtcttttcgcaagctaatgtacctaagcatccacaccacccatcactctgctcgagctgtttgtttgccctcctcatccatctcgctctctctcctctgtctgttcaatttgtcccctgagggggtatctttcattttcactcattttcttgacatttattagtgcacccgtcaagttccgtgtcctcccccccccctttttattattcaatttgtcccccccccgggcggcgccctttgaaagggccaacaaaaagtgggttggatgttgattaatgaaatttgctgttgacgcttcccgagactcttggcctctcgactctcgcgagtgtttacatttggggagtcatttgccccgtgtgaaattcgagtgtttatccgctaacgtcatttctgggtcccatcagtgcttttggcacttttcagcccacgcctaacccgctaatccgaaattggccggtcattttattgtgtcatttcagtatgggtgtctttttggcagtttgagtggccatttaaatatcaatggcctccgaggagctggaaaataaaaatgcatttacatatatgcaaaagtccaaggcataatcttgagaaatggatttaaatgaatttattgatagagtccagaatcgggatttcggtactgagtcgggatttttattcgaactcaaaaaaattcacaatgagaatcttgaaaatttctcaaaaatatctcccttataatcagtatggcttgccaaatattaacaaaatcggataattgtaaacaaattataatggaaatcccggtttgaaattcgaaaatcccgatttggtgctcagttggcaatacaaaatcccggttccaggctctagtatttttgattttgaatagttttttaattttgtgaaatcaaaaaacctttgactttgaaaggacacaatttct

SEQ ID NO: 15103 - DNA, 521 bp, Heterodera glycines
agagaaacatagaaccacactcagattgggagagagagagacatagagagacaccacccccgcccccccccttgcctacgctcttgatcagcagcaaggagagcgagcaccagaagcctgggttcaatttttcactttttaaagaaaactcaattaaaaaatgtcaccacatactttggcattcggaagctcattgtcagcatgtttagaagcttttgttaagcaatcaatccacaaaaaatttcaacaaccactaaatctcagattttttgaattttagttaaagttttttacgctatttaagttgatgaatgttttttaatttttttgcgtggctaaccgaaagaacagaattatgaaccaggcacttccggtttaatttttcctttaaacctaaaagttcaaatttgaatgggttttatttcctccattagccactttttgtttgccttcgtcctgggcacagcccgacaaaaaatttattggcattttttgttttacgtcagcacccccatcctttt

SEQ ID NO: 15104 - DNA, 3541 bp, Heterodera glycines
  misc_feature (3503)..(3503): n is a, c, g, or t
gacagtaatccgtcatttggcttcagttacgtatttttgaattattgaataaatcaaaaaacagctaatgttgcatttttcacagggcaaataatgggcccaccgccaccgcgacagcaaacgccattcaacgaaatgtaccaaacaaatgcttcggccgttcataatcggcccaattcgttcactcgccttttaatgcatcgcgcaaaagccgctcctccaactaaacattccgcgagtgtcaaatcccttccaatacggtgcacaatcatcaaattggcacggaatgccattggaatcgccgccatcttcaaataggcacggaatgccattggaatcgccgccatcttcaaattggcacgggatgccattggaatcgccgccatctcttcagagtcttttgttgaatagcccaacttctgttgtgccgcggcactccgctcacaatacggttccatttgtgcctcattctgcagaacccaatattttaatttagctgttgtctccatcgctccaaacgcaaaataatccgcctttaacaattcgggaaggcaatgcgcaagcagcagaaaggcacagacaacagcaacaacaacatcaacaacaacaatcattggccaatgttgaccgaaaaatgaagcggccaatggacgatgaagcgggcgaggggccgagtgccatcgaaattcaaaatgtgcaaatggcacggtcagaaaatgacagcagaacggcaccgaaactgtttatcagaacgggtaattgtgattgttttaaaataattttaggatttttagtcaatgtttcaagtttctacatacagtcatggtcatatgtttaacaacactcaaaattttctaccaaatttgatttaaattgattataaaatctcaatatgactatattgtgtatatatgttttatatttcttgtagcattttttgtgggctttataatgataccattcactatcccctgtcaaaatgttattattagttacaaaccattttaccaactgcactccctttttggggtggtcatatgtttaacaacactacccatatattttttcatcagcattaaaaaaatctaaaaaaattcaggtaagcataaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccatttttagagcacaaaatttgctaccgaattgcctttggaatagtgggtctacgatttaggcccgctgagatacgtcgacttttatttcggtgcctataaaaagtactgtatttcttaagaaaatagtgcattttacactacgtcaaaattgaagtgcccatacctcagccggtataagtcatagagacatgcggttttttgaatattgtagagaattttgtgctctataaaatgggcctactcaaaatttccagaaaaattttcccaaccccctagaaattttttttcaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatataagaaaaagaagatgagtctaaacatatgaccaccgagaattggggctgcatttggattttgttttgtattatttgtgaacttaacaaatttgataatgaatggtaccattgaaagcccataaaaaatactacaaaaaccgtgaaatgtgtttcccgttttgcctgcaacttcagcttttattacgcatctaatcaatattcactctttgagtctaaacatatgaccatgactgtattttttccatattttggaatttttttccaaaaaacccctattagaacggcccccataaactaaattggccgttttggtccaaacgaccggaaattttccaaaaaattttaaattttaaactttcttaaaaattagtagatttatttcaaaaataatcaaaaaattgaagatttcgtttttttggtcagtttcctctaaaattgcttttttttttcttctaaaacgagttattataccgtatttactagaatttaatgaatttggagaaattttggaaaatttacccctcaattcggaaaatttataacatatttttgccatttttgtccatattttcgggttacggtactacttttttcacgctctgttccatgaaggagtggtctgatcaagttggggtaaaagacttttttgatcagcatcaaaagttaagctaacctgaatttttgcagatttttagagccaccaaatattgagctttcattgattaaatattatgtttccatacttagcaccgccaaaaattggatcactttggttgcgcacccgtaatccgatgatcggaacttttgccgtttttagtaaggtgatattagggtttgttttggtatagaaaagatactccatccaatcactcatttcttatgaatagtaaaatgattgacccaaccaaatttcccgccttttatagacacaaaaacaacgatgtgaagacaatttttatcaacgttttttgccctataaaagcgcttcttcccccgcatttgccattcattccacaacacttttattccaccaacttcattcttcacccacaacatcctcgtccctccgcttcaatagcaaatgctccgttcactgctcttcgctgccgtgttcgcttcactgctcatcaattgctacgaggcgcggacgatacgcctggccaacagtttcttatgtgccaagagcggtttcacagtcgaggaaggcctcacgcagcacgaggcgaacaacatgtgagtgacaaggggaattacacattttcgaataatatgactttccccccatttcagtcaagtcaaaggcgaagagatatcaaacacacagacggagccagtgcccattctgctggtgacagcgaatgtggagttcgacgtggtgttccacactaacagcaaggagtgcaaggagcaattcaaaatcaaagaggacagcaaaggatgcaagaaaaaaggcactctcgttggccatgtgagtttttcaagaaatggcgaaaatttggctttggaatgttttgtttgtttcagaatgattttccgaagacgcctcactgtggtgaaagttgcacagggtacgaagtcgtctgcaccgttgtcaaactggcttcagtcgaggaacaggaaacaggcggcattgttggactcaagcgatcggaattcgccagaatgttcggcggcgccaagtgcgagtgggaagcggtcattgtgagtggcactgatcagtcgtcttttttgtgtggttaaagcatccccattttcccgctgttcagaagcaggcgcgtatgctggttaacctgaaagatcttcatanaggggagtcctgtgggaaaaaagaagacaccaatcagc

SEQ ID NO: 15105 - DNA, 2394 bp, Heterodera glycines
atttcgtcacatctctcagcaccaattctccgatcttctcaaaaagtgtgaacatcctcagttcctcttcagcttcttctcccctgctgctgttttcttcctcttccaactccaaaaatgatactttattctctcgttggacttgctgcttcttttctgccgctttctcctctccctcttcctcctcttccttttcctcctcttccgtttcttcatctccattctcttccatttcgccatttcctttgtccccttcgtccgctttttctttcttcccactctcttccaattcctccatttcttttccactctctttttcccccgtgcaatttcctccttcttcctcctcctcttcttcatctgtttcatattcactctcctcttcttcctcctcctcctcttcttcttcctcccacttttgttctcccccctcccctttcatttgtgttttgtcataaatgtccaattttctctgccgttgcaatgtttccatggtcgcttaattaaatttctaaaatatataattacgttttgtctaatgaacgggtaaaagaaaaaaaacaataatagggggaagtgaagcgaaaatgaggcaaaatgtgccaaagaattgcggcaaaacccgagttgtcgcgactcgccttccgtttgcgctgcgttcgatgggtctttgcggtcggaattgacttctcccccggtttcccctcttttgaggtcgaatgaaccgccgcgaactatcggcagcagcaaaagcggtgggagggggaacaatgcctcccccgcgcactttccgcttgagccactcgtcgagcgattgtccgcccctcgccggggaggtccccccccccccgcattcagttcttatgtaaataaacaggcaaaagttcggcgagagatgcgcggctggtggtaggaatgggaatatcccgcggtcggtctcccctcccacatgcgcaagtgtgggactgaaacagacgggggaagggaatgatcgatcggatgagaggaaaatggacggaggaaaagcattgtaagtgggcggggagggaggggaggacgacgccattctcatcccttccctttgtttgttggaggtgagaatggcaacacaaaacgcagatttaataatccttttaatctgtggctgagcgtaggcgaaacccaaaagaaaaaaacacaatcatttgatgcgaaaaaaatcggtgatgaacgaattccgtgacaaattgaaaaaatgatcgaattggaggaacaagggactgagcacagattgcccatggacagcacaaacgtcgacttcgtaaacaaatttttaaaaaaatgctatttttgaatttggcagaacaaaaccgactcttttatgtttgggtctccaaaaataattagataaaaataaatttaggcagccaaatccatccacagacactctgaattcaatccaaaaaaagccaattgagtattatgataaaatctgacgtcaaaacgtggaaagagatctgaagacttaacaaacgaaggaagagaaaatgctgaaaatataaatttaatatgtagaatatgctaaagacatagtgtaattgagctcggtgagtgttttgtattgaaatggcaattttggaaaggcagagaaatcgtccgcgtcttcgtttttctctccgttctcttttccttctcgcgcaattcaatcgccgccctcctcagcttgtttcaaagcggtggccaaataacaagccaacgcctgcaaaatcaaaggcaatgtttgggagttgggggcgagccattccaagtgactgaccctcggggcgatgtccaaaaggtcgcgcatgatcaccttcttctccttcccgtcaccgtaacgcgccttaaacacgaatggcaccccgtcgatgtcgcatgactcgtggctgagtatttcgtccaccgctttttcttgcaatttggacgccagttcctcgatcgttttggcagctgtcgtaacatttgattctgcaagagaaaaacacaatagttcacgaaatggaatgaataacaaagggaattgacattcatcagacaagcgcacttaattcatattctaccgattttgttgttgccattagagttcgtttgaaatgatttgccggaggaaattccgttgagggaagcggtggacgtttttcgctttttggcaccgaccaatggttcgaccgacaatggctgcggagaaggcgcatgctttctgatgattttcacattcttcggaatggacgcacttttctgcttaaggggagggatctttttaatatgtttataaaaatggaggttttttgtgcgatttgttcctgtctttaacccacccctttcttatgcgattttggcaatgacggaatggacacggagccggaagcgacaacg

SEQ ID NO: 15106 - DNA, 1543 bp, Heterodera glycines
ttagaccctttgagtgcatttccttttcgcctttgtcgttgaaatacatttcgcgttgttcgtaacggtcgatggattcttggcataaacgctgaaaaaaggtggcataatttgactttcttcagaccaccgctgaccaaattatcttcgggctcccaagtgctcttctcaatcggataccccttccaataaacgcgatattccaccttatcaggacgcaatttgtccgtgcgtttgccccatctgaaaaaagagaaagtcgcgtaagaaacatgactttttgcaaatttatctcaatcagaatttttattgacgattttaaattttccttttccaaatttaaaaaaaccctcacatgtattccacttcgtatttgacttttttctccccactctttcctcttttgctttcgcttttcctcggcctcgcctttgacgttttcttattcgaattgttggctttgttgttgatcataaaaaaatccggctgtttgacgctcctaagcattttgttggttaaaactcaaaagataatatttttaatgacaaagacaataaaattcaccgatttgcagcaaaattcggatttgctcgccttatttcattatcactttccaattccattaaaaaaaacctccgtttccgaccacgggcattatactcatcgtcatattcgtcatcgttctccacgtcgacaaaaaaggaacgattttcttcgtccatttcttcaactgcagattctttgtaacagtaatcgtggtccgaaaaagaattgttgtgctcaatcttgatgtttaccgctttcggaaaagaactcattgcttacggctagtaagaaaaagagacgcaataagaaactcaaatggatggaaacccaattgtaactaaaaaatacgaacttactaacgaaagataaacaaacaaaaaagaaaggttgggcgaaaaacaccgcaaaaatcaccattggatttgctgatacgacagtgaagggaaatgggcgtaggttagaatccgctttttttttcttagttggtcaatttaaaaccagaagaaaatttaaacataaaatttaaaaaaataaaactttcaaaaagctggcataatgttttaattttatttttttgttttttgtattaagctaaagctcacaatcagctacaatttaagtttcccagttttgagtgtgttgtgccttcatatgtcggtcccgcacgttcggctatccgatcggtcgagtgaagcgaatttgcgaattggatccgcagatgatctctgtttcggcagatgccgttaaattgtctcgcgttggctgcactcagtttttcaaataagtcttggcagatttccatttaactttaagaaattacatgaaacacccatattttcaaaggcaaagctcagtgcataagtattattcttaaggagaaattcgtagctatgcttggccgttgtgcaggaaaatgggcattagataatggaaggacacccgttcaaatttgtgacgtcggtccgtaaagtttatttactcccagttattttatcat

SEQ ID NO: 15107 - DNA, 1746 bp, Heterodera glycines
  misc_feature (1662)..(1662): n is a, c, g, or t
  misc_feature (1674)..(1674): n is a, c, g, or t
  misc_feature (1733)..(1733): n is a, c, g, or t
ctgacaaaaaattttattgtataaatccatttcattattatacttttatttgcatatttatttttcggccaaatcaaaggcgaagataaaaatgatttatttttagatattatttctgagtttagatttattgtttattaaataaacagaatataaaacttcttgtttctccgaaaaccaactcagatcggcggcgctatctccattattcttatataagacttttccatttttaataattaatttaattttatttcatgtcgtattaacgatggtgaagtggttgttgttaacacaagttgttattcttaaaaacacttaaaaaactatatttatataattattttatttttaaaataatatattaataaatatttactaaaattaaaaaactttttttttgtataattctttgtgttttggtttaaattttaattttaaacaatcttaacgatatttttatgaaaaattatttagaaaagaaaagattatttagtcttcgtttctgactatcattcttatttatttttattgtaacagttgaatgaatacattccatttttaattaaattttaagatgaggatttatttatttatttgtcatttaaattaatgtatttttaatttaaaaaaaataagggctcaaatctgttatttagtgattttaatttttattaataaaattaaatgaatacggaattttaaaatttatggtgattattatataaaaattttgatttggcctttgcgccgattaagatttaatattattaaaagttttcagaaatgactcattaatgaaaaaataaaagaaaatatagtattaaaaaacggtcattgaacttttcttaaccataaaaaattaaaattaattataattatttatttgtttccttttaaatgttttagtttttgtgttgtaattattaagaaaatttttattattgttttaaattattctaggcatttttaaatatgtaatttactttagtgaattagcaaacttttatttttttagtgagattggatgagtttgagtgcagtctcgcctaaggtgacaaaggagtttttttaattctatgcttgataaaatattagcataactattttgtgaatatatatatatatatatattcaatcagaataatttcttatttctttcgttttgtatgtatttgattcttcttgaatatatttgatttttattaaatcgtttatagataatattaacactttgttataatttttttatttcgcaaggttataatatattttgacatatagtgtttcaagtgcttctattcatacattttgaattttagtcgctagtttagctgaagataaaattttccgttttccattgggttaattaaaatttcttaaactataaaatttcacaaaactctttattaattatttacatttcattaaagatttataggatttttgaattttgcgtttttcgggcattttcgtattaattttattttatagaaattatttcttcgatatctaatctattaagttgtattaataatttttgtcgtctttatttttttcttgagttacaggatgtggctgtttggatttagtgcttcacaatcccgtattgtttctgtaaatgtattacaatgtttttgataagataaattaaggatatanttggtgattgtngaagttaatttcaatatttaaaaatttattatataatttttaataattaaatgaattanattgtttctcata

SEQ ID NO: 15108 - DNA, 1687 bp, Heterodera glycines
gagatctgaacgtttatgtgggataattagcaaaagattttcattataaactttatttcatttaccaatttttttttcaccctaaattttatgattttctgtaaattaattcaaacatggcaatttaaaaaaaaaaaattctatttttaattgtttaaatatttgaattacaagcaattttttagtgagtctattatttggaaaagcaccttataaatatcacgcgcttgaactacgccttccagcggcgtcgcacaaggctgtcaggtttggatgactttatttttctcattttgcaaaacgtattcatttggctatattttgaacgttgaccaaagttttattaatattctgttgaggaaacttgattgttattatgagataaagcaaatttttgaaaataactcaataatctacccatcggttcatctcaaaacgagaagacttgtgacacaacccaatagattttccattttgtaatactaaataaatgttatttaaaatttcatttctattattttttaataaaaaatttcctgttttccattaaccttaatatattacaccctttaaaacaatcgtttagtttttgaaggtttgcattatttttaattaattagacaatcttttgataaaacggaatttttttttattttgttaaatctttcagtttttaatacttaattgctacttaaatattaattataactgtttttaatttatattattttaaggaagtttcctggtttttaacttgcaaaaaaaaagttgaacatatttttatcttgttaaattgtcatttaatgataaatttttcattttttggatgtttcacagctgttgcaaacaacccttaattctttcaaagataattaatgcacgcatttaaataaaaacattttaatatctttattgagatttatcatagtaattatgtcttattacttttttagtttttaatcttattttatgcgattttttttaatttcattattggttatcaagtttcaatggcagaaaaattaaagatgtccatatgttcaaaactttatatattctttactgttttaattatatttacttatattttaaattttatttattcctctctttttgatgaaacaaaataaaaaaaatatatatataattatattatatgtttaatttctattcatatatatgaaactcttcgagcttcaattaagctgtgatttttacaacaaattttattaggtgatatatgttaattatcaaatatattaaatcatttaattaatctcggttcgataataatttttatatatttttaatttatttttactttttcttacaattatataaaacaattatcttatatattcctttttaattaatattgtcatatttatttttttgatatacgatgacgaagtttatgatgttccttattaataatttagatgaattgccttgaaaatttgttattttcgtattaattttttatttcaagtaaaaacggcaacgttttacatttttcaagctgataaataaattaatctatttaattgtaaactttttttaattttttattatttttttcttatgttatgctgaaaattttaatgattgtctttgttttaaatttgttttaatgcttattttttttgaaatgtcttttgaggcttttaacgaataaatttttattgaa

SEQ ID NO: 15109 - DNA, 1172 bp, Heterodera glycines
taaatttttattgaacatactatgatttgattttaaattatttggcaatttcaattgttaattttcttgtcatagtcaattacaagtttctattttattactaattaaattgtaattcataataagaatttttcatatttgtgcaatgtcttcataatttttatattagtgaaaataatatttttccaatcaatattttatttattgttcgcctgtccttttatttgtttctgtaaacttttgtttattcactgtggacgtgacggcgtaacaaattggcgacgcccgattctgattggatcaacttttggcttcaaaatttgcaagtttaaaacaatcggctattcatctttcatggaatagtattttggactttcttctgaaaagccgaaccggcattcgtcattaaagccagtcggctagcaattcgtcatctaagccaagtctggccaaattcttcgacaaagccgagacggcaaatcttcaaattcgttaagccgagtcggccaaagaacgagttcaaacccgagtcggttatcatcattcttcaataagactctcagctaggcgctgcagttatacttgctaggcgcaagtcaggcttaaatttgaaaaatgccagggcagcaagacccagcgattgaccagttggtcagattgctggcggaacagcaacaaatcgcgatacaacaagcggatcaaatcgcacagcttctcggcacaacaatgcagctgctggtgctgccgcccaacagcaaattgttcaagacacaattcaagctcttacagcgccgatctgttttgccgtctgcggtcactgattttggatttgacgacaccataaaaagctaaaaagccgttcagtcgtccccaatcgaatattcgttgcaattccttatataccattacctcaccactgtaggatgagtttttgccttttctctttaattaaaaaattctgagaactgaaatacagatgatgaccactaccaaatcgacaattgacaaaaaatatacccaaatatttgaacttgaaactttaattttctcaaattctttgaacactactaagttaaaaaattcactatccgtgtatgacgcatatttgggaagtatttctttcgagtcaaatagaagtttgtatattttcttctccttaatcagataaattt

SEQ ID NO: 15110 - DNA, 3540 bp, Heterodera glycines
attttgttactgtttttccattcatattttcctttttctttcaatttgtttttaattgcatcaaatttttgaacagtttctcttttttgttgatcggaaaaatcagttttttgctgatcattcagaaattcttttttccatttgaatattaaatatcggctaactcctaaatgctttccaattttcatctcaattttgcattgatatttctttttatatttccccttttgcttcaatttatttttaattgcatcaaatttttgaatgatttctcttttttgcttataatttgattcatttttctgataacttttcataatattccgcttgtcccaattgttcatttgatcaaatgggtcggtttcattttcttcaattacgtgatcagcataatgattgaattcaaagttttctttttgatagttttgttcattttttgactcgtttttgtccaacaatttttcttcgctatcatattgagtgtcccatccgttaccaaaaatttcgtcaaaagttggttggttttgtgcagtttcaattttataaggaaagaaaattattataattaaatgacataaaaacatttttaaaaaagaaacatttgtattaaaaaataatttttacaatttaaatacattaattaatcaataaatgccaatcaatgccaacaacacaaacattcattccatcatttctaagtattatgccaaaatagccttacaacagaacttaactgtgaatctgagcggattttagcgaattcaagaaaataactcgggagcggattctttggttttaactagggtaggtcgggactgggaactttgggcaaaaccgggaccgggacttttcgggttgaaaacccgggattttttggctgggaagaccgggaataaccccgggaatttcccggtcaaaactgttcaaaaccgggaccccggcactcagttgtactcagttgtccgtgttttggtcccggtccctacctagtcaatgaagaaaaagtcgtgtaaaatcccaaaaaatggttgtagataaaagctttctccacacaaatttagccccatcctgaatccaaactcacttcctttacatccctgtacgatgtactaattattcatccactctgaaaacttttgttcaaaaatttggtggccaaaagactatggtcagaacttacaaaaaaaaatttctcagagctaagctatgtgaaactcgatcgatttaccttaaacaaaacttctactggctaacttttataatgcgccaatttttttaccattgattaaaaaatttatcaaattaacaaagcataaagttattagcgtcgaattcaatgttggttatgaaagaaattatcggaaatcatatgacggaaatgaaacaattgttcaaacaaagtttattttataaagggagagaataaaaattttgccaactttcaaaaacagctaagcaatgtgaaagatgcggttcaaattttcaatataaaaaaggtcaaatgcatataaaaatctcacaattaatattggaaagaaacccaataaaacaaacggagaatgcggacccaaactattttttcaattgcaattgttctgatgatatgcgaagtcaactcattcccggtaaaatgaattttttttttaatttgaattttttaacgatttataatttaaggcattttcatcactattctcttcagcatttggtggaagtaaaaaagtagaaaatattgggactacaaatgatgaatcgcacagccgacagaagagacaagctgaaactgttgttagtgatgcagacacaatcacactaacaatatctggggaaaatttgacagtcacccaagagacattggcggacggaacggttgtgctaagaataactgggcaaaatacaaacgttgaaacaagtaaaaaaataaaaaataaataaatcgaaataatttaaatacaataataaggtaatgctgatgattccgcaatcgaaacagccactgaagagtcagcaactgcggcggaagacgcagcaaatgatgagtccgcaaccgaagcagccaatgaagagtcagcaactgcggcggaagacgcagcaaatgatgagtccgcaaccgaagcagccactgaagagtcagcaactgcggcggaagacgcagcaaatgatgagtccgcaaccgaagcagccactgaagagtcagcaactgcggcggaagacgcagcaaatgatgagtccgcaaccgaagcagccactgaagagtcagcaactgcagcggaagacgcagcaaatgatgagtccgcaaccgaagcagcaactgaagagtcagcaactgcagcggaagacgcagcaaatgatgagtccgcaaccgaagcagccattgaagtatcttcaacatcagttgccgcgtcccccactactaaagccactgcacctttgaaacccccagcgaaaaagccaggaaataaatctagtagcagcagcagttgttcgtctagcgaaagtgatgaaaagaagcaaggcccaaaacgtcgtcctactcctcctcataaagccaataaaaagaagggcaatcagaagcacaaaaaaggacgcaaccaccaaaagaaaggtcatggccatcacaagaagggtcatgggcggccccatcgccatcagcacaagttcgctaggcctgattttggatggtttcacgcatttcctcaatatttcagaggacttcgcttttggtaaaaagaaatgaacagaacaagatgaaattggcttggaaatcgaatttgaaccatatttaaaattatttttatattattgtaaattgtattgatgagaatattgaaacacattgttggaaaaatttttcttgaatgtgtttgaaagttataaatcatctgagaaaacaaactaaaaaaatatagcttgtggaaaagctgcgttttaaaattggaatttcctattatttctttgatgcgacacgcttaactccaaaaacatttaaaatagttcaaaaacacggcaaaaaattccaactttttttaaaacacggcaaaaaaaaatgtcaacttttaaagtttttccaagaaaaattctgaaaatatgttgaaatttcttgtccaaaaatgaccacatatcgaagaattaaagtcaattttaaaaaattgcacaatttctgtgtgaatagttgccgccgagggaaaaatttaaattttttattggaatttttttaggaattagctaaagtgttagaacatagaagttaaaaaatgggcaaattccttcacttataactaactatgttattaatttataatttatgaaatttaataaattaatttattattaatacacaagtgtcactgcggatctttttttttaaatttcggtcattatttgagtatgcatttttaatttttataacattttcataagaagtcttcgaaaaaagccagtttttattttcgtgcattctcagcgaaacaaagatgcaggaagaattcttttaaaatatatataataaatcccatccctactgatgaattgaagttttca

SEQ ID NO: 15111 - DNA, 3979 bp, Heterodera glycines
atttggccaagtcgtggccattcctatgcctttcttatttattatttgccgcttttcgctccgtcctgtgcagatttgttcggttaattgtttgactgcctcaagagactgttcgcatcgtccaacgtcgtaaatggccgctcgtccgggctcactttgtgggtcgccaactccgatcaaatacgccttgagaatgagagagaatcagtttcgaatttgcctcttccgttatgccattttcttacggattgcgccgcgtttttggccaatccgcagacggcatttgccacttgtcgcactgctaagcacaactgttcgttgtcattgcgacgtgcgtaatgtgccaatccgttcatcccttccaattcaattcacttgcattttgcctttccctttgccaaaaccaaccgtcgcccaaattgcgagcttcgtttgtcacttcggccaatgactcgtagtaactgttcccgttcaacggcacattcaatggactcgtcgttgcgccgtcgaacaaatgccggaccgaatgaatttgttggatggcttcttcgcactcgcgcagccacgcgctcgtcccttgcgattgtgccaattcgacaagtgccgaaattgtcacaacgaattggcgaacggaggacgaaagtgacttgaattggggatgagtatttatattcatttccaatggaacacctgagcaagtgacgcgttatttgggtcggtttgggcggtgcggagactaaaatgccgaaatttgttcaacaaattgagtttgatttgccccccccctccacctttccaacataattagtgccgattccttggcatctccgagtctttctgccatttcttggcccgtcgtgtcattcgcttgcgctgtcattttgctgactgtcgtatgaaatcgggcaaaattggtggtgaattcgttgatcccccgggcgttctcttcggtcgaattgtgcaaaagggtgggcaaacgattggccgattcggtcaatgcgacggcaaccgcgtggaattcatcggcggacggaggcggcaaaattggggaaagtttagccgattgttggatggttaacgcgttcagcttgtcaatctgtggatggaatgatagcatgatagccatgctggcaaattcggtgccaaaatcaccgctctgtccacaatgccattgtccggcagagaagcgagtgttttccgcaaagactcagtcactcgtcgagccgcttcttccaactgttgggccgtgctctgttcgcgaactctgcagagaacgtttcccgagtcgtggaccaccgaccgcgcgttcagaatcaaacggaaatgggaggaggtcgattcaacgcaaaagcgagcattcccagcccccaaacggctgaggactcacttgtccaccctctcgtcgccctctgcgagttcgccgcttccattggcatttgcttctgtcgctgcgacgtcttcaaccgaatcggcaaaatcactgagtgcttgtgccatttcgagcatcgctgtgcccatttggcgactttcgctggaatgtgtggcggagaccatttgggcgatcgtcgagttcaaaagacggcactgctggcgaaatgttcgcgtagtttgctgcggactgtccatcggcggggaggagggcgggagaagcggctgaccgagtcgaattcgttgcgacaattgctgaagctgggcatccaatgaacggatgagctcctccgaatggtccaattgggagccaaagtccaattgctgcacattattaagcactgtacgaagctcagcgacatttatctttaatcaattaaccaaatagttaattaattagggcaaacgcaatcgaaattggactaccgaaagctgctgacagttttggagcaaaaggccggcggagtgtttgtcgcgcacatgcgaaacggaagagcgactttcgtcgacgagtcgcgtcgcggggccaaccaccgcctgagagtcgtgaataaggccgaccttctgcaaggcacacaaatgctgcatttttgtgaattgatataactgacagctcggaactgtgcgcccgcttcgctcgccccctggtgctgtttgatgcgtttgatcagcggaggcacataacggctaacatcggcacactcgcgaacaagcgaatcgagcggttgctgggcgagaatgtgagggcgagcctatacagtaacaaatgggggatgaaggcatcggcagacgtactgtataggcactgaccgaattggcggcagcgacggtttgagtgatcgaagcggcggtctctttggacactttttcaagctgttggatggtttgttgaatttgtcgttcgccagtcgcctgattggtcacctgtgaaaaatgcaatttcacaacaaaaaatgccaaaatgggagttgagttatttctgatcagtgatcactcacacacccaaacggaacgccaaaacaatcaaattcaaaacaaacaaaaaaaatcgggactttttttttagccttacaatggtggaggaacacagcggcagctgaagagaataaaaatgagtcgaattgagcccgaatttggacaaaggaattggaaatttgaggggggggggggacaaacacagcaaaacgagaaaagcgaacaaaaaagcagaagacgaaggaacgacggaagcttaccaaaaggaggaggaaaagtgttgccgagacggcgaagaacgtcttgcggatgatgggcaaggaatggcatggaaaatgaagtgaaccaactaatcagcgatgggaggcgacgaaaaattgaaaaagggggggggggagagggagggacacaaaagtaattaagaaactaattaaaggagaaaagcagcaaaaatgaaatgccaaattggaatatttatatgtactaatatatcataaaataacaaggcaaaacattgcagtaacagaaaagcacagagagagaggaaaagcctatgataaaaaggagaaagcataatttacaaaaatgaaaatgctaatcagtagcagggcgaaaagaggctattgtcggaagataaaaagaaaaaatggctataaaagggataattagtgataaatgggcatggcaaaagtggcaaaggacactttgaaggatatgtgcaggggatgaaagagagggcgatcggtcaatgaaaagagtgtgggaaaagaggaggaagagaaagagacaaacaaagaaagagagagagaaagagaagacggcgcagacacaaagcggcgggaaaagttttgtgggaaaagagtgaggcggagattcgctgatcgctctgatcaatgatggtgatcagatcgtcctcccccaaccccattcaattcggctcaatctcaactgacactctctcctcagcccgccgctgtttccctccgatggcgttctggctaaatttgcctttgttcgttcctctgatcactgatcggctttttctcaccctcccatatattatgctttcaatcattttcccattgcaatgtcatgttttgcagctgcctcccacctgcacaaggtgttcggccgcgtttcgcagtgccacttgaggtccaacttcgccgggtcgactttggcactcgcgcgtcgcgtcgatcatcgaactcgtcgcttgggcaaccgaaccttaaaacgatgcaccgcgtaaagcattgcgctttcctcgcttacgagcagcgttcaacaatttgttgcgctgttccgccggactgagctgagcctcttgctccatgccctccacgagtaattgggacgaactgaacaaacgacggacggagtgatcagaggattgatcagtaccgaattgctgactcggagtcgcgcacaatggcccccggctgatggccttggtttgtgatgattcggttggatgattcgacgatttctgaaagttctctgaccaatgaccatcgggtgcccgtccgtttccgccccccccccccttctccacgccttccgtttgcttacgttc

SEQ ID NO: 15112 - DNA, 1778 bp, Heterodera glycines
agtaattttgctggtcaagcatgggggcgaacattgtaactgcggacgaattcgggaacaccgcgctgacgatcgctttagcaacgggacgagtgagttttctctttctcctccgtgggtcggaaacactgatcagggttgtgattttgccctataaaccgggcatttaccggattttcgagatctgtgcaaattttagcaagtgccacggttttggaatgctttgccgcagtactgaactcatgtgtccagttttttgagttttggccataacatccatggttttggtcccgattttttattttcgagaaagattcttcttaaatgatccccaaaatttcatccccgaaggcttaatgaagctaaaacagaaggaaacgacttttttagaaatgctccaaacagtcttttcgattatcgccattttatgttcgcttttgtgcagaatttttggaattttcggtagtttttgggttcgacattgccgatagccgatgtaggaaaatttttttgattttgcttaatttctctaattagaattttggaaatatgtgctaagacccaataaaaatatagaaatcgaaccccatttatgaaatttattatctcaaaaaatactctttttgaaatataaccgaacggaaaattattttttaattttttttccataaaatattttaatttagtaaataaaaatttctaagtgcaattaattttattttgcccattatatataaatttagaaagtgctgatgtcataaacattgctctggtcaaaactgaactttgacgcagttgttaagaaaagttgacgcaaaaatccgattcagttttcgccattttcctaatcttgttaaatttaaaaaacttatttaagtttgaattaaaattaaatgtttctggccattatggcgccgtgctccatatctttttttgaaactaatattttaaaattttacagactaattgagaagatagaattaaataatgtaataaaatattaaatgtcgacgcttaatttcccgatcaaaatgagctcagttcttttatttattcctttttacatgttgactaatctttgtcattttttttgaatgtataccgtatatgctctaattatagcccagtctctattaatcccgcagtctccaattatcccccagtctacgaggtgttttgaaaaataatccctctatcataatcccccagtctctaattatccccccttttctgaggaggttgaaaaataatcccccatgggctataattagagcatatacggtagcccaatctttggcgatgcaaaattaatggagcaaaatgtttaagcgacaaaaagtttgaaattaaaaaaaaatagctctatcggaaagagaataaaattctcaaccgaattgttaagcatgaatttatttcagattttctgacaaggcaatgaaatgttaaattttaaatcttttgaaatttttaaaaagtatgctgaacattgaggtggactagcgaatgacttattagaaaaaccacagggaaattgcactgtttggcgatatgtcggctaaaaaattgcaaaaatttatgaaaatggaaggattaaacccaacgacaatgaaaagtcaaaaaaaaatgaagaagtgccgagaaaaatgtaaaaatatttctcaagagttggaagaaagaatcgaattttatgagaattaattgccgtcctttggtcaattgaaagataatggcacaacaaacgaaaaaaccaattaattaatggacacaaattttaattc

SEQ ID NO: 15113 - DNA, 3323 bp, Heterodera glycines
  misc_feature (20)..(20): n is a, c, g, or t
cgtattcctttggcttacanttgcccttcaaaatagtcaaggactccttgggcactcattcgctttttttgcatcaatgttagcatattttatacaagttaaattattcacagagaaacccacgaaaaatttttcatagttttaggtatttttaaaaaactgggcctagatttcttgttggactcggtctgtgtgaatcccctacccacttgaaaaaggggctggactgaatatggctcaagaaaacccaaaaaatggtctttaaatttagacattcttctaggacttaccactgataggaagacaatctctggcattttgtcccataacgtaagaatatcatggatcactgtcaaataattgtaccaccaatttcccgatggccaatattcatcatattttaagttttccatacattcataattgtctattggcagtgctaatcgtgttaattttgtacgatcaggcttaaattcgcctccttcaaatttcaattttgcgcttcgaaacaattcgccaattttctcatccaccttttctttatagccaaacgttttttgagggtcaattgtaaaatggtaagcccagctgaccaaatgtccatttttggagtgacctttatttaataaaatgatttaattaatagaatgatttaaattttaaaatttgattcacctcaacatcgccctctttgtcatataatagctaaaaataaaataaatttaaactttttataatatttattaatctctgacttcaagcagttcgggcgcggtaaatccgttattgtaactcgaaaattttttgtttacaattattccctttttttcttctttcaaataaagaacagacgcttaaaaaagaatttaaaaataataacatttgattaacaaaactgttgaatataaaaataaaattaaataattaataaattaccatcaaaatcggtcaatttgataactttttcctcccatttaattgtcttggccctctctttctcttccctctctctttctttcctctctttctcttccctctctctttctttcctctctttctcttccctctctctttctttcctctctttttcctccttggcttttttctcggcttcgttttttctgttaaacattttaaacaatggaaatatgttttgctttgatttttcgttttctgcttttttttcttccagctttggcaattcttcttcttcttctgttttttcaaatacaattaaattcttcggcttaaaattcaaatgaatcccaactaaaaacaaaaattagttttattggtttaaagagtctaattaatcatcacaatttctcaatttaattgttaaatgaagctttcatcataattaattaattaatgagttaattaattacttttgtgaaattccatcagcggtttcataatatgctttagcatcgttttaatctcttccctgactttactgacttctccttctaaatcaagggatatttccctgactttttcaagttcttcttctaaatctctctggccaagctccgaaatagtcacccattttcgctcttttttcattgagtttgattcatcaattgtaccactaaaatgtataaatacttgtgatttgttattcatttttaatttatttaaattaaatttgtttttgtttttttttaatttactagtcaattaatttgacaaagtgttcatttgccgcgtcaatttccttcaacttttttgagattattatgcttttttcataatgtagtctgccttctttatcgaaatattcgatttcgctcccataaattctgattaaaacgcattgtttttcgatgccttcttcattttcgccaatatatcctatgtaagtctaaagaatgttttgttcgaatttattcaaaattgactcatttgtttgtcggtaaatccgccaatatttatccccaattttcagatatgtgtaaaaatttttaaataatcataattttgttcttcactattgaaaaaccatgccaaaagcggtcaaattttcgtaagcatattgtaatcattttttcgaaaatgaataaagattttgggggattgaaccgaggcagagaatgaagaaagacttcagctcagacctaagctaaggcattaaattttaacaaaaattacactaaagtgcggtctctcagaaaatttgacttcctttggcttcgtccattgatccgattggtaattaaatgattgcatttgatcaattgaaatgccacggcatttaattatgccatccgaatgtgtttgatcaatttggaaataaaacagtaataagagcagtaacggtagaaaatcaaaagccattttttctgaaatattaaatattactttaatcctcgattttttgagcgatttagctatagaattctgaagctttggggaaaatttgattatttttgggaccaatcttaccaacaaatcttaccctaatttttgaaaaaattttcccggcggtgcctgtggcattgccgtcgtccctcccttacccataattttttttgagatttataagtcgactcttatgaggttattttatgtttttattgcaattcctagggatccgtagggaatttcggtggacgaaaagaggaaaagtgccgcataatttcatgggttaatatacatactgatgattatgccgcaccgaagctagttcaagctcaaaatttgaattttattcattttttagatttatctttggacaagagggttacgcaaaaataaattaaaaaattaactttaatttcaattaattaaaaaagtataatttgttaaatccaagatcacttcaaaatggacatacatatattcctttttacccataaatctagaggccggacttttgaaaaagaggggccgggattcaggctttggaagaacgagaaaggactatcggggtcaaaacccgggatgatggcatcattataagcatggtaagcaatgttattaattgagcgaaaatgccaacggctacaaaatgattaaatttggagggcaatcagaaagctacaaaagattatgaatgaataaatgtcaggattattggttgtttcaccgcttgcgaaggtacctcttttatggggcagaaatttagattatggcaaaatattgaattggcatttgaatgatcacttcaatttggcattgttctagtgaattattgaattggcaattgagtgatcactcaaattgagcataattgtagtgaattattgaattggcatttgaatgatcacttcaatttggcattgttttagtgaattattgaattgacaattgagtgatcactt

SEQ ID NO: 15114 - DNA, 1965 bp, Heterodera glycines
tttcaccctgaaactccaagggtcatttcgttgtgacattgaagtgaccccaggatcttcaggggcgagagtagacagaataaaagatatggtttattataaaattattttcattaaaacgtatataatttattttataattgattaattctcaaaatatatttttaattcctaactttgattaacaagaaattcaatagataaaaaacatgccatgaaatgaaagaaaatatgcttttctattattttggtgtacataaacggcatgaactttgctgatcaaatagcgaccgtgctcatccggtgcaattctgctgtccggatttccttcatcaatttggactgccaacttaaaaggcggattgataatttttattagagcccggtaaaaaattttccggaggcgggagcaggagttaaaacttttctgggacgggagtcccgatcggggatcccataaaaatcccgctgccgttacaatcccgttcaccaaaaaaaaacgggtgcgggaccggaaatctcgtaaaaatcccgcgggggtcccaatctccaggctctgattcttatttattatacagaatttcacgattcaattttttatatttcgcttttctaccggcttcggcttggtgcgtttgtttgcgcgttttctttgttgttttgccgtgttttttgcccgcttggatgatgttgaagtggcggtgaaagttgaacttctattcccatcatcaatgtcagactcggcaccaacaagttcaacagttgcaccaatgtcgagaaatgccgaattcgcgtcagggtcccagtcaatttgctcttcggtctcatcgatttggaaattttcgacaattgtgttacttttgttgtcctgaacaaatttccagctcaagatcatttgttgaaaagctatttgttaacagattttcaataaaatttctaagtcctagcaaatttttaagaaaaataaagaatttatggacgagcatgaaatttttggaattaaaaaaacaaattttagccgttctttctaccgtctattcctacgattcgaccaattttcctcacaaatcgggattgatcgatcataatttgattaatgaaaatctaaaaaaagccaatcgtattgcctatgagatttttttgcgtaaaatttcgtttaatttctttttcgatcgacatttttgctcaaattttctctggcctgaccccctcggccttaacaaaattaataatacgttgaaagattttttttgaaatcatttaaaattggacctaatctccaaaaaccagtagcgccttcgatctccctatacaaaatataattacttagttttattaatactttgagatttgacctgtcgtgtctacatgaatttgttaagatttaccaaattaatatattttttgttaattaattataattattctgtttttgatttaatatttaccattctgaaatcgtttggccaaatttcgttgatcccgccggaggtgcccttgactccttaattacgggcaaaatcattcttggtgatgccttggatgttgtcatggtgtgcctgaaaagatttatgtgtttagtaaaaattaattttcagaaaattctaaaatggcttattttctgaatgaaatttcaaaagcttatatattaaaaccactttggaaaaaaaattaacaaatatcaaagaatttagaaaaattatgacagccaaaaaaacaataccattgaaatttcttcgtaatccagaccgggaatgtgcttcagacctccgcaacgtgccagtctgcggatgacagtcttggtgatgcattggatgttatgccgaccagtctggaaaataggaacagacaacaggtattttgggaaaataaaaaaaacgaaaacgtcattttacatttaattacataaattatttatcataagtattaattgtctcgaaaaaagcaccaaaaaatcgcaaaaaa

SEQ ID NO: 15115 - DNA, 1439 bp, Heterodera glycines
ggggctgtcaattactagagcggaatttgggggagggggcagcaactcaacgccgttttcaactgcgtagaagaaaggatgaaaagtggtagcgtaggggaatttgaaattgaatatgaaaaagctgaaataacggatgcggaagggggaggagaggggactaggggtggggggaattgggggcccaattttgggggggaatttgggggcggaataagggtccttacactactaaggcacaacaaatcaaaaacggatgaacaaaaaattgaaattgttcaacaatttatagtaatgaaagatgaatataagccaaaaggaataaaatattcaagaaaagaatggcaccaaaattatgacgaaattggcaagaaaattggagttggttatgtaacaattgaaaaatggaagaaacaatttggaatgggtgaaagaataaatgagaaagaaaaaatggaaaaaatgaaaatgtaaaaataagtgatgaaaaaattgccaattgttgcaaattagtgggcagaatattcgaagatggaaaaaacaatttgtagaacaaaaaaggtaaccttagaaagaaatgggaatttttactgatttttatttgtttggagctgtttgacaaatttattcatataatttctctatttaaatttattgctttttaaaatgcataaatttgctgaaaaattagcccgaaaatggcgcatataaattatgaaacaatataaagaaggatttttttggaaattttcattaactctgacattttcggaataaaaaataatcaaagttcgcttttaaatgtgtaataaatccgagaccaaactgggaatcccttctgcttatcacatattcataacttctatacatttgtattttgcgcacattaattaaatactataaaagctgatcaatgatatttttggggattatcatacgcactaaaagcgatgattaatataataatttttaaatgaaataaatcttatattataattataattaaacactaacacttttaaaaaatatatttttaatgaaaaccattttaatgaaatagaaaaatattacctattaattttgccaaataataaaattgatctttttttttttgaagaaaacgtatttccggcaccttgtatatcacaataagtaacgtgttcttacaaaatttacttaccaaaaattttcattcattaattaatgcccatgaaattaaataactatagcgaggttaaaaatttttaaaaataatcctacagttttgttttgataaaaaatgcacgaaacatcatttttagccgaaaatatttcattttaacgtcccataaaaataaaatattgattattttcattgcccaattcttaggtgtgatgttcacctgacgccggaggacaggcattaatgtcaccccctcattaattatgatttttactaa

SEQ ID NO: 15116 - DNA, 1530 bp, Heterodera glycines
  misc_feature (1392)..(1392): n is a, c, g, or t
  misc_feature (1509)..(1509): n is a, c, g, or t
tccacgctgcattgataaaaggcaacgcagattgaacacttgaaaaattattattaaatttgagcattttttgatcaaaaaatttttgaaaataaattcaaattttagaattaaagtgtctaaaaaattaatgtttttttgatatacaatgatgactagggttaataatatacttaaaaaactataaaatatttgattttgaaatttgcaagtataaacttttgtatattttcgaatttataattttaatcatctgacaaatgcaaatatattgaattttgaaaaatttccttctctttaagctcaaattttttcgagttttaagggtatattttttgaatttcctaaaaatcaatcataaggtgtattttgcatttttcttatcatattttatcaaaaaaacgaacgcatattctattacattcattggtaaatgccgatttccaaggaatccaagacgcaatgcccagatccaaggatatacttataatccgaggactaatgggagccctcttgcttaaaattgacaatcaaaaattaaaataatttaagacttttttaattcagcggaaaaaactatgaaacaagacgaactcctcgcaaattttctcagcagccctctaccaccattgccaccaagaaaaaattcatcaacgaatacccgaaagagcacatcgatcaatgatcagctgaatgatccgagttggatatatgatatcaaaattaactatggacaatcatcgcgcaacaaaacgtaccaaaatagaactaagctgaccaaacatgaaacgaactttcacaaacaatttggtcaaaatatttttaacagtaaggacggatcaactgaatctgaaaaacgatctaatcagcagacaaaaaaaaatccaattagcatatatggacgagaaggacaagaagtttccggcaaccaaagtgatcagaatactaaaaagacatcctctgataagcaaaggaacgaaaagaataaaggcatttcatttgctaagaatgtagtcaaatatttatctgggcattcatctgacacccagaaagatcaaaagccaaaaaatcgcaagaacgaagctggatcaactggaaagaatactaatcagtcgaatgatgtcccttctataaataaccagcgtgatcaaatttctcaaaaagcaaccaatgatttatatggacaaccatctgaaaccccaagttatcaaaagaaagcaaatcgcatgaacggagccggaccatcggagaagaaaagcgatcagaatgacaaaagcgagctgaatgaagggacaccatcagaaaatcaaattgacaaaaccaaaacaaatcgcctgttaaaagcaaaagaaattttgccctttcaacagaaagagtagatacatttattanggatgtgtgagaaatgaatttttaccgagaattgagaaatgacaccgagaaacaagaccgagaagtgaaaaactgagaatttctcgagtcgcgaacctagaatcttaatgaactaanttaaatgtattttttaaaagt

SEQ ID NO: 15117 - DNA, 1350 bp, Heterodera glycines
gatagcgacaaccgacgtatattgcgacaccttgggcgttggtcgtttatcttttgtcgttcgtaattgtgattggcccctgctggggtccagtggtgccgaaacacgctgccgggaacacaaatcgtctcacatcaaaacgagattttgtttcggtacgagtttaagagtggaattagcacgaacttagttagaatttcatttgtttcggccttcaacttttattgagcttattgtctctacatagaaatggataaatactataaaatgtcattagagtaagcagacagttaaagtgtcacgcaattttcattttgaatctgataaattatagcacaaaaaaaactcacacgctaaatttctctttttctccgttatccaaatgaaattgccatatcatattttataaaatattttactaaataaatctgtcaatgaaattaattttcgatttggtgcaaaaataatttcaaggacaaaatcaaaaaaaaattgttgcgatttggccaaaaatgctgattttattttttaaaattgtttattagatatttcatctatttgaaaatgagtttcttcgataatccaattgttctgaatggtggaaaggcattatttgcctttttgatgcttttctccaacggattgttggtgttcgtctcgtttaaagcaaagtattttgttaattatataaaattcgcataatttagataatagttaattcaaaattttccctttaaggttcctcaacagcacctgcaattggctgatcacagccaactcggcatgcattgccatctattcattcacttattttatccagttttggcattgtgttgatcagtccctccggcattcccctctggctttgttttctgctcgtctccgtcccgctgttcgccgtctgttgccaatacattttgttcccagtgatcgctttggacagattgatcggagccctttttccatttaagtaagtaataatataatttacaaatcttcaaacgtctagcgggggtttttttaacccctcgtaggaaggcacaaatttttggtcaaactttaagaaatacggtaatttaaattaattatccagacaaatgggcaaacgttataagcgccgtttcatgctatttgcattaattgcctcaatttcgtttgccatttttatgctggccgcctcaatcaacaaatccatcattcatttctctgaaaagtaatttcccatttatttctgtagttaaaaaatctttgataatgaaaaaataaaatgaattttaaaaatataaaaagtgatttattattatagaatttatgaaaatttaaatataataatttttttgtaatcttaaa

SEQ ID NO: 15118 - DNA, 1916 bp, Heterodera glycines
tggtaataatacgacaagaaaattttggaattattaaaaaatagatgataaaataactttctgaaattttttttgatcaaattttgagaataattcaaaaaatttttagaatttttagcaaaaaattttgcatttcgtgttttcgttttttagggcattccgttttcgtatttttcgtgtttcgtatttatttttcgattcgcaacaactctgtatcagtgttttatcaataaattttaaaatttaacgtaaaacaaggtcattttttggataaaatatgtgccaattttaaaaatcttacaggcgatttatatcggcatcgccgtgtcttaaaaatcctttgatttcttaaaaatagcaatttcgcggaatgttctgatttcgaccaggggtggagcgcgaccgcgggatgtttttttgcacgatccgcggccgcggcaaattgaatgcgcgctgtgcgaccgcggattcttttgcgcgatccgcggatttttctgtgcgctctccaccctgatttcgacccaatacgccattccaactggatgagttttgacggctttcgatcgtcaacgaatgccaacattggcacggaacggtttggcccaaagttgggcgacaaaagcgccgccgggctgctagagccgttccagcagaaggacactgagtacagcttcatatacaacgcccaaattgcctccggtctccaatcggcggaacaaagcgcggccagctcgcagcaaaaggcggtgacgcgcatccaatgcttggccaacattcacttcgcatccgaacggcatgcacagctgcgactggagcagtgccgggtgggccaacagaacgacaaaatgtcgcagcctcaagaagtgcagccaatggaagcatttgatgaggtgaacacgcaacaatggcatgacttagataatttaaaatgtagagcagacgaacattgcggagcagataaagcagcagctgctgaccccgtgccaattcagctacgcggacagagtgatcgaacgcgtgccgtgcccccaggacgcggaggagtggtcgaagaatcaaaaaagcggtgttgaagttccaggtgactgggcatctgatgccgaactgcttgaccaatatgggcgttcaaaaaattgttttccttataactcatgaaataattaccgtatttcctcgattatacgcccccccccctcgaatggaagccccccctcgaatataagccccccttggaggggggttgaacaatagaagccccccctcgagtagaagcccccttcgaatataagcccccctcaaaaaaaaattttttttcaaaacttttgaagtcagaaacgtgcaaaaactattgaacaatttgttttaataaaacattaacaaaaaaatattaggaaacttctgtatcaatttcttcgtcgctttttatggataattttataatatttatttgttattttaaatacttttaaaacacaaaaattttctgaaaaaaatagtatttttttaaaattcataaaatattttagaaagactaaatgtacaaacgggacccacgcgtttcggcgctcgcgtttcggcgccagctctttttccacgatagcttttttctttgacatccaaatacaacattgttggtatcactcgaaagctcttaacatgctctattagccttaccaaaagcgaaaagattttcaagcctggaaaaaattttattacgaaaaaacttcaaaaatttcgacttttcgcaattttcatgtataacttttttggaaattgtctaatagcgaagcaatagcttagaaaaatttctgttaataaattgcactggaaaagattttgatgaaaatcactaaaaaattttcaagcaaatatagaaatattatacccaatatattttttggtttgttaaaaatggg

SEQ ID NO: 15119 - DNA, 1177 bp, Heterodera glycines
aaatttggtcattttttgacaaaaatctgttaacaaatcgctttaaaaatcgaaaattttcccggcggcgcctatcggcaccgccggactctctcctctcgcccatttcccaaaagtttttttggaaaaatgcgccgcaaaaaatttttaaaaatctgatttttcacccgagtgcactgaaatttacgatttgctaatttcctcaacaaaatttttaaagatgataatcggacgaaaatctaatttttaatacatttttgattaaataaattgtaaaagtaactgatttgaagcaattttgcaaaatgttctgatttttgactttaaaatctggttttttgagcccgatgttctgatttcgaaaaattttcgatcgcacccctggtgtatacacatttaaatacatttcgcatataaaaaggtgaaaaaatttacattttaaatacatttcacatataaaaagatttaaaaaaatttatccaggaaatccaggtttttcatgcctggacctggatttctaaattgatctggacctggatttcctggacaaaaatccaggtccaggaaaaatccaggttgccgaaaaatggcctggacctggatccaggtccaggtcgagctctagaaattactgaattcctaaaaaaactcacgaaaaaatcataaaaaagccatcttttcgtcaagtcttcatatatgattgatggctgtcatgcatattttatttttttagcttttgtctcattttcgctttaatctcttctatttcctccttcaaattgccccattatccgccattaattaatgtcttctcccccctcgccaaaagcctcgctcattttggaggcacaggccgattttgcgttgaaattgctgcgcgaagtgtccacggacgaccgttcgtgcattgtttcgccgttttctgccgccgtcactttgtccatggtttacgcgggcgccaaggaaaagaccggcgaagaaatgggccaactgctggcaaatggtgggaagtttcgaaatttcataaactgctgttttagaattttggttttttgtttaaatttgggtcttgaattcgaatttggccggaataaatggcagattcgttatcaaaaacttagaaaacccccagaaacattatcctcctactttgaaaacaacaatttctgttcttttc

SEQ ID NO: 15120 - DNA, 2281 bp, Heterodera glycines
  misc_feature (86)..(86): n is a, c, g, or t
  misc_feature (122)..(122): n is a, c, g, or t
aaaaggtaactcgcccggtgggactcgatcccacgaccccagcaatccgtgccgtgctctaaccaactgagctacgggcgctcttntagaggttctctcaggtcctgtatcccactttctcncacactccgttccttctggcatcacataattagtgcgtgaagttttacaaatagggtgacttttgtagtcattttaagtactttaagttttacaaatatgcgggtttaatattaatttttagtatatgcgtcatgttttagaaactttacaattgatcacataccagattttttacaatttgcaaattacaaacaagcaccaaattttacaatcaggctgattttattttttgtattaattttttagctgcttcaagttttacaaatagtcgaattttttctagttaggctttatgccattttttcctgcaaatttctagaacttagttacaaaaaccgaatttaaccaaaacacaaaattcatagcactaaaaattcttccttccccgattttcggtaccgcaaggggctgtccagtgccgcatgagcgacccggtggcgcggaattgtctgaaaaacaccacgcgccaactgagccaactgatcgctgacggagcgctggaagaatgccaatgcccgttgccatgctagtgggtacatttcaaagggggccgcccagaaaagtgggctcaccgactaattggcatttgcgtgccaattctcgcattttccgaaattcaaaaaattcccgagtcacatccattttaatgtcattgatcagactgatcactaattgccttcccccatttcttcagtgagacaggctatgaggtgacttactcagcagcaaattggccctcgggtaccaccaaattactggagtgcgaaagcaacgacgctctttgcatggagaagtatcggatcaacgcggcaatgatgcaggtggcttaggggatgaatcgagggggggggggatcggagacggggacacaattattgtttggcaatttttacaggtgttctatgaggaattgaactaccaaacattgaccgaaagcccggcatacagtgtaattaacacccgtccttgggggagctggacgtaataaaacattctactgatggaaaaccaacccgtaatataccatgattagggctctaaaaaaaccaaaatttccgtaatctgtcattacgcgtccagctctgttctctgcactctgttttgtaagcatcccctattataaaaacagatgaccagtttgatcgccgatctcggaggtctcagcggactttggattggcatctctgtggtcagcattttggaggtggtccaactgatttggttctgcatgcaatacatccacaagaagaagtcggtttcaaccaaagaaggaactgacaaattccagctttttttactcaattattttgtgattttaagaacgcccgaactgttggcaatggtgcgcagtgcgcggcaacgctcatctgctggccacacagacaaatcgccgtccggcagctcttcgtcgccacctcgtgcccggactgagtcggtcggcgcctactcactcaaatcgttgcattccgtgcgcagcgatttgcggcccggcattcgcattacacaggtgcgaaacggcgccaatcggcggcatgttcaaacaccaatccgaatcaccccaattaggagcggttaaaaccgtaaaatttgcaggaacgtcgcccatctcatagcactggttcatcaacgccttacttggcgcccgaagtggaattgccctgtacatgtttgtacggtgcgcgaggccaaattgtgtttatgaagccgctctgccctttccacgggtaagagttactgtatatacagtattaacttaggtgtcccataacggcaaatgcttatgtggccgtgccattttaacatttttgcatattttgtttattgtcagttacatggtgcgacgaatcatgcgcccacactctgatgaggaggaggaggatgagatatttgacgaggaaggcgatggggaagaggaggaggaagcggaagatgacgccggcggcgaccatccgcaacggcgattactcaacccggaagagatcaaagcgctggagcacgaggcggacatggaacatggacaagcggacggcggtgcggcgacggtgccgcacgataacggcaagccccgaccatccgtgccctcctccggtgccacccgacgcgcatcggcgcgtcgcggaacggtcaaatcatcacgacgctcatccagcagttcgtc

SEQ ID NO: 15121 - DNA, 678 bp, Heterodera glycines
taccggatgaagagccaagcgcgtgtacacgaaggcagtctgaggactgcagaaggtggacgccgatctccgaagacgacggacgcttctgacccgttttcgtcatttttgaggccttttgatccgcaattcttaattttcaactcatttccatttttttatgttgtccaccacttattagcattttgacgacggataaaaaacatttatccctaagttattcaccgtttcgacctcaattttcgacccaaaaataatttaaaaaagagttggacatttcgacccctcaccaaatcatactgtttttggcaaaaaatcgtcataaatttttgtcaaactgaattatatctatcattcttggtaacattcatcaatatagccctccgtttaaggaggttctctattttcaaaaaaaaattcaaaaaaaacaaacaaaaatgataagtagggcccggattcttagttttttaactattttttctgcggttttatttcaacgagaaatgcacgaaaaacacatttttagctcggaaattcttcgttttaacgccactattcatcactaggaatcactattttggagctttgccactaaaaaaaaattattttggaagttggccactaaaataattttttgccactattttggcgtttcgtcattatttttgccactatttt

SEQ ID NO: 15122 - DNA, 1533 bp, Heterodera glycines
  misc_feature (1411)..(1411): n is a, c, g, or t
  misc_feature (1440)..(1440): n is a, c, g, or t
tcataaatattttcgtcatttttttgcgaacattccttctatgttaatgagaattttttcgaaatttggcaaacttctaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctacttataaattaaaaaaaaataataagcgaaacgaaccggcgcttatccaatcttaatttaattagccaaggttatgcttaattaatcccagttaaacgcttcaattagttaattaatccctgctagtccccggttaaactctcattttcttcctccaatttcgttacgctggtcctcaatatgtccagattcttctcaaaccctttgatgacttttcccatgtcgtcaacaaaacattcagcgtttgcctttatttgcttcattttctccaagtcatcctccaacgcattaaacttttcacaatatcccttataaattagagagattaatcaatttataaaaaataaataaaaatgcacaaaaataattctgattttttctccttatttaactaacaaatacttattatttgttaaaaaatatttaaaaatttaataatccataaaaaatcaaattccttaaatttattcaacaaaaaagggcaacgtttcttataataatcacatttaaataatgaaattaattttctaactcacataacagccccccttcccaccgccgtttcccccttttgcgggcacaatttgcgtgaaaaaaatatccaacggcaaaaacaaaagggcaaaaggggcggaggaaaaaaggagcagcaaaaaaagcatttcgaattattaacggaatttaaaaatatataataatatggaaaatggtttacaatattatttctataattttagcgtttcatcaaattaatggaaatatttttttatttgtcaatatcgatttaaatgtgaatcgataaatgaataaaaatgctaaattttacgattcaaagaataaaaagaataaataatttaaaccatgcttaaatttaataataacttttttttgtaattctttttattacagattttataaaacaaaaggtaaatacagtatatttcactaaaattgatttaaaacgatctaaagcaatctaaaaatagggtaggggccaggtccggggccaggtatggggtccaaccgggtcctgaaaaaaaaattanaatttcactttcaataattaaattcttanagattttaggttttccaaattacttgagaattttagttttgttttattgtcatgactcaagaaattttgtaggtattttaaaaatataaataa

SEQ ID NO: 15123 - DNA, 2907 bp, Heterodera glycines
aggagcggtaaataaggcaatttaaaaataaatattaaagcaaacgcccccaattctatttttctattcattcctaacatttttagaccgtttttaacaaattttaacttttgggactgtaagacaattttcccaacaaatattcgaattttcaagtcacagtccaaatttttgaaaaaataaaatccggactattcatttcttgtaagatggaaaataagcactggtaagaaatgtgttagcccatttttatctaatttgttaatactattaaaaactttcgataaatgattacctaatcttatgaaaaaaagataacctttaagcaattagcagacattgaaaagcaagttctcagattttaatatttccaattcatatgttttgttcgaatataatcaaaccaaaatagaaaatcaggaagaaacatttgtctttcggtcaaacttcggcatttattcccttggcctttcaattgccttcttcgtcgtgcttcatcaaatcttaaagaattggatcacaattttgtggatttttggcagtcatttaacacatttcccaaaaaatgaaaaaataaatgcaaaaaaatactcaaggtaagcgcattgttcgcttcaagttcactgagcatttgagcgcaccaaacactgacatcaaattcttttgacttaacaaaaatgaaccattatttgcataaaatttcaattccgttaacatttcgttcgtcttattatttgatttctttgtggattaacagaatttttccaaacccaaaaattgccccttttttttggataattctataataaattacactcaaatttaaatcttttctataaattaaaaaatgagtgcgtggcgtaaaaagtgttgtgaagaatcaaaaaaaaggatcacccgactttctcaacccaactttgggggatctcagcccttctgaacccactttttgcttcaaaagtgccctccattggtccaaaataattcgacgatgcattttcaattcgccgtaccattcgttgattagtttgcacactccgatttgattgagcctacacaaaaaacaaacaaataacttaaggtttcgcttaaaatgaaatttaaaaattcttccgaattttccgctcactttttgcgatggtttctcttcgtttcacgcaatcgaacgcgcaaagcacgcaaatggtcagtgtaatcgcgccgaagacgttcagcggaccaaacggtggccgtcggaaacatttgggacggaatgtcgcgcggtacgaaatcggaccgaaaaggaaaggacaaacggtgccaaaacggagaaataaatgacaattgggcaaattaaactattttaaaagcatttcactaattaaaggggccaaattcactttattcggtcggcaagccttttgacttcgttgaatcgctcgtccatttctttcattcgcttcttaaagctgaaaaattgaaattgttcatatgacgttggattaaatattgcggccttgtgcttaagaaaggggctcaaaaatataaaaccttttggcattcgttttttgttttgtttaagtgaacatttagtgcatataaatgcctatggcacgatttttttagactttttaaagcatatttcggccaattaggcaaggtttcataagaaaaattcagtgagtttgtattttattagaaaattttaatttcaaaaaatatgagtgttttcaaatttattggcatttttctgaaatgattcttaaaacacattccgggataaaaaaggatggtgccataatttaggattttttaactggggagttcccgctggaatttactttttttttttttttggggggggggggtgcttactccgtgtaccatagccccgcatttccactgggacttgcttttcaatgaattggtgcatgttaacgacgctgttcaacagttcggtcatcacttggcctgccgtttcatatgttgccaaacgctgcaccaaattggcaccaacgaaaaaggaaagttcggcacgagaatcttgaatacgctgaaatttggaatggttatgcaaatacggaaacaaattaatagaaaataatgagattatgatcacaaacaaattgaaggcctttcccctttataaactctgagtaaattttcaaaatttagtgaattgaatattttggacggcacacgcatagcgacggcacctccaaattagaattttggttataagtatcctaaaaaggaccagcagcagtttggggaaaatctgcttcaaaatttttaattctaacggcgttttttatgtcaaaagaacagagaaaaggccgtcgattttgtcgttttttctggacatgagaggcccgactcgaagaaatggcgtgggagaggcaaacccgacggtttttgtatataataaaggaaaatgggtccctaatgatttttaaattaattttaagaaaataaaaacaaataatccgaacctctctttttgtgccatggatagtacaataaatttgccataaaaacgaattctcaccttattaagatatgtgtcttgctggtgcgcttccgaatgctcaagtgaatgatgttccttaattaatgagacaattaaggaacccaattggactaattaccatgccaaactatgaacaaatatgcaaaagtgacagctcacctcttcaatgcttttcagtgttggagagacgagcgggtgataaactttcataattttgtcgatacaattttcggaaaagacctaaaaaataaataaaatcataaaaaataaggtttcccttttcaccttccacccttttttttgtttttgcacgagagaatcgcaatttttggcaattgctttagaaagtaaaagcagacgagcggcatgttcaaagggaagcgcagaaagcagctaaa

SEQ ID NO: 15124 - DNA, 1550 bp, Heterodera glycines
agtcattctgaagaatcggagttcttcagtcctttgttgttttaacaactcttggagctgttcccgagcctgcttgtaagccgacgcagctgggtgattttcttggataacttgttccaaaatttcaaagctgatgaccctgcacaaactcttcatcgtttgtgattttttcaccagtaaaggtgggattttttcgtcgctgctccatggcttcgactggatccagaatgtataactgaccgaagccaggaatctgggttgtgccagcctgcatgctgcttatacggcgatggaattctccattgagaattactgccatcggtccgcctgcaggacttggcttattgccagccgaaacactcgcaaattggagcaaattattgtaccgcgacatattcctaacaaactccttcccttcgcggggttgtttgtcgcacacgatgagctcttcaagctcttttgggtgcgggttaagctttggcaaaacaacccttccttgtcgacagcaaaggctgctgttctcatgcgggaagagtagtgctccacaatgagagcactttttgtcgccaagctttccagaatcggaatattccggataatgcttagctgctgcagcagcacagcaccagcccttgtggataagatgacaccgtttagtgaaaggtgtaacctggctgagtgtatttgccgatgtgcgccgctttggtgcgggtgaaggcgaacggctaatcgaagcagattgccgcctgccaatgcgcgctgatcgccttggaggcgtcttcggtctgacaaatattgcatcgtcggcctgcgcaattggctcttgcggtgcgcaagactccgacaccaaaccaagtgtgtcagcttggttttcacctgccacttgggcttgggtgagaacggcattgacagcatttacactcatatgaggttcgatgatcataatgtcatttttatcatcaacttccattgactcagcggccttggatgtcgactgcgcttcatccgtatgtcgatagacaattgggcaaggagttggcaccccttcccttggatgatatggcacattatcagagccatacagctcgttaatgtgccacaaaatacgcttcttttcataatttatgaataaacttggtagaacaaatgttcgattgttcataagccaggattcagcatacaggcaaacgaagtacccgcagctatttccatcgtgttgtaccgtgagattttcggcattaagaatcccggtcaacactgtcgacggcaaaatgtcacaaatgatctttttaattttatccgtcagttgcggatccaacctgccatatggggtaggcaaagaatcggcaaaatgagtgccaaattgcacatcatggacaatgagagcccaatgtccagggaaatgtactggcaaaagtataacttctgccggaacattagggtcgtacccaaatgtcatatttttgtaaggcatgactctgtccaggccattgctccataccattgggtcaacaacgaccacttttcgttgtgatatggttgccaagtat

SEQ ID NO: 15125 - DNA, 1380 bp, Heterodera glycines
  misc_feature (1332)..(1332): n is a, c, g, or t
tattttaaatacatttttaaaagttttttttttgacatttcgacacggctaatttgcgcatatgcccaaaatagagtcgagtccaaaaagttggctggaagtgtcaaaaatgactcaagaaaagggccacgaatgttcaattttgctgaaccgggacgcaaatgtccgggacaccaaaaactgtactattgtttgggtctggattcgggacgagaaaaaaaaatgtcgggaatcggtctgcatatataatttgaacccaattttgggtatagacccgggcaaatatctgtacaaatttattttaaaaatcaattttttttcaaatttccctaccaccacggtaaaaatgggaaaaaaacatgtacaataatatttttcctttgccaaccttccgccggcaattcccatcgcacggcatgttgtttgtacgcaattgcaacaacaatcattctttttaattattaaaacaaaattagaaaaataattgaaaaattggccatcagagccacctgtgtgccaacaaccaatggcaccattggtggctggcgcaacaattgcggcggtggggcaatgaaagtgggtagtgccggaattggctctggcagcggcacttgcggggccggtgtttgcacaggacagggttctgattttttgggactttcaaggtcattgtcttgaaattgagaattttagacagaaaatcaaaaaacctgaaaatctttataagaaaattaaaaaaaaaaattttttgaaatcattttagcggtttttggaaaattttttgaaaaagcactaattcagcataaaattttaaaaatcgctaaaaaaaaaatcaatttttttttctttaaattttataagaaaattttctaaataaaaattttggaggggaggggtaactgcgcgtaatacatccgatgaaaacatgcataaaacttgcctggtctcgggcacaccggtggaggtgggcactgttgtggtggtgggcaaatgaatgttggcggtctgggaggaggctttatggagcaattttaaaattccaaaaactgcccccccccccctcattgctctaacccttggcaatctcattgggaccggaattgccacggggcatggcggcattggtggacattgaagcagttgttgttgtgccaggggtggcactatcacctgctgtgccgccggcattggtgccgccagcggcggtgttggcaccgaaacgcatgcgcacgggcgacaaatcttttttatggcaaaatcatttgtttgttaccaatttgataactttgaaacttgatcaacttttctctcgagtagctattcccaagtttncaattcaattaccgcctgctgctgctcattggtttgtgatgcttcggc

SEQ ID NO: 15126 - DNA, 1848 bp, Heterodera glycines
  misc_feature (38)..(38): n is a, c, g, or t
  misc_feature (1837)..(1837): n is a, c, g, or t
tcaggcaaaatcagaaaaacaataattagcatcaattnatgataatttgttggcattttctatttaaaattatttatagattaagtatgtgttttttgagctgcttcatgtaagcgttttttgattggcactgcgattgagacatttttatttgtgctctgatcactttgattgggtttgtttatgtgatctgatcggacgatcattttagtgggtggcgaaggttttcttcccattttttctcctttctgaagtggtttctgcttgtagcattaagtgtttgttatgctcaaggccatcgtcatcatctcaatcacatggagattacgcatacaaatttgggcaaacaaaaattgctcataaaccctcgggcaaaatggaaattttttgagcgagtaatggttagaattgtccctaccaagattttttttcttgaaaaatttctaactgaattttttttttaatttttggtggcagggggggtgagggaacgacctgctccgaccaataaatacaggcatgtaaaacattttttttcaaaaccggaagtcctgttttttggactaaaacccctctaaatggcaacgaattttttttttgttgtaattttctcaaatttcagccgcctcactctggccctaggctttacacggtttgtgcgtcgcttccggcgcatcgtccgaagggcatttttcatggcaacaacagtggtgccactttttgaatggttcactcggcgccgtttggccattcttgtcggcattttaataatgtaaaaaacgaataaaattttccctaaatttccctaaattttcaagttgttcactattcattctgctattcgaggaatatgtggaggacagttttgcacaagcggacaaattgtttcggcgtcagccgagcaatgtaaaaaacgaaaaattttccaaaaaaaaaatccgaatttccaagctcccacacccaatttgtccgagcaatggcggcgttggcgcaaacaccagcaaaagtgccatttttgccacactaacccagcattgccaacgctgcaacgattttgagcttaaagcgctccaatctggtgccgaaaaatccaaaaatttttaaaaaatattttaaagggcattgtcgtccaacgggatattttgatgtgtactcgtgcccagcagtggcggagtacaaagtggacaatggcacaaaatcacatcacacgatcatttataagtgagaaaataatgtttttaatccaaattggacgcaaaactcgagtgaaaaaaaaatagaaaacgtcatttctcaataaaaaaaatttcaagagttcgtgtctcccccccctccccccccccacgaaatgaaattttttttttacaaaaaattgtgtatttttgaaaaaaaatttctcatcgatttgtttttttaacaaattttttaaaattaaacgcctcgtagaccggggggaggggggtaattgaagattgggggataattagataatatacggtatgtctattgccgctatttaaaaatttttttttttgttttgttatcgcttcactttttgctcaactgatttttttcttacaaattttaggccctgcttgaccatgtcccgggaccaggagagtgacagcttttatatgttttgtatggcatcaatggccagtgctgtgctgtccgcgctgtacgttcgctggcgtcgtgaactgattgaacggcgtgcatttggctcttcggcacattcatacgcccgattggccaccgctgtggggagcaattgaatttgtttttgttttttgtggaaaacgcaaaaattcctccgatggcacttttgcacaatgantaaattaatga

SEQ ID NO: 15127 - DNA, 979 bp, Heterodera glycines
gtatcagttcccccccgagaaaaatttaaaaaacgggacaattttgtgcggggtatcatccttcccatacgacggacgattgagacaagggtcacattttcaaaagacagcccaattatccgtccgatggtgacttttttttattgcttttcaaaaattttttcgtcatttgaaagcatttcaaaacttggatttcaaaatttttctcttaaatattgtaagtaaaaaaaaaatgttttttttaaaataaaacagaagtaaataaaaacggggaaaagagctgttgccgcttttcccgccttcaaatttacattttttcaaaccttaaaaaattgtcatgaatgctctaaaaaaattttttgaaattttcttacaaaaattttttatgatttttttttttgaaaaattttttgttagacggttccgtccgcgcccgtcattatggacccgcaccagcagcaatatcaccagccggcactcattcaatcaccgccacaacaacaagagtacacttctcctaaaaattgattttttttttactcgtttttattttttgtgttgtgtaatctccgctctcaggtatatatagtataaatgattttggtggcaaaagatttttttttttcgccgaatttttttatgtttatctagtctttttatgtatgtaatatggtaaattaccgatggtgccaccctttttaacaacaaatttttcgtcctgaaaagtaagacaattttccaagggcttatcgggatcgctatgatcttgaatacaaaatccgtttcagacatttttgaatcccgaacattaattccgacagaaacttgaaaactaaattttttttattttaaaaatcgaaccgcctgatgaagatttcccacaagaaaaatcgtcatcgtttataccaacagcccctcaaacttttgaaaacgatttgtcatgtgagaaatctccaccacctacaaaaatatccgagtc

SEQ ID NO: 15128 - DNA, 591 bp, Heterodera glycines
ttatttcagggactggaaaaactgacaagtccatccattttttgtttttcttttttaaaggttactttgtttgtttaaatgtcctctcatttgctgtcgatgaaattatgtactctagcgaagtttctttatctttttcaaataggtaaaaccaatttagcatagaaaatttgataaaatgacaaaccaatgcaaatttgaagcggattagagatttgaaagacattatgcaaatttgaagaaaaagtggaaaaacaaaaaaatgacccaacattaacgtggagggcgcggggggggggagatggacagtgagagagagagagagaaagagagagagagagagagagagagggagtgcgattgaacgggtttttagtcggtaagtttgttggatgcctagtccgaagtcccggtccgtattttcgcaaatgccgatctctaattaaaacccaataaattttattaattagtcactgcttctcgtccattcaaaatatctttattgtaaaataaataaataaatctttggtcaaatgtctgtcgtcgcttttacacccgaaattcgttgctcttttccgcttcccccgcttc

SEQ ID NO: 15129 - DNA, 1446 bp, Heterodera glycines
cgtataaatataaaatctctacaaaaatatttatttaatcttgttcaataattttaataataacttttaacgaaggctttgaacggagcaaactacagaatttagtcgcagattaatgcttcttcaacaaaatgggcacccaaattcattttaaagtttttttaaaggcataatgccaaaattaatcatttatgaacttcaaattttttaaaccaaatttcccgtgggtcaattgagctaaaaattttgcttaacgaaatttttggaaattactcattcaggctaatagagaacacataatgctgtcgacagattcattcagtttgaatattatgaaaagagataatcagaaaatacggccgtcacccagcatttccaccgacaaaaattcatctttgtttaacttcatatttataatgcgtaaaacaaaatataagaccaaaatgaatggtcaagatcgagtccgttatccaaaaaatacggctgttaattcgcctttttgactttaagcatttgacatgagtttctctgtttggttgtatttgcttttgtttgatcattatggcaattttaaccatttatttgtcttttcagcatatcaaatattataatggacttaagtgctggtgatgaacagttgaagcggaactttagctgcaaaatttgttttgaggtaaataaaaaaagcttacaaagactaactctgtaattccaaaaattttttttgaaagtgactcgaattttcacattttaatattttgactccggtaataccggagaattggtgtcccggcgaaaaataaattaaaaaattttttttaagtcgttaaaacatatttatgggggttttctgggtcgctgatcgcgaatctgacatagttttgactaatttcgaatctcggacccgaacaaaagtagagattcaaaattctcacaaaatcaattttttaatttcgacttttggtccgaattcgagacctcgactccaaattattttgtcagataacataaaatacctttttttaatatattaaaaccaagagggagttcaaccaaactctctttcaatttctttaaaaacaatccgattatctctttttcctttagcccttctccaaggatcgtcgttatcccatttcgctaaattgcggtcacaccttttgcgctcgttgcgtcaggcagctcagcagcttcggcacttcaattgcttgtggtctctgtcgccgaggcacttactccgactttcgtcaactcggcaagaacgtcacactgctaggttttgtgcttttttattggaagaattcaaatttggttgccatcgggtgaagtattctgggggactttcaaaagtcgctttaacctgttggtagtcatttcgaccaatcccaaccatggatttgatcattttcgagaaagtttttagatttgcttgagaatgccaacctt

SEQ ID NO: 15130 - DNA, 2704 bp, Heterodera glycines
  misc_feature (2631)..(2632): n is a, c, g, or t
  misc_feature (2637)..(2638): n is a, c, g, or t
  misc_feature (2641)..(2641): n is a, c, g, or t
  misc_feature (2643)..(2644): n is a, c, g, or t
gtctttttttcaattagcccatacaaattgcgcaatttaaattataccgctactgatttttgaggggcattatcttgtgattgtaatgtgatgtgatgggataaacggcgggacgaggcgattgagacggatgcattttttgtgtggtggacggaattttcaatatttttggaggtcacatcatcatagtgaatcgtaattgaggcagtcatcttagtttaatttaaaattgcttagtttactccgtccgatacattccatacaataggtgtactcgtatgtaaagcataaaactatggtaaattgcaagcccatcgtagccttgtgaaaataatttttgattggcgggggaaggaggatcaccgcatatgaggacattttttttttaattttaagagcactttttattacatcttcgaatacaggcatggtcataagtgttgtcccatcatgctttgaaaaaaataattgcgtataaaattgtcattttccaatttcaacagataagtagcataccattggatagcattttttatgggctttccaatgataccatatttgcatttgtgacataacatttatttgatttattttaccatattcacaatttgatcaaaatataggtggtcaaaagtgttgtcccatttcatttttaaaatattgcttcccctatggtttttcaccgggcaagtaaattctgaaaaaatgcctacaatttcacttaaaaagcacatttttacttaaaaaaccatagaaaattaatttccaagttctatttataaaaataattctttctcgaataaatttctaatttttttctccccctgtgtaaaaattcatgatttttttttcttaatgtggacgctgaagatgttctcgaatggacaagctccgacggaattgtcccaccttaaaaagtaattttgttaaaaaaaataaataaaatcgaaatttaattggaaatttttaaacatataccaaatatggtcaaaaaaaattttatgagcgaaaatactggaaatttcgttttcaaaaaatttttaagttcgattaattgtgcatgttagaaaatttgatcggcatttcctggaactaattttggtggaattccaccgacattttagcacaatttaaacaaccaattttggcaaaaaaaagttaattgaaagtttggcacaaagtctctgagcatttcggcatccacccaaaattaccgtgtcaaagctaaagtcgaaagctttcagaatttccatcttttgttccttaatctgttgaaaaattggatcaaaattgtacagctcgggctgatcaaccattctcaaatcatccatggccaattgttctttttgtttcaccaattcattgattttaactcgtggaataatgccgataatttgcatttgtgccatcaaacttgtgcaaatttgcatgaatttttgacgtcggaccgttgctaaattgatgaccagctaaggaccgaattttaatttttaaataaaaattatcaacttttttttcttttgtgattttaaatttaaaaattttttaaaattatttttgatattaaatgatccaatttttaatccttttaagcatttaatttgaccttttaagggtcgaatttaaatttaaattaaaatttttttttcagtttttagtttatttgattttaatgttttttttcgaattaaatttgccaatttaaaaaaatggcgattttgttcgagccgactccgaccgaatacaaccgtcgtcaatgtccgaccatctccaggccaaaacgggtgaagctagccctaaatagggtcattaaagctctccatatggcaatggctgagcccgctggccctaaatggtcccgcaatcactccgtccccgtccgaaacgttcagagggacaacgctcgccgctaaccataggcaagcgctagcgtactcagcgagcagcccggtgcacttggctagccacaagtccgcagcagcgactagcgagcgggaaacggcgccggcgagcaaatcgcatatttggcgttgtgttattgttcgttttatatatagtgggataataatgaatcttttttggatggggtgtaaaatgcgtgagggaagacagacaattgggtggggtattttcattgggcgctcgtttctttgtcagcggcaaagagaaaatatgccatgctatttcgcccttttcattttcactaattgtcacctaattacatgtaattcattaacttaaataaattcagtaaacagattctttgaaaaacatgtggcgaaaattgttagtttaagggattataaaaatgaaacaaaaaaagttaaaaaaaaaacaatttttcaactcccaatatcgctgcaaattgaaatattaagaattaaaaaataaaatatccatctgaaatatttctttttggtccaaaattgcctaatttggttgaatttttggcgtcggatttttgctaaattgggctaaaaccaaaatcaaaaaaaaaatttcatcattaattaatttaaaaatttttattcttgaaaaaatggaaattttgctatttcgctactaattgacatttataggacaaaaattacacaataggtacggacttaattgccgattgatttaaaggcnntcttnnatntnnttaattttaattcaagaccctttacgaaagattcaaaaaaaaattaaaaaaattggcgtt

SEQ ID NO: 15131 - DNA, 1204 bp, Heterodera glycines
agcaaattggcatattttgcgtaatgttatcttatttttatattaatggaaagcatttggaatgctttttggaatggggtgtaaaaggggcgaggtaagacagacagttgggtgcactattctcacttgaccatcgtttcttcgtcagaggcaatgagagaatatggccatatttttgctctttttgttttatgaattgtaattttgcctaattaaatgcaattcattatttttgattgtttgttttttaggggtttgaatttataattaatagaactggtcgagcatttttatttttatgaaaaaatttagaattaaaattaaataacgtaaattaaagagtttttccaaaacaggtgactaaaattattattaaaaatattttattaaatgaatgtaaaacataaaatataaaaaacagaatttttaaatttcaaaattttttaattttctgccgttgatttgcatctaataatcaatcaaaaaaattgattaaaattcataaaaatactgataaattcacgaagttatcaagcaaattaatgattttttggaaaaatacagtcatttttctatttttaaagaccttttaaaactttaattttccagtttcttatgtcaaacattttttttgagattttatttatcttacattaatctaagcccttgttaattaattagcaaaaatattcataatattccccaaacttacacctaaaaatgcgtaaatattcggatgccgtgttgtccccgaacttgcctgtctggctctgcaaattggcaagttcgtttgcggcatttgccaccaattgttccaattgttgcgcaatgctctggcgcaactgtttggacttttgttgcgcaacactggccaaatttttcaaatttttacgaacattttcttgaattgggttcgacaaattttcaatgattttaagaagttccttggattcattgagaaaatcgcgtgcaaatgccataaatccgtcgccatcaattggctgtgttgaataaacgtgaattttggcttccatttcaccttccataatgctcagctttatgcggacagcaatttcttggcactttactaatgagtgaatttttcattaattagtggaacaaaaatcattaaaacgtatctgttggatagccctaacaataagagttctctatcagtctgcaaatttcaaaaacttcgtaagtt

SEQ ID NO: 15132 - DNA, 2223 bp, Heterodera glycines
aaaaaatttagcctattaaaatatttagaaatttttttatactgtatatttttgaaaaattttccgatttcttgcaccgcaaaaaagtgggtttgaagaaaaaaatagtcaaatttatgaacgttaataatttaatttccgatcaactttttaccgtcggatccaatcgaaaaatcttagtcgacccatcagccccttttaatgcatctaatgcatcccgacagcccctaaaaatttatttctcagcattttttgatttttggaaattttttgaatttaattgaaattttttcgaattttccaaaatcccgcaatcccgcaaattttaaatgcgggatttgcgggattacgtcccgcaaaaaattttgagtcccagtcccgcagcgggacccgcaaattttaaatttccggtctctaataaccactatatcacacaatacaaaataaacaaaaagaaatttatagggatgcgatttttagttaaatacctaaaattttgcgcatttaatacgcacagataagcacgaaaaaagcattttccacttggttttgggtgtctacgatgacttttataatacctatttttacctattttggagtttttctacctattatacctatttaaggattttcagaaaattccttaacaaaaatgcaataaaatcaaaaaatacacccctaagaattggaaaatttttcccaaaaatttatttgtttttttatgtaacaaaatttttaatttaaaatgtcaatattttctaagaacatattaaaaatatttaaattattcgtttacaaagaaatagaaccaaaattttccccttttgtttgcttttttccactaaaaatcgttaataaaaaattttatttacctattttggaatttttgtacctatttaatacctattgagattttttttttacctatttaagtacctattctgggatttttcttacctaaaaatcgcatccctagaaatttactttatttaataaaatttggcaaaatggttaaaaaaattcaaatttcttataacttttttgccttttgccccacaaaaattccattcttaggggtgtatatttaaccccgacccccatcggggttaagggtcggggttgtggcatcgatcaggacgagggtgacaatgataatgatgtttggtgcatcatcaagcaaaatgacaaatcaatgtgaaaaaccaactaggtaaataggctaatgccgccttactttgcacttcaaatgtctttttaacttgcaaaaaaagaaagtctacacggttttatcagaaaaagaacaaataagttaaataagtatgtccaacagcaacaacacaacaatatgtgaagaggacggagctttttttatttctccgcacactgatacagcatttgttgggccttcctcactcactaaacaagtcaagaaaaatgattcaatgtttaagcagcaattacggtcaattgaagcttaccgcattcatagtgagacggccagtaaacgtttcactcgcctcctcctgtccatcaacaaacacagtgatgacgcggaaactgtactcgatggtgtgaacaagtgaaagaggcagaaagttgtggcagtatttgctttgtccagtgaaaggaatggactgaaaagaattgattgtagtgattaaaattcttatagaaatataaatttgctaaattttcagtgcggtgcctgcccatcagtaaatcaacttaaatttttaaagtttgagtgcagtagagagagagcagcataaccgatgtttggctcgggtaaaatattcaacgggaggatttctcgaaagatttttgaagaaaactggaattcgcgattttcccgatctcaaaaatccaggacattagctgaacctccctcaccccacataacaatttaaaaaacccaattaataaccttcgacacattaatccaacggcccttgtccatacgttgcacaaagtaatgtttaacaggacgcgcctcctgctcaggcgtccaatagatttcgatagcactcggaccgccttcggcccagacctttgaaaagaataggaagtttaatctgtaataataagagcgaaataaatttgtgactgattgtcagtcagttccgaaaataaactgttgctcaaaatgaacctataaatcaaaaattatgccaaattcgaggcttgaaagcagagataatgtttaaaagaagttttgtaaatggg

SEQ ID NO: 15133 - DNA, 3231 bp, Heterodera glycines
tctttcctttccctcctccccttccccatttgttagacctctccctctctttctctgtccccttccccatttgtaagacccctctctttcctttccctcctccccttccccatttgttagacccctccctctctttctctgtcccctcctcgctctctcccttccccgtcttttcagtctttcccttcagagtgatcaattgactctcgaatattacggtcgcctcaactttttcccccgggagaacatcagtgtcaccatccctttgatgcccaccgaaaattggttcgacgcgcgtacgaggcgaaacgttgacaaagtgacaaagccaaaaaagacaaaatgacattctttggctaaggccgtttttatgcgcgcgttggccgacgttaagggcattttggtgcgggcgcggtacagtcagtaccaattgcagtcgagcatctacggatttcacatggaaactgcttgggactcggcaactgcggagacagacaaaaatttggcaacggtggcactttcggatcaaaaaaggcatcccgtggaggtgaaaaaggaattgtgaaaattgtacaaaactcaaaagaggggaaaggcattcggtcgagaccaatctcgacaattgcgagcagaagaagcgaacaactgacaattaatacataaacaaaggtatgcgcatgtcctgaacactttggagggaacagctgcgaaaagtgtgagaaaggctatcgaagggtgaacggccaaatttacgacggaatgtgccaaaagtgcgagtgccaaggacattcagacaggcaacgggcgccaaaccaggcgttgacttttgattttggcattttcagctgcgaccccttcacggggcattgcctgcactgccaagtgagtctttccaatgatcggggagttaatgagccaattatcagcacaacaccaccggtctcaactgcgagcattgtttgagcggcttttacggcaatccgtcgctgggcccccttttgggtcagtgccgcccctgcgcttgtccaaccgttgcgcattcgcattcggccgagtgcacactgagccaattggtcatggaccaagtcgcagcagtggggcaggacgactacgtttgtactgcttgcgaaacgggctatgacgggaacaaatgtgaaaggtgaatttgagaggagtaaagagattggcaattgccaaatgatgctctaaggccatgaatgacccttttgagttgtgccgacggcttcttcggcgacccttttgccgacaattcgtccctcgcgtgccatccgtgtgaatgcaacgataacattgacccggccgccatcggaaactgcgaccgtcgcacgggaaaatgcctgcgttgtgttggccataccacgggggaccaatgcgaacaatgcctgcctgaccattggggctccgcgcttctccactcgtgccgtccctgtcggtgccatcataagggggcattttcctcgcaatgctcaaatgaaacgggcaaatgcgaatgtcgggagggatacgcaggcgaacggtgggacggagaacgttttttagtttcactagggaccattttggtaatcattctgccaaaggtgcgatcggtgtgttttgggccacggcgacgtggaaaacggctgcccgaaatgcctttgcaattccaccggttcgcttggcattgcgtgcgacgaattctcgggccaatgcgcgtgcaaaaagggcgtctacggcaaaaggtgggctgatgatcatcgactgatcaaattatgcgctgctgatccgctgatttgtttcgtttggccaggtgcgatttgtgtgtgccgtcttacttcaatttcggcccggagggatgcgaattttgtcattgcaacaaatttggcgctttcccggacaaggaatgccacaatatgacaggcgagtgccaatgccagccgaaacgtggaggggctgaaatgcgagcgatgtgtcaagggcttcttcaatctaacatctggggacgggtgccaggttgtgaccaagagcacttgtcggaatgagaacaccattaacctttgtccttgattagtcgtgcgaatgcgactcgcaagggtcgctggaggggcaaagttgcgacacggtgacgggacagtgcggctgtagggcgggcgtgacggggcgcaagtgcgacaagtgcgagcccaaccattacggcttcgattcgtcgggatgcaaacgtttgtgctggtgcttgtccttggcccatgcgacgaacccccgtcttttagtgtgccgtgtttgtcctgcccctggccaagtttgcgacgctgtcactggcgactgcgtctgtccgccgaacacgcggggcgaaatgtgcgagcagtgcacacagaacgcgtggaattaccacccgtaccgcggctgtgaattgtgccaatgcgacggaatcggcgccgactcgcaattgtgcgactcgcaaacgtaggcattggcaatgccaaaatggcactgctggacccaaacgttgttaaggggccagtgcaaatgcaaggttggctatgtggggcaccgttgcgaccattgcgaacccggccatcattcgttccccgactgtcgcccgtgcgaatgcgacacggccggcacggagtccagcgagtgcaggggaaacacatgcttatgcagcaacgaaggacaatgcaagtgcaagaagaatgtggcgggacaaaagtgcgaccgatgccgcgagaacgcattcaggcaaagcattgataacgaaattagcattggcaaagccaaaccaatttctgttcagtttggaggcttggaacccaaatgggtgcaccgaatgtttctgttccaacaaatccgccatttgccatcagagtgcgcgcgtgtggcaccaaatttacgcgcctgaccgaagtgtgctgttcgagtcgccctttgaaatgttcgatcgacggcatcgcctgcacattctcaagtgggtggagggggtcgagaaatgatttaataatttgttaattgcttatgccctcccccacccctcagagagttgccctcccattacaattcgtaccccactgaccacactcccctctattggccactgccgcaaggcttcaaaggggacaaaaccggctcttacaatggattccttcgcttccgaattcgaaacgacgacaacttccggggacggccaaatgttctgccggacgcgcactctttcagaatttatccgcaagtgctgct

SEQ ID NO: 15134 - DNA, 869 bp, Heterodera glycines
ccccccgttttttgccgtttgacgattgcggacgctgcctcgcttgcaaggcaaccgaggccgaggtggacataatggtgaccaaagagggggtcacattgtggtgcactcgtatcaacaaaccccaatttgtgccgttcgatgtcgtctacgacctgccagggcactgctttttccgcgtgaagaacaaagcgagggtgttcaatgtcccctacggagacctgccctccggaacgtgtgccaaaagcaaaccgacagaccaccaacaacaacaacaacaggatctgaagcgcaaggcaaaggtagcacttgacctcgtggaggctggactaatggccgatgctatgcaggacggcacacggtggaagaaggccaaaacagctatcaacgtgcttggcaatctcctattggctgaatcactggactccaccaacagcaattccactgatgccccgacgcaggcaaatgaagccgctgacatcaaagaagaagaggaaaatgtgcagggagaagaagaaaacaaagaagacattggagacattgataaaactcttgacgacttctttaacagccttaatgcttcaacctcaaatgtgcctatttaagtgaataatttaacacacatcattttctcaaaaatattaaacacacaagcattcaccaataaagatatttgttttaaattgccatttggcctaatcatttcggggccttcatcatcgggcaaaactgaatttttactgaaattcattgccgaatcggaccaattaatcacaccaaagcccgtgtccatgctctactgttttggtgaaatgaatgcagcggtgcctgtgcttcaaaaggcgggagtcgacaaaaaggctcaccat

SEQ ID NO: 15135 - DNA, 2736 bp, Heterodera glycines
agatgatgattatatgtgggagagtgggtttgcgttgccagcgccatcacaatactatggcgatttgcctgtgctgccagacaacgcggacgaaattgaggagatggacaccgcacagcgcaggattgcaagcagaagaaaattaaaaaaggatgaagcagaagatgatgatgatgatgatgctttgcatcacaaaaaatacaggatttatcagcgttcacctccacggctcccttccccacctcgagcgaaaccaaaaccaccaccacgccaaccgaccacaaagagagagcaacagaagccaaaaaagttggaactaaaaccaccaaaaatagagccaaaatttgaacccgattcacgaccatcgacatcaaaagtcgcgcctcggtcgaaaaaagagcctgagttccagcttgacccacggccatccacatccaggcaggctggacacttgcctcccccagcacccaaaattgtaacaaaacatgagccgacaaagagacccgtgccataccgtatcccgaaaagagaacccaaaattgttgaagaaacgccacagaggcaacagcaaccccttcctgctgctgtcgtcgaagaaatgcctcctgttcctccgcctaggagggggaccaaacgccgccaccccgtaaatggtgagaatgatggtgaggtgcgcataagaaaacgcgtgaggcaagcgaggagggtgcgagtacagtactcacccgagccgggtccatcaacatctgcacaaagtgatgaacaacaacaacatcgagaactgtttgccatcccgtcaaatcagctggagagcgggccgccctaccattaagccacctggagcggccatatttgaagagaggcttaggcaagatccaattttgtattcatggacggctcctccaaagaaaacagcacagagcacaaccaccaggacggcaccgaaaatcaagaaggaatttcgcccgaaaaagtggagttgatcaactccacgcttgacaagctgtacaacgacccatcctccccagcggcgtttgcaggtgttacagcgctgtggaaagaggcgcgaaaaaagttgaaaaatttacggaaaaaggatgtgcagcattatttggaggggcaccgcacctacactctgatgcgcccccgaagggtgcgctttccaagagccaaaactgttgcggctgggttcatgaccgatgttcaagtggatttggccgattttcaggcgctttcgcgccacaatcggggtcaccgatacctgcttgttgcggttgatgtgctgtccaaacgcctgtttgttgtaccgctgaaaaacaagagagccgaggagatgttggaggcattcagacaactcatcgaccaaatgccaatggtcccacatcgcatcttctccgacaaaggcaccgaattcaagaaccgattgttgaaggaattctttgatgagcaggaaattgagaagcatgagccagtgcattcatccgtcaaggcatcggttgctgagcgggccatccggaatgtgaagcagcgactgtaccggtattttgctgaaaaggagacgctgaattgggtggatgcagtacagaaaattgtgaacggaattaacagcgctccaactcgtgttcacgagatgcgccccattgatgttgacttttcaaatgcgcagaaagtgtggaagcgattgtacggacaccctgcccttcaaaagcggacgccacgcttccgtaaagatgaatttgtgcgcatgagcagagagaaagggcaatttgagaagagatatttaccaaattatggagacgaaatcctggagattgatgatgtgctgaaagcggtgcgcccaattcggtacaaactgcgggatgagcacggtgagaaattcaagggcagcttttatgagcaggagctggcgcgcgtaagaaaagatgcagacacaagctaccgcatcgagaaggtgtacagaaagaggaaaagagcggatggatccacagagatgcttgtcaaatttataggatatcccaatcgggaatggattaatgagtctcagcttgtataaaagcatgtgcatttttcattttgttgtgataataaacaagcatgtcaaacagtttctttgtgtttttgcccaacaatgtaacggattacccggacaatcagcccaacaaatttcgtgtccgactcccaaagcctttgcattttaacggctcgtgggtgtgtggactgcacagtatcagttacccctattcgtggtccaccatcgatacattggatgagcagtggattgacattcatttcacagaccgaagcactatcgatgatgaccgacagcgagtaatccgagtgccggtgcccaaggcatcggttaacagggttgaccagctcagagactttttggcagtcacattgcggaaccgtagcggagcaaagctgttgcaactcccacgtgaggtggaagaggatcgaaatcggactaaaccccttcactctccaccaccactaaagagaaacaaaagggatgcgtcaccgataccacctccaccaccagacgagagtgtaaaaatcgaagactctcccccattgtacgatggaaatgatgaggacctgattgaggactctcccccattgtacgatggaaatgatgaaggggtgattgaggagtcaccgccccattatgaagaaacaccaaaagaaactgtgaaaaaacgccaaaagtgtcgacaccaccgcctgtctcaagcc

SEQ ID NO: 15136 - DNA, 2371 bp, Heterodera glycines
ataccatacacttatgcatatttaagtacaaaaaatcattagtgtaatttaaaaaaaaattgtaaaataattttaattcaaatagtgtagtggtgtgtccaaacatttaattgcccaacaacggcaggaattgatttaattaacactttatcagtcgccaaactgttgccctcttgcgcctgtaccaacccgcacttgctttttgatccgaaaagaaatccgggctaccactgccgccccccttgtaagaccaactcgacatgcaatacgacgcttagtggatgtacgacaggctttttagcggtaagaaatattgttgtggaatttatgtttacaaaaaagcgaaataaaaaatgcaaaaatatttttaaagaatgttgatcaaggtaaaaacccaactcgtactaggccactcgttctgtttttcggcaaaaaaatggtcataacttttgtcaaaatcgacaaaattaaacattcttggtaccattcgatagtccttaatgttttctatctatctgcaaaatataagaaaattttattgcttttcaaaaaagttatgaccaaaaatcgtaaaaaaaatttttcgtccataactttttttcaaacttgatcaaattttttgaaacttggtgggtagatagagaattttaaaggctattgattgataccaagaaaggatgtttaatttggttgcctttgacaaaagttatgacgattttttttgtcgaaaaacagtacgagttggggtagtacgagttaggtttttaccattcactattcattttgtaattcatctcacacgcttttttatcttatgtcccaaatactgttgcatactgtatttatggggaatgaagagatacaaaggatcttccggtaatcccttatattcaggactaaaaaatttttaagttacacaaatccttacattctttttttatttcttccaatttgttttcatgaattattcttataaggttggccgaatcgctgacatcttgctccaaatttttgcgattttcttgacacttccaactttcgacgaatgcatcggctgccaaagccatcattttccaatttttacaaactttaaataattcttcgatggaatttttatcaatttcttgcgacttattttcgtcgttctctttgcattcccattttgtcatcattttgcgccaaaaccaaagtttctcgcaatttcaatgccttggccatgtcggcatcctccgttgtgccatcgtcgacgatcacttccatttttggctgattaatgtgatcaattttaagctgctgatcctgatcagcattttgtactttttcaagcaatggctcctttatgtttgggtccattccaaacacaacagaaccaattatgcccatggcgatcattaaagcgagcattggaagtaaatttgggaggattaatagaagacgcattttagctaaaataaagagaatattttttttataaaaaaaaagtaataagaaaatagataagtagctgctaataattccttcatattctcttttctgaaatttgtccacgtgtaataaacgtataagcataatcaatacattgtatagaatattaagcatgggtattgcatattcatataataattaaattatacatatacatacaataacataacggatgcccccacaaactataaaatacataatatatacagggtgcgaaaaggttctcgtattttttgaaaaacttcttattgtacccaaaaatttcactgtttctcttctgagtcttcaccattatcgtatttagcgacctttttttactccttctaccattacgttttactttgttttgataaagataacttttctaaagaccctgaaacaaagtcaaattgctctaaaaaggacctaaactgcaaattaacgaaaatctaattttgattttctgaaattttgtgaaatattatcgcctagtagcctagcaatggctcctttatgtttgggtccattccaaacacaacagaaccaattatgcccatggcgatcattaaagcgagcattggaagtaaatttgggaggattaatagaagacgcattttagctaaaataaagagaatattttttttataaaaaaaagtaataagaaaatagataagtagctgctaataattccttcatattctcttttctgaaatttgtccacgtgtaataaacgtataagcataatcaatacattgtatagaatattaagcatgggtattgcatattcatataataattaaattatacatatacatacaataacataacggatgcccccacaaactataaaatacataatatatacagggtgcgaaaaggttctcgtattttttgaaaacttcttatt

SEQ ID NO: 15137 - DNA, 2067 bp, Heterodera glycines
  misc_feature (27)..(27): n is a, c, g, or t
  misc_feature (68)..(68): n is a, c, g, or t
  misc_feature (2060)..(2060): n is a, c, g, or t
tataaattgggctgtgatggctcaganaggcataccaaatcggcttcttcttctgctcacttccctcnttatttggtaaattaaatattcaatcgcttttccctcattttgacttttaatttgtcccattttcagtgcttccctttgtccaaatgaccctcattagcaaatgttcgcttctcctccttttcgtcgcgcccttttccccatgcgtttttctccggctttgagtgagttcattacaaattttgtaatccgatgatcattgtcattgcttttctaatcatttggtcccctcaagggtttctcccaacgcggcacgtctccgtcggcgagtgcggttgcggcgggtgccctcctccgcccgagcggcggtggctcgagtccaactcggcatcgagctgcgactcgccgcgccctccaccgccccctccgtgctgcggttgtcgagtcgtcttgcggctgcggtggcggcggatgtgagaattttcaaatttaaaactgagtagtgccaatctgatccggacaatttttgccattaggaaaattctcggcattttaaggtacagacggttttgtttagctttggaatttttccttttcgatttttacattttttgcataaattaaaattaattttcgattttttaaggtggcggcggttgcggcggcggtgccattaaactgacaattggctgcgactccccacgccctccgcctccccctccgtgctgcggttgcgggtgcggctgcggcggcggatgtgagttcatttggtgacaaattaagacaaactgaattaattggccatatttgcacaataattctttcaatgaaaatccaaagattacttttcattgctttcacatcgctttctcaaccaagaactctgactttgtgattttggcttttttttgggtatattcgaattcgattgaccacgacattcctcgggggtcaattccctaatttaaatttgctattattattaaggtggtggtggcggttatggtgcaaatggcggcggcggctgcggcggttccattaagctgacaattggctgcgaaggcccaaaagccccgccaccgccccctccgtgctgcggttgcgggtgcggctgcggttgcggcgggtgccctcctccccccagcggcggtggctctgtccaactcggcatcagctgcgactcccctccgccccctccgtcctgcggctgtcagccctcgggcggctgcggttgcaatcgccgcaagcgcatggcttttctgcgccgcgccgttgctcagcgctctgttggccgtcattaagtgcaaaatgaagcttaattaggcactgcttattgatgacgtcaattgccgacccgaatgatcaatttaattattaatattttgtaacaaattttagcatagaaatgatttttaatttttagtgacccaatcgaattttagtattactttttgataattattttttcaattcttctgttttttaactaataaataaaattccttatgcattttcatttcatcccttttttggatttttcaaacaaaaaatctaattggatattgaaaataaaattcgtgatatatggtcgtattattgctatataaatattggattaaaacaaaatacctataaagactttttccaaattaatcactcaatatccactcgttaatgctgcaattatgacaattactttattttttcgtcatggtaagtgattcggggaacaattttaaatttatgtgtataaactctttaagaatattataggtgtaattgtaattttgtgtaattttaaggtttatttctatacaattaaattgataaaattatatatttttattatttaaaattgttcatcacatcattaaagcatcatccttttccgcctttttttgctttgtttcttcaaattttttgtttggcattttgtcactgattttgccgaacacaaaggccccttctgccgaagtcgcacgcccaccccgactcacacgcactgcacgtgtcacccgagccgtaaatggtttggcccaaaacgttacccctgnaaattgt

SEQ ID NO: 15138 - DNA, 1104 bp, Heterodera glycines
aatatgattaattttgagaaaaatatggcaaagtttaatttaaaaaaacacccacggttttatgaaacgaattcttttattctataattaaaaagataatttggtcatctcaaataggtaaaagcgcaattttttcctttttttagcatatctaacataaggattttttaattttaaatttttttaaattttcgagattcccttatgatatcataattcccaaataaagttcatcaagaagcttgaaaaactagccacaatgggtttaatttcagatgcaaaaaatgatctaaaatctcttaaaataggtttaaaatttttaattttcccaattcctatttctcccaaatttttcaaaattcgggtaattttcttttatggctgcatcaggaaaataaataaaatcttttttagctttgattttgtttcttttaattattttatttttggtatttttaaaaatattttatttaagaaattaaggcaattatactttattaattttttaatttataaactcaattttttctacaaaaaataaattcaagaagataaatataagttatgagttttattgataaggttcaaaatttttttcagagaaaatgacggaaatgcatagaaaaattatagcgcaaacaggaaatatattgaacggaaggatatgatggcagacttatattcacgtgaagagtgttttatttgactataaatatggcacttcccaaagagtgccatcaaaaatttgcttccatatcaaattgctcacccaaaaatgaattcaaagttggcacagtgcttattcctcggcattgttttaattttaaataatttgcttgttatttttggccatcctgtggaaaatgaaaatgatggcactaatggacaaacttcagaagaatgtaacacatttgtggcaatttgcaaaaagcattttgaattttattttcactagttaaacactcaaaattgaaaaaacaacgaaaagccatcactttttaagccaatttccaaaagtgtaaattaataattttggaatttacattttcagttgacaaagtgacgcgaaattacgttgaaacaattggtgaagagtgaaaagca

SEQ ID NO: 15139 - DNA, 1831 bp, Heterodera glycines
  misc_feature (24)..(24): n is a, c, g, or t
aaatgcaaaatgacaatttacgcncaaattacaaaaaatataaaatttagcttttcagaaaaccattcgaaaaaaataatttttaaagtaacacattaattaaggttcaaattgggggaaatttttgctgttaattacatgaaatgacactattttgatcatattattttttccaatattttgagaaatatgcaaacaaataaatgctcgtaatatatcaacaaaagagaatataatgttttcatggtcaagcgattgattgcttctgatcactgctgatcattgcgtccacgcgacttgaacaatttgttggaggccaacgcgcgtctgagttagtaccgcgccaccgcacgcttcataaacgaaatgtcgcgcgcacgcgctttaactgacgcctctgaataaaataaaataatttaaaaaatgttattgtctctttcaaatgcaattgctttaactttttctgccggtggccgaacgtttcgtcactgaacctttcgtcactaaacttttcgtcactgaacctttcgtcactgaaataaaataaagaattatttattagtgaaaactatttttttttaaataaagttatgtatttgaaattttggagtgtctgatcagtgatcaccgtaaaaaatttttaatggacgtcaaaatttctcgtttcccaaacatgagtgcctaaatgtaattccccaaatgctatttccaatagcggtaaaaaattcttgactatctacttttacatatttctgtaatttagctatggaatctgactcatcgcctcgaaattggtctttcaagaagcaacaattcgttagaagcgtggcataacatttggggggcccttcttgaaccaaacccactgttcagcaaatttgttaagcgaatgcttaaagaatttgaacgttggcagcacattgttgccgattttcacaatgcaccggcaaatgggataaggggaaagggccttaagagaaagtccatttatctacaacaagacaacaatttgcggcaactcttcgctgaattccaacaacgagcgggtcaagacccattgcaatatttaagagcgatttcatatcacttggctcaaatttaatgcttttttattcaaaaaataaaaaaaatatttggcgtattgtttaattttttaaaattttatttcagtgacgaaaggttcagtgacgaaaagttcagtgacgaaaggttcagtgacgaaacatcagggagcctattgttagaaccaaaaagctaccaatttgaattttgattttaaatattatgtatttcgatactgatttgatttggttaattttgttgctttttggataaacttttacgattttacacccctaaatttaagcaaagtgacatcggagggtacgacacggaggaggacaaagtaaccttggccatcgatatttatgtggacgatgaaaaaagggaaagaacggacatctcgattttcggttgagtttatggcattattcattttttaatatttcactatttatgcttataaattttctcaacttgatcgaacttcaatattttttaggattagagctataaattatatgcactaaaaatgcctaatatttgcataaaatatgcactaaaaataccatagactgaaccgtccaattttaaaatcgcaagaaaccacaaattttcagttgaaattgtaaatatcattttcatccatatttgtccgttatataagatcatttacgccatttttgggccaaaaatgataaatacgaaagtttggactttcgactttttgttcgagttcgggattggggttcggaatcggcgaaatggatat

SEQ ID NO: 15140 - DNA, 3113 bp, Heterodera glycines
  misc_feature (2983)..(2983): n is a, c, g, or t
  misc_feature (3041)..(3041): n is a, c, g, or t
  misc_feature (3048)..(3048): n is a, c, g, or t
taattcctggttataaaatatgcctttatattaaatttcctttccaaactcttcgatcactgtatgaatcgggtgtcgttggattaacaataacgaattataaataattcttcggtaaagattgggagatacccctttgcaaattttcctttttcaatggtaattcgaacgatatcgtcaaattataatttgttctttttcgaatttataattacattcccctcatataatttttcccagacagaacgcggcattttcacaagaggcggatactgaccagccccccaacaccgtagacagacggaacatagtaatcagtaattggcatcactaaaaatgccctctgaagaacaatagtaaaaaatctcttgccattggacgaaattcacacattgatctgtgaaatcgaagccatcatcaatcaccggccgctcacattcgaatccgatcaagagccttacgtttcacttcgttcaatcaacttcctcataccatacaaccaaacggagaacaactttcccgttatcaacgaggatcacaaagatccagactacgaaccaacacccagcaatggaagaacaaacggaaacgaagaaagggaaggcaacaaaagaagagcctatcgacagaagcgaccccgcagttgaaagaaaaaagcacgatgaacatcgaatccgatgggcaacacaacgaaaagcagcagtggatgaacttcgccaacggataaagctacgcaaaaaacaatggtcagcagcagacatcgaaaaagaaatgaaggaaactgaaaaagacgacgaagaacacaacagcgaatgcccgacttctatccaacagatggagaaaaagttctggcctactgcgatagaagatacggcacaaatctcatggcatcctggagacgcaacagagtccaaacggaattaaaagaactcctggagaataaacgcatcactctgcaacacatcacggacaaccagcacttttgcatcggcttactgagcacaaaaaaggactttgtggagaatttgtcatcggaaaaatttgttcgtggcagtacttggacgaaatcgaattcaaagtcgccgcggacccagaagaacaacaaatcgctatgaaagaaaaatcgccaacgccagaagtggtgatcatcgaagaagacgaatctgaacgagaagcatcgatcgaaccgcaattcattaccgagcgtgccggacacagaccgcaattactgtttcgtcatccttcaccggagcctaaacaatttatgaagcaccgcgcagctcacactcctccacccgtgcgtcaacgtcagcctgaccaacttcagctaccgcgcaacaaaatactgttacaaattcatcacggtcagaattcacctcccaaacgcttatagggacgcatttctcgacgctgaaatgcgcatcctttcactcacctcacacatcgccagttgctcacatctccgctaccattatctacaactacagaaaaattccaacattttccctagtctagttttgcaggatttgtatgttcactcggcccacctgtcactcatttacgcatttttccttccatgcacatgcaattcattgtcagcccactcatttttcccatatttagggccgatcaaaatcacttatcgcacattcattcgcaacacaacttggggaggaaaactcccattcccccaatttcctcccccaaaaaacaatattaatttaaaaaaaaatgcattggtatcgaaaattttataataatgaacagtcacgcaaccagtcattatgttgtagtccgcaatagagcgaagttattattagttttacatttgtataattttgttttatttaaacgattttaaataattaatacatttttgaatttaaaataatttataaagacagaacattttttatttgtacttgacatggtttaatcttaattttaccattatagaaaataattttgtcatattttaagtcttgataaaatcatgatataatttgtcttaaattttaaataatgaattaaccttcatatttttaaatttcaaaaaaatgacttaattaaactcatttccgcaatgtaccaataagagaacgccgaattccaagaaaaaaaacgaatttgaaaagaaattaacaaatagcatataaaatttaaaaaatatttttttttacaaaatcaaaactcactatcaaataattcacaaatgagctaaaaaatagttcagtaaacgaatattaaacaataagaataaaagtaaaatgtatatattcataaattcttaatgcgtgcctgcaaaaatatgatagaatataggttatatgtaaaatttaaattcgatcaaatattttgtacgtctttatttttcgtttcattttgtgcctgtgctcggaaaataaaaaatatttaaaacatttatatttaataaacattcaagtacatattattaatataaaaatacttctcatcaactattttagttatttattatataaatacggaaaagtattgtttatcagtttcattttcacttttatttttttgttacatttttcttcaaaaatttacacttaagctttaattattcaaatatattaaaagattttatgtaattttaaggcaaaatttaaatgtatttagtgaataaactaaatctctacatgatacaactttctaattttcttattagtttttatttttatgtaattaacactcatttatttattatatatatttgagattttttagttaatttaataatcttgttataattttaaaagtgattatttataatctttcttttgatgtgcttttttaatcgccttttttatgctcattgttatctttaatattgctttgatttcacatattttaatattgcaaatttttttaatcattggtatttttaaagaaattttatttgtatttactgtttattcaataatgtttaaataaatgaaatttataataaaataanataaactatttagttgaaccttaacataatttattttttaactagtttctttaatganacaattntttgaatcattaatttactgtaaattgtgcattgttgttttgtttacttacacattcatttttct

SEQ ID NO: 15141 - DNA, 1016 bp, Heterodera glycines
  misc_feature (113)..(113): n is a, c, g, or t
  misc_feature (158)..(158): n is a, c, g, or t
aataaaataattatcccattggttttgttcaaggtaatataaaagtgattaaacacattctaagtcattttctaaaacagtaattactgaaacattggttatacaattatatntagttttctaaatacatattaataaataaaaccataaacctaatntcttgagcaaagataattcaagaacgaatagtagccaagaagcgggtgacttggaacgattaatataattataggtaataatgaagagtttataaatatatttattttaaaaaataaaaggaaaatattataaggatcaatattcttaaaaaaaattttctattaaataaatttagtttaaattttcgaaaataaagctaaacttcaatctttattttaataaaactacaaaaaaatgaaatttatataggtttaattaacgataaacagaaatattaatctaaaaaaggaagagaatcaaaaacaataaacatgtcacgctgtattaagactttcactcaattttttaaataaaaccgatttacttttagcatttctcagtattgaaaagccaaagtttatcatgctcactgattcatagttaaatactcaaaatctaacaattcaacaaaatgtttcagaaaattaacaaatttatagggtgctaggtcgtttcgtaaattccgccactatgggcgtttcgtaaatccgccaacgtgggcgtttcgtaaatccgccagggcgtttcgtaaatccgccaacgtgggcgtttcgtaaattccgccactacgggcgtttcgtaaatccgtcagggcgtttcgtgaatccgccaacatgggcgtttcgtaaatccgccagggcgtttcgtaaatccgccaacgtgggcgtttcgtaaattccgccactacgggcgtttcgtaaatccgtcagggcgtttcgtgaatccgccaacgtgggcgtttcgtaaattccgccactattggcgtttcgtaaatccgccagggcgtttcgtgaatccgccaacgtgggcgtttcgta

SEQ ID NO: 15142 - DNA, 2951 bp, Heterodera glycines
  misc_feature (45)..(45): n is a, c, g, or t
ttcgacttgtgaaaaagtatgaatggtcgttgttttgaagcttgntacggttcttttttgttagaagtatttccatttactacattaaacataaaatttattgtcttataatgcatgagaaacatcaaaatgttgaaaagcctctttctatttttgaaattttgccgaaaattttcgaaaaaatttttgtcctacggcatggaaacgccgctatggaaacggcggcatggaactgaccccaaccgacaaaaaacatttttttgctggatttttttccttttaccgtccatgatgtgctttcggtaatagtgtatatggtagcccccttttttttaaagaaaattttcaaaaaaagttttcgaaataaagttgtttttaggttttcagggtcggaaatatgaaccatattctccggcccaaaaaacctataaagcaactttatttcgagaaaattctttgaaaattttctttttctaaaaggggggcgctaccatgtacactagagaccggaaatttcaaatttgcggatcctgttgcaggattggaattcaaaattttttacaggacaggatccggtaggattaatcctgcaaatcctgcatttaaaatctgcaggatcctgcgcaggattgcggattttaggaaatttcaaaaaattctgtattaataaaaaagtctttcaaagtataaaaaagtattcaaatatatttttaaaccaaaaaatgatgaagatgaaaaattaatagcgtttttttgcttacactccaagcaatcgactgaaatcttctttaatgcgtttaaaaagaccgatttgccaaattgggtggctcataaataatagcttaaattaaagtaaaataatttttatttaaatttctttgcaaaaaagccataatccattatgtatagggatgggatttttaggcacaaaaaatcgcgaaataggcacttaaaaaggcagaaaaatcctaaaataggcacgaaaataatttttattaacgccttttaggtagcaaaacacataaaaaattcaattgtacaaacttttttccgctgacccacaaattgtccaagccacgaattgtccaagccacgttttgtccaagccacgaattgtccaagccacgaattgtccaagccacgttttgtccaagccacgaattgtccaaaagagtaaaaactcacgaattgtccaaaagtctaaaaagctcataaaaagccgggaaaacgggtctgttttaggcttttcggggtcgctgaatacgaatacgacatttatatagccccttgcctaaccctagatccactcggataagaaaaaatctcataatttgtctaaaatatttgctctttttttacttgatttttcttttcattaattgaacaaatgattcgtaataaacttgaaagtctacaaaaaagtcggaagaagcgttatttgtcagacatttcaaacgcaactgaggaggccgtgaatttgggagtggaactcgttgaaccgaatgccgtaacaacctctgacagcgttgaacaacagaatttgaaagaggctgaactctcaacagtgacctttgagcgcggaaaaaccaattatgggaccgattgcctatggttgaacagaatatggtgaggcagttcgcaaaacattcaggtaaaaaataaaatttacaaactattcaggatttcgttttacacaccactcaggaaatcgctggagatgcacaaatcgcagttgctcagcatatataaacatcacaaacaacggcgaaaccggagctagtggaaccttgagtcaaaaagaacacaaccacctcccagcacctcagaaacaacaagtgtataaatttaaaaccaaataattaatgctttgttaaaggcagagtcaaggcgacagaaaatcaaagaaagtgtcctggtcgagccgtgtctgaagcccacacgacttttggctaaagtgaggcgatcagcaacggatgaagcctttgttgccatgagctccaacaatgcgttgactgaaatgatgcggcgtgagaagaaaaagttgctgggaaacgtcgacgtgcaggacccactggcctttgtcattccagcaacgttacgcgaaaaacgtggcgaagacatcgtcttgtatgacagtcgcaatgtcaggcaaggcgaaaaggacgttgtccttattttcggcagtgttaaggtacattttttggctataaaattctgtttgttattggcattcctttagactctggacattttgcgccaatgtggcacgtgcacctcgatggaactttcaaatgtgctccagcgatgtgggagcagtgcttcgtcattggtgcttcagtacatcagaggatgtgcatcagcatgtggtgtctcctgcctggaaaacagcgacgctactacgaagaagcactgaagcatcggctcaccggcaccatcaactcttacgtggccaaccactgtgagtccacgggagcagcttgttcaatattcgttgagcccgctaccgactttgacagctccttcaggcagaatccttaatcaatcatccgtttaaatttaataaaaaaattcagttccagcgtgggaggacgaaatcgttcgtgcgccacattttccaattccgctttggaacatgcactcacaggcaacatctgccctcgctcgtacaaacaacggactggaggcaactcatcttcattttatggtctttaatttattaaaaacaaattgaaaagaaacatttagaaaggcctctgtcaccacaccaccccgccctctcggacttcatttgtggggttaatgaaagcatcgacagacaggtggacgctgcccgatctgctcgccatttcattcacaagcgacacaaacgatacatcctcccagatgctgtcattatgcgaattttggcggacgcgtcgtacaacagcaatggtgaaaattagtgatctgat

SEQ ID NO: 15143 - DNA, 1191 bp, Heterodera glycines
tcgaaccgaccatttgtagggctcaaccgtagatagctttgcgatttggctgaaacccacatgtctaatgatgtagaaaaaagggataaccattttctgagaatacctattcttacctacaatgcaaatttcaaaccgaccatttgtagggctcaaccgtagatagtaatgcgatttggctgtaaccctgtcaatgatgtagaaaaaagggatagccattttctgagaatacctattcttacctacaatgcaaatttcgaaccgaccatttgtagggctcaaccgtagatagtaatgcgatttggctgaaacccaaatgtcaaatgatgtagaaaaaagggatagccattttctgagaatacctattcttacctacaatgcaaatttcaaaccgaccatttgtagggctcagccgtagatagtaatgcgatttggctgaaacccaaatgtctaatgatgtagaaaaaagggatagccattttctgagaatacctattcttacctacaatgcaaatttcaaaccgaccatttgtagggctcaaccgtagatagtaatgcgatttggctgtaaacccatgatgtcaaatgatgtagaaaaaagggatagccattttctgagaatacctattcttacctacaatgcaaatttcaaaccgaccatttgtagggctcaaccgtagatagtaatgcgatttggctgaaacccaaatgtcaaatgatgtagaaaaaagggatagccattttctgagaatacctattcttacctacaatgcaaatttcaaaccgaccatttgtagggctcagccgtagatagtaatgcgatttggctgaaacccaaatgtctaatgatgtagaaaaaagggatagccattttctgagaatacctattcttacctacaatgcaaatttcaaaccgaccatttgtagggctcaaccgtagatagtaatgcgatttggctgaaacccaaatgtcaaatgatgtagaaaaaagggatagccattttctgagaatgcctattcttacctacaatgcaaatttcaaaccgaccatttgtagggctcagccgtagatagtaatgcgatttggctgaaacccatgatgtagaaaaaagagatagccattttctgagaatacctattcttacctacaaagaagattcgaaccgaccatttgtagggctcaaccgtaga

SEQ ID NO: 15144 - DNA, 952 bp, Heterodera glycines
ccatttgtacggctcaaccgtagatagtaatgtgattaggctgataacccaaatgtcaaatgatgtagaaaaaagggatagacattttctgagaatgcctattcttacctacaatgcaaatttcaaaccgtccatttgtagggctcaaccgtagatagtaatgcgatttggctgaaacccaaatgtcaaatgatgtagaaaaaagggatagccattttctgagaatacctattcttacctacaatgcaaatttcaaaccgaccatttgtagggctcaaccgtagatagtaatgcgatttggctgaaacccaaatgtcaaatgatgtagaaaaaagggatagccattttctgagaatgcctattcttacctacaatgcaaatttcaaaccgaccatttgtagggctcaaccgtagatagtaatgcgatttggctgaaacccaaatgtcaaatgatgtagaaaaaagggatagccattttctgagaatacctattcttacctacaatgcaaatttcgaaccgaccatttgtagggctcaaccgtagatagtaatgcgatttggctgaaacccaaatgtcaaatgatgtagaaaaaagggatagccattttctgagaatacctattcttacctacaatgcaaatttcaaaccgaccatttgtagggctcaaccgtagatagtaatgcgatttggctgtaaacccatgatgtagaaaaaagggatagccattttctgagaatgcctattcttacctacaatgcaaatttcaaaccgaccatttgtagggctcaaccgtagatagtaatgcgatttggctgaaacccaaatgtctaatgatgtagaaaaaagggataaccattttctgagaatacctattcttacctacaatgcaaatttcaaaccgaccattgtagacgcaaccgtagatagtaatgcgatttggctgaaacccac

SEQ ID NO: 15145 - DNA, 2182 bp, Heterodera glycines
  misc_feature (12)..(12): n is a, c, g, or t
  misc_feature (49)..(49): n is a, c, g, or t
aaaaatgcatancaattcttagccaaatcccccaattaatttaaaatantgggaacaaatttaatttattgaaaattttccaactaaaatatttagtcctacaaaatttgctgtccgcggtgcgatggactgtctgcgcatggaactgtctgatcgaggcttgcacaacaacataatatgcaccaccatttgcccgttctttgtgcgcacgccaatgatcacttcaattggcattcggccaatttccaggcattaaaaaaatatatatttatttttaatatttaaatttatttctgttttattaaagatggatcccatttttgtcggccaacagttgtgcccagcaaattgttgatgcggtcctcaaagagaaggtgatcgcgttcatgccatggtggttagggctgattgcgctgcttcacaggtggcacaattaaaatatgaaaatgatcttctattcccaaagggatttgatcagttattgagatgacctaaatttcttatcagtgtagtctttgctcccaattttcttatcacaaaatgacatgaataattaattattgagaaatattccactataaaattatatgtattttcaatttattgttataaataagcaaaatctaagttgattttttgtgatgctttttccaaaaaaaaaacttttggggaacaaggggggtccggcggtgccgataggcgccgccgggggaaaaattaagaattttgaccatatttttagcagattttcattaaaaaattcttaattttatggattttcgaaaaaattggttattttcaggtttttatgaaaaatttaacaaatttttttggaaaatttggatgagattttcgttttgacgctcttttaaaaacccaaattattaaatgattgtcaaacattatgccaatttatcaaaattcatcataaaatttaacagattctgacgattttccccaaaagcctcaaaaatcctcaaaatttctcaaaaaaccgcaaaaaagctcaaagcctcatttgaaaatttagcctcattgacctatcaaaaaaccacaaaatgaggctaaagcctcagatctgggagccctggtttaaaagccctcccccctaaattttaaaaaaaggaaaataaaccaaaaaaaaaaaaattaaaaaaagaaaaaaaaagaaaaacttaaaaaaaaataaaaatattttcatgcaattttaaaaatatcagcattttaaataaattttcaatttttaattaaatttttcgatttgtttagcattctcccgttgaacatgcaacgagtggcgcgggacttcatcaattttcgctatgaagaacccgattatcccatggcagatgatgctcaaccaaaaacaacaacaactgccgttgaccaccaaattcaaaatggcgccaccgccaacacaaaattggcggttggcgaaatgcccatatccaatggacaaacggttgaggagagagtggcagagaagcaggcagaaaatggcggtgcaaatagcttccgccgaaaaccttcgccattgttgcgcctccaaaaacgccaaatgcgggagcacttcgaatttgccggattcatttggtggctgatcattgtgccggctatggcactgacatttgtaatccaattttaatttaaattttaattagtaacactttaataaccccctaattaactagactttataaccccacctttttaacaggtggtcttttatgatcctgcgcttgttaatgtgcattggcttggccctgttggtcaatttgtgtataaacttggtaaatttggatttaatttcaattttttgattgacttggttaattatgcttaaaaatttggcaatttaattgtttgccatattattttaattaaattccttttcattgagctcaatcgactaaatacaaaatttagcaaatgctaagtcaaagtcttggctgacattatttagagaataaactattgcattttattagggttttatcattatttgcctaattgtgccataataaatattgtattaatataatttcccccccccaggcattgaatatccgaccttgattctgtttatcaatgtggcggcatggactgcgcatctgcttgaggcacttattgcgctttatctcaccgatgagctttatattagccataggttataaaggaaatt

SEQ ID NO: 15146 - DNA, 1899 bp, Heterodera glycines
ttgattctgtttatcaatgtggccgcatctaatgtgatgtgcttgaggcagttattgcgctttatctcaccgacgagatctatattagccataggtgataaaggaaatttaaggatttatataaaataaattaaacgaaaaaaagaaaagaattaaatgttttatctttttcttagcagttttatcgatctgaatataaattttgctggtctttttaagcgattttaattatttatttttacaataaaaatatttagaaaaaaaaataataatatttttaaaaattttataattgtttttcagatgcgcccttttttggttcttgcagacactgattcttggcttcccctcacttcgattgttgctaaaattacgccagaaattcaattaaaatgccattttatcattatttttatcatttaaatgaaaatgaattaattaatatatttggaattaaaatgtgtttaatatacatatatatttaaaaattgtttcaaggattaatgaaccaattttcttaattaattttgtcattataacatgcgaatttaaaaacatcctactgtaaaatgtaaattaatggaaataatatcaaaccctactgatcagaggactgaagacagtcattattgaattgttaaattgcccattgatcagtagtagtaggaaaatgcaaaaaccaacactgacttattttaatcaaattttccattttattatgaattaattgcctattgcattaataccaaaacaaagtttgccaaaactttacagaattgacaaaaacattccgatttttaaaacatatatttttatgaaattgtactcattctcattttataccataataaaagaaaagataaaatgcagacttttaaattaattttattatattttattaatttaaagttttacagaaattttaaaataaatgtttttgagagtttattcaaacaaaaatgagctgaatgaaagagaaacgctattgaaattacaaattttcgtgcatcttttctgcacataaatacttcaaattaaaattattgtttggcagcgttatagcttttattgagcaacaaataattgtaaaataaatcaaatctattattttaaaattaaaaatgcataaccaaatctggaatttttccttctaattgaacaaatttattcgattttcaaagaaaaattcaatgaaatttattatgttttcatacacatttttgggtgtttgtgccaaagagatcgaaaggaaattcaaaattttgtcggtaattgttcatcatttatttttcaccgttgcgctgtgttgttttgaacatgaaaaatataacaacaattcatccgaagcgaaacatctaaaaaaaatttcaaaaatttcaaaattatggtaaatttttttacaaaatttgtaaaaaaaattatagaaaatttaagttcataaaaacggttcccaattattctaatgctttgcgcacagaaacggagataaactatggcaaaagtataatcataaaataataaacccgaattggaactataattaaattgagtaattaacaaaaaatttaattttagaagcctccccgactcgaaactcttttttatataccaaaaaactaagtttttttttaaaattatgtttatttaagtatacgaataaaaatagcatactaatgaaatagaaaatatataaatataaaatttaccgttcctcccaaatcgccaagatgacgcgcatacatttttggagcagtcacctcttcaatgtttcgtccagcccgcaacaaattttgttcctcctcctgccgttcaacaaatttatttatttttggcattttttttattttttggcattttttgccttatgggcggtccgcgcatttaacgcttcgccatcaa

SEQ ID NO: 15147 - DNA, 3711 bp, Heterodera glycines
actctgttaacaagctaggcgctgttagcaatatatttgtgaacgacaaaaatgggagacgcagccattcaacgattgacggatattttgcagcaattgttggctgcgcaacagcaaaacgcgccaccggcacagaacgcctcccaattgccaacactcccggacgtgaaatgttttgatgctagtcagcatcgtggctgcgaaattgaggattggctcaagcgatttaagttcgctctggactgtgcagcgccgaacttccaggatgagctgaaggtgaagctgttgatgacgaaattgtgtggaccgacgttcagcgaatattgtaagtctgtcttaccgagagaagtgaccgacttcgactttgtggagacttcggagaagctgaaggcattgttcagccgacctcaatcagtttggattgaccggtatgaatgtctccgctcggtcaaagacgacgacgaggattttggcaccttcatcaaccggcaaaagaagcttctgcgggatttcaacttcaagaaattgaatgaggagcaattcaactgtatggttttgctcatttctttgaaatctccgaaggatgctactctgcggtcgagaattttggccaagttggcagcggatggtgacacggtcaagtacgacaccgtggtagacgacttgaagatctacatgtcgaccatcgccgaagccaaggcactggagcagccacatgtttcgaagcatttgttggcagcaaaattgaagggccaaaagaagaggaagaactcgtaccattcgtcgaatgcgagcagcgtgtctacaggaactcggagcagcaaccgatcgcagcgctaatgctggcgatgcggttggaagcattcgtcgagggaatgccgacaccaagaaacggtttgccgaaagtgcaagaggaatggccacttggaaaggatgtgtgccaagcaccaggcatggttgaagaagaatggcggaacgaatgaaaaagcggtgaacaacgtccgcgttggaggagttttcctggttaaatctgagaaccagaggaagaaaggaatgattgatgttccgattaatgtgaatggaacaaaagtggacttcattgctgatttcggcaccgagtgaactgttctttgtgaggacacggtgcgccaaatcggaactttgaaattgagtcgttgtcaagaacgcactcagtaccacgatgggacaattcgtccatttgttggccaaggaaaggcaacgttttcgtttggcaaccgatcagcgtttgggcatttctttctttccaaagacggatcaaagaatctgctcggattggacatgatggacagacttggattgtcggactccatcagaaatggtctgaaggacaaattccgaattgagactgccaaagcgaacggagagatccagaacaagaagaaattcttcagaaaaaatcgacgcggcaaaaagcaaaacttcttcgccgttggagcgaatgtgatcgccagcttgggagatgaaccatggcgtgccggacgtgtgatcagccagaaaagaggcctttacaacgttcagttttcggacggcacgaccggagaattcccggcaaagagtgtacagccgtacatgccggacgaagacgaaaatttgaattttcttgacggatttggactgaagagatcctcatccggtggaactgtcaggaagcaccaaatcggcagtgacggccgacgagatcaattggaagatgatctccgagcttccgactgtgaacaagaggcataagaacgccgacctgaggatgcggatgatggacggaggcctggcactttttaaggggggagatgttagggttgggacccaattggccggtacccattttgaccctttgctttattgtatttcccttttcccttggttatgtcacgcccctttttccgcccataaatacccgcgatgttgaccctccccgttcacttcattcatttgtgttatttttccttcttgttatttaaaaattcctccccatttattttgtgtctttttcccctctgctccaaataaatattgattatttgtttgccatcggccggcaaaacaaatgatatcttataattgcatactttgcagggtaattctttgaattgttcatctgatgaaatttcagacatgcaaatggtgcaatcattttgttgttcatttgaactttgacttggttgattagcacttgactttgaccgattagcactttgattaccggtgtctcgattaacacctaattttatagttataatttgcatagaaaattttttttaaagattcctaaataatatataattttaaaaataattcaaataaatttctttgagataacatggaattaatagttcgataaattttaattaaatttacatttaatattttgaaaaaacccatttattgatttgcacattattttttcttaattaattacccatgccttccgatgttgttccaccatattcttctgcttgcaatcttgctgctaattgtgcatcatcatcaactccacttcctcctcctctttcttgctgtgctaaagttgcagcgagtagttcatcttaatttgcttaacaatgaattaatgatttcttcaaatttttaaattataaaatttaataaaaaaattacggtaagcatttgtatttgtatttgtatttctgttgctggtattccgtcgtccaactaaaaatggtagcagtgacattttgattaaaaatctgccaatttcttggtcataataattgttttcgataaatgttatgatttttttaaggaaagagtaaaattttaaataattagatgaaaaaaattaataaaaaatatttatttgaaaattgtgtatttttttcaataaagaagaagaaaattaaatttagtggattatagcaagaaataattacctcgttctgcatggtttaaatcaaagataataaacaaaaaaataaaatatacaaaaaacatctaatgaaaataaaatgtgctgtttttctagcttaaaaacgatttttaatgtctatctctctgtggataaattatgattattcgaagtatttaaagcaaaaacaataacataattaataattcaaaatattaatataaaataatattaatacttataataataaaaataaatttctaataaaattatacaataaaatatagttatattaaaaaaggcattagcaagcttttatggcattgattagcatttaaaacgacctttttaaggcaggaattattttgggaagaagtcatgcgttttctaatattaatttttacaattagctacatttttaattttataaatttatatattatatgctataattattacaaataaaatgatttattgagaaattgtagaactagttgtaagcagcatgtcaaaaggattttcgaaaattaatgtgtgatttgttaaagttttcaacaaaaaaatctcttttaaaattcgcaattttaaatgatggctccgaaacaattttaaaaaagtcatttaaattgaaaatatttttattgttaatctctcttaaaaaaaacaattaatgaatagtcggttatattcttgtttaggcgtccaatgatgaggccgctcacgggttttgaaggaacaaatttttttcaaatttggccagggccaacttttttttaagggtttttttttttttcttgtttttaaaaatt

SEQ ID NO: 15148 - DNA, 1601 bp, Heterodera glycines
tataaaatgatattatataaaataagcaaaaagcgaaaattcgcttttaagtgcttaactatgtctgttttttctctaaataattttttagccatttttaaagttttacattacatttagcgaatttgatgaaaattgagaaattacacactcaattttgaaaaatttatgtccatatttttgaaactttatgttcatatttcgcgatttttggtccatattttatggccatattttgcgatttatatccatatatttcgccgccctagtcataaaactgagttgtcccatcagctgagttgtctccagctcacttgcctgacagacgagtcggggtcgttttggcgcccacgttttggcgccgacgttttggcgcccacgttttggcgccaaggtcgttttggcgccgacgttttggcgcccacgttttggcgccagggtcaggtttttaaattttgtctatgtttgaataaatgaaaatatgtaatcgtcagttttctgagtcgctaatcacgaatattgtattcattttgacaattgcgaagcccggacttgatttaaatgaaatacaatttttgaacatattagatcaggccttctatctgttttgttttatcaaatgttttaatatggtgggtccaaatctgagaaaatgatttaccagattctgatttagggatagtgactattatttattaaatataccgttaaggttatgtttataatcactaactcttttgaaatttcaaccgaaaaaatttaagagttacagtcaaaatcgggaagtttgaaaaaaaattctagggggttgtgaattttttgaaaatttgaaaaacccattggaaggtaaaagtttttcactttttttataaaatttttgatcaaatttttaccttttttaatttttggcttcgcgccaaaacgtgagcgccaaaacgaccctggcgccaaaacgtgggcgccaaatcgtcggcgccaaaacgacccagtcccctcaaaaatgaaggaagaatggcttaaaatgcatagtcgtcaattcaaccgggactgaaacttaccccgtaaaaataagattttaaatttacctaatttggtgttgtgtgtgggtggttccaaagttttttccattgactgattttcctataaaagaagcacaattcaagtggtccactctcattccattttttttgccccgttgaattttattctgtcatttttattgtcggaaagtgaattgcgtcaaaaccaaatcactagtgctcattttgcgctgcttcttttccgtttaggcaccaaaaagtaacggagaacaaatggcggccatcgacaccaatttgtactctcggcagatgtaagccgcgacggtactcattgggtttgggtccccttttttggccagaaattttcaatttttttttggtttaaaaattcctgaaaacaagtattatggggttttcggggtcgctgatcacgaatacgacatccatttcgaccaattcgagattccgaaaccaaattcgaacaaaaagtcgaaaattcaaaattttcgaatttcgggtttttggccgaacaaggtctaattacattacaaggaactttaa

SEQ ID NO: 15149 - DNA, 2430 bp, Heterodera glycines
ttgcttttttgaagaaagttgaatagcaattcggaaccttcccgaaattgccaaaatattccgacgttgagcttcttttttaagacgggcgtcgccaattgttcggtcttcaagccgacacaataaaatgtttatttgatgaacaaataaattaaacaatttaaataaaaatgggcgaagtcggtggcgcgaataaataatggaggagaacaaatatttaggcgaagtgaaataagtgcataaaaagcaactgaatgaatgaggggaaaggacaggcaatggacataataaatcaatagtgtcttacataaatgaagacacaataattagagagtggggaaaatggagaggaaaagaaaaatacaaatgcaaagggaaataatgcaaatgtgttctttcatctctcggggttgaccacccgaacaagtagcaagaaatatgtagcagaatgtaaaagagcatttgaaattaaatttaattcatttaaattgttaatttaaaaaaatcttttacacttacgtggtgttgcttctgctgatcaggctgagcagccatgtttacaaaataatgaatactttgaaaagcctaagtatttatttaaaataaatatttttgtaaatgaataagaaatgaaaaataaatggcaatgggataaagaaaaaatgaaatgtttaagaaatgaaggagatgtttttgcctttgacaatttgtgagaaaagacggcgaaacaaactttacaccgcacaatcttatggccaatcatttgaacggcaaaaaggaaacattgctgtggtgctaatggaatgcaaaaaaaaaataattaaaaaaatttaatgatatacaataatcgtattgttttacattactgtattcccccccccccctctgctgtgtttatatttatttctcgtatttaattatcactaattaagctgacaatgagttaaaaaagcgggatatttatgttgattcataaacaaaaacagcttggatgactttaatggaatggaaagccattaaagctcattcaaaaagattcaaaaaatttatcaattaaaatatatccttatttttcaatacattttttgagctgtatttcattaacaccacagcaatgtttccttatttattttaataattaaaataataaattttcattttgattagctaattaataattacattaattcaaataaacaaaaatgaatcattttttgctgcccataaatctgacaaaaattggatggaaatgggattcatttaatggaaaaaatgaataaattaacagcaattaatcggcgtcaaattcagtcaatcattcagtcattcattcattatttttccattttgttaatgggaaaagcgttccattattacaaataaataaaataaaaataatatttcaattattgtttatttaaaaattcaaagcaaaatgcgtctttatttgaacatccctttaattttgggccacatttttgcgttgaatggcatccaatcttctgcagatgagcagataaccaaaccgtaaacaaaaagcattttaataattttggaatttaatttttcaatttttaattagcactcgactgacgggccacggcacaaaagtgacgaccatccaaattcaggactttgaccaatgctttcctcgtgatgcaaccaaaacttttgggctcgaatttcgtttgccacgagacgggggctgttgtgaagacgggtgaactattcaaatttatgttgttttaataatgtttggcgaaatgtcagggatttttataaaaatgaaagccgtagagaccggtaaagacaggcattaattattcagtaattaagtaaatttcgtactaaaattattgtcaacttcaccatcaaaattcgacaattaattaattttcagacccttttgaattttcaaaaaatttagcttgggttcaaagtttttcaaaatgttggcaattatcaaaaaaattttattttaattttaatagcaaatttttaataaataatttcagtctaatcatttgctacccgagcataatggccaccggagttttggacaacgatcattcagttgatactgtagacctaagcaacgaaatgttcaacattgacaacatcgataatgtgaaagaattttttggcattttaaattaaaaaaaattttttaaatttttttagaatccgattgccgaagaatgccaaaacagagccaaaaagcttggaaattcaatggcaaaactcacttggcatggcattagcataaaacttaacagacaaagtgctgggataagcacggcaattttggacacatcattctgcgagaaaaggtaaaatttgccatttatactgtaattttttgaaattcggtaattttgttctaccgtaaaaggatgatgaaaaactgtagtttttataaataatcgaaaa

SEQ ID NO: 15150 - DNA, 1311 bp, Heterodera glycines
tcaatttttgaattgtcttagtgaataagtaaaatttaaattcaaatttttgaattgtcttagtgaaaaagtaaaatttaaattcaaatttttgaattgtcttagtgaataagtaaaatttaaattcaaatttttgaattgtcttagtgaaaaagtaaaatttaaattcaaatttttgaattgtcttagtgaataagtaaaatttaaattcaaatttttgaattgtcttagtgaaaaagtaaaatttaaattcaaatttttgaattgtcttgagtcctcccaaaagtcttggctatcaatgacaatgaatatgtggtgcaaatcacagcaaaagtaaattcgaaaatcaaatttttataaaaatttggtctttcaattgtcacgacgagtcatcgttgtgttgtgaatttggtcttggcacatcggatttttatttatttattttttctaatttttggtactcctttttacgggactcaaataaaaaaactgtgcttcaaatataattattgtaaaaattatcaaagcatactgtaaaaatgatacggtttttagctgtgttaatgagacacagaaactgaccatgccaatccacatttcggacgtgaaccaagtgattaccatccgactgttaactgataaaatgaaaaatgacaattcgacgaataacacaatcgcgctgaaactttggcacacgaatcaaggaaaggaaggtgggtagaaaattgaaaatttttaggtaaaaccgaatttttcaagaaattaataagaatttttaatttttttttttttgcgatctccttattaaccttttttatcctaccattaggttgaagtttattttattaaaatctttttgaaagcccctgaaacaaagccatgttgaccaaaaaagacctaaatggtcgccctgttttttgcactaattttttcattaaattcttaatatctgctacatataaaccaatcaaaaatttaaaaaattgaaatgtaaaattaatttaaaagttagttttaaatttaaaaaaaagcaattttgcagatatcgaaatgcttagcattcacttttttcttgccaacaattccgtggaagtggtgattggaactgaaacacatttttgcgattacgaattttctaacgaaatattcgaaatgaatctgcaaatttggataaagcagtacggttacaaaattttgtttaaaaacaaacgattgggcaaaagggaatattatcccgcaaaatggtgggaaggattgaaattcaaggaccacaacaaattgacggtaagaaaattttatatggaattaaaa

SEQ ID NO: 15151 - DNA, 1447 bp, Heterodera glycines
ggaaaagtgaaaaggaaagagaatcagcaaaaaaggaagttccaaggaaaaggagggaccaaagacaacagaagattctgccccaattggagcaaattgaagaacagacggtatggctaccggtgagagaggaggaggcaaagaaagagacagacgactaaagagcacagcaagacggagaaaatgaaagaggaaaagaaaaggagcgtcaggaggaagagggagtcaaagaaaaagagggaagggaacacgaacaacaaaagtcggcacaacgcaaaaagacaacgaacgtcccgggcaatgccattgagccggcaattatcagcagtcggaagccggccattgtgaccatccaaagcaaagagatagaggaaatgccgccggatgcatttgacgatggcagcatcaggacggcaccgacccctcgggtgcaacaaatggaagagttggagagagaaatagccggaagcattgtgccggaactgattgtgccacaagtgatcgtaggagggaaacggaaagaggaaaaaggggaggacgaagaggaaaagggagacggaaggcaaaaaggaaatggaaaacggaaagaggaaggaggaaaagggaaagaagaaaaaggggacaaagaagagcaaaaaggagaaggaggggaaaaagaaaacggaaaagggaaagaggaagaaggaaatggcagcaaaacatcggcatttttgcaagagaaaaccgacgaacacaacgccaatggcaatgataaggtattatcgtgttagaagaatgaatctgaacagaaattggttaagggaacaacaaattccaaggcgaaaaacgaaattcgaattgagccaattgggacaaaaggacggacaaatgccaaggcaaagcctacggaaattcccgcggaggaggcagaagagggccgagaagacgagcagaggcaacagcaagccgaagaagagccggaacagcacgagccggcgtcgtcgagtgccgtgccgccatctccgccacaaaggcaacggccgacgacccccgaggcgaagagaacggcacggccatcgacagaaatggcaacaacggaggaacagagggaaacaccaaaagggaaaattgacaaagaaaggccaacaactcaaggaacaacaccagcagaagtgagccgaacattcattctgatcacgaacagcacgaacaaagccaattcgccgtccccgtcaattaaacggacgaaggcaacgacaacggcaccgaaagtgaagccgaataaccccgacggggacgagccaatgctaatggaatttgacaacggcaacagcaacattctggcggagagtgccgtgaacgggaacagtgagtgaagggaaaggaaagagagggcaaagaaaaagggaaatgcaattgaacagaactttccgtggtggtcccagtggcaatgtgctcatttggctcg

SEQ ID NO: 15152 - DNA, 2926 bp, Heterodera glycines
ttttgaaatttaatctttgtattaattccgtcattttctttggcattattaggcaaactcaagagcgtttgcgcactctgtacggcccggcctatcagataaggccagtgtatacgatgcgagtgaataagttgggaagtggcaacgcatcgtatgaggaacagttggacaaaacggcccatcggctgagtgcggagatggcatacaaccaggcgagttgggattggaagtgggagtgggtgcagttgcacccccacccgcccgcccattgaccgttcactggccgtgccaatgccttctcccccccctggcgagggttcgtcggctttttggcttttcttccctcatccgtgccgaatgaaaaatgcctttgctgatatttgtcttttctcagaacccttttgtgcccggtcgctattccgtgtacggctcctattggaacatttctccacagggaagcgccgtcagcagacgaaacggcggcaaagcgacgcttaacggcacggggccccagcaacagcagcaaaatgcctcgagggcacagatggcgccgcttgaaatcagttcgccccggggcagcagcggcgacggcagcggcggatcgtccgcttttggcaattacatccaatcgctggcaaaaatgagggggacatcgaacggcgttggggggacagagcgggaggacgcgcaatcggaatactttgccaacagtcaagtagaggcaattaacaaattaatactaattgccgaaacaattagcaaatgtttagagaaatacgaaccgtttcagcagtaataacaacggaaatggacggatttgaggagaaaaacagaagagaagagatggtgaaaaaggaggacaaaaagaagaaaaagcaacttttagtgccattcattgttattttattccaaattccaaccgaacattttgcttaaaggacgcaaatgcctcagtttcataattttcatttttgaaaccatccattcacttttgtatgtaaatgaattacaatatttttgaataaatttataaattattaataacttttaattattttatttttataattttgattatatttttatgggggtaaaaactttaaataataataaattgcataattttttttttctttaggggtttaaaatctgaatttgtggggaacacccatcaatcagtaatttaccaacaaaaaagtatatcctatataataaagttgagtgtctgtatgtatccgccttgctttgaattggcgtggcgttttgtaattgttttgcgttaaaaaatgatttgaaaatgaaaatgtttttgttttgttttgcgttaaaaaagcatttgaaaaatggaaatgtttggttttgatttttcaatttgttctgattaattaatgcatttgcattgtattttatgtctatgattatagttagtctattattgtattttagtctttgtctattttttatgatttagccaaaaatgaattgtttacttaatttgaattttctacaggtttgatatattgactttctctctgccgcttcggcattttttttttcatcaacggccggtcggccatccatgtcttacccaatacttttgatgtgtgattttagttgaagtttgttttgtttggtttttatgcaaaattatgtttataaaatttagatatgacatgaagaactaaagttttatgatcgctcatggttttgtattcgttgtgaattcattcacaagtttgaaatctgccgtggccatcattcaacagcttgcgattgagtttaagtgcctcatcaaagtttattgggattaatttgtttcgaattatattttgctttgttatgttaattattatgtaaaatttagaaatgagaaccatcatattgaagaaatgctgttggcttacaattggttgtgatttcatctctgaagtgttgaacctgtcggtcggccactcaactttttgctcactttcgagaaattcactacttcaactttggcggccccttttgtaagtgggttgggaagagttgtggtaaatttgccaaatagccaaatatctgataaaacattagtgtttgttctgtgattttagtgtgacacaataatgtgtcttatgtctgataaaacaatagtgttttttctgtgactttagtgtgacccaataatgtgtgtcatgcttttgataaaacattagtgtttgttctatgaatttagtgtgacacaataatgtgtcttatgtcttttgataaaacattggtggtttgttctgtgattttagtgtgacacaataatgtgtcttatgtttttgataaaacaatagtgtttattctatgaatttagtgtgacacaataatgtgtcttatgtctttgataaaacaatagtgtttgttctgtgattttagtgtgacacaataatatgtgtcatgtttttgataaacattagtgtttattctatgaatttagtgtgacacaataatgtgtcttatgtctttgataaaacaatagtgtttgttctgtgactttagtgtgacacaataatgtgtgtcatttttttgataaacattagagtttgttctatgacttcattatgaaatttatttgcaatatgttaaaaattagaccaatataattattaagcaatgaagtgtgcactgggcttaccattggatctcttcaaaaaaatcatggatttgttagtgataaactgatcgtaaatcgtaaaaactttaaataaataataaatttaatgttatgaattcttcatttgattttcatttcaatacctacaactttttgttttattttaaataattaattttcagttatttaatattatggcttcaataaacgatttagattatgttcgagattatgattatgtttatgatttagattttgatgaagttgagaaatgtgtgagatttt

SEQ ID NO: 15153 - DNA, 2549 bp, Heterodera glycines
ttcgtcggagggaaaaataaccggttaaaaaaataacttcttaggcttagacatttttcaaaaaatcttattgttcgaaatttttttataagaacataccaaagaaaaaaaaattgtgaaaattttttcaagctgtatgatgaattattaagtttttactagggttcggaccccgcccccgtccccggggcgggacaggtttttggggctcaccaccgtccccgcccccgtgactctgacccccgcatcccccgcccccgcgaccttcgcccccgcgggggcacgggggtgaaaatacacccctaagaatgacatattcatggataaaaggcaaaaaatttatacaattttgattttttttaaccattttgacaaattttttatgaattaaagttaattttattattggtcattgatgtgtagtgtggtgtagtgtttagtgaatcaaccgtgacattactttctgtcgtgagttcgattcaggttgacggtttcttttttaatttattttttttaattttaaaattcgcctggcgctgcctatcggcatcgcatggcccaaaaattcgtaaatcttattaaaaaaattctctaaaaattgcaaaaacctatcattttttggacaaaatctattaacagatccatcagttttcaaaaaattttcccggcggcgcctatctgcaccgccggacctctacgctcgcacattcaccaagttttttttttttgaaaaatgtgcctcaagaaaatatgttacaaatctgagttccaattttgcttgagtaaatcatgataatttaatatattaaaaaaacaaaaatttatcgtaaaaattttattttttttgtaaacatctgttagaaatcgagcttaaatttcaaaattcgccaggcggcctatcgacaccgccggccccccaaaaacctattttttcttaaaaaattagccaaaaatctctaaaatttggtaattctttagacaaaatctgtgtaggaaaaaaaaattaattagatccaaaaaataaaaaatataatttttagttttttttagatgttttatttatttttttttatctttaaaattatatctaatagatagagctcgcattttgaggcatatgccttttttttcaattttttggtgcctattttagtgcctttttcgcgatttttggtgccttttttgcgagctctactaatagaattaagtttaagttgaattactcattcattcttgtagttataaaatattcgaagggattttcaatttattatcatttcctaaaagaatatcacaaacaaaaattgctactgctctgcttttattcgttttatttattttttggtttccaactagggttttgtttgttattttgtcaattagcatacataattttaacaaaatttgaaaattaaaaaagaaaaaataaatttaattaattaatcaatttttcgatattatttatgcacattaattttcgttcaagttatatgacaggtcaattggtctgctatagtaattattcatttgacaattaacagttttttatggtaccaacatttctttcaaaaatctggttgttttgttagcggtaaagaataaagtgtttgttttaagcaaatttaagaaaataattattattttattaataaaatatttatttatgattcaaagccaataatattattactaaaataaaattacaaattcaatatgaaaatgataacgaaatgttcaaaatgttttcttcattaatttagaggttaagcgctttgaatgttttgatgctgcacatcttcagacttgcggtatatttgttgtcaaaatattcatcgccataaactcggacgcggaaggcgaattgtttcgtcgcattaaaagggatttccactgttttgatcaaattgttgacggcactgatcagacacttttgcagcagttttctggacgtttggtcattaatccaaatctgaaatttatgacacatttatttagaggttggcagcaaaaagccttctaggcacgggtaaatattttccctcctagcagcacctatcggcaccgcggacccccttgatcaccacatatttttgttaaaaagtggtgcgaaaagcaagctaaaaaagtggggttacccccccccccaagccgaactcctgggagcgtccagtccctggtgcccacctccaattttccaatgattggtaagtcgagtacatcccacggcttctcctcctcccacttcgccccctcctccgcttccgcatccaattccttcctccactttcttttgccattggccgtgtcgatttgccacctgaggaaaagcccattcacatgacacccaattgtcggtgacgcgtcaaggataagtcgaagcgattggagaaaaagcgcgtcaaatttggccaaaagtggcgcactccgttggcccgaagaggcaaagagaagcatttggaaaactccgccggaacaattctcggcactttccaagttcggtgtgacgccgtcgcggacatcgccacgcccaatttgcgattgaaaactgt

SEQ ID NO: 15154 - DNA, 1059 bp, Heterodera glycines
ttccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattccattcatttctcttattcattttcagttggtctgccgtgtttcttctattggtcgattgtgccaccattcttttttggttctttttggacaatgcaaaaaaacgacgacgcccacacaaaaaagaaatgtaaatacaaaaaacaaaaatttggaaattgcaaaaaaaaatcttcatttttcagctttatctgcggcgattgttggcttttggtgttcgattttcttccgccttctcagctcggactcgaaattgcactggtcagccgccgctttgactgcatcgtcgatgaacacttcaagacacgcaaatggacattgggcgaaatgcgaatttcccacaaaattggagagaatggcaccaagcaaatgcaaattgtcaattccgatggaaaaccattgccaatcccgcaaaatccgttgccgaacaaagtcatcggattccgaggcattacgaacgagtaaaaattaattagattaaaattttcgtctacatttctgcttttcagttacatcgacctcaatgtcatcgcatttctccgccgttttcgtcgtattttggccacttgtgcaatcagcttgtacattagcactgaaaatgttcgcattttggagtgtgctttgctcaacatttggccaatgt

SEQ ID NO: 15155 - DNA, 2544 bp, Heterodera glycines
ccgattgttggtcattctgcaagaaagcaaaaaattttttatatagtaagacgaagaaacaattcattaaaaaattacaaattcttaaattttgaatttccactttttatttgaatccgtgttcaaaatgtgccaaaatgaatgtaaagcaccgacccatttaaagtaaaaagtgtcattttcgagaatatattttgaggcatcacacttttggggttagcaattcccaactccaaatacactcaaaagagagaccaagccaatccaattcggctgaggtgagtcaatgtgcaggccgagcacgtcactttccagcacaggcattgcacagttggaaacccagcagaagccattgtggcggacaaaattagtgatgcaattggcatgcccaacgtggtgacacggggcgagcatggccaacccaaagggcactggcgaatcacacaacggacagacggacattttcaaacctcaaaaagtgacaaaaataattatggatttagaaaattgactacattggatttatacaatgggacaaattagatcatggatctgacatgaaatgagacaaattcctaatccctaaactaaactcgaacaagaagctcccctcttttggtttctctttggtttttaataaaattcaaagggtttaaaacagtgaaaaaaacatagattggcgtttataattagccaattttaaatcatacagtatatcactatagcgtgatatgatttgattagtaggcgcagcgagaaaagatcaaatctatcttatgatatctattaaagcgcttccatctatagtggcagtatatttatcggggtaaaatctattaagaaaatgactaaaagcggaaaattggctgaatgacatttttccagctggtaccccgcccaaagccacgaacagcctaaatccttggaccgtcaatggttttatgcagactaaatgatttcaattagaaaaaaaatggcgaaaagtttccttgaacttgttagcctgtataaattattctatgtttaaagtgttcttttctaattacggtattaacaaaaaagcacaaccaatttcgctgacaaatgaattttttcgttactgcttgacttcactcgcattatgtttaaaggtacaattgtggtatgactgtatgaattacactttattccgcgttctcttcttcctcattccgtgtgctaattggtctcgagaccgtaccaaaatttaaattgaaaaggtcaaactcaagaactcggtcattcggcctctgtgcctttttctattttcgaccttcaccgcggtgccgtccatccctccaccgtttttgccaccatttcctcgaattggtgtgaagcttaatttgccgcttcggtgtaattttgtgcattttttacacttcgccgcctgccaaagcactgattttacgccattcctcctcatttaatgacgtacaaaagggcgtccaatgcaaagccagcgaaagatgagccacaaaaacccctcgggggggggggggggcggtggaggcaaaaaatgtactcattttgttgtggtggtaaggcgttgtcaacccttaacatttaaccaccaccaccaccaccattaccgcactcagtccttttatggcatttataggaaaagaggcggagagggaaggcacaccccggggaaggaggaggagggcatatcactttccatcaaaaaaaaacatttcacaaccaactgcttcctttctcgcacttgagacgccttcttaagtgagtcacagccatttttgcgaagagaataggcaccacggcaccacactccccccccacccaaaatgccaatgaatacggtccatccccacccaaaatgccaatgaatacggtccatccccacccaaaatgccaatgatttcagcatattgcctcctcccaaatgccgatgattgcattttaatttttcatcgaaggtctgctcgtccgtccgctccaacgcttcgtctctttgtctttgtactgctccaatttgtcgtccgacccttggtcattcattcaatgctttttcctcccttcgttttgctattggctcccattccattggctttttccatttggcccatcgttttggctgaacccgtttttgcgttggaccatttgtcactgcaaaaccgtgccaccgatgaaaagcattcgtccgcttccacctccccttcactgttatcgtctgtcgcgttgacaaagtgtcaaagcgactatttgtccgcactgatccatcgctgcatgataagaggagtgcccacagcgatggaggggcgcatttgctttgcggacggtaaaaatggcgcggaaggggggggggggagaaagtcgtaatcactagtgatgctcaagaccgaaaatttcccatgagtcgagacttgacaggcagagacccaaaaaacctgagactttgagccaagactgagaatgtcaacggtcagataggaagtgcaaaaaatgaaaattgtaggctcttttttctcgagtcgatatcctcgagcatcactaataatcagagga

SEQ ID NO: 15156 - DNA, 3116 bp, Heterodera glycines
ggggaggaggagggaaaccattcatttcattcatccacttggatggttttcgcaattgcacgtaaggaggaggggagggggtgtacccaaagtttggggattcaaaatgtcctttctttgtggcgttggagcagggaaacggagggggggggggggggcaaaatgaatgggggaaagacattttagtgaacaaatgatgtcctgttgagaggagaaaagtgagggggggggggagaagagatagccaacccaaagaaagagagtgagcggggaaatcaacaaataaatgatgaataattatgagtggggttgacgggaacgagtttccgggaccggtacccccgagggattggggcacgacgagaaaagtgttggacaaaaaagtcggtaaaatttgtttttgattctttgataattaatcatagcaatttgctataatacaaccaccaaaaaataataatagacaatttttattttagtaaaatccgaattagaccattctcacgacagaattcgactccgagtgagggagcacccctccccctgctgtccctacgattgtttacccaatgacaaaaaagggaacccatcaaaacccattagacactaacgcggttaaacattgggggtacccatgtttttggctgtatttaacgaaaaacccctaaaaaaagcaataaaatggatatttttttgttttactcaaaaattgtcaaggaaacagcgcattttaaatgagggcgaacaaaaacaaaaccctcttcttttggtgaacataaagtttgagcgaaaatgccattcactcacctgaatagtacactccttttgttgagcatccgggggaaagtcatcctcaataaaatattcgtccggttgtaagtgccgagttggcgtcaaatgaatggcattttgtttcgcgtaaaattgtaacaaattttgccacctaaaaaatgaattttatataaaaaataatttgttagaaattgatgggaaacacccatccttttgaaaacaatttgctcatttttaagccaaatattcaaattttatttaaagaatatttatttatgcacatccaaaaacaaaccatcgaatttcgtcagttgagtcggccttcacatagcacacaaccgggtgctgtcggtgttcgtccgtcttcgcaaccgattcaatttccgatggccaattgaccttcttcaaaagtccgtcgcctaagccgtccatccgatcatttttgaacgcgatcagaatgctgtgggcatggtttgtgatcgcatctgcctcgcatactctgatgcatttgttcatgtccattttcaattgcggcacagtgtcggactgaaatggcccacgggtgaatgccaattggtccaattttctcttacatttgagtccaacccataactgagttcgccatcgtcgtacaatgtgaaccagcgacgttgccaacgctttttctcatgtgacggttgtgaaaaatcttcaaaaataaaaatcatcgggatttttacatgataaattacccaagtttatcggtgcaacataaagaaaaccacaagcagttattttacggttcatctgaaaagggaattatgaatttcagcagtacaaaagtttgtcacatttttacaaataacaaaagcaaaacatatggttgaaatcttgaaataaacagaaaataggaaatttttttttgaaaaaaatgagtttaagcatttttgaaactaaaatattaaatgtttttttcttgagtttaattaaagtttaattcaacgacacgatctcgggttgtaatgcttttcgcaaatatgtatttggtccacaaaaaaatttttatgaatgaaaaaaatcagactttgaaaagcattatgccaaatatttgaaaaatgccaataaaaacgcgttttctctattttcaaaaatcttagccacattaaaagctcaaaaaggataacctattatgtcatttaaacagcttcggtgctacttaaagaagaacacattgaattttatcataaaccaaagggaaggtctttttggtttacatttttttgacataaaatgtcgtgaaaatatatatgcttccagcggtaattttgaggtcgccggtcacgaaaccgacagcaaccaatttcgaatcatttagcttatttcgaattagagttaaggaattcagcaatttgttgaaaggatagcagattcgtcgtaaacagaactccgaaaacaaatataaataattttttacgataaggcatattttataaaaatttatgaacctaaacgggtctcccggtgcctttggtttttaataccagctttattaatatatatatatatatatatatatatatatatatatatatatatattattatcatgcaatcgcccccccccaattcgacaatttctggaaatgtgtttctatcgcttccgttacagacaatagccaacccaacccaaatccgaaaccgcagaaatgaatggtcaatgaatgagtcagttacccaaattccccctttcgccgaaatttcctcggtcaaatgaatctccgactgttgttgactgattacgtgacggatgacttatgacaagcggtcagagtttgaaattaagttggaaatgggttaagtgacaaaggaaagaagggcggggggcagcagtaaaagaagataacggagaacacttcgccaatcgcccgcttgtttaatttggtttgatttggaatggcactctgctaattgtaactaaagttctgacgggatcaggatcccgccgggatttttccgggatcccgatcccggcttttttgaaaaagggccgggacagggatcccgaaaattcgtggtttgaatcgcggcaaaatcggatcggatttgaatcccagtaatcttatcccggcccggttccaatcccaatcccgactttaactcagggctataattgaacagaaaaatactgcaacggaaggaaagtgaacgggggggggggacgcactaataagagatcgagaatgagtgacttgttgaagaagaggcaacacatgtaaaagaaatgggcggatgaatgaatgaattggatgatggattggcagtgattgcgctgataaaaatcgaaga

SEQ ID NO: 15157 - DNA, 562 bp, Heterodera glycines
actctcttccccactctcctcctccccactctctttggccccgctctcttctcactctcttccccactctctttttcctcccctcttctcgttggccccactctcttctcactctcttccccactctcctcctccccactctctttggccccgctctcttctcactctcttccccactctctttttcctcccctcttctctttggccccgctctcttctcactctcttccccactctctttttcctcccctcttctcgttggccccactctcttcttactctcttccccactctcctcctccccactctctttggccccgctctcttctcactctcttccccactctctttttcctcccctcttctcgttggccccactctcttctcactctcttccccactctcctcctccccactctctttggccccgctctcttctcactctcttccccactctctttttcctcccctcttctcaatggccccactctcttctcactctcttccccactctcctcctccccactctctatggatccgctctcatctcactctcttcccc

SEQ ID NO: 15158 - DNA, 2161 bp, Heterodera glycines
  misc_feature (2005)..(2005): n is a, c, g, or t
ttcctcaatcgcgaaagcagtcgcttctcgctgcaaattcgccgcgtggacttttcccaccactctccgctagcccactaatccaagctgggttcagacgaagcggaagcatcgtcaaatttgcattccctgctgatcaaaacggcgggagggaaaatgatcagaggaaagagacgacggtgatcggagcatcaggcaagtgatcactcactgctgaaatgcaggctaatgaaacaaaatgcttttacaataatgaatggatacgccatcctcctacactttaattgcaatgagtgcgtgatttcgtcggtcccatctctcctcctccccactctctttggccccgctctcttctcactctcttccccactctcctcctcccctctcctcgttggccccactctcttccccactctcctcctccccactctctttggccccgctctcttctcactctcttccccactctcctcctccccactctctttggccccgctctcttctcactctcttccccactctcctcctccccactctctttggccccgctctcttcatccacctactctctcctcatattcactcactttattaatttaatttcactttttttttgtttaccttatgttgctcacaatcagctgaatcaactttaaaatgctaaaatccttttctacccgtccaaactcaaattacccccattaaattggattcatccaatcatttggcaattaattttgaagcgcttctgaaaatgaaaaactctcattttgttaactgtttttggctcgttttgatggtttatatcgctaaaacgaatggacaaaacgctgaagcgaccactgaagtgaattcggagcagaatggaacggcaaattttgacaatggcaatggcaatttaaaagaaaatgacaacggaacatccacacaaaagccatctctgagaaggaagccgctaatggaagaggccgagggcggcgtggcggacgaggaaattgagcgattggaggaggaggagaagcagatggagaaggacaaagctgaactgcaggaagagaaggaggaggagggaggggaggaggagaagcaacggaaagacgaggaagatgaggaggagaagcaacaggaaaacgacgaagaatcggaagcgcaaggggcggacgacgcagagcaaagcatgaaagcaaagctctttaaagaaaaggaattggcggaagaaatggaattgagtttggctgattctgaggaggaggcgaagcgagcgaagaagcaggggaagaaacaccacgggaagggcggcgggggccatcgccacaaacaccgaaacggaagggacggaccaacggcgttcattttgccgtcatttttccttcagcgtttgttcagccgcggcgcttttgggccgtcgggcgctccctttgacggttcatcatttccaatgattcttccgattataattaataataacatccgtggggggccgccggaggaagaacatcagctgatgagcagcagagccaatcaccacaatgggccaatgttccaagcggcgcatcactttacggcgccctttccgcccgacttcttcgcgcagcgtcagtcgcccctcggcaccccaattggcggacaacgcccgtcccaccaaaatgccaatgccaatttccccccgacttcgtttggctctctccgagcccaacaatcgcaaggagttcctcaaatgcacaaccaacagaacaacgcctttggcccgtctgccagtgatccgtttccccctttccttcactcaatgcaacaacaacagcagccgattttcccatttggctcttcctcttttgacgggggccgtggaccatcgtcgaccgaaactcagcaagaaaaccaattccaacagaagggccaaacaaaattcagtgaagcgagtgatagcgtgagtgatgccttttcatcaccatttgggcctcaaaggggagcgatggaacaaatgcgtgggaaacgataaattggnggtgggaaaatgatcagagaagcggatggagtgatcagaaggagagacgatgaatggatagaaaaggcgagaagtgatcggaaagcggagggggagtgaatgggaaagaagtgagcggagaagcagcagaggaaggcggatgacacccactttgat

SEQ ID NO: 15159 - DNA, 1066 bp, Heterodera glycines
aatcactaaaatcttttatttgctcagactcaacccaaattcaaaaaatttcattattttattacggtatcaattctaacaaaaaagggaatgtgatgaaaaggggaaaggaaaataaggacaaaaaatgaaaaaagggaggggtaaaaaaacgaaaagccaaaatgttaaaatgccattaaaatgtggcggtatcgttgggatttgtgggttaggatttagcaataaattcccccaattcagccaacatccacaacgagtttggcatttgcggatggattctgaccattctgtcgtacgttttgatcatcctcactttgcccatctccgcttgtatgtccatcaaagtcgtccaggagtacgaaagggccgtcatcttcagattggtcagttggtcttcgaatcccttcaaatgcaaacatttgaccccccaggggcgtctcctccccggcggcgcgaaaggacccggttagatttgattgtcccgaaattacccgtatttctgagcaggcattttcttcattgtgccttgcatcgactcctatcggaaggtattcgccgttccgtccgtccctccgtcgttttcctccattgctccccccccccccaatttcaggtcgatcttcgcgtcctttcttttgaagtcagtccccctcctccttcgtctttatttgccattttaggttcctccccaggaaatcctttccaaggactccgtaagtttcgcctccgtccattggctttcgcttgcctttctcaccccccccctttcggttaggttaccgttgcggtggatgccgtcgtttattttcggtttgtcacctccctcaaaatggccataattactcactcagaatttcaaatgccaccatttccgtcaccaatgtcgaggatgcgtcccgctccacaaaactgcttgctcagacgacgctgcgcaatattctcgggacgaaaacattggcggaaatgctcagcgacagagaggcgatttctcttcaaatgcaagtgaggagcaataataataataataattgtcatcggttattgtcattgtcaaaaacatagg

SEQ ID NO: 15160 - DNA, 2988 bp, Heterodera glycines
  misc_feature (851)..(851): n is a, c, g, or t
tattttggttttttgctcttaaaaatcccagtcctactcctttcctactgcaaatagtgaataaaaattatttttgctcaatttttggctgaaaattatgtcactatttgtcactaattcgtactttttgcctatgtcactattttggcatttttactcactattttagttaactattttgggatttttcgtcactaaaagtcgcgaccctactcattagtctaaatttagcggttatgtttaattttgtaataaggttaattttctttttattttctgaccaatttttgataaatttttatttaaaatttatttttggccaatataattgaaaactttggcccaattcaaatatttccaatttcattttttgctcactttttctatacataaaatgattgctaaatttattattttggcatttaagccgatcgtcttgacctgttgagccgtctgaaccaaaaagcggttgaagggcagccgagaattgaagcggtcgaagccgctggcaaacagttggacgaagcgacggcacagaccgatgcccatcagcgattacaggtggtccccaaaaagtgtgccgccagaggcattttttggggacaaaaatggcttagattggcaaaaaatatacacattcttggtaattaaacaattttaaaatttggatatatggttgagtttaacaaaggaataagggccacatggacggacaaagtgactcaaaaattgccggattaccctaatctaaaaatgtcattgatctgaatctggcattggcagcaaaaattgctcgaatttttgagcccgagctggcaggaaaggcgtttcagtgatacagtatttttcanagtagagatacgataactgattaatgaatcttcagtttttaagcattaattgatatgagaagaaaattattgtatacttttctcttcattttatgaatttccatcattttcacaaaattttattaattttttatgctacagtatttttctttaaaaattcgctgtatcgctaccgtatttttcaaatgatccgtttccggtagccttttttttcttggacctttttatccattttctcctgagcatgactgtaacttggatgacgaccaaagatctttcatatgatttccgattgggcttaaggccgaacacgctgatcacctggcccaagtgcgcaaccgctttcgcacactaagcgaccggttgcgtgacagtgtggacggtgcgcgagcggagatcacgcgtcgcgaggggctggcacgcgggctccagcagatggaagaatggctgaacgtgcaggaacgcaagctggcacgcccgcgcgcaatcccgctgagcgcgggcaaactgagcgaattggtgagaggcctaaacaaaatgccgcatttgaagatctacttgcacttaagcttccggtctctttcagattttcaggttcaaaaaatgcacaaaaattgatcagtttgacaaaatgtgctattaacaaaggcaacaagcaaaagcgttaaaacacaaaaaaacactgtcaaaaaaagtcaattttggcattttttggttataattttttttttgagcgtgctgatagacgccgtcaataatttttgcaaattttaacgaaatttatttttacaaatttgctagaaatttcaagaaattttgtcgaaaattttttgttagtttgagctgatctgttcatgacagattgatctgaggtcgattgagctgttctggtttcgaatttactttatttaatcattatcaatgattagtcttagcattgggactttttcagaaatacgaagaccaattggagcgaggcgagttggacaatcgcgcaaaaacattggccgagttgggcgaactgttgggcacagaacggcacggcccccacgaacagttggggcgtcattttggcactgtcaccgaccgtttttggcgggttgaagcaatggcacgtgcacagagtgacaacctacgggatgcggtaagcatttttcgaaaaatatggaatttcgaaattattttttgaattttatacaggttgaagcctttgaacagtggcaacatgccgacgaagcgttggccgagcgaatggcggcactaagcgacgcgatagcccaactgagcgccgcggatgttgacggcgctgagcagttgggcgccgaattgaactcggtggaaaggcgcgaatgggccaagttggacgagttggccaatcagatagttcaaatgccgaatgtggaacagactgatcacctgactagaaaggtgaacaaactaagatggcgtaccattatcaaacaaataaaaagattacggtagagtgaaaatgatcaaatgaatagatatacgataagagggatataccagcagaaaaatgaagtaataagggtgaaactgatcagaatactgattggataaaattggtcaaaggtaataaataatatgagaaaatgaaaagatttgcttgtgctccccctctccgcatctttattaaaaatttttaaatagggcgttaaaaaatttttttaagctgatcaaaaaacatgattcatagacaaagtaatatttggagcagatcaacaccagaattgacagaaagtggtcattttttgtgattgattgaatgagaatgattaaattttgcttggatactgctgacaattatgatatttaacatggtataaatttaaacatcgttttagatgcgttccaatgagtcccaattggcccgaattcgtcgagatttggctgccaaactcgagagtggcgagaagaccagcgggctgcttcgcaaatttcgagaaaatgcacaaaaaattgagactgatctggcagaggtgaattttttgcttcaatcgttcttaattttttgcagtaataacagtataatttttcttggggggcggaagtttgggcaccgggaagtttgggcaccaggaagtttgggcaccgagaaatttgggcaccagggaag

SEQ ID NO: 15161 - DNA, 3426 bp, Heterodera glycines
  misc_feature (3392)..(3392): n is a, c, g, or t
attttgtttcttccgctgtcgtagaatttctgataattcgtgaggttcgcattcgttaaaatcgcatagaatttcaatgagagaattcattttgagcaccagtaggcattttcatattcgttgcaagtccttatatacacttacttcaccactgtagagtgaatttttaccttttctttttatttttaaaattctgagaactgaaatacagatgatgaccactaccaaatcgacaattgacaaaaaatatacccaaatatttgaacttgaaactttaattctctcaaattctttgaacacgacaaaattaaagaattcactatttgtgtctgccacatatttgggaagtatctcgtttgagtcaaatcgatctttatatattttcttttccttaatcagataaatttgtccctcaattattaggaaatcggtaaatgaagacggcattgatccgatcggtttagtaataattttggtaccattatgatgtatccataaattctcgattgatctaatgtcaatttcatctattcgatcgtcactgattacaaaaagtcggccattaatgtgatcaaatctaaggtccccactgggaaaattcctaacaaccttttcttgactccctcttgttatcgaagtttcatttgtattttcgttttggaaaattaaataactatgatcgttgtaataaaagcacgctcggggccttaattgtcgaaaatcctggtaaagcttaacattagttggtccgctcttttctattgaattaatttcttggattgataggctccaccctgaaatcagattcctatttatcgtacataatctcgagcgatcgaatccgaactgtctttcatttaccgaactctttgtcatagtgagatacttgtcgtcaaaaagttgtgtatcagaaagaatagtaaccctttctccactgagttgaccgactatcgttaggagaacaattaaattaaacattactgacaaaattcttaactaatatatcggacatcgggcgaaccttatatagaccatcaatgacctcacaataaaggattccggagcaccgttgtgttaaaaaataaatgcaaaattgaccacacgcatctgagaattgatgttggacgatgcggtcgttaatgagaattcgttcaaataggttaagatatgaacttaaatcttcattgggataatcgcccaatgaatcaaaatattctatttctgttggcgaatttacaaaacaagcgacccagtgttcacctattgtgcccgcccggtcagtattcgccacaaaacagtacggaaaatgcctgtccttcaattttggcatcttgtcggaagcaaaaaccccgataaaatattttcgggttgtcggatgtttggatagaaatatttcaatctcatgagaattcatcatatgcttccgtcgctactgagcacacgattagcattaatagatagaattgaatcaaattcccccagaactatcatctcatacccgccgtcctttataggctcattaaactgcaccttgagtctcggaacaatgcttgtaaaaacattgtgtgaaagatcagaagtgccacgcgggatgaaaagactcctgatctcaatttttctcataggatatttggccggggtggtttgtagctgattgcttattatgttatttaatgactgggtaacatctactgtttttacataaattctaatatcgtgtatgttaatacgatatgtgtgcgggctcactatgactgcatttccggaaacatatggcggtgccataattagaaaatcatcggtgttacggtgtatgctaaaaatcacgtcagagttattaagcaaaaaattgggctgacgggcgagatcaaaattaagtttcaccattgtttcacattttgcactatcagcaaaacgtgacgctctgtttttaaagccactgtttgtataatcatcctggtcgacatcgtcgacataatagcaggacgcttcacagagaccctttttgacatcttctgaaaatcccaattcattcatcatatatgccctaaacgcatagtaaatgccggaatcataagactcaacacctgaaattgacacctttaaggttttgacaaagctgtgcccaaaattttgaatgacaccgacgtgttggtcagcttcactgtccttggtaatcggaatccaattgcttttttcttttctctctattgaagttgacagatagagaaaggttttattgagatcgcaaaactgattatctgaaaaaagtctaaagatatatggcccagattgatttattgctgaaagagggagtaattccctaatactggatttattaattgcaacgttcgtcggggggatatcaaacagcgaaaggcccccctcgagaccatcctcactcgccttgtctattttcttaagagttgacattttttaattatttgtgttatttattctatttatacctttaaatgaaacttaactgatcaaatacccgtttccgattcttattagtgatcagagccctttttcctttcccacattgttgtaacttgtcggtaaggttagtcaacccctgtcttgaatgttccctgacggcatcccctaaatcacggccctgagcgatgtcactcagaactctctgcccagcggcgagcccctcatgtcctgcactcgaggcaatattcctcgcaataggggtcaagaaacgtgccacattaccaaggaacccgaatccccgttgatacttgcttccgacaaaatattgtttctgtcctcttccatgttggggagtgataaaagatgaccaatcgaccgactcgggatcgaaaaacacatgtgtcattttttaaaatatacttttcttaaaatgtaatgtaagaatacaacttccccagtgaaatttaacgaattcaccaaacggtgtgtgaatttcaattgtaatttctgaaattcgtttcgactgtagacgatgaaaatactcggtgctatatataacttcactaatcgatcctgggtcatcgacgacgttaactattcttaagagtggagccatctggttcccgataattgtgttttcgattaaatttggtgcataaatgtatagctgccttacacctcccgtcaaatccggcatataagtcgcctcttccgcgtgaaatagccttgtattcttaaatccgagcacataggctaggtgttttgacaaatctatatgggagacagcagcggaaagatagacaataaatttttgatcaatgctgtcgtagttaaattgaacatcctcattggctaatctctctcttttttgtggtcctttctcagcttcagatacttgtctatttttcatatctttacgtttaatatgctcaccgagcgcctcattaagnctattcactatcccgctaaaacccttttccgatt

SEQ ID NO: 15162 - DNA, 1833 bp, Heterodera glycines
aaattctgacaattgctcagctgtttctgccgtccgctgttaccccttcatggattcgcattggcgctgccttttcccatttgttttgcgacgggtaataaatttccatagagctcaaattgttctaaaaacagtgaagatgcatttagaatatttcatcatgttcatgttatattaagttactatatctaatagtctatgatttgccacctctccgtcgtatccaccaattgcttgcagcaaatcgccattggtcactaatgaaacacgagctctgcacacacccatcggcgcaatgtacgaccattgatcctacgataaagcacataatgtgaaacaaagacaaatgaacaatttcaattcaccatctccggatcgtacacttccgctgtcgacatgaattcggtgttgtaatagctgaacaaaaaactgactaacaacaaatttcaaaagcacttttccggaatcggattagaattaaatagccctaattgaaagcaactgttatttaatgttgtttttttctttacccgccaaccgcataaattttgttttggtatgttgtggctgccagacgacctacgattaagtgacaattattttttgtccgaatttatgtcatcagctcacatctcggctgttgcatgggcgcaactctttcccatcgctgcgagatggggtcgaacctctccacggtgtcgaaaattgaaacaccattatgcccaccaatgacttaaacagagatagcgtatgcatagtgaacagcaaggaatgagcataaggcagcaaacccaaaaaatcaatcgacccatgttttttttacggtcgttgccccatacaaacaaaatcaaaagcttgggttcgtccctgctgacttagaaaaaaagatttgaaaatgctcaccgtaaatctgtcctttgaggacagccgttgccgcagcacatcgtttggttagcatcggcggacggacgaaccattggttctttcggatgtcaaatgactcaacggaatccctgaaattgaaacggaacggaaatgtattctctacaagccaattcgaaatgcgcacaatgcgtggtttccgtcgtatccaccgcacacaaaaatgttttctcccaaagtaagcgcacacatcgcagaccttcgattgagcattggagagagctaaaaaatttattaactgtaattaggtaatttagaaaattgacgcaccgtttcccattgatttgtcctcgtgtcgaaaaccttaatttatttaattacccaattttatttgtttagtgtgcttaatgttcgttttttccatctatccagtgggtctaaaagttcacttcggttttttttagtcgttctgtgccgttgtaaccgccaaccgcgtaaatttttcgatcgaaaacagcaacgcctattctataaaaaattaaatttgtttcggaggaaatgtatttcaaaattgccttgtcctttgggatagcattggctttcccaaaatccattttttggtgggcgggtcgaaatattcgacaccagaaggcgactgctgcaactgattgattccgcccatggcataaattcggccgggcatatccgtacaaatgcgaacggacattttgaaaggtgtgctgaactgcgaccgacgctctaaaagacattgggaaataaaaattagcaacagaccaatcagagcaccgggtacgagatggaaattctttgcctcgtcatcaaatcgcgacattccatggatgaatggagcagcgggtgattggacaccacgtcgacgataaacgcgggtttgagaaagggcatacgaatggtggccaaaagactgaaaat

SEQ ID NO: 15163 - DNA, 2472 bp, Heterodera glycines
  misc_feature (58)..(58): n is a, c, g, or t
  misc_feature (75)..(75): n is a, c, g, or t
gcgggttgagaagggcatacgaatggtgccaaaagactgaaatgctagtgatgcgttnggattagaatatttatntaatgcacgtgggaccgtggagcaaaagtgtggcgattcattgggtcaaaatccaaccaacgggcgagggcctcgaacacgcactcctccgagccgacatgcaaattgtcccagtcgagggtttggacgagtgtttggaaatccaattggagaaactcttccgacttggacaccgactcgaaaaaacgctgaataaaactttcagtgtcgagcacagctaaagagacgagtgattacaatacaatttgtaccgattgaactaaccctgttgggcattgtaaagcacggcaaactttcggatagaaaaaacattttcttcagtgatatgcgcttttagaatttcggagcagcgattggagaggacggagagttgcaaataatcctaaagtgacacattgtcagacaaataatgcaaatgttgctaacttactgcggccttaagcagtctttccatgtttcttgaggtaaattttatacgaccttaatttggatgagaaatattattgggtatcaaaacaaccgaccagtgtaaataaaatccaaaatcaatcccattatttccgcgtcaatggctgaaaaaacggcattatagtcaattaattttgctttgaaagtctctctcaacatactattcatttggactgaatcggaatgcgcttcgaccatttccgagccgaacattttcatgaaatacggcactgttgctgccaaaatgactttgtgcgctttgaatttgatgccttcagtttcaattttaatgtcacacattttgccggataagcgcaattcgttaaaatttccatgagctgaaattgcaagttcgcgggaacagtccaccaaattaacatcagagtcctcttggtcttcaaaagcgattgaaatgtcaagcatagaagtcatattctgtttcctaaaggaaataaacaaatatcgcttgactaacttttataccggggaatagctgaactgattttaacgcaaaacaattaaaaaacgccacgccaattcaaaccattgcagatacatacaaacactcaactttattatataagtagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaacattttcatcaaaaagcaaaaatattttgccaagtcattaaggatatacataattttcaaaatcaaaaattatcgtcaagaaaataaaataaataaattttggagataaatttttgagaaatttttcatttcttaggggcgcatttttgaaaattttctggtcgattcttagggatgtattttttgaaaaaatttttgggtcggttcttaggggtgtatttttcttttttattgcatttttgttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgtttcaggccacggggagctcaggaaaaaaatatgtaaaaacctaaaaatcgaagccctataaatcactaaaagttgcatccctacacataatgcgtttttctttcatttgtgagatcgtttcgcggccaattcgacgcgttgcgttgcgttagccgtggactccgttcggctgctgcagctgcggcaccgtcccctgcctgctgattgtgagcattgtgcgtgcgcagccgcgctgctcgccccgtccgttccctttcgttcgcatttgcccctccgttggcattgtcccccgtcttttgccactttcatcgctcctctttcgctgctgtttttgctcctcgtcctcctccgcctctctttcatcggtcggaaaaatcaaactgaacgacgagtcgcgactgggggaaggccgagagaacagcgacttgctgagactgctcacggccggacagccgccgcttttcgtaagccgacggatcaaacgccgcggggggaaacctgtgggaaaagtcatttctgaacaaaataggaagaggtcgaaaagcagaattggcaactttaatggccggtgattaattaattatccgtccgagtgaccttcggcatttggccctccgtccgtttgcaccattccgttcgtttctaccgatgactgtctttggctgaagtcgaccagggcacagcacgcgccgttctgaaatttatgaaatgtcaatgaatcggagggccattttcatttccgtctttttttctgtttttcccttcattgtcttaagtggctctcttttccctttccatcttttccccctttcc

SEQ ID NO: 15164 - DNA, 2456 bp, Heterodera glycines
tcccgggatggaaattttgggcaaataaaccccgtgaaagaacaaaatcgttactctcagagtaaccaagtcgaccccaacatcgataatcggcgcagaccattaaaagtctcgacaatttctcgtactcaacgacgctacaccattcgccagagctaagaggaaacgccggagcggacgaagtgaacgccttttttcgccagtcggacgcagttagcgaagattggcccaacgaaaagcgcttaagcgcattaaaatcgaaatgttcgggtagggcagaacgcgcatacaattccgccgttgccaataatcccttccggtatgaaaatatccgaagagcgatgaagcaacaactcgattcaactgatgcaaagtcaacgtgtgcttttgatgagttgatggcaggtgtccgcagaaggaacggagaaagcattgacgatttggcggaccgagtctcatcgttagtgcgaagggcctaccccgggctcggcgaacattcatatgatgattattcgatccgacacctcatccgctcactcaaaaatccggatttggcactcactaaactcgacatgatctttgacgaattcgtggccatggcagctcgcgcggagatcacacaaaaatccgcaaaagcagccgagcaaaaaaacacaaattttcgccaaaattttgatcagcgtcggcaaataaattttcgaccaccgaatcagcccgaacatttttcaagacgaaccaacgaaaacgaaagacagaatacatcttttggcgttgtcaaatgctacaattgcggccagcaagggcatatttctcgcaattgtcatctcccacggcgcgatcaatctaattttgccccacaacaatacaattcatcggcaagaggtgccaaccgaacccccattgcaaatgattacaggaacccgccacaaagttttccgaaccgtacccaacaatcgcgtaactttttgcgccaaaactttttggtagaacaacctgatgattctcctgcagtgtccaattcaaatgtcttggttggtgcaattagcactgcaagtgaagaagtgtccaagttgtttgaccaatggacggaaaataagaattgtagaaacgcggaaaagaacggcagtgctgttggaaaaattatgttggtaaaggtctcaattttagagcaaaaggttgaagcccgatcgacaaattgcacgtgtcatagacataaatggaaaagaggtcaaatgttacggtgttgtaactttgcctgttaaaaggcaggaaaggacagtgcaagtgcgtcttcacgtagctcaaacatcgtttggatacgatttactattcggaaccaactcactttcggagttagggttcaaaatttttgacgagttgtcaaaaacgatggtagacttcaagcaaaacgtgaacacccaaaactcggttcatgtgattttcaaaacgactttaatgcgttagccactacacttgttgaaatgacaagttcaacgaagaaagacaaagaattggcaatttttccatcaaatgacagaaaaaaggtgatgagaattgaattgaatgattcaatgttgttcacattgacaggcaaaaatgatgaagaccaaaattcgtccaaatctaaaagtgaaatccaattaaattgtgcgaattcaaaagaattccagcaaatctggcacaaaaaaacggacaacttacgtggagaagaaaagcaaaaattgcaaattctgatcacggagtttgaagacatttttgctgtcagtgattgggagttaacacagactaatttggtccaacatgcgatcgatacaaaagacgcagaaccaatccgaagtcgaatgcgcccaatcccatacgcataccgcggaaaagtggctgaaatggtccaagattatatgggacgtggtctcattcgtccatccagctcaccttgggcaagtccaattgttcttgttccaaagcgtgatggtactttgcgtttttgcgttgattatagaggtttaaattcgatgacgatcaaagacgcatttcctcttccgaacattgatcacactcttcttgcactgggaggaaagaaaattttctcgactctcgatttcatgtcaggctactggcaaataaaaatggaatcagaatctgttgaaaagacagcatttgtaactgagttcggtcttcatgagttcactgttttaccttttggtctttgcaacgctgttgcgacttttcaacgatttatgaacaaactttttgtcggaatgattaatgattttctgtttatttacatcgatgacatattggtggcttcagaaaattgggaacaacatatacatcacctacaaaaagtttttgagcggattcgaagcgccggactaaaacttaaaatcgaaaaatgccatttggcagcgcggataatctcatttttcggtcatatatcgaggaatgaagccattaaa

SEQ ID NO: 15165 - DNA, 1662 bp, Heterodera glycines
  misc_feature (45)..(45): n is a, c, g, or t
  misc_feature (116)..(116): n is a, c, g, or t
aataaaaatggaatcagaatctgtgaaaaagacaccatttgtacntgagttcggtcttcatgagttcactgttttacctttttgtctttgcaacgctgttgctactttcaacgatnttatgaacaaactttttgtcggaatgattaatgattttctgtttatttacatcgatgacatattggtggcttcagaaaattgggaacaacatatacatcacctacaaaaagtttttgagcggattcgaagcgccggactaaaacttaaaatcgaaaattccgaccacaaaaaagcaacttcagtctttccttgggtttgtgacctactacaggaaattcatccatggatttggaaccttagccgctccacttttccatcttcttaaaaagaattctccatttttaatgggcgaaaaagaaacgcaaattgtgtcggcattaaaagaaaaaatagtgcaggatgcgattttgtattttcccgacttcgcagcagcaatcgaagacccgaaaaggcgctttgtcattttaaccgacgcaagcaaacacggcgtttcggcagtcctttgccaaaatgatgaaatgaaacgcttacgtccaattttgttttgcctcgcgtcaatgcaacaaatacgagagcgattactgcccgacagagctagaagctttggccattcgctttggcaccgaaaatttacccaattcataacgggaattccgacgagagtgatcactgatcacaaagcacttgtccccatgttcgggacgaaaaagagacgggcaacgcaagaattgatcgttggcttatggaattaaattcccggtatcagttgaccgttgaatatcagcccggtaaatcgaatgtcgttgctgacttactttcccgttatggaataaattctgactccgaaaacgatcagcaactggaggaaaatcctaaagaaacaattttggttggaaaaatcgtcgagggcgaaaagtctcagaaagatggaagctttttagagttgggaggtcgaagtgattgggtagaagaagttaaaaacagtgaaatgaagactgtttatgaatttttggagaaaaagacgtgtccgcatagtcaacgagaattccaaagtctaattgacaaaattcatcactttacaatcgtcgacagacttttgtatttttgcgaccctaaaacttcgtcgcaacttttgtttgtccccgaaaagtttcgcaaagagctaattgcatcacggcatgaaggaaaatgtgctggccatttaagcggaaagaaaatccatcgccagctttcggagcactatttttggccgaatatgttgggagattgcgtccgattttgtttgagttgtcgaatctgtgcccacgcgcgcaaatcgcgtgcaaatgaacccccactacaaacggttaacaccgtcgaaccaatggaattggtttgcctcgacattctctcaattggtccatcggaatcaggaaatcgatatctcctcgttatgattgaccatttttccaaataccttgtagcagtcccaattcctgacaaaaacagtgaaacggttgctagggcatttgtcaaaaatttcgtgcttgttctgggttgtcctggtcggcttcacagcgacaaagggggataatttgttaacgaaactttgaatgaagttgcgtt

SEQ ID NO: 15166 - DNA, 1174 bp, Heterodera glycines
  misc_feature (9)..(9): n is a, c, g, or t
ataaatttntttttacagtagtaatagaattaggataaaaaagcgttcagtgattttctagcaattaccagaaggatgaacaggataagaagcattgaagcgataaagagcgttaagatacaaccgaagtataaacggggcattaagagcaattaaaatcaaattaaaaccaattgaataaaataaaataaaaattcaaatcaacaaaaaatttaaaaattaatcaaattaatcatttatttatattttttggggttggtctaaaacttccgaaaaaatcgattcgaaaaaatgtttgaaaagtcgatttaaaaaaaaatttttttttgcgaatttattaagaaacaacgaatggctgttgatggaagaaattgggaaacagttggaacaaagtctgggaaacctgatgaatgtgaagctttttaacgcattgtttgaccaaacttggccaaatttggcctttttttgcactaaagtagcgcaaaacattgagacagagtacggcacttttttcccttcatgggcatttgcgtgcgatgtaatggtcaggttcaagttggagcaggaaaagaccataaaaaacaacaaaaacaaaacgccaaaaaggggaaagggacaaattcaaaaagaaaacaaaaaggaagtaatccaatggacagaagaaggaggacaaagataggaagaaaaaatcgaagacaaaatgatcattgacaagaagaaaaaggaatgatttgaaaagttcgacaaaaagactagacctggatttttttgaaatttgtctcaaaatgcaaaaaaaagtaagagaaatcaattaattgctttcgaaaatcaaaaaggatctaattgacaataattaggggggcttcgttttagctttgcctatttcgggggggggggggggggggggggacagtgtcgatacgacagtctataatgatgtggacacaaaataaattagcgaaaaaaattgcctctacaatcagtggtgaaactgaaagagaaaaacttccccaaaaaatcggagcttttccgacggcatcagctgcatttccaacagttcaacagtataaataaatattaggcaaatgaaaaatttttttccttcctctttagagagtgtctaaaaatttttgttgttaatattcagaaaacgtgttttttttactgacaattt

SEQ ID NO: 15167 - DNA, 739 bp, Heterodera glycines
tggtggtcccggttatatccggtcgtggacaacgcttttgcaaaatgctcaaatttttgtgccacatatttgattttcagatcgaaattcttatttcaaagtttttgatgacatactcctatttataccctgttcggatgagcatatttgaattattatggcgatctgtccattcaaattccacgccatttttgttgttgtcactcgcccataaatagacgatcattttctccctcctggtctttcccctcattcattttattttgttattttcctccgaccaaattgtcttcgcttttatttattgtacgtcaataaacatttatttattgattgtcttccttaaaccctcggaccgaacataccccatattattacctattaaatttagctaaatatattaaatgtttattttttatttatgccattatttttaaaaccgaaaccgtcaacctggtggtcccggttaataaccggtcgtggacaacgctaattataattaaaaaagaattatttgcctgattatttttttttttttttggttaatgaggctttgagaaaatataattatttgccaaagtcacattgagttttatggaatcggtaatcccaagtgtcctgattttccaatttgtcctgaatctaaaaaggcaatatgaaaaacaggaaatgccctgcttttttcatttcatcctgtaaaaatgggcgccataaatgccaagagtaagaaaaaaaaatg

SEQ ID NO: 15168 - DNA, 2081 bp, Heterodera glycines
atgtgtgccaccaaggatgtgatgtcttggctcggcttttgtcgaatttgaaagcagtcgaagcggcggacgaaaagtgagcgggtttcggcaaacaaatccttgagctttgtcagcgattcgccccatttaacctggtccggttgggacgggctaatgctgtctctgtatttgttatactcgtcgtctcccaacttgccaagaagaagccgaactttggtctgttcggggagttcctttccgtcctcttcaataagcactccaaatcgattaaaccaccggtcaaatgtgttgccgcattccgaatcgtagtggaatttggtgatccggttgtccaaggagctggccagagtcgcgtgtgccagtgaggatgaggccgtgtttgcaggtgccgcatttccggcaaatcgtgcaaaaactgcgtcaagcacttgctgcagttgggtggcgtccattggctttgactcgtccgatgatcagcaattaaccacgcagagtggctcctcacccgcctagggactattggatgtcgaaattgaagaaaaccgcgtcttgcggaacctcacccgcctagggtctattggtttttgtcgaatttaaccgctaaatttagcggacctcacccgtcttgggactattggttttgttgaggttgggttgcagttcggtgtgtcttcgaatgggtgaagcacggctgctgactgcgccaatgttgtgtctctactttggacacacaataaaataataaacacaatttatgtcggaggagaaatgcagtacaaaatataaaatgtaaaatagcaaatgaatggagaaggaatcaagtggggaaggagggagtgctaaatgaataagggggagggattgacacgtcacaacattaatcaataatcgatgcgcgccaaattcaaattctttaacactccaacagtttcataaaaaaaaaagtttgcaaactgaattcgataacatgcaaatataaataaaaaataacaaaaacattagcgtacgctgcacatatactcaagaatataccatgagaaactaaattttatataaacaaaacaatttattaattatttttcaataaagttaaaaaaaattaaatataaattttacacaataaataaataaaagtttaaagcactcttcttatttaaattatttcagaatttaatatattaaagcagaaataatctaaaaataattaaaaagttttaagtgcaaaaataagataaacaattgattagacaaaacttagataatgaacaaaaatgaatttaaaaaaggatattaaacgcatcataactaacagattgattacatatttttgcatacaattagaaatgaaaaataaaaatataaactttattttattcataatatttaataaatattcacacctgacaaattaaacgtcgacatttgaaatgttttgttaatggaatattaataataattcaaaactgataattggttttactattggaaaatagcattgtggcttgtcaatttattaattctaaaaaaatataaatattgatagaaaaataataggaaattttattttattttattttatttaggtaaaaaaatagaagaaacccgcaggcaactgaaagaatatgcaaagaacaaattagaaaataattaaaagtattaatgcaaaaaaaagaaaaacaattagataatgaacaaatgaatttaaaaaaaaaacaatattaaacacatcataacaaacatatttataatttattttagcataaaattagaaataaaaataaaaatataaactttatacacaataatagaattttaattttttaaccatcaatcggtaatattgcacagcgagtaatatttaaaatcataaatacaattattttattaccaaactacaattagaaattaattgatgcatttgggggagggtctgcgccgtttgttccgatttagccgtcgtcaattgcccaatttgccgctcaaaaaatcgcaccaaaaatactccgcaagtttatctcaaccctgggtaattaacccctacacttacaataaatgtgcgagaaacacaaagaggaggg

SEQ ID NO: 15169 - DNA, 2543 bp, Heterodera glycines
  misc_feature (47)..(47): n is a, c, g, or t
  misc_feature (59)..(59): n is a, c, g, or t
  misc_feature (2534)..(2534): n is a, c, g, or t
aaaattacattaatttcacgagatatttgtacaattaatatccattntaataaaaaaanatatataaattatttttaattaaaaaataaatcaaatataatgtttatatatttcaactttcaaaaaacgaatttaaagcataataaatagatggaaccatggttgaatgccgtttacttatttagaaaattttttatcataaatttaattgaaatgcatgataattcattataatattttattaataattttctttattttttgcattaaaatcgaagaataatattgagtacacctagggggactattattcccttagaatggtatttcattaataaaaatattatagaataaaatattattgaagaaattataaaagaatttgctgacttatttaattttaattttaaaaatattgtaaaaaaaactttgataaaggaatagtaatattaatttatttttaatgttattctttatcgtataatttttttaaataatatatgtaaatgacagcaattacatttaggtatcaacgatgtgcgcattaaaatgataatgtatttgtgtgatttttaagcatatgataaaagccaatttatcaatgtgccgctgagcgatcaataactttttttattaaattgtctattttgccaatatgtattcttcgattaatcattttcgtttaaatcaatttcatgtttttgcaaattttgctctttttctgtaaaaaaataaaattattgtactctgttttaatttttttaatttattgttttcagctattctatataagatcataaattaatttttcaagactttttttactttatctttttattcattatttttgggttttttgcgagaaaaaattaatacaaatgcgtaaatttttcaaaaaacctgaaaaaaggccaaacagcattttataaaaatcactctgtcttcttaaaagaagcaaatactgatattattcatattttagtattatgttacctttttataatgatgttcgatatttattttttattatatgttttattcatgataattttaaatgaatggaatttgagttaaaagtattcaattttttattttgttatagttgatttaagttgatcaaacaaagatcaattacacgcatttatactttaacttgaattatttaattatacgcttatattttcaacatgataattaagaaagtttattcaaattaagaaaatatgcagaatataaattcaaaaataaacaaaaaaggcggaagtcaaattctcatataaaataatagtagtataaggtcccaggggccggggtccagaccactgcccctgcttaaaaaaacacccatttttgttcttcatgattttgtctcagctgccggggtccagggattcgccctcataaagtaccatttagctttgttacagatgaccataatttatataaagctcacactaaattattccctttcattaaaacaaaacaagttagattatgagagtttgaactttagctctaactgtcgaactcgtcgtactaacactaaaccaccggaatagctacaagaacaattatttaatgaggcaataaaattcgatttaatttcatgtttaatgtgattaaaaaatattaaattaatatcacatatttaaaaataatcacaattaaaattattttaaaccttcaacaaaaacaaattcccaactccaaaatcacatgaccgtcacccccttttaacattttttttgcttctttgccctattcttcttccttttcatcttcagaagacaaaatacgtcttgtccccgttgaagcatgaacgtcactgtcagatgacaaagtgtcatctgacagatacttcttttttgatgtttgagtcaggccaccgccacgaagccctggaggcttgggcggaggtggtagccgcgaacacttgagaattgagggaatagcctaaagcaaaacatcatttgaacccgaatattttgtaataattcagtttttttgagaaagggatgaaaaattaatcaagcctaaaattaactatgttacatttttgggtgttatagtgacaaaaatccgaaaaaaacatacagacaaaggaagatctgtgccatttttgccaacgttttcaatcacaacaccacgaccaccgtttgcgccaactgtgatgggatttttttattttttttgtttttatttttaatatatattttttaatgttatgttggacttttgacccttatttttatttttatatttgtttggcattatgttcatttatttgtgactgttttttcccaccttttccttcattcgaatttaattgtattaattttatgatgttgtcttctcaaaaaattgtttgtgtcctttttttgtctcttttatttaatttggaaataaataaactctgaaaagccttgactccttctttgagttcccaaccaaaagtcgaagaaaaatcccatcgttaaaaatgttatttttccgggcggggggggggttattttttattttattttaagaagaantataaagag

SEQ ID NO: 15170 - DNA, 2567 bp, Heterodera glycines
  misc_feature (31)..(31): n is a, c, g, or t
  misc_feature (54)..(54): n is a, c, g, or t
gaggcgtgcagcgtggacatccaaagagtgntgcagagatgtgccaccggggcnagagtagaagtgggcaacatattaaaagattattttaaaaatttaatatctttttttattaaaacaaatttaaatattacaatttaaataaacaaattttattgcgattttttaaaaatggaataattattcctaatcacttaatatatcgttttatttaattttgatgttgtctgcgaatttatcagatcttacaatttattgtttatctctaaattcattaaaaatcaatttccaatcaataaatcaatttcgcaatgcttttttccctttctcagttatcatgtgccttgtggacgcggcacggaacggccaagtgcatttgtccgccgcatgtcaaacaaaactgacggatcgaaacaaactttggcaaatggcacacgacgagtaccgaatggcattgccggagacatggtctgaggtaaagacgtaaagacaattgtggcaaaaaatgtcaaaaaaccgtttggagtcattttactcataaaattctataagttttttttctaaaaattatttagcctcaattaattcgttcaagcatttaaaagataaaaaattgttcaaaattataaatattttggtttttaattaaaaagaaattcattagcttttaaatatgggtcaattatgataagctgtgattgaaaaaaaagattccgccattttaaatattttgcgtcgtttatttatttaatcctatataataaagttgagtgtctgtatgtttctgccattgtttgaatttgtgtggcgttatgttttgtttttgcgttaaaaatgagtttgaaaagagatgaaaagaaattgttttgaaaaagaagagaatataaagaaaagagacgaaaataaatagttaagaagaagaagaaggcaaaagaaatagcacagaaaaagaaggtaaaagatttctcctcctaggatgtagaggttagagggagggatggtgggaaatagtgcactgtatgactgtctgtctatgcgggcagcggcagatgggaggggcagacagtgaacagacgcgtgctgctgtggctgctgtgcagcagcagtctgttggacgcgtgcgtggtgtgtgggagggagggagtggggaaaaagagagattaagtggaaaagtaaaagaaataagagaaaagaaatgaaagggagagaacaattgaaaatttgtctcgcatctcttccttatttacatcccattttttattttaataaaagaaagggaaatgagagttttttttatttctgttttcgcttcagtgagaattttcctatcttatataataaagatgagtgtggttatccgccatggtttgaattggcgtggcgttttgtatttgttttgcgttaaaaaatgatttgaaaatgaaaatggttttgatttttcaatttgttttgcaataaacattcttaaaattgtacctatttatttgcttttttatgtatgttcatagtttattaagttatttgttatataaatttgttttttgtaaacgaaaaaatttatcagtatattgtttgagtttgatttagtggttgttgtttgtttgtttgtttattttgtttttgtgttctttacgtgaaataattatgtttatgcttaatgttatttgaacttttaatgaaatagaaatgcatatctttggtttgttctgtgactttcgtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgcttttgaaaaaacattagtggtttgttctgtgactttagtgtgagacactaatgtgtgtcatgcttttgaaaaaacattagtggtttgttctgtgactttcgtgtgagacactaatgtgtgtcatgcttttgaaaaaacattagtggtttgttctgtgactttagtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgcttttgaaaaaacattagtggtttgttctgtgactttcgtgtgagacactaatgtgtgtcatgctttga

SEQ ID NO: 15171 - DNA, 3077 bp, Heterodera glycines
taagcaaaatgtttgactatttgtggagacttttgttctttccgtttgcttttctcaaatgccattcgatttgactaccgagtggaggggtgtgagtcatcagaacatcgaccaccggcctcggctgtaccgttgggattttcatccattctttgtggatgggaacgcctcgtggacgatagaacgaaaagacgggcaaaggttgccaagaagagccgaaaatgtatagacctaacaactgcaatagctacaaaagtgatatagaagataacataagcataattattgcatgagatcaatggtgggtggctctgagcatgtcgatgcacatccccgtgggtttcagcaaatgctcatccgaccattggtcctcccgggctttcatgcaattgtcaaatgagtcggaaaagacaagtcggagattggagaggcaaagttggaaattgtcgtatgccttggccaccaatgaacgcactccttggtcggttatctgcaaatattatcattttcttaaattgaatgatgccctaaacaattccctgacatgttcgtatgcttttgtggacggctcgtccaaagtgttcagtttcaattggccaagttcggggattaatgtcgtttttgttccaatttagcggacagttgagaaaaacgcaattcttccatcacatcgtccaacttcaacatgagtggtttcaggttcaatttgaacaggttttccacaaaatgtttcggatggtccgtcggtggcatattttactgagatttttgccaatttatacatttaaattgccattttcactctctcttggtagtcaatggatcaaaagaggcgctacttctcctgaggggtcaattccttctcctatttttcgaaaatttgtgcgtcttccggcgccgccgcttcttgaacacgtccacccagcccatcctctgacacctgacaaccgaataaaagattttcagagcaaaaaagcattaatatgcgactagttttagttttaacctctcggtagtccctcgtgcgcgtggtctcagtgatggcggacccggtaccggcgaaagagcctgagaaaaaattgttatttgttttatttgtttagtaatttacttgtcaatttgttcgtccgtcagtgttttcttccgatcagttaaattaccagcttaagtattttatgaagtcttaatttttaaatgtagttcttactcgtttcaacctcctcgcattgttcatcaaaacttgggtcggcgcgtctgttgcttgttggagtaaatttgtgattgcctcgtctgttggtgccatttcactttaaatgtctaatgtaaatgaaaattttaatatgtacgttacttgtattgccacatttcgcgcactttcgacgtcttcctcgtgtccttgcgcgttttcaaacatcaatagttccaccgcacgtccagccataaattgcacaatttgcgcgaccagttcttcatctgtgtagaatccttcaacataatgccaaaaagtttcgcccaaattgcctccttgggctcgaatcgtgacctattaaagaattgataatgaaaaaaacgaaattcaacttttccgagcataatttttttgtctattgcatttagctaaaaataaagttatacagaagcttctatagaccttaagcttttgtttaataccaagaatataggtattgaccaagtaagaaaaaaaattatgacctaagaaactgggtatggtcattcatgggacgcataatctgtcatgggatgcataatatgacatggaacgcataaaaccgactagaactaaaccgacagttcttcgttttaacaccctatgcatccctagaaatctactttggattttgccactaaactagggcatgcttattttggcatttcactcttattacagcatgaaaaatagaattctcgtagaaaatttcttttaaaaaaaattttaaattttggtaattaaattactgaaaactacttactctgtctaaaatgtcgatgttgttttgcccatattttattaaataagcgtgagcgcactcatggtacgctgtgaccaacaaattttgcactccttgcaatgccggcccgagcaatttattgtatttgcgcttgtaccgtccaaatctcctacggccgtcaacttttccatatctagcgaattttggttttcgttttgttcttgccattgctaaattaaaacttaaagaagaaattcactgcaattaaaaaaaaagtaggcagatgaaaacggtaaaaagaaacagccaaaatattcatgttgagtttaattagaacagaaacaaacaaaagtaaaaatgcagttttaggaattgaaaaagaatttaagtatggttaatgttgggcttaacgtagatacagtcaacaaaaaaagaggaaatgttaaaaaatggcgttaactaaatttcgaaccattttagtcggaaaataattatagatcagatatatgtacatttcatacaaggcatagactaggcctgttttaggcataggcctaagtcaagcccagtgtgacaaatcattcaacatgccaaagtggggtattttgtgttaatttaaaaaagacagtatacatagttattttttcgttattttgacaactaaagtaaatcaaatgatataatttgaactcttttaaaaggaataaacgtttagcaattgttgcacaaaagaacatttatgtgtaaaaacaagggacctcgtagaaccgggagttcccgtcccgttcccgctcaactctaatctaagctattacctttattttttgtatttacctattttttaataaaatttttaccggaaagagctaattttcgacggtggccgaacgtttcgtcactgaacctttttggagtgtctgatcagtgatcaccgtaaaaaatttttaatggacgtcaaaatttctcgtttcccaaacatgagtgcctaaatgtaattccccaaatgctatttccaatagcggtaaaaaattcttgactatctacttttacatatttctgtaatttagctatggaatctgactcatcgcctcaaaattggtctttcaa

SEQ ID NO: 15172 - DNA, 2261 bp, Heterodera glycines
tgtttttggtcacgagccgatcacccgcgtcatcggtcctttttccacaaatgatataattttaccaataataatttttgttttgattttttaaggttgcaccccctcggacacctcaccaatattcgacgacatttgtgagaagtgttctaaagttagttcgtggattagtttctccaatgctttgcttctcttcaccctcttccccctcattttcagtttgatttgtcatttgcggccaaaaacaacgatggaaaaatactgggagttctgttgaatgcgcccttcaaattggaaaatattcacgaaagctacagagacattgggcgcatgccgaacaaaaaggaattcggagaaggttaggcaacgtaaggcggagattgaagatgaaagcaaattgttaagagattcgcaatggcccttttccatctcaaaatgccaatcgaatccacgccattctcactttcgtgaatagtcatatcgcactgttgccccccgaagaggatatcaaattagtcgaattgcaggccatggctgtaggtccaggacacgccaggtaacgttgtgttgaatgccaatcactcgctcgtcaaatgcggcactttccgctccttttcaggactggcttgggctccggtatgctccgtgcactcatccaaacggcttccgcaaaaggctattcccatttgttcacctgtgccaccgccatcgcctctcagacggggcttaaaaaagtgagttgtctgaccagcagtgatcactattttatttttccattttgaaatctttgactttacagtttggctttgacgagatcaaaactgtccctttcaactcttttctggaggacggagtgccaatcttttctggggttcacgacaacggagtgggcgcaaaacttgtggcattgcatatctgaagtctgtgtggaaacaaatgttaattggcataacacaattgatgatgattttaaatagaatcgtcaaatatgcaaattgtttgtaatatgtgcagaaataataaaacccatttattgtatcggtgtgccttataaagaatgagctataaactgattagccaattaaagttaaaaatatgactctggcgaaatatgatactaaaaatagcaatggcggttgtttttttggtaatagttcagtttgtccccccccccttttcgaaatttttttatgttttcaaaagtcataaaaacactttttatggggttttcggggtcgctgatcacgaatccggcgcccatttagaccaattcctaatcccggacccgaattcgaacaaaaagtcgaaaatttaaattttcgattttcacatttttggttcaaactttgtttaaatacacggaaacgaactgaaattcaacattgcttcaataaaagatcatttgagccatttttagaccaaaaatgtgaaaatttgaattttcgactttttgttcgaattcggctctgaggttcgaaattagtcgaaatgggtgccggattcgtgatcagcgatcccgaaaagccttggaaacatgttttcatgacttttgaaaacacaaaaaaaattttcgaaaaaagggggggggacaaactgaactattaccaaatgctttaattattatattattttttcaatatcgcacaaaatcattcatttaacaaccacccacatctgcaaaatctaccaccaaaaattgcacaaaaaatagaacactcaatacatacctacaaacaaaggacgcttgcataataggcgtacgacaccttatgacatttgttatgaccaatgtgcaaaaaaatgccgtcaatttggcagattggcattattgacacttggacatttaacccaaagttaaaacatcctgataaatttagatcgctcggttaggcaaacaaatcactgccaccactaaatgcaaacgcgtgaaatacttgcctaatttgctcccgtatgtgctgccaccgcccgaggaaatgtcttactatcctcctattgacacccatttacccacgaaatatctgaatatatgtctatattaataattatatatattggcctagataatttacaacctcctccggcaaaccgaaaagaaacggctgcggacagagctaatgattcgcattgtcactcgactaatcgccgaatttgacgcactatgatccagtcatgctggagcatgtcctaaaaagacaggaatacacacacagcagtgtcaaaaaatatcatgttattttataaagtataaactaaaaacc

SEQ ID NO: 15173 - DNA, 3260 bp, Heterodera glycines
  misc_feature (3227)..(3227): n is a, c, g, or t
  misc_feature (3249)..(3249): n is a, c, g, or t
caattcctacaatagcgccaattcaaattgctcagccgcctgtccgtgatcaagctcctgtccgtgaccgcacatccgacccagtctaaatctcctcgtccgcagtgtcagcgcaagaagccaattcgctattcgcccggctcattgccacggacggtctttccaaaagagggagatgttggatgtgttgatatctaatattattaagtttcgacacgacttcttttattgattagttatttgttgatgggtcctctcccatcgactcattcttgacatttgtgttattttacttttcggtgtttattttcggactctctaatttgagtccgtcgttattttattattattttgtgattataattttattgtttattcatttaataaatttatcttgttcgtgtggtagcaaaacacaacaggtctcataaatttcaaaatctttgtcatccttttgaacaattttcaaagctttgttcaatggcacccaaatttttttttcattcggtacctttaaccaatgatttaacgtgcaggtggtttcctaatttccgcaaatgggttcgaaaacaaaaaatgtgtaaaacataaaaattcataacttggctcaaactcgaccaaattaattttcatggtataatttaataaatgtaagtattgttctatcagaatataatgctaaattttcgaataataaatttggttgaatttgagccatgagatgaatttttatgtgttacacattttttgttttcaaccccactggcagacttaagaaacgcgtatgggtttcggaatttaagcaacccgctagcaccattaaacatgcctagattaattatcttttattgcttactttcattggaatcatttttcgattcatctgtgtatttaatatggtttccaacaaattcaactccgtctaattttggtaaatcagtgatcgtgggcaaagtattccaaaattcatcgccaagatcatcaatgtaacttttaatgttgtcattagctttatattgagttgaattgtctccatttttgtcgttattaccatgtacattaacgctgatcaacaaaatagtaataataataagaatgaaattattaaagaaaatgaagaaattcatttttgcaattttctaaaaaaatatgaaagataatttattatttcaaatttatttcttgcatcaaacaaatattatataaccaataataataattatattgtaaaaaataaaatttctctgaaggaattataattgattatagacattgcatgaaaggtggataattctggccatagccatacaatagcaattaaaataaatttttacgttttattatagatacaatgacttgtatttctcttataatttattgtagcaatgaaatatatatttattatttatattattatgcaaaaaattctaaaaattttaatgagtttcaaaaaagttagcgtcaaaattgttgagccaaatttttcgagcttttttgttacaactttttgtaaattttagtaatttttaaaaaattacatactgggcattttggcattgtccattggctcccggacttttcgacagcaaaggacttttcgacagaaacacaaaaacaactaattcttattaaaatgaattatattgcttgtcagttttactaaatttattttaaattaacatactaaaatgtattgttaaatcattattactagggatacgatttttacattttttacaatgaaaaatttcagaaaacacacccttaagaatcggcccctaaagttttcaaaaatatacctctaagaagaaagaaaaattttctcaaaaattactctccaaaatttatctatttattttcttggtaataatttttgattttaaaaataatttatctcaatactgatctggcttaattttgttgctttttcgataaaattttacgatttacacctctaatttaaaaacttattactctttactgtcgaaaagtcccctcctgaaattctaaatatttctgtcgaaaagtccggcgcccgaagcgaattcattattttttcttcgaaaaagaaaagactatttaaatttaaaattaagttgctattttggcgttctattaactctaaaaaaatttttttttccttttgtaaatttaaaatttttctgttttaatttaaaatcaatttttactatataggccaattaggtaggtaagttgagattttttcaaataattagttcgatttttaaatattcctaaatttatctgtcctttagctttatttacatttcacttttgtcaattcgtccgtttattcaatggccaagcatcatcccgacctcatcttttgtcgtaagttttatcacttgaatttcataaactttctcaacaccttgcaataggcaaacagcccggcgttgcgatcggacgcctctgtgacaaatgcgacgggcggtgcgtcgtctgcgattcgtacgtgcgcccgtgcactctcgtccgcatttgcgacgagtgcaactacggaagctatcaggttatgcgcattgaactattgtatttaagcaacaatttaccgacttaccctcacattttttgtattagcattttaaaatgatagaaataggcaatttttggacgaaaaatataaaacttattgttaatccagaaatgtgggcatggattactgtggtcccaatttttagggtcgctgcgtaatttgcggtgggccaggcacaagcgacgcgtactattgcaaagagtgcaccattatggagaaggacagggacgggtgtccgaagattgtgaacctgggcagtgcgaagacggaccttttctacgaacggaagaaatacgcgttcaaaaagacgtgatcatagccgggggttggactgtcagggtttttgtctgttttttccgaccgttcgacctccgtttaatttaccatcgtttctttttataaaataaaaccgcgttctccattcattttttttcaattttgtgttgcttttcattcgatatttttgccttattcttgtccttttacactgatccatgattttataaagcattgttttgaatttcgaaaaaatgggcaaaattcactactgcaagcgtccggacaacagcacaaagtcgtgcaaagctcgtggttcagatcttcgtgtccatttcaaggtttgttttgccggaaaaacgtatttttaagtaacgcctgtattagcagccanaaattttggcccattggagaantatgacctgca

SEQ ID NO: 15174 - DNA, 1596 bp, Heterodera glycines
cattaaaatcagataatgggcgttagctcttgccgttttaatgtcccgaccgtagagactctggggttacaaaaattacgcttacgttccaattatgggagcccctggtaaagagtagatcgaggaaagtattctgcatattaagcattaaatcgtcaagtatcagtaagaggagtttttcctgttctttaatcttattcatgtccggaatcccgttaaaagtctcaacgccctcccgattaatcctaaaatactatcattcatctcaccataacaataaagaattttcttaggcgatggttcaattagattcttatggtgttttaaaaaccgtaatagccaatgggtcttaccactcccggtagcccccgagagaattagagtgaacggaccgcgaaacatttttaattcctcttatttatttgacctatttatattttcatagggaacatgtttcgcgcatttggggcatagccagaaattatcaaataatgatgtgccgaaatgtaaaagactgtgctttttacacctgctacaaatctcgtaatgacagggacagtaatgacaacacttaattttatgtgggcagttcatttttcaatttaattttattttgggttgctatttatagaaggggtatataaagggagtgaaaggaccatttgattgaaatgtatcattatattcttccctatctgaaaatggctcaaaagaagttagggagacgataaaaaatttttcatttattgggacggtcccccaatttatagttctgttgggtatttattttgttatcgattacttcgcgcggcgccggcatcgcggcgcaccggcggggcggagaggaaatgcatggttttggcaaattttcaaaattcagaaaaatcatcataaaaaaaaaatctcaggatttgagaaaataaaaccgcccaaaaggtttgggatcaaaaagatttaaatttgcaaaagaaaaaattgaatttcctacacctgtcacttttggtgacaggtggatgattgatgaccttcccgcggcgctgcgcggccgggtgaaaaaaacacccgcacggatttgggtaaattaaaatccacaaggcggcaacatcaaagggatgcacccctcccataggctttggttcttggcggtaaatgtccacgggcgtcaacttcatagggagtacattaggtttggtttggaacacacacccctcccctcctgggttttgatggggcggcaacttcaaagggttgcgcccctcccatagggtttggttcttggcggtaaatgtccacgggcgtcaacttcatagggagtacattaggtttggtttggaacacacacccctcccctcctgggttttgatggggcggcaacttcaaagggttgcgcccctcccatagggtttggttcttggcggcagcttcagaggtagtccaataggcatgggtttgtgagcgggcgggacatttcaaaagaaaacacccctcccgtaagattgggtttgtgcaggaaacacccgctcggaaccgagcgttttcaaggtcatatactactatcggtcgagagtttatcatagtatggggaaaacgacatca

SEQ ID NO: 15175 - DNA, 1347 bp, Heterodera glycines
tttattaaagtatggggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatggttgagatgggaaccgaaattcaaacatcccgaaatgaacttaaatcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacataaggaaattgaaaataaagaagtttcagaagctgaaaaagggccgcaaaaaagagagagattagccaatgaggatgttcaatttaactacgacagtattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccgggatcaattagtgaagttatatatagcaccgagtattttcatcgtctacagtcgaaacgaatttcagaaattacaattgaaattcacacaccatttggtgaattcgttaaatttcactggggaagttgtattcttacattacattttaagaaaagtatattttaaaaaatgacacatgtgtttttcgatcccgagtcggtcgattggtcatcttttatcactccccagcatggaagaggacagaaacaatattttgtcggaagcaagtatcaacggggattcggtttcctcggtaatgtggcacgtttcttgacccctattgcgaggaatattgcctcgagtgcagaagatgaggggctcgccgctgggcagagagttctgagtga

SEQ ID NO: 15176 - DNA, 3487 bp, Heterodera glycines
ctgctgatgaggaagacaattttgaggagcgcactcgtcaattcttcgccttcgtcaaccagggaaacattggacaattgcgtgcgctggtcgactcgctggacgcggatgagctgagcattttgctggagatgaaccaaccggatgtccaacatgctcggcccgcactcgtgaacgcaattttgaatcggcacacagaaacggctattttcttggtaaagtttccgccgacatttcgacgacagcaatttgatttccccacatttttcttcattcagttggagaagggtgctgatccgcatcagaccatgattggccaactgaacggcttgaacatgagtgagtagcaaacagcagcagaattggctatatgcactctttatgagttcaatcttcagtttctttgctcatacataaccttacttggtcaatgtgccaacattcttggcataatttttgtttctttgtgtcagtatttgttcttcctgtatttatgaattggccggactttagcctttttgttttatactaagaaagtaaattgaaaattttctttgaaaataatttcaggggggggtctcaaaacagaaaagtaccgaaaaaagttatgggcaaagaaaatgaagattggactgataaagaatgcaattgagccgttatttaaacgttgtcccccaaatttgcagatgtgacactgctttgggccgctgtcgtttttgtcaatttggagctgtgccgtgcgctgatcagccatggtgccaacattgaaatgggcacggactctggccactcgccactgctgtgcgcatgtttcaatggcaatttggagatcggtgagtcaatctcgaatggatgccgttttgccgctgcgtaattgccacaatgatttcccattttcagccacttttctcgtcgagaatggcgccaacgttaatctcgcggacactgacggaatgacgccattaattgccactacctttttgctgcgcctcacttcgccaacaattctctccgatctcaacatcaattcaagcaattccggcacactgtgtctcgatgtgtttgctgaagaaaatgattttgttgggccaaatgcgacgacggcttccactgggcaggcattggcaaatggttgcacacaccgagaaaagatggccaaccaaagcgattgttttgtctgaaaatgagtcacgggcccagcggacattggaagaaaaattgaatgaattattgggcgttgacaaatgatggatcgtatgaatggaaactgatctgaccattattgatgcccattttgttaattttcgatgattttccgacgaaaatattcattgtttcgctattctcatgcaaaaaaacttaaaagaattcacggcttttagagttattaaaaagtggtcataaaaaatagatgtatgtgttattgttagcattgggttcctaatcactaattaccttccatcacataatcagctttctcacctttgttgttgttgttgttccccaatagaaatatgtcttcaccatcgcagtcggatacttccaagccgaacacgcttgaactcagcgggtggataacttccaacccctgcggacatctgtcgacgaattggacggttacaaaaataaaaatacaatcacacaaaatgttggcgatcgaattctgctctatatgccgtcaccatgcggtaaaagtgtcgataaaatgccgaatttgtgaacaaattttctggcggacatatgacttttcatcaagcggaaagcacgacaagtaatttaagtgtattatgccgcaaaaaaaaactttttttttctacaattagttctggtctatatcgcaagcatatggccatttggcgcatgcacatacgacttcagttccagcggaaagcacgacaagtaatttaagtgtattatgccgcaaaaaaaaactttttttttctacaattagtgctggtctatatcacaaacatatggccatcattaactgttcaaatataacaattgattacaacacagtggatgattgctttaaagaaatgagaggacatgggtactgtgtattgacctacaattgccaaatttgggcgcgagaattttacaccaaaagtaagattttttaaatttatagggctgggattttgtaactcataaatataaaaatgacccaaaaagtggcacccatgttacatatatgtgcaagtagtgcgcccgtgtacacctttcctcctctggccataaaaaagcctacgtaaattccgagacaataagaaaaataagaaatgaaaatggattttagcggaggggggggggggcaggcggagtatgtacccccctccatcaagcccatttcgcattccaaattaaaggacaaaaatattattattgaagaaaatttcctattttcctaattgttttccctccaaggttttcatcaccaaaatttctccaaaattcttctagcttgtttttatcaaaaaacttttggggaagggcaaggattcggagagtgttaattttggaatttaaccaatttcttatcagtagagaccatagctgtgcaagggggcaaggggagggtcgtgacgccgaacgcaaggggtcgacgggtgtcgaacgcacgagacggggggggggggggtcgagaaaaaaaagaagaaaaaagtgaaaggaaaaagggaaaaacgacgagaaaagagagcggcgaggtcaaggaaagggccacgtattgcgttcgactaaccctgaggagatttttcgaacaaaaaaaaagtggggaccgtcgaacgcaagcggaagggctgaaaaattccttaaatcttgcctaatttctaaaaatttgattaaaaatgcgaaaatttttcttaaaaattgactcgaaatagtaaatagaaattgggtgaatgtttggaaaaaatatgatatgaatttagattgaaagatttataattttctgggagagggattgcgtttatagttcccattatttgttttgtgaattgtgatcttagtgatgaagatgttcattttgcgattgatgttgctgattggatgagtttgggaaattggagtttatcacattaagggtggggaaatcaaagggattatgaacagaagcgtgaatttcaatgttgcaaaggccgtccaacaatttgtgggcgagtgcactttctctgtgacggggctttactgtaaagggcaaagggtacggtagggtgaaaaataagaacaaataaataatacatgaaatttaaatttatttaatttttgcctgcttttggcccattgtttccatttaaatatttatgatatactaaaaatataacaaataaatgtaagagaaataatgcgatgaaaaagtctatttttgtcgattgtagcataaaaaataaaaactgaaattgtaatgtaattttattttgtcagaattctgatgtcattactattaaaatgaaataatctttcttttagtgaagcattctgattc

SEQ ID NO: 15177 - DNA, 877 bp, Heterodera glycines
aagaaaaaagctatagccaaaaacatggtggggcccaaaagagaggggccaaacgaagggagcttaggtataatccttaataaaaaactaaagcggaaaaaactattctaggattttatgagagaaaacacacaaacgaagtgaaacaacatcaacatccaactgaatgaaaagagtgatgaatgaattgatttttggaatgattgcgaaattgacaaaaaccagtcgtggtaaaaacattactttaaaattatgatttgctgagcgattaaaatatgaggatttttaaggaactttttgtaaatcctcaaaaaaatccaaaattttgggaaatttttttaaatatttcgagaaaatttatttacataatatacatatgttcgtacatattttttccgacaataatattcattgtttggctattcttaattcacggcttttagagttattaaacaaatggtcataaaaaatggatatttgttggcattgagttcctaatcactaaaatacattccatcacataatcagcttcctcacctttgttgttgttgttgttattcccaaatagaaatggtatcaccatcgcggtcggatacttccaagccgaacacgcttgaactcagcgggtggataacttccaacccctgcggacatctgtcgacgaattggacggttacaaaaataaaaatacaatcacacaaaatgttggcgatcgaattctgctctatatgccgtcaccatgcggtaaaagtgtcgataaaatgccgaatttgtgaacaaattttctggcggacatatgacttttcatcaagcggaaagcacgacaagtaatttaagtgtattatgccgcaaaaaaaaactttttttctacaattag

SEQ ID NO: 15178 - DNA, 1499 bp, Heterodera glycines
ttaattcattaacatttggctctgcttcatcaggatcataatagtcggaagtcgcacacgcacagaaaaaggcatttgcaaaaaagaaaacaattaaaaacatcaaagacaataaggaggctaatgagtatgaactaattaagtgtctgccattaatagaaataatttaaaaaaataatttgtagtttaaatttgctttatgtaagaaattcaatgaaaaatgtcacaatattttgtaaatgaaaaattgaaaaggtcagttgatcagatggttaaataataattgcgccaaaatcagtttataattggggcaaatgacagggggtccaacaagcaaattaagcaaatatttaatgaaagagcgtgggtttaattagtgtacaaaatcatgaattaaaacaatgtttgttctccatacagatttgcattacgattggtaaaagtgccaaattaattaattaaaggttaaaaatttattaaatagtgaaagaaaaacagactaaaatgatttatgagcctaaattcctatttaacctatcaaatttcgctttttattaaacattaaaatctttcaattgcattttattaaaaataaatgataataaaatcaaatatcaataaaaaaatattttaaaaatcaaattgtgttgaaagttgctaactttgatattttaatttccaggtccataattttcggtatttttattactattttcaattcaatatatcaattgatcgttcgtatcgctggtgatccttcactttctaatcaatttgttaaaaatctttttaaaataattttcattttaataaagattttaacttcccgattattattgtaaataatgtaaagtgattaatctcaaagcattgtatgaatataacatttggccattttatccacaagcggtggatggttggaaatgatgactaatcctttttcgacactttgctttaacaaaatgttgaaatggcattaaaaaggacgaaaagcgatcagctttaccattttgatacacaaaaaatggaatacattaatttaatttcaacaattagtattcttattttttctttttcattgtttggcccaaatttttatactccaaggtgattattattattattattatttaattttactaaatttatcaccataaattttatataattatagtgatgccaccgaagaggaacaattggcaatgaaatgcaggcagagatgcggcatacggaatttgaattttgttgtgaacgacgatgatgatgccacggcaagggtaaaaatcataaatttaatcacaaattgaagccgtaaagctgttataaggggaggggaggtgagggagggtgttatagccaaaaaaccgaaaaattaaattaaatagactaaatccggagcgggattggccccgtttttttaagaacggcactactctcaactcccggattcctaccccttagaggaacccaccccctcccccccccaaaaaaaactacag

SEQ ID NO: 15179 - DNA, 1636 bp, Heterodera glycines
aattttctcatggaatgaaaatgtttttgtggtatttaggggttttaacccaattcaggactctgtttttaaaatatttatagaggaagatgttgtaatttctgagttaagtttgttccataatttggttgttctgttaaaagttttttacggttcaaatgacattacaaaagtaaaaatgttgttgcattgagaaaaattgaagtgccatcgttctttgatcacgacaaacaagcagaaccgagagaaaatcacatagaagttatcagagtaaaaaaaatatacattttttatttcattaataagcgacgctgagaaaaaaatcagagaattttacgtataattgtagcagatcagcaaaaattgctgatttgtggattttctgaaaaatttggcgaaattttggaaatttgggtgaggtaagtctcggagtgctatttgctaaaaattttgtcaaataaacggcctattcttttaaagaaaattaaaagcttttggtcaacttgacgggggaaaattggaattttgaaagaatttttttttaatgatacaattttccaaaaattatttttttaaatttaaattttaaaaagactacaattttctttatcaaatttagccccgtaaaaatcacggcgcgccgcggatcgtgcaaaaaacgccgcgaatcgcggtcgcaccccaccagtctgtacgataaataattttaattcgcaaattttttttttcaaattttgtttataatttctaagatcaatttatacgcacgccttgcgctgcagctgatcagcgcttttgctagcagttcaattcaaaaacatctatcaattcggaatcactttctctctctctctctctgatcaatgggctaaatgatcatcgcaagcgttcattaatcattcaatacccacccacatgattatgttaattagcccattgtgtcgcggcatttaatgctgttttgcccatttactcaactcattttctatccattgctgctgatccaaaacggtggcaaggaatggaatacagtatttcctaaattagaagcccccttttgagggggttgaaaaatataagccccagggcttctattttaggaaatacggtatgtggaaaccgacgaaatcaggatcagtcagaggtctgatttaatccaaaaagtaaaacaaaatgaataaataaaatgtagtggaataaaaataaatgataaaacgtgtcaaattttcataatcgaataaatcaaaaatctcataaaatagagtccataagcatttttcccgctcttctcattaatataatttgtcgcctcatttgtcactttctttgatcacttcggtccccagcggtggttgtgccattgtttgttcttcggcatcacaccacgctcatcctcccaaacaaaagaagagaaatttgttgaagacaaattgctgctgttgttgcgcgagtgtgtgccatgtgatgacgacggcacatcattctgcgcggaagacgaaccgaaccaattaagcacgggaatcctctctgtaaattttagagcttaaaaaagtactattggaattgcttacgcaacaatgaactgcttgatgacgacgttgatggttgattataagcagcgtaatttccagttgct

SEQ ID NO: 15180 - DNA, 946 bp, Heterodera glycines
ggactaacaaccatcatggttttttgtcaaaatccgatgtgccgacaaccatcaatctaacgtgataggaaattggcaaaaaattagctgatcattatttatcaacaatttctgcatttaattgcatttccaccaaagcattgcccgataaatgcccaaaatagcaactgcccttttttaaatgcaaggacattatgccaaacaatttcagaatatacaattttgtttgctttctctccatgttttcaactttttcatttttgttcctgtcgttaacctttttactttaattcgttcttttagttttatttttttgtgcaaattttgaaagcaattttattaaatacgtcatggagaaggctccccaaaacgacacgattgatgttgttgtgcacgaagtgggtacggaacacagttccaaggacaaaaacaacatcaacaagtcacctttgaaaaaaaatgcacatcattcaatcgagggttcgcggaaaatggctaacaaaacggtctttttggcaaaagccgtaagctatgtgagcgctcttctgatgaaaaacggagaaactgatgtttcggagaaagaaatggatcgtgttcatcagcggcttttagatgtttgtttgtgattggcggtctattcaagcaataataatttttggcattaatttagatgcgttgttcaagttacagtgggtacgacactcataatctttggcgtgcttggatcaatgtgcgaaatacgcatccaaatacatatcaagaagccatggaggggaagtttcacattctcaaaaatgcaccaaactatgggggtccgccaaaccgtgcatgggacattctgcgccgcaaagaggaggcgaagacaagactggttatatttttagacttttaataatattagttatatttgtctttttaagctcgaagcacgcgttaaattgactga

SEQ ID NO: 15181 - DNA, 2261 bp, Heterodera glycines
  misc_feature (6)..(6): n is a, c, g, or t
  misc_feature (103)..(103): n is a, c, g, or t
tggacnaatacaaccagtttcgcccagcgctacaacagacttttgagtgggtacggcgctgaggtttgtttttagcattgtaaccttttttctataatcagtntaaatcgttaagcatgtttacgtgccaaaattgctgacggaggtttcaaaaagactggaagcggttccagttcaaaaacgcaaaagggggtccgaaagggctcaggccgaggagatggcaatggcacagcagctgtggggtctgcgtggggtgaaacgtttcagagatgctgtaaatgcatcgaggtaaacttcttttgattattttgctagcctttttatattaattataggatagagcgcgtgaggaagatgaaggggcttcggatgatagtgctgatgatagcaaaataattcggagccaatctacacgaagtgaagagagtgaaaatgaatacgacaaaaatgtttgatgtgggtacgatacttttggtgtttttgtacattatgcgatgcatttttattctttatttgttctgattaaatgcttcgcaataattagctgatcattttcctttaataatgtaaatttccacaaaagtaaccccgaccccaaaccccaaaaggaccattcatacggtagaagctctttgagcgacaaatgcaaaaaaatggaattaatttgcatactgatccgcccatctattgcagcagaagtcagggaataattatttggaatcgtttgccgtgctcggcacgtcagtttatcaccgttccaccaaagtactgcttgcccatgttgggcaccatgctttttttcggcatttatcgggcactggtttggtggaaatgcaattaaatgcagaaattgttgataaataatgatcagctaattatttgccaatttcctatcacgagtaagatagatatcataattaaaataatttgaatttttggaaaacggccaaaataggtgctaatgttcgaaaatgccaataggtgctaactgtaaacccctgcttttaagttttatatgccaactcatcattctttttgcttagtttgaaaaattttttaaacctaaaatgggaaacgttctgaaaaatatgcctttttaaagaatatgaaaaatcggcgaaaatttgaaattttcgatgcggtgccgattagggggtatattttcgtggtctcaacgtgtaattgggttgaggatgacaaatatcaaaataaaccgatgaacaaaaattatatgaaaatcattttaaatatttattattcttctctttttcaagccaaagttgccatgcgacagtatcaggtcgcaactggcaatggttctttgcaaataacacatgacgcaaatccatcatattttttacagattttctccaatttggatgaacaactttttgtttcggcgcatccattcaagacaaatatatcattattttgttctgaacgcaggcattattggagagaggaaatggctccttcaattcaattttgtgttctaaaatgtcaagatttaaaaaatatgaaaaattagttagggatgagatttgtcctaatttgtcacatttgtcctgagttggaggtagcaaccaaaaattgttctgggttcttaaataaattcataattttaaaattttatggcagaatgttaatgttttctcaagaaaatataagattttaggcaaaatttggtcatttaaaaatctggttttttgatcccaaatgcattaaaatttatgatttgctaatttctccccaaaattgttataatcgataaagtgtggtgaaaaaattatatataaatatatttttgatccagtaaattgtaaaaataacttcaagaaatttcgcaaaatgtccaaattttgtatgccaaaatttgatttttttgggcctgatgtcctgatattgaaaatgttcagatcaaatcactgctttagttaaaaaattaataaatatttaaattgaaacttgtgactgttttccagccgtcaaacatcagctcgaacatctacttggcgctgctaaaatcgctgcagttgcgcgagatcatcagcctggacgagtaaggacagcgaagagagacaaaacagagcaaaaatggacaaaagacacgaaatcaaaacctataagacattttccggctatgaattgggctcgagtattccttccccccaatgaaaaatttataaacctaaaatgggaaacgttctgaaaaaatatgcctgaaggagaatatgaaaaatcggcaaaaattgaaattttcg

SEQ ID NO: 15182 - DNA, 854 bp, Heterodera glycines
ttcatttcttcgaccggcggcgcttctttttggcaacggcctaaaaatccaagtccatgatttaaatgcaggactcgaaagtgtccttatttctaagatttgtccttatttggaggagccaggtcttagaaactgaaaatgtccttaattctaagatttgtccttgttttcaggcttccctaaaacatttaaattttctcttccttttgcaaaatttgaatgactttttgacttaaggttttttatttaattcgattttgaaaacaattacatttcatttcattttcatgagtgtaaatgccaaaaatgctttaaaaaacattcaaaattttacaattttctgaaattttttgctaaaaatcacactgtgtattattttaagttcagagccacagaatttttttagattttccggtggaataacaattctaaatccacattaaaattacagtcttaagtgaccacaaattacattaataactctttaatattgtacgaattaatagtttacaatgtgcacatatattacaacatactgtacaacagtgaatatacaatagaaaaacagacaataacatgtgacaattacagcgcctaacatcggtcaatcgaatttgctcataatagacacacatcggggatcggcacgtcaattcagtcgctcatctgtagacggcactatttcttcacaaaaatgttatgatccaactggccaagcgttgcataattctggtcacttgctgaaaaggggcgaaagataaagcatttgtttggcttgaacaattcatgaattatttactcgaaacgaatttcgctccccccgctgtctgctgcggttttcctggcgcattctt

SEQ ID NO: 15183 - DNA, 1685 bp, Heterodera glycines
  misc_feature (24)..(24): n is a, c, g, or t
  misc_feature (200)..(200): n is a, c, g, or t
aactttataataatgttaaatacntacatgcatacctcacgaaagataactcttgaaaacaaagcgattcagttttgggctcagaagaaaacgaattgaaagttcgtcctttcaaaaaaaagaaaaagcggcgctactgtaaaagttaccgattttgaaacaaaaggggggagggacccttttgttttgcaaaatttttntaagataaaaaaccatgataatttgttatccggggttttaaaggtcgctaatcacgaatctgacatgtatttttactaatttctaatccctaacccgaactcgaataaaaatcgaaattttgaatttttcaaattatgattttttgttcaaatttagattaggaaatcggaattgatcaaaataattgaaagattcgtgatcggggaccccaaaaacataaatgttgtttttcctaataataaaaatattagatagtacgccaaaaggagacaaaaaattagagaaaaaaagataatgtttttctctagcattctctatttattggtacacatctcgttttttcggacggtgtgtacagtagcgccgaaaaagcgccgaaatggtccgcgccgaagtgaccccgaccccccatcgaagcctctattgcacttttacgtgtccaatcaatgacaatcatcagtttattaggtcgatattcttacacattctgcctacattcttggtatgaagttaatttttcgcctaactttaagaaataagcacgtcgtataatttcttggcaagtgagaccaaagttcaattctatttaagcaagtccacttttaagctacaaactatgtaagtaccaaaaagtcagtagaagataaaagacaaaaacaattaattgacagccaagggatttgaccccgaagacagccgccttaagtgaccaacattaaatttcgaaaaattgaaattatatttaatagcctgattctaaaaccacctatgagttttacaccattcaggatttggattttaccataaatcatttttagaaaaaattaaaaaacttggacaatcatgagtgaaattcgtcgacaaaatcagattttaaatttgaactccgattcatgatcagcgcaattttttaccatagaaaaagcgcagagacagacccgggactgaactggtcaaatacctatgggactgaaccgtcactacttaaaacgcatggaataccgacaaaatattcctctcagtatataaatcacgaatccgaaagaattattaagcgcaaaaaaattgaaaaaattattggtcagcaaacctccgaaaatgactttaaaaaataatttaagtgagccaaaaacgaaaacgttttcaggtttctgaattacgcaaaaaggagcatgcgaacacggagcaagcagtgggcgcccgagcgagcgaagggttgcgtgcgcctggttaaggccgggccgaagtcttcacttggtttttttaataatcggaacccgtttttcccatggtttgatcactgatcagaatctgtggtttcgattactggtttgaacacttttgtcatagtggttttgttgttcgtgatcagaatccacagtttgttactaatgattggaacccatcttgaccggatcattgaccaatagggctttgtttttaggcaaatgtctaaaatttctgcgaaaaaccaataaaaatat

SEQ ID NO: 15184 - DNA, 2638 bp, Heterodera glycines
tttttatgtgcatattttgtcatttttggtgcatattttgcgattttatgtgcatataattctatgctctagtaattactatttcattttaatgaaattgaacattaaattattaaattctgcttctcgacaatcttcttaaaatcagtccatatttattcattccgatgacggatttagcaaatatcttagcgcgccagttttgtacacattgtataaattacatttaagccattcaatattttccaataaatccacgtgaaaaaattaaataaataaaaaattaaacaatgggaaaagatagtcgttataattacaaaatcaatgccaccagatataaaattttattgccatttatgtacatttttatatttcaatgaaaaaaaaagatttgcgattttgttatagctaataataaaaataataatataataataaaaataatcattttttatataatttacatttaataacaaaggagtagttcattaaaactttttatattaaaaaataataatatttcaaattttactataaaatattattgaaaattcacttaaataaatctttaaaattaaatcgaaaaaaaagaacgaagtctagttttcaaatagatttcctaattcaaatacagaaaattcttaaaaataaaatcggtgtccatattttcaaagactgataaagaagtgatgcgattgcgcgacgttttgctcacttttgtcgcttcatttctttttggccattcatttggcggcctttgcggctccaaaccgtccaaatttgagcgttcggcgagtgcgccccatcgacgggcgtcggcaccgccgccgacgcaaatgcgaagggccaacagcacaccgaaaaaacgacgaaacccctcaaaaaaccgggccaattctgctgatcatcccccggcactgtccagaaatctctcggcaagaaagcaatattttgatggtaaaaaggaataaataaaaaattgcacagttttaatgttataattagtgtttgtttaattttatttttaaacggaaattttttctgttccgcgacaaaatttctttttttttgttgctcttaatttttataaaatttttgaaaaacgagcgtccctttgatgcggtaaggcgccgttgaggagaggaaaaatcttagtgaaattttgaaacatttttattcaaaaagtggacaattttgaggattttgccttatatgtaaaataaaaggaatggcggcccgtgtgccaaagaaacgatgggaaaaattattggaaaataataaattaattattattttttagataccgtcgattttctaaataatcagtcgtcatcaaaaggacggaaaagtgacgtaaatggcacattatgggaagaatttgaagcgggaagagtaacgcaacttccattgaaagaataccatagttcaatccctgattactttgagcgggaacgggcaaaaacagcccgcaaaaaaactgtcgagaagagcttcacaggtattgtaagcgcaaaccagggaaaaaacatcggaacgccaaatccgaagacctagctttttctccaagaattttttttttgctgtaatttttcaaaaaattataggtgctttgcgcaaagatatcatttaaaggcgtttcgcaaaaaatgactactttttggttttgtttaaaatttcgaaaaatttaaggaaattattcgtcttgcgatgccaataagtgttggcggacaaaattggttgaaggaatatgaaattaattttcaaaaaactttggaatttttttgttctttttcgtgagagaggaattcccgtcccttcctttaagacaggtcttcagatgtgtccccaattttcaacaatttttacttttttcacgattttaagagggttcggtaggcattttagagaaaatatgttaatttagtcgaaaatcataaaaatcattttcaaataacgataaattttcaaattcactgctatgtataggaagtattttgttcattttaaataatcttttccatgcccaaataattattacatatttgaagaatgattaccgtatattgccaaatcactgtttgaaataatttaagctaaacaatttttgcacttcattggcatattgtaaaaaccaaagtgacgctgaattcaaagttaaaaaaacgaaaattttcaattttttttattatgcacagaaattttggtatgataatatgcacaaattactacgatagcattgaatttaagactcagcgctgaagaaaaatcggagtcagaaacggaaatcgctcaagaatcatttggagcaagaaagaactaatgattaccgagaaatggcacccaattggcaatcagcgggttaccgtgactcatatggaagtgacagttactacagaacgtcatacggtaagtggggggttgggattggatatcaatcaacattatatgtatctatctgctacagtttagactagtcgtaattggtttgtttttggtgttaaaatacctgaattaagggcattaaaattggggtttaaatgttatttaatttttttctaagttaaagattaataatgaacagggaacggatttatatgtttttacaaaaaaaacgtattttggattttagtagttttgg

SEQ ID NO: 15185 - DNA, 3477 bp, Heterodera glycines
ctatcctgtcgctcccttgccatgtttcgtgcattatacaactttctcccacactccattttcttcttctggcattacatttaccattaccataaaatgggaaatatgattaacaaatttcaaatttattataattttttggcattgagtcatcaaccaaccaattcaaaaaatgccacattttgtgccacaacgctccgccgttcgttccaccacaattcacgtgccctcctcctccacttcctcaactggtgaacgaaaaatcactggcgacggtggaaatggcactgcttccgctcggctggaactaattcaacaactgcaattccgacgtcagcacagctcgccagccgttgttgaggaggactatgagcgaagtgtacagtttgaagactgtgtatcaatgaggtgctaaagaagaattaattgttcgatttaattcaaaaaaaaaattactttatttcaaaaagtttatttaaatttcatttatttttaaaaatttttcaaattttaaataattgtttttgtatatccgttttgaatattttaaataattttcattctatgagaaaagggtacacatattatgcgccttaatgaggtggaaatgattttttgtgttccaatttatattaaaaaaaaaatttgaattgttttataaaacattattaaatttaaaaaaattgagtttattatccttctatataataaaataattattaaataatttacaaagtttaaaagaatacgattctgggctaattcttatttaataaaccaaacgaattaattaacaaattttaaaatattatattttaggcatattttttcccccaaaaatttttgaatcttttataaaattaaattcataatatttttcatcatcaattaatgtattttgttaaaaaatatagcaaaaaagagttttttcaggtccgtttctgcgtggtccgcatttgacgacattgacacagagttggagcccaagcatgaattccaagttaaaactaataaattaaacgaccatcataatcgccaccatgacaatcaaaatgtgtcaaaaactgttcatcaattaatgggaaatttgttcaaaacaggtaagccaattaaacagatgaattaaataaatattatattaatttaatcgcattgttttttagtctacattataattaagaatatcatgattatttttttaaataatattattataattaagtattaccaaatgttttaaacataatataagcttcgtaaaatggcatctttgatatcttggttaaattaaataaaattatttctaatttaatgaattttctgcttttttttgccgattctagatatatatatatatatatatatatatttttttttaaattttttcattttttaaaaacatttttatataaattattttttatttttccatttcttaaaatattatttattattttcaaaataaaactttccacaatccgtcattcgtaaattgaattttccattcattattcgtgtgtccaacatttggaattttctatgttcatcttcgtctgttggttgtgtaatttaatataacgctgactttcatacatatatcaaagtctcacatgtcaattccaaattaattcaatttcatagcataacagaaaaagtacacccgtaaatattatttacaaattttttttttttggcatttttgatggcattttattcatcggcactaaaatggcgcattgccctcaaaacaaataattttttgagtctcggcgctgccagaatggcatagttatcccaaagaagaaaaaggcaccagcgggggacgctcgtgggaatatttacttggttttcatggaggaatttttgtgccacaatttcttcccaccctcaccaccacaacgccaaaataattttttgttttggaagaaaaaatcgaaaaaaatgccggacggcggcgacccatcaaaggctggcaccgcttcggcccccgcctcatttggggcattatttgtgctgttaagaaattatttggtcacaaacccaatagcattggcggtcggtgccgccaaagtgccgacaaataaaggcagaggtaaaaaagaataatttacatttttttatagaaaaaataatttgtttttaaaatgaaacataataattattattatttaatattaaaatcaaaatgtagtgattctaattgattttttaatggtttgatggaaaaaaatgaatttttttataatttttattttctttctattttaatattcaatacaacattccattctttaacatttttaagccttttaactcaaaatatatttaattaatcaaattttttgcatttgagagaaggttaagaaaaatccatttttgcatttgagagaaggttaagaaaaatccaatttgaaatttattacgaattttttttattattttacttttttttaattaattcattttattttttttccagtaaaaatatgtaaataaaaattttgcaggtgtgttacaaatttctgaacctgaaaatcttttaattttaaatttacccgacctttattgaaacaattagcccggcccctcttttttaaacatgtggttttttttgacgaggtgacacaatgccataaatattgcacatgcacttttttttgttgttgttgtagtgccaacttacacgcgaacaattttttttttttttttgctgcttattcacccgttaaatatgaattatttaactcacactatgaacaaagccaaccagctgtttaaggagagaagaatgaatgaatgccaaacagtttttaaaaaagtgccaaaaaaatttttacaacgctttcctaagccccacaaaatcgaaattttttgccaccccgccctaaaaaaatgcaaattttgcatgaaaattattcgtgtcgaagaaacgaattgtgcagtgatcgtgaaaaggacacctttttggctgatcaaaaattatgcgcactgctttcagacatgttcaacgtgttcatgtcaatggccaaagatggcactaatgggggcacaatgcaattaggcgttggaggttcagttaattagggcataaaaattaattggaaaaaaaattatttaaattaaatgatatattgaaaaagattttaaatattgttaattattttaaaataaatgattaggtctttctggaatagttaattaattaaaacatactatttattctttttatttcattttttaatcgacttttcgatgttttattattaatcataaaattaattaaaatatttttttgttattattaatcttaaattaattatatatttttttctgtcaacaaaattttttaggtgccaacagcaaagaacagctggccatcactgtctacaacaatataaggcgaagatgaaaataatggaaccgtgagtaattattatatttttttatttgtttcatccctaattactctatatataa

SEQ ID NO: 15186 - DNA, 746 bp, Heterodera glycines
taattttaattaaaaatatttttatttaattttcatatcagttacaaacggtttcggcaccgcgctgaagcacttgcaaaacggaatatgcacaatcgaaggcccaaaatttgttgatgcgttacacgcacatgcagaaaatgatccacgaggtgatcatcacggaacgccaacaacattggcaacatcaacaaattattgctgatctgccggtgcaagcaatctccgaaacaccacaagcatatgtgctccggtccaattgattatagatatatttattataaaattgataattttaattgtctttgcatttaaattttaacaatttttttaaataataattttttgcttaatataatagaaggaattattaatggttaaaatttaaaaagaaacaaataattacaatattgtgttcattgaatttatgaatattcttttttattgaaaaggaattttcttaaattatatattaattgtacaaaactttttcaataaatagtaataaaaatttatattaattttatttagaaatatcatttaagcttaaatgcttgtttctttagtaattttaaattattatcattattattattattaaatatattatattaaatatataatattttttaaatttctaaataataaatcttttaagaattgcttcacttttggacgatgaagccaaaagtatgccatcatctccgcgtgttggcggtgccattgctcaattgcttggctcaaca

SEQ ID NO: 15187 - DNA, 947 bp, Heterodera glycines
catgctattttccctttcctcctcctttcttcctcactcataacttttcctcttcctcctcctgctcctcttcttcttcctcctcatattcccccttctttcttcctcatcatctttcattccctcctcctcttcccgcctctcctttttcttccgctccgcttctccccccccccgtctcccttttctttttgtccccgtcgcttcgccaactttttttcttatgcaaaagtgttcagtcataaatatatattatacataagatccagtcaccagaagcagtaggaccgaaaaagagaggaggaacaggatatccaatcagatcacagccatcgcattttgggcatcgcttcgcccctcccccgccccgtcccccgcggccccgtcaaatgtcgtgccaacgacggccgttctgcagcagcgaaaccagcaccaacagcagcaattccaattgggactccgccgccatgactacgtcgtcggcgtcgccaagttcgagcggttcggccgcttcgtcgcccgccccggccgtctcctccgctctgccgtctccgtccccgtccgcgtcgtccgcctcctcttctgcttgctgttgcgccgacaacggcaccggcagctgctgtcacagcagttcgtccgccttgcgcatcttctccgccacgtcgtccacctcctcgtccggcacttcccctcgtccggaagagtgccatcgttacattccggcaaatgatgaccatcgcgaatgccatcacaaacattataaggagcacacaaaatgcttttcaaccggtggaataattgcagaggcaaaattcaagcgatggccctgctgtctgatcaactttgagcgtgccgacgaaaagtcttcatcgtgcccgtcgttggctgcgttgttcagccgggaggaaacccctcggggagcaacagtacgaggtgagagagagaga

SEQ ID NO: 15188 - DNA, 1629 bp, Heterodera glycines
ccgttgcgcgtgtactgctacaacgcccccgacctgttggccgtccgaactccgctgcgcgttggccctgccgcttgtgccacccacttttttgccaacaacgcggcccattgggcacaacggcactcaaaacaacgatttccgtcccccaattcgacctgttctctgaatggcactttgcccgtccttctccgcccgtggcgtgccatcgcggacaacgaatcgtcaattcaacgcatcatcgtggtgataaaacattttttgaattgccgcacattggtacaaaatggccaccgttttttgtcgtgacagattcgcagtgccccgcgagcatctgagtaccgtaaggtggtgcaccatttggttacagtacattttatgacttaattgtacagtaattgccatcgtggatttgacttgttcatggcatttggtttttatttagtacattcgcgacagttggaagccggcggtggagcggctgaatgggccggtggttttcgtgtcgggcagagatgggactgaactggcagaggagaatggccaacatggggacattttgcagttggattttgaggactcctaccgcaatttaacgcttaaaatgatgggtaagtgaaagggaagggtcaattaaaagtaattaaataattaattaggcatttatcgcttcttcacggagaacacaccggtgcagcaaattgtggtgataaatgacgacacaattgtaaatgcgactgcactggaccaactcttacgagcgcaagtggtaataaaatgaaatgacaattacaaaccaacacattaatgagaatcaattacaaaatgacataaaaaacgtggaaatttccaatttgcgcatcggtgtaaaaatatgccaatttttattttttaattttctaaaaatatcacgttgaactttattttaaaaaacatttttcaaatgctttagtatttttatgaccgaattcgcgagaatttctttcttcacagaaaagggcaaaaattaaaaaaaaacccaacaaaaaacattttaaaattgatgcgttcattgtcagatgcgatagattaaattaaactaaaaatacatttgtgaatttcagccctcacaagtacaaaagggcgaaaatcggtatatgatcggcaaagtgtcgcgagcttatccccgaattgtattcgtaagttcagagtaatttttagtgaattccaagggcgtagccaaacccttggcttcgagagggggggggggggggggctacgccctttctgtatccctttttcttttttcatttattttaattaactaaatccaattttgctcctttccttctccctttagccgtggttgccatggcacgtcggctcggagctgtacccgcacaagtgctatcccccatttgtgcaggtcaccttagcaattagcaaaatctgttcaataaccattttaatattcccaatttttcagggctccagtttcgtaatttcgcgtgccgctgctgcggaagtgcttcggcacgtgtgcgcttttcccggctttgccattcatctcgacgacattctgatgggactactcaccaactgtttgggcataagggacattcaccgagacgggtacacacaaaatgccaa

SEQ ID NO: 15189 - DNA, 3503 bp, Heterodera glycines
ttctcagtgttggcagttgtaggtattctaatcgattttggtatggaattggcggaaggctacatttaaaaaatactcttttggtgaaatatttttgacacttttcgatttttttaatatttttttgaagagacggattccaaacctccggagcgtattccaataaaggcctaatataagttttatataacgtaatccaaatcttagatgatttggatttaattattcggaacaaggaacgcatacgtaaatatgcattccttgttatatgattaacatgatcggaaaattgtaatttgttatcaatgtttactcctaaatccctaattgtatccacagcatttattgtatttccatcaaatttatatgtttcttttgggttttttgaacccaaatataatataaaagttttttgcattgaaacttttatttgccatttatttgcccattcgaataaattatgcaatgctttatgcataatttctgtttcggttcttgctttataacaaatatacaatttaacatcatcagcatataattttattttcactcctgatggcaaagcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaggagaaagttgtaaatattttgaaaaataaaaataaattaatagacaataattagggcatcaagtgaaagagcagtaatttatttttaattatgttttaaattaaccaaaaaatataatttctaacaataaaacataaacttttgtacgaatttgtttaaaatattgtcattttagcacaactcttatttgatagttcactaacagaattgaaatgacgaatatctaagccacggaaaatatttttttttaaagaaatattatttaggttttttaaatttaaataaaaattccgaacaggccatcaaccatttccaattttaatttaatttttttgtgctaataaaattccgaagcaaccgaacatttccaaatgaaacgtcttttctaacttttttaaaagcattcattgtaatacccccattttttgtataccttttataccttttcgttttatttatttttatttttcattttaattatttttaaataattttaaaatgtttactttcactttgcccacttctgctgatgtccaatttgagacgagcccaaacaatcaggtagaaggagaccgaaatcacaatgcaaatcaggcaacactgtccaacaattgatgcccatcctccgcccaccatttcgccaagcgtacaacagcgctcactttaatttgataaaatttaaatttcaaatttttcaaaattaaatttaatcaaaaactgacacattaggcttgctggtcatatttttgaatgcaatccactcaatgaacattggaaacattgttgaggcgaagaacagtgggaaaaagtagaggcgatcatttctcgaaatgtacctttttaatttgagatcgaatttttacaggaaataaattgctgaattttttggcaataatttttaaaccagaaagctcctagcgaaattttttggcattttgcagaccaaaagtgcgaaataagttaattaatttaattggatgaaaaaattgtaattttaatgaattttgagaaaatttataaagtatttctgctatatgtaatataaaggtgctagcgcgttcttgaagccaccaagccaaaagttataaataaatgatatttgatttttcttgtgtttttgaatttgtcaatattgtcaaaataaaaaaaaaattcattttttcattaaaaattcaaaatgtcaattatttgtgtcgttaaaaataataattttgtgaatgaaattttatttatattaattgggtcatttttggttattttttttaataaaaagtagggttcggaccccgcccccgtcacccccgcccccgccgggggcgggacaggttttttggcctcacccccgtccccgcccccgtgactctgacccccgccatcccccgcccccgcgaccttcacccccgcgggggcgcgggggtgaaaatacacccctaagaatgacatattcatggataaaaggcaaaaaattcatacaattttgatttttttaaccattttgacaaattttttatattgatgtgtagtgtggtgtagtggttaatgaatcaaccttgacattactttctgtcgtgagttcgattcaggttgacggtttcttttttaatttatttttttaattttaaaattcgcctggcgctgcctatcggcatcgcatggcccaaaaattcgtaaatcttattaaaaaaattctctaaaaattgcaaaaacctatcattttttggacaaaatctattaacagatccatcagttttcaaaaaattttcccggcggcgcctatctgcaccgccggacctctacgctcgcacattcaccaagtttttttttttggaaaaatgtgccacaagaaaatatgttacaaatctgagttccaattttgcttgagtaaatcatgataatttaatatataaaaaacaaaaatttatcgtaaaaatcttatttttttttgtaaacatctgttagaaatcgagcttaaatttcaaaattcgccaggcggcctatcggcacctccggccccccaaaaacctatttttttcttaaaaaattagccaaaaatctctaaaatttggtaattctttagacaaaatctgtgtaatttatgccaaaaggaattgaattgaggcgatacatcgactaaaggaatgtggagccatcacatcattcataaaaaattaattttttgtaaaattttttggagttaattcaaatcaaacccccgcccccgcccccgcgggggcggaattatcgtgcccccgtccccgcccccgcgactctgacccccgccatcccccgcccccgtgaaaagccacccccgcccacggggtccgaaccctagtttaaaaacctatttctttttctctcattttggcgtactattttcatgtctctaacatatcaaaaaacacaaaatttgcaaatgcgaacaatttttgttaaaatggtataaaataaatttagtcttatagaatcattataaaaagtaccaattttagcattttggttagatagagcggcctaggagtagagaatggcaaatgaacatttttcacttagaaatagagtgccacgggac

SEQ ID NO: 15190 - DNA, 1678 bp, Heterodera glycines
attattagggcatccaaaaatatgcacatgcatatttttttcctggactgtgggaggcctgaaacgcacgaaaaacatgtttttagcttgatttgaagcttctaggatgactttccatatgcatattttgcatatttcgcgatttatgtgcatatttgcatatttgtgcatattttggcattttgtacatattttatgtgcatatttggcattttttcaaaaaacccctattaaaacggcccccatcaggtaaattggactttttgaccctaaagaccgaaaaaatttccgaaaaagacattttttatcaaaattttgtcaaaaatattgattaaattcaattttcttaaaaattcgttaatttatgtcagaaataagcaaaaaagcgaaaatttcgcttttcaggttgatttttcgctaaaatgagtaatttttaagctgtatcatgtttttaatgccatatttaaccatttatgaaattttactttgcgtttggcgaatttaaagaaattttgaaaaattataccctcaatttggaaaaatttatgtgcatatttttcactttttatgtgcatattttgccatttttgatgcatattttatgcgcatattttgcgattttatgtgcatatttttggatgccctagtgattataaaattggatgaattgtaaaataaaatttataacgtctttcctgagttaggtaatcttttcatgattttttaaaaatgaatgacagatgacaaaacatttccgcctgacagtgaagaatcaaaaaatcaagtgagaaagaagtgattggagaaattgctttcgtttgtttcttgctctcgtacgatgtttaaggcataccaaatgcccgggaaccagccacaaaaactgaacgactttcagtattttgctatttaaattaataggaaccaaaggaggcagcatttaatgcaccgaagtccaatggcagaacaacgtaaaccactcatgattccacgaataaaaacggcgatgggctatagtcccgatttagtaatgtgagtgtaaaagcactacaagcatacataccggtagtaaaactgcaaggagccaaaaaaacactcgcagccattttttgagcatgacgatttctttgtttaatttttcatttgtttgaagcaacgagtcgttttgatgaagcaacgagtcgttttgatcttgaatgtcatgtacgtcgcctactgcttttctcaagactgtaatttctcgagctgctgcctgttgctcgaaatcactgcgaacttgcaacgcatgatgccgttgtccaaattcacgcagttcgtgtgacagagctctgtttttttcttccagatccagtcggctcatcagctcctcttctcgaactccctcaaatggaattagccaaatttaaccaatcctattaaaaatgaaaaaaaagaagcggaggaagggtatagcgccacaaacacaaccatatttttgtgtttccgccaaaaatttgtttctttattaattgtagcattttctattctttctaattatttcattagaaaaaacagttgaaaatcagaaaatttttcgaatacaatagtagcaagaatgaattaattcggcacgacgacatttcgccaacccacccaaaaatgacatttcgccaactgcaagaagcatccaaattaaacatcc

SEQ ID NO: 15191 - DNA, 1150 bp, Heterodera glycines
  misc_feature (10)..(10): n is a, c, g, or t
ttttgaaatntcgaaaaaaatcgtcggtggttaacctgcgccatgttaagtttgaggacggcggcaaagttgttgaacaccaactgctcgagacggacaaactcttcggaggacatttggccaaacagtgcctggagcgtacgcgagcgaacgggcaacggacggacgatgccacggctgaacaacgtgacggaaccggtggaagcacgacggcacacagacaactgcacatgcagtgcctgattttgtgacaaacttgtcggcgtggaagtccaacgtgaaaatggcggacaaagtgtcgaacagtgacacggtgacggccgtgtttagtggggacggcacagcatgtgaggaggacactttttggtcgattgaaacaccgctcacaaaggcctaattatggaaaaattattcggtataaaaaaggttttctgccggacgaaaggaaaagtctcacaaaattggcatttgtcgtcgttgtcgtcccggtggtcgttctgttggcttggattcggtcggaagtgtgcgttttcagcgtgttgaattggagggtgttcagacagaggcgaatgtcactgccgtgggaaaggaacagttcgtccagctgatcacggccaattcgcacgccttcataatggcaaatctgacaattcaaaattctatctctggtccattcaaaatgctagcttttgtccccacctcttcaagccgtcgctgcatccgctggcgattgcaccgctgcacgcgcacgggcaagcagttggcgcgcaactcacgcagcgcgggcgcatgccaaaaggaggcgcaagtgcaaatgacgggacgtcgacggacgacggatgaagcgcgggaacgacgaacccatgaacaaaggaattgaacctgtacagggtagaaattgtcgctcaaattgatggcactgtccggcccggtcaacaaccatttccggcgacgcctgttccaccgcgtccacaatgaaacagcacggccgagtgccgacgtgcggtggctgtgcttcgcctgccgaagcggcagagacggacaaattgtggaagagcgcgtcaatggacgtacaatcggtggcattttcaagacgcgacttcagctccgccatgttttgaagttcactgacaaatattcgatttgtgta

SEQ ID NO: 15192 - DNA, 2852 bp, Heterodera glycines
ctggcgctttaaaataatttttaaactttgtctcgtcaatttaaatgactatcataacatttttaacagattgagcttgtgcccagctgtaaaacgttgcgcgagattcaaattgtcagctcgggtgccgccggcgtgttcaaagacgaagtgctcaacgaatggttggcccggcagaatccgtccgaattccaatataaggcggtcagtaattaagcaattttttcaggtttcaaattgattttcaaggctttggaaaatttccggcgttcgtgtgccggttggtgtgtggccacttatgtcctgggcattggcgaccggcacaacgacaacattttggtcactaccaatggccacgtgttccacatcgactttggcaaatacatgggcgactggcaaatggctgccggcttcaaacggtgtgcaatcatttgattaaaatccattctttcaaatttaagaattcgaaaatggaactaatctattctattggattataaaatgaattgaaatttcaacgaaatttctttaaatcttgctggggaacagaatttggtagcctaatagaagacctaattttggttagatttctcttggtttatgtggtaattgttgtcaaaaatgtgaaaaattttataggccctaaaaatgcctaatttcttcgccattcccttaaagtgctcttttaaacgctgtttcacccttcagctaattaattaccaccccctccctaaattcgcttgcagagaccgtgtcccatttgtgttcactcccgaaatggcctatgtgatcaatgggggccaaagctcgacggaacacttccagcgatttgtggatgagtgttgccaggcgctgaatctcttgcgaaaaagtgcgccgaccgtactgaacataatgcgctttctgagctgctcggacatcccgggaatgtccatggaatcagtagtaagctgaattaataataataaaaaactatataaatgcctaaatgtttcacaacaatcagatcgacatttcttgggggaggggaatcggcactcggtttattggaaccaacttttagggaactgctcgattccggcaaaaattttgagttccaagcccatgaaattaccgctctttattaatgaccctttcaatggcattttattcggtttacacgaaggcagaaaggatattaaaattaattttttttttgcaaattttacaatcatactgtggaaatcatatgcataaattaaagatacattattttaaatttatatttctagaaactaaaattcgattgttgtccgatttttaacaaattatgtgcttttctaatttcttaaattaatttgtaggctttcgtggaaaacaatttgcttttggatctgagcgacgcacaagccacaatgcttttcacccaaatgatcatggattcgctgcagagcaaattccctcggctgaatttcctcgcccacactttggcccaatttcggggaaatcccctcgggggccgaagcgaggacatgaacaggctcagcttcatctccgaactttacaagtgagccaggaaagtgatatcaatcagcagcataaggcacagcaagattcaaggacacaaaattgattaataacttaaaaggacattgaaacaatgcccaatcgggattcgggatttgagatggggttgccaattgaaatccaatgccaatgacgatcattagagctttgaccaaattgcatttgaagtgcacgaatttgtcctaaataattcactccctctccaattactttaaatttaattgctaaattttaaattttcagcgaaaagaatgaaggtcgtcttgagtcggtgcatgtcaattcgtacgaaaaatggaaaaacccggagaaaatttatgtaagttttgttcatccgccatattccttaagcttaagcaatgacataagataaacggataataatggctcattttgccccgccccctttctcagatgtacaaattgttggtgaaacggcagcaggaaaatgtgaccacggtgatattccggtaataattaaaaccggaggaatgcagtaaaacaacccgtaatcagtgacttggaaatcaaaaatttaaaatcccgaaaattcttttccttacacaatgcccatgtgcgcaggtcctttgccgagttccaagagttgcactggaagctgtgctaccgcttctccagccgtgccattccccaactgtgccaaacggtgaccttcggccgcacaaacattcgcacggtcgccgtgcggcgtcaggtggacctgcagtacttcttgcagcgcttgttcgccctgtccgacgaggtggcacactcagagttggtctacacgttcatgcactccatctaccgcgacacggagcccgaggcacacaaacagagcggtaattattaattaattagttaattggcctataaatatggaaatttcataagccagtcactttccaggattaaaattcgaaaaaattaattgaatgataattattattaatatatcaccgtttaaactgtttggcagatttattttctatcaatttcatttttaaaaaattaaaattatccatttaaaagcgatttccgaaatttgtacggacggcgctttgtccacccaatgccaacttttgctgcgcttggcctgggaagaggcgcagaataagctacgcatttttgttgggcatgccaaaaacttgccgttggttggccgtgagcaggcgccagacagttacgtgaagagttacctcagatggacgggcacttccgcggcacagccgcgccaatggaagcgcaaaacgcacgtggtgcgcaacgcgcagaatcccacgtacaac

SEQ ID NO: 15193 - DNA, 1112 bp, Heterodera glycines
ccttcttcagtcagcgtcagcacaggtggcaatagtactctaatcgccacgacaacgacggccgacggacagcggcacaatcccgagcagaagcgtgagcatattggagttcttgatggtccgttcttcgccatctgttatggaaaatgaaaatgacacgcgaagttggagcagttcaattcatcaacggcaaaaaggaaatgccaaggaaacagtggcaaaatgcgcccggggcaaagcctcgtggcaattcttggcatttgcgaatatttgatggtttttgggacttgggccattgtccgcccgaattaggacaaaaagtcgaaaggatggggaataagttcgagtttctatccaatttttggtccggtgatattttgcattggtttcagtgattctcgcggttttttttgtcccgaaattgtccaaaaataaaattttctttcaaatggcggttgagaaaagatacggcgaatagcatggcaattggataagttcaaatgccatacataacctatcgaaaaccttcaaatttacgagttgtccgtgccgccctccccggggatgatttaccggaaaccccgagtcttgcccgaggcctaaaaaaacccgagtcgacacactctccatcaacgagaaacgcgaaaatgccggcctattgccaaaaaagttctgtctgatgttgccttccccccccccgtgcccacccgtcggatggtcaaaggtggcgaattcgccgggtggcgggtcaatgcgttcgaacacccggcggtcgtcctcgtcatgcggcgggcccatctgctgctgatgctggtactgctccaccgccgttcgaccgccgccacttctcccgcgtgccgtcgccgccgctgtgccggtgccaccgttgtcaatgtttgtgttcgccctgcgttttttgatttttttgggcatcgaaaaacgcacggcattttttgtccaaccgaaggaagaggaaagtgttgcaaaagtgttcttcgcacgagcagatgtgagcccaccggtccaaattgcgttggcagccaagcgcttcgttgccgcacgttctgatcactgaaaatgggcaacaaaatgggggaaatgatcaaaaaatg

SEQ ID NO: 15194 - DNA, 1906 bp, Heterodera glycines
tccgtcctcggcccctcctccacaaacagcaacaacaataacaacagttcgctgttcgcaccgtcaaattccgttggtgctgctgttgctgttgatcatttgttggatcgatttcgtttttttcgccgtcaccagaatttttcggttgcccgtcggtgctatccttcgctttggcattttgccggtgccgaatttgttcgactttgcccctccgccccctttcatctcgccgcccctcttttacaagtcgacacgcatttccaagagacggcagaaaatgctcgccaactgttgaaattgactaaaaaaaacattttaagatagatgcgacatttagtggctaaactaatcggtactatcggtgggattttattgactaatgatgattgagctgaccgaatttggcatcaatacgaaaagaaccgagccaagcctcgagaccgatgtgacaatttcaagactcaaaagtgccaagaggcaaaaaagacttttcaagtcgagactctcgagcatcattattgaagaattccgttaatgaaagtgctaactcatccatattctacccaaaaaacaaaaaacacataagctggtgagatggagagacattcacatgacatgccaacaataaggtgccactaattaggcctcaaaagtcattcatttgaaattcagaacaaaatgacccggaaaattggccattatgggatttccacactttgtgtcccttgggaggatgaggaggaggggatttgactatttgatgagcccaacagaatgtgccggagagagagaagagactggagaaagagagagagagagaaagtgggaagagtgagagatataggagagaaagagatagagagaggagagagagagagagagagttgatgaatttgtcttttttccaaatcccaaccaatggcacttttgctttgggaaagtgtgacaacgaaacccagaaacactcactggcaattggtctggcactgacgtcatttgcgttggcattttcagtccaacaaaaagggaatcgatgtgctggcaaattatgaagaaaattgcatggaatttttactaaatattctaaacaattttcaatgctcattataaataattattttggcttagtaattagcccattagaaagacatttttgtttgtttgtttttttatgctacgttacaaatgctttaatgagtttttttggcaaattcaaataatggcaatttgagtggcatttggcattttgttactttccttcggtgggcagaaaaagaaaatggaaattttatttttgctgtcgcacggaacagtgactaaacaaataaaaagctttcattccaggagatatttgagccgacaaagaaagaaaaaaaggaaggggaaagttcatgaacaaaaaaaaagtgagttgctgcggggcaaaggcaaagtgccgccgggggagcggagagtgccgaggggcgacggcggcaaattatttaaatatggcactcccggggggtgggaaaacagacgggtgcagttgctgaaaatgcgaatacgacgtattggccaacggcgggaggacggaaaagacggacacatccgccgaagggaaagacggacggggcagatggccccgagggtaaaaagtgcacaaacgaatggagagggaggggagagggggaaatgggaaaagccccgaggggagagcaaagcgggagggtaaaagccgggaagagggacagagagagcggggaataggatgagggcaggcacaaaacggatagagatgtgtgagagataacaaacgaaagagagagaagaaccgagagagtgagagagaaagggagtgggaaagagagaggaaaggagagagagagagagagggggagagagaaagcgaagagaacaagctgaactg

SEQ ID NO: 15195 - DNA, 2969 bp, Heterodera glycines
  misc_feature (71)..(71): n is a, c, g, or t
  misc_feature (2033)..(2033): n is a, c, g, or t
  misc_feature (2238)..(2238): n is a, c, g, or t
ccgtaaataagtccgattcataatggtaaaaaaaaacaaaaacaaagattccttcaaattagttttgtttntaatgtatttttaactttttatttaattaattaatttattatttgtttgttgttatatcgatacaaaatgcaataaaaataaaaataataataataataatactattgtattttattcaaatttatttttattttataatttaaattgtttcttttttgctttttaattttttacttatttattacattttttgtcttcttcaatgcatatatttttctcattaacttttctattctttttaaaattcacggcacttcgtccatttgcgttacgatagggatggattaggaagaatatttgataattttattgttttttgttaattaatatgactatattatgcaatatattctgcttatgctaaatattttcaaatattgtaaattttaatattaatttatttatcaatttaagttttattttgtttaataaaaaataattgaatatttttgttttattatttccatgatttcccgaaggaacttttaccaatctattgcggttttttccatgaatgtctattgagtttcaattaataattttgtaatttattaaacatttgaaatttattttagtaaagaacaaaaactgataatattcaaatcttaaaaccatttctaagtttggcacttcctttgctgatatttattattaaaaaataaattgtcagcaaattgttttccatttttggatctttattctttaagtatctttttatgtatcttcagatctttttaaaatgaaaggtccctctcttcgaatttattatgattttgttaataatttggacggcgtatatttttaattatttatttttattttttgtaaaatttaattatttttttcattaattctttattgtctttctgtccatcaattcgttcattagaatgtttaattgttttggtttttcatttttaaatgatcaattaattatttactaaaaataataaatattcattcatttttttggaataaaccttggtataattaaaaattaattatacaattatcattttctctatttgttactttcttattgttagcttggcaatgtaaaaagcctattgaattcaattaataatttatctttgttaaacttagttgccaaaatcattccaattgacataattatactattatctttttctttttatgtattatttgcaattaattttaattttattttcgattttgttcagtttcattataaattttttttaattcactatgaagacttaccgtgctgagacgaacctaaaaaagtatcagttataataaaaataattaaatttaaatgttataaagtgagtaaatcttataaaattatatattatgtaataatcaattatgaattacatactcattttatgtcacataaataaataatgattttgcaatttaagaaccgaataaatgtaatttttgaaggaaaattcgttgatgataatatttaaaataataaacacttgtttattatttttttacatatattcattcatttttaagtttctagctagctaatactttctctgatatcgatgtttgaattgaaatacgaaaagaaatgttgcgtaaacataatgctaaaatggctgcaaaaaacgctaaaaatactttttttaatattgacggcattaaatttgatgagataaaagctgcggaggaacggcatgaaatttaagaaaataaaaatattcggaaaagcgtggggattttgaatgccaaaaacatttgatcctttcgttccattaatgagaaagcgagaaccacccattcacttccttcattagtttcatactaaaatttaataatatttttataattagggcccggattttgaagcatttgcttaaattttttgctaacttatgacgccctacggagcacaaaaaaatccggccctctttataatttgtgttttcatttttaaggtccatgaataagccatttctgtctanaccctcttggagataattcaagcgttgcatctactaccacattattttacaatttttgccgcttccagttgtatttttgacgcacaaaggagaattccgagttctctatttttgtatagcatccattctgttcccacaattgttttccccattacaagcttaatcgcccctatttttgttaactgtaatctttcaggcacatcanacggatcgtttgagtctgaacctgtatctgttttctttttctgttgtaagcccggcgaacttttattcaggatggataattgcttgtcaatgaatgttcatcaataggatttgtgactttttccaagtcatatttctcagaatccgtcttttaatttttctagttgtaatggttcacactcagaattatgattggaacgcaacataacaagattttttccttgtcgtatcactgctgtcgaaacaatagattggttattttttccttttcacgcaaatacaaacaacttgaacatgaaatatagatgtcctctttattttcattagtttgaatgtattttctccagtttgtttcgtttccaattataaacatattgttggtcagattcctggcaaaacatttttcaactttaagttcaggtgttaattcaacattttttttactggtgcaaaaaatatttttaattttcccaagtaacgttttagtgtgcatatagaaatctgtatgccttttagttgcagttgttgaagcagctcattaattgtttttatttccttgttttcatagcttttgacaagtgttattgcttcggagttttgtagaaattcttcaaatcctgatttggtgcttgccgaataatcgagtagaaatgagaacaaaataagtttaaaaataaaaaatgtgttcattatttcggagttaatgtattaatgcaacatataaagaaacgc

SEQ ID NO: 15196 - DNA, 712 bp, Heterodera glycines
attgaaataggaatgattttggaaatccccccccccccaaaaaatccaaaaatttcggctacatattttcattttttaacatatttcgggaattttgtaaaattatattaatctattatgaaatacaaacaatttatttttgaatgtaccccttaaaaataacaaaaaattagtttttaaatatataaaattgtgtttcttagtctcatttttggcattttgtgcctatttcatcgtttacgaagaattttatgcaattattactttaacatagcggcccaattttgggctccaagtacaattatgctggatttttatttagtaatcagaacgccaaaactttgcaaaacttaaaatttttttgggattttcccttgtaaaatagaagagccgatctcgagttaaaaacataacttcgaaaaaataaacaggattcgatagagggggtcaaaatatgggcctatgcaagatttgaagaaaatctgacccgaggaaaatttttttgaccctagtgaaaatttcaataaatttcaatcattttcagctaaaaatggtcttgacacgcaaaaaaagcgaaaatttaaagaatatgagcaactcaggtgttgaagcaagacaaaagcggaaggaatggcgccgggagcatgcaaaaaaagctggatcaacaccaaaaaatgacgaaaattgaacaaatttattttattttaaaaac

SEQ ID NO: 15197 - DNA, 680 bp, Heterodera glycines
atgttaataacaattaaaataaataatattataaatataggacctttttctcctttaattacgaataaatcaaaattaggaataatcgcaaatatttgtttatttttaaataagtttttaaagatgaataaattttcttaattttttcaaattctattttttgggtttttcgtgtaattttatttaaatttaacgaatttggattttttgtaaactttaattcaaataatttttaaataatatcttagagctggaattttttttaataagattaaaattcatttttcaaattaaaacttatattattttcccttctataaaatactttaattaatttagtttaggataaattcttccatgaatttcttttccttatttttcatacaaacacttagaaaaatttaattattagccttttgtttagcttataaatattttatataaatgatttaaatatttcaaatttaataaattttacatagtcttaatatgcataaacgaattcaataattaaattttctcattttatttgcttttttaaattatagattatttggatttttcttgattggttcagagccccaaatttttttcatttactgactaatagagatcctttgcttttatatttttatatttatatcttaaacaattttttattacagcttccttttgtaaat

SEQ ID NO: 15198 - DNA, 2694 bp, Heterodera glycines
  misc_feature (2687)..(2687): n is a, c, g, or t
taaattcttccatgaatttcttttccttatttttcatacaaacacttagaaaaatttaattattagccttttgtttagcttataaatattttatataaatgatttaaatatttcaaatttaataaattttacatagtcttaatatgcataaacgaattcaataattaaattttctcattttatttgcttttttaaattatagattatttggatttttcttgattggttcagagccccaaatttttttcatttactgactaatagagattttttgcttttatatttttagatttatatcttaaacaattttttattacagcttcattttgtaaatcattaataagttttgatatttgcaatataattttaattccaaaaaatcatggtttgaggttgtacttctcagcttctctttttaatcattccaagaaatacctccactaataatgaatccaatcttttaaccatttgtccggacaaatgatctcgtccacaatataattaataaaaatttaattctgaacaaatattttatcaaaaggttaatcatttttttggtaatcaaacaaaaataatttaaaaatacaagatattcgacaatataaaaagaatttaaaagaaaagcaagtttttaaattcgaaaatttcataattagcaaaaataacttttaagattttaaattgttgatttgaaaaacaaatttttactttaaaaattaaaattaattgtgtttataaattttttatcttaatcatcaaaaatattaacaacaaagtcttgaaaaaatagtaaaaataatttttgataaattgctcaaatacttttttaatttaaaaatttttaaattctcaaaagatatttcaatctttgatatttaaacatatgcaacaaaataaattttttttataagatataacaaatcagtagaacaaaaaaaaagtttaaaataaaattaaacaattcaaacgactagataagtaaatctaaaaaatattaaacaaatagcattaaatgacccataaatacacaatttattagttctataatagctataagagaattttatttttgcatttaataaaataaaaaataaatatatcaataaaaagtgtttatgcaattctgagttaaaagtgaaaaaatttaaatttttattatataatatacaaacaaaaaaaaaagaatttcaaaaatcaaacaaataacaataaaaaaataatgagaaaagtatattttcaataattaaatctgtaactaataaattggccttgaaaaagatgatacactaaccgattataaatcgtgagaattaaatactacatagaagcagaataataattattatacatatagcaacattcttattttaaaataaaaaggaagaaataattcgaatttaaaactgtaaaaagaaattataactgaaataaaattatttaaaaatttccaaaaaattatattcatttaataaaaataaataaatgctataaatacgaatacaaagacatgtgaaatagagaattcttttgaaaaaattcataaatcatataatttcatatttattataatatttaattttaggtcatcacctaaataagtaacataaattttaattggcataaaattaaattttaaatatttattgttttattaacatcctaaatgtcgggctccctaagtgtcggatccccaaatgtccttcagttcccaaatgccgtttcaccaaatgtcgttcggtccccaaatctcggtatacccaaaagtcgggactccaaatctcggtatacccaaaagtcgggactccaaatgtcgggatccccaaaagtcgggttcccgtatgttgtgttccctaagtgtcagctcaccaaatgtcgttcggtccccaaatctcggtatacccaaaagtcgggactccaaatgtcgggatccccaaaagtcgggtcccaaaatgtcgggatccccaaaagttgggaccacaatgtcgggtccccaagttgcaaatctccaaaagtcgggtagccgtctcaatacttcgcttactgcgtctataatgaataaataatcaaacaaatgtgaattgagaatttttgaaaaaattaataaaacatagtgattttcatattttataaataatttttcaattttaggtaatcacctaaataagtaacataaattatactagaaaaataaattaaaataaaacaccaatcaattgttttatagattggacagggggcagtaggggtcagttccgtatggcctaaaccgtctgagccagttccgtctcgccagttccttcttggtactcaaagggccgttctgtcttaaatataattggaaatttgaaaagaaaaatttctcaaaaattcatgtccaaaagaatttatttattttcttggcaataatttttgattttgaaacgataaaagttgttaacatttttttttcgttctatacactaaagcagtacagaatctacaaacgcaccgaagaagcgcaggagcttttagcgcggtactttcaaatccaacaatgtgattttttatattataatcagggttgtaaaaaaatcgaatatttagtatttatttttaatgaaaaaaattaaatattataactcttttatttgtttacaaaagcagcattttgagtatttttatttatatgtataataattgaaaaaaantatatta

SEQ ID NO: 15199 - DNA, 1025 bp, Heterodera glycines
  misc_feature (11)..(11): n is a, c, g, or t
ccgtggatttnagtgaagaaaaatctctaaatagttaactattgagtagtgaggaaatatgccaaaataatagtgacaaaaagaccgaaatagtgacgaatatagcgatataatttcagccaaaaattgagcaaaaattatttttaaacacttatttcagatgcaaatgaggtacattcgacattttcttggatttttttttctgcgtctcaggtctcgagcatagcaaattgctactctcgagcagacctactaattaaaattgaaataattaaaatttaatgaataataaatattattgtgttaaaaaatgaccatgtccaatatgccatagaagaacatcaatttgtagcaggcattgtttttcatgtttttgtaaattgataccatacacggaatgtaaagtagcttaatttttcatattttaagtttcgagaattttctttacttttggtctcgctatccgaatatagcaaatttttactctagagcagccctaattcaatcaccccctgaaaatatttttattcgtaggtttttttccacgattgcgtttagattttttaatgatatttttttgattttttattattttctttttttcttatttttgctttttttattatttaaaaaaaattaattttaaattaattaatataaataaattaactattaattaatttaaaattaactaattaattaaaaaaaatagatattaattcttaatatattctctttaagacctcaaaaacgaaaaaaagtgtgatcaaaatgcatccgttcacaatgtttgttctttcttcaagtgggattttgtccgcattaaatccctcacagccgtacaatttgtcaaattcatcatgacgaaacagcaacaattccatcgggatgaattttttttatttattaaaaaataaaaaattattatttttttagggaacataaaaattatgaatcataataatttttttgtttaagaaaaagaaatatcatattttggagtaaacagtgttacacaacagcaa

SEQ ID NO: 15200 - DNA, 1318 bp, Heterodera glycines
gccaagaatgatggttgggtattcgtagagcggtggctcgggcaaatcctgatcagacagataaaaaataaaaatttaaatttatcatttgttttttttaattaattattaaaaaaattgcctgatacgaagtggtctcctccgactctgaacaacaacaaaaaaaaaattttaatgaaaatttatttatttaaattaatttatttcgtttctaattttatccaaccgatttgacattaagaaaagtttatttaaggagttggttgaatttaaataatttatcaaatacctatttaaaagcttataggctaaaattaatgcaaaataaaaatcttaattaaataaaaaaaacaatataattaattaattaaattttactattaaattttaaaaaaaaacttatttaattgtttaaatgaaaattaaaaccaaataaaaataaaaccgaaaatttaagcattattgaataatcaaaaaaaaaaatattaaaagaaattaatatttttaaacaaatattaaaatatatttttttctctcaaatcaaattaattatgatcaccttctgtgttgctggtgcggttgttgttgcccatgggcatctttgtaatcgtcaaatttgggcgcatggacaacggcaagttacataagtcagtgtaacaactttggcatttgccgtccagacaatatttgtgcatttcaaatgcacaaaaatagtgctgcttggagcatgaagcaaagtaccattggtctaaatatcgggaatgttctcgagagtcagtctcggcatagattttttctccaagaattctcggcttttagcgatacttgggcatcggcttgtccgatttttcctgggtgcgaatcttaccaaaaaattttatctttcaatgcttttcagtaaagtaacaatggtctaaatttgggaatgctcgagagtcattcttggcattgattgtttcgtcaagaattttcggcgtaagcaattcatggacgttggcttatctgacttttcccggatttggaaggaatcgagaattttctttcaatggatttcggtgtcgtgtctatgtgtgacatgtttttaccaattcaattcattagtttcgattataaattcgggaaaaactaaatgatcgggttgaccgccatgaaattaaactaggattatcattttgggactaatttttggtgttaaatgacgagaattttcaaatcttgaaatcgatcaaatttaaaatggtcaaaattaccgtcgcaaacgaaagatgaacaaattttgtcctcgctagcacattccgtcatgttgccatctgtcgaa

SEQ ID NO: 15201 - DNA, 3341 bp, Heterodera glycines
ccccccccccccccccgtcgcccgcaaagtgccccaaaatgggggaccccttcgcatcgagggggccggtgtaaaagaggtggggggggggtcgccggcgaagtggaaaagaggaaaaattctgaaaaatttggctattttcttaacaaaactcattaaaaattctgaaaatttttcctggcggcgcctaccggcaccgctggccccctttttgcaaaattttcttgaaaaaagcgtgccgcaaaaaaaagtgcttttgaaaaaaaaaaaggtcgtcgatttacaggccgggaccattttgcaaaagcaaaattgaccgctgaccccctctcgacccccccccccccctccaaaccccttcgcaaaaattccggttgaccccccctttttcatgtatgtactcgaccgggtcccagacactacccggactcggttttttgaaaatccaatacccggtacccgacccggtaggtccgggtccaaaagtacactggtaagaaaaatggtttattgtttttttgggaaaaataaaaaaattcaaaaaaccgaaaccgaaacggtataccgaaaatttttcttcggttttttaaccgaaaccgttcgaccgaccctcttgtccggtctctagtttttatacaatatcaaaataataaaatttgaaggaaaaatagtattttttgcaaaataaatattttttggattttttcaggacgcgatacccggattaaaatcttggacccggcttttcaggaccccatcaataccgggacccggtttttgcccaaatacccggacccgtgtaaccctactttaaaccaatctaaaaacatgtttttaatgcgtttcatgcctcacgcaatccaggaaaaaatatgcatgtgcatataattaccaaccctagttattgcaaatttcaaaacataaaaaattttgcaaaaaatgtgtgctaccatctaaacaattaccgtaaaatgaatttcgtaactgacggaagaaatggtggcacggagaaaatgctaaacaatttggaaacaaaagcactgatttgtcgaaagtatggccacacctccttgaagttgttgacccaatctaagtccgcttgtgcgttcaaatttctgcgaaaacgcaatcgctttggttggccatcttttctcggagagtgcaaccatttggacaacgcttggccagaagaaattgttgcatttggcacatcaaaatcatcaccaaacgcagcgggcaaccgaccaaatgatttgattgaattcaatttgttgagatcggtgagaattgttggcgaaatgcgacgaagcaaatggtcgaaattatcaccacgggataagcccaattggtaaatgtttgccgaaaaaattggccaaatttcacgggcaaaaacatcccaaattggttggccattcgtagagtgtgatgatggaatccacaaatataaatcggtgcctcttttgtcgaaaatttggtgattggaacgaagaaaagcgatgacggaatgatcaacgtacctaaaaatggaaggaatgctttcattgccataaaactatggctctattgcagctcacacgaccataattttttttttttttgcaaatttagtgcaccataactttttcaagaagcatccaaattaaacattattagtattattcgatagccctaagaatcctttattagcctgcaaaatttcaaaaaatttcggtgggtttcaaaaaatttatggctgtcggaactctgggattccgactgccgatcaattgatcagcagaattgaagaaaggaagtggcgacccttccccctccctttcacatgccccgcgcaccccgttccactcctctgcccccatttccctccaaattgttaattgtttttctgcgttccttccattccccgcgcacaattaatgaccaatttgtcaaaaccgcaacttttctgccgccgtccccaattcggcaaatgagactccaaagaacgatgaacccccaaatttcccgttttccgcccattttgttcatctgttcattttgtcccccgtttttcatttcgtgtccaaattttcggcccattttgttctgctcacatttgccactttttatttaactttattgttatttaagcggccaaaaatgcccccaatttcacaaccaaaattcattaggcatttttgccgtttctctcccctcccttccatttgcctttaactgtgataaccccattcgtgatcattctttgacccccggttattgatttttgttctgtggccccagtgccctccatttcctgtcccatcccggtgcccaattccatttgtgataattccccggtgatggcatttctgtgatcaatttgtgataattcgttcaccatttcaaaatttttgtttaattacccaagtttgaggtcatttcccggaataaattttttattcattctgtgtctcgtccctgcctgtccctgaaccccgcaccgtggaattcatttggcccgaccccagagcaagtcgggacactaagatgtcagttttcgagaattctgaaattccggcactccatgccgaaaacattgctccaattgacatttgtcggccttttaagcccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgagaattctgaaattccagctctacatgccgaaaacattgctccaattgacatttgtcggccttttaagcccaaatggggacttattttgtaattcttccgttccgttttcagttctcactaagatgtcagttttcgagaattctgaaattcccagcacaacatgccgaaaattgctccaattgacatttgtcggccttttaaacccaaatggggacttattttgtaattcttccgtaccgttttcagttctcactaagatgtcagttttcgagaattctgaaattccagcactacatgccgaaaacattgctccaattgacatttgtcggccttttaagcccaaatggggacttattttgtaattcttccgtaccgttttcagttctcactaagatgtcagttttcgataattctgaaattccagcactacatgccgaaaacattgctccaattgacatttgtcggcattttaaaccctaaatggggacttattttgtaattcttccgtaccgttttcagttctcactaagat

SEQ ID NO: 15202 - DNA, 1627 bp, Heterodera glycines
taaattgaaaagcatttagagcgaattcttctgcggaaaatatggagtgaaaaaatacttccttggcgtcgactgccaggtcgctaaattttgataaattttttagttataaattaattaagggcgagccgaggaaccctgtcaaaagaatggcgcaagaagaggtttctgatgagcctcaaataccagtgaattgggtcctaaaaggatatttttcaatgcttttttaatttaggatgtggtttgtaacgaagaacttgaagagaacatttttggatgcgtatgctgttttacgaaaataaaataatattattaaaaaaatattaagccaaaacttttgggatgctttctccgaccgcacaaatctttggtaaatcagctataatacaaaattgtacttaattttgttagacgagcctgaaggtttgcatgcccaatgacctgagaaacgaggaacaatgtgtatgtatattttattctttattatttattcaaattaatattttttataaaggccgagcctttgccgccaactgaggaaccgccgacaactgcccaaacagttttaattattttttaaaataatttttaattcggttacagtctacgcaaaaaccaccggatgagatcccaattgaaactggaggaggcggccaagtatcataataagggcgagtgtttgtatggatttacatacatattttttaatcaatttttcaaaattaaaaacaaaaatggaaaaaagcgagttttatgggaaaattgtttgatggcacataaaaagttgataaattccaaaatgtacaaatttttacgtttaagtttacaaaatgaaaaattgtttaaaatattattataatttgaatcttttaagtaaaattttgaatttttgcaaatttttggcattttttgtggtttaaagcaatttttggtactatttagtgggtctttgggtgctttttaggcaataatttatgccaatatatagttttttattggtccatacaaacattcgccctaattatagcctaagatggctcatacaaaatttttttgccttctcagaagccttacgtggatgtgctggacgtggataactgcacaaacatggtcaaagaactgtgcaactgcgggtatgcaaattatgcatattgtgtgcttcgcgttggctacgcgcgcaccccctgctgccccagcgattacgacttggtctgctgcgcgaaagtgagtctaagacaaacttaacttaaatacttgcttataattttcaacagaaagccaaatccattgaccttgtccgaatggagtttgaagctcaaggtagggtttaatggggtgaccaattttctccatccaaccatttttcgtaaaataattttcacgtggttaaccttgatttaaaattctcaatctgtaaataagaatgtaaattgataggaaaattttttggccctatcgtaattagctttcatttcatgtacctaattaatccaaagtcatcgcttttgatattttggacacgaattattatttttgacaccaattatagtggaaatatttcatgtatttttcaagaaaggctctagaaaacaaatccaaaaaatttaagaagtcctaatcagatggg

SEQ ID NO: 15203 - DNA, 1624 bp, Heterodera glycines
acagtcctctcggcagcaatcgccttcctgctgatgaccatcactttgccatgatgaattgtctgtcctctcccctaaacgaaatcagatccaataccatgacgattttttctatttaattttgaaacaaaaatttaagaactggctttacgaacttttaaaacatacccataagattttttcaaattattctaaaattagtttaaaaaattcctttttatagaaaaataccttaaatttttttgctccaaattcaaaacctaaattttaatgaatttgtttttttcacaattttaatctgattcattagttagggtttttctgcaaaacccttaaccataaaaatcatgaaaaaatcgtcataagatttttaattttttatttattgagttcttttaatttttgtaaaattcaacttatatcaaagacatataagatattcaacttgtatgctttattttctgtgttgataaatataattttaatgataaattcattgttcttctttggattgatattaaatgtttataaaagctatttcatcaaattaacaaattaattactaagaaaatttttaaaaaagataacccagaaagttaatgagtaaaagttcgtaaaactcggtaaaaaccgaaaattttcaaaaaaccattctttaggtattttctcgattattaataaaaatgtaaccttctgaataaattcaaaatatgccaaaatgagtctttttggggcaaaaattgaatatttatgaaattgtgcccaagttgtagtacgattttattcagtatgctaaaggaatgcactaaatttcaaaaaaaaaaatttaaaaccattccaacttaagtttgacaaaatgttgaaaaatgtaatcaatcatcaaaagaaatataatcaattaaatttcattcattatgatcgataagattagaactcggattttagagagaatgatcaatcagttaattttttgaataagagttttgatcaattaagaaatttaaaatatttgaaaaattttaccattaatttgaaaacctaggtcaatattgttggtagaatgattttgtaattttttttaacgaaaaatcatattgtttttatttgtcagcattttcatataaattctgtcagctgttggttttgttaaaaattgccttaaaatgccaactttctatctatttcagacaacctactttagctattggcttctttttgtatttaaaagctttacataaaaaattgttgaaaagttttctcaaagcaaaagagttttttgggtcatttaaaaaattagaaacgcttgaaaaattttacacataatttgaaaaatttaggacaatcaaattaatggaatgatttttggaaatttttctttttaactcaaaaaattaaaaaaaaagtcatttaagtaaataggccaatcaaaaatgatgaaattaatccggcgattcatgttcttcgatttcttaaaggagcctttctgggtatttgaagacaggcccaaaattggcctcaattttgtcaccaggccaaaacaacgaaacacaagggaacagttcgggtgaagaagcattggcagaaatattaacagaacctgtgaaaaaataaaaattaaaatttt

SEQ ID NO: 15204 - DNA, 2534 bp, Heterodera glycines
aaaatagaacccttataataatggaaaaagtacaccacttcaacttgtccagtggcacagtggtagtgcgtttggttggtgtcgtgttggcacggagtgccgttggttcggttccgcttccctgtggttgatcactgttgttaagccccgcatttatgtgggtggccgtgtttggggttcacggcttaaaacgtcccccagtgatcgccgcggagagcggggcttgatccgacgtgcttttcgttcagcatggcgctttccatacagttttatggagatgtgctgggaacttgctcatggtggtatggtcgacataccaatcggctcgctttgggaggtttggtcagattggtggccacagatgaagccccttggtaccccaaccaaggcgggggttctgaagtatctcgggagttgtcaaacagaggtcgtagtcggcggcactgtttcctcctggcgcctccacagggagtccgtgcggggccacccgaacttttttgcattttttgtgtaactccctaattaataataattactaattatttttcctcccttataaaatgccaatatatttgcgtgcgcggcgaaaagttaaagttattttattttattgaagacttcattaaacttaattaaattattaattaatataatttattttttatccccctctatcaaatgccaattcattgcgcagtgaaaaagaattaatgttttttattttgttaaagactttattaatgtaatgagtttgttaaatacagtttatgcacttaatgatgattggaaaaaagaatcgaaaggttatacagaaaagcaacacaagtgataaaaaaaaatcatatacaaatatgatatgtatgattgaatatgttaagtataagtaatatggaacaacacaacggtttggcaagagaaaaatatcacaattaaaaaatcattaagtgaattactgtaattttctttaataatccgaacaaaaaattttcatgtgatcaatcaagcctgtaacatcggtttcaaattttcggaaatctgaaaatttttattaaataaaatgaaaaaatatgaggggatcgggaaggaccttaaattgacagccggtggcccgcacaacatcttccactgagaacgtttcgtacacctccaccaagctcaacccgtccgttgggtgaacatcaaacacagcctgatgtgaaaatattattgtttttttttgaaataaaagacataatttgttagtaattaaagtgtttaatttggccaattgagaactgaattttagaaaaattccggattaggaggaatcgagaaatcgacccggatcggatttcaagattagatcttgtttacaatttcgggattcttgatccaggtgcttttaattactcggataaggtatcgagaagatcctgaaaggatcaccccctgtatcccggtctctgttggtaaaccacaaaaatttacggcattacaacaaaaagttgctatgttaatttttataaatttcttggtctcgaggcttaataaaattttgaaatttgaattccgtcgcttcaacaaatttcagaatttcgaaaaatcgagaattttttggggagggaggggggaggggcattttttgctacggcattctgctgaccatttcggtgatgatacgacgaacaacatttttgccggtcaacggaagtgtacagttgtccaggatttttggctttccaccctttgcacaatgctaaaacagaaaaagcattgttctatgtaattgaatttgttttaaactttatttgtttacctccattgtgatcacaactcgagagccgggagcaccgaccaaatccatcgctccgcccattcctttgaccattttaccatgaaaagacacaaaattaaatatattttaataaataagtaaatttaaatattgccattttgtggggtcaaaaattttcgtaaatatggtaaagatcaggaaaatttttggaaatttaaacgatttttttttaagaaaattgattaaaaatttgcaaaaaattagccttttttcttgaaaatttttaattttctattttatctccggattttgagcccatataaattcggggcctgttaatggatagcaatagtcaaaacttactggaatcatccagtttgccagatcaccgtatttggatacttgtagagcacccaacagtgtcagatcaatatggccacgaaaattgaaaattgaatttactttttccaattaaaaagatttaaatgtaataaataaataccctctgatcatgccaaatgattcatcggagccaaaagtggaggcaccgggcaaaaaagtgatggattccttgccggcattgatccaatccgggtcctcttcaccagggtacggataaggaccctggagaaattttttttaaaattgtcaaaacaaaatttttttttttgaaatttaattcgtcgaataacggacgacgccaagaatgccattctcggactgcagatgcacatgggtgccggcgcgcaaatagttgggg

SEQ ID NO: 15205 - DNA, 1082 bp, Heterodera glycines
  misc_feature (71)..(71): n is a, c, g, or t
gcatgatagtctctcaaaatgctaattaatacgatccctataaccttgatataaactctatcttttatttntaatatgcatacaaagtttgttgcggttctgatcacttatagactggtgatcaaagtttctataaaactaaaaataattaccgtatttcccaaaatagagctaccgggggctttattttttttaaccccctcaaaagagtccttctttagggggagggcactaattcagaggaggcgggtgactgtataatagggaatacggtaatttgacacaaaattcaaaatactattgtaaaattcaaaaatttaaaatattcttatagctgctgctcccttttcggcaaaacaggatcaaacgctaaaaaaactatcattcatctggtcacttaccgtacatgccatcgcggaactccagcgccgctcgtctggcaatcacttcgcgcgctttgtccccacccaagtctgtgccgccgccgttgttggcaccggtaggcggtggcactttgccatcatttgcgctgtcggcatgtgatcgttgacgatggatcagccgttcaaagggttttcggtagttttggccaagcacaattcgatgcgcataaatggacggaacatgcacctgatcagatcaaaaaaatacatataaaaaaggtaaattaacatgaaatgcgtttaagagcatttcttaaaaaaatttaggaattaattttgcaaaaaaaaaaattaaaataaaataaaaaactcagaagttcgaaaaattttttaaaaccaataagcgttgaaatattttcagaatatgggatgaaaaagtttaaaataggtaagttgattctcttccttttagtatccctgcaaagtattggtgagcttctgatcacttttaagaattaattttgcaaaaataaaaataaataatggaaaactcagaatttcgaaaattttttttaaaaccaataagcgctgaaatattttcaggttaagttagtcctgtaccggggagtgtgcctataaattttggtgagattatattaattataggaagagctaagttcgataaaactttttaaaata

SEQ ID NO: 15206 - DNA, 1390 bp, Heterodera glycines
ccccccacgcccgacctcaggacgggcgcttcgcgcccgttttttattttgttgagaatttctttaagttaatttttttcatattttattagaagaggtacaatgtgaattttaaaatttaaaacaattattgataaaaaaatgtaaattaaaaatttatttattattaaatattaaatcaaaactattttaaataaattaaaaacatctaaaaataagcaaaaaaaatacttagaaaaataatgtgttaccgcccggattcgaacttgcccccgccccctcaaaatgatgcctcagaatccccaatcacacagggattctgaggtcttaacaatgtcaaaagtaaaatctgattacgtattcgtgatcagcgtcataaaatagccctaatgacatgttttttgaagatttttggtgaaaaaatttttcaactcaaaaatcctatactcacccctttggtcccgattccctaaatcacttttatttctataacttttttcaaaaaagtgataaaaagctaaaataaaatttctaaaatagagcaaaaaattgcggatttttgtattttttacttttccaaaataacttttcagaaccgagttcagaatttttttctgaaaattcgaatttttccagaacttctggaataactttttttagattcatgatagagaatctaaataaaagccataaaattctcctgatttttctccatttttttgctcggtgtagaccgtatacttttggtatatatgggcgggcgctgacatgagcgcttcgcgcaaaggacttcgttgctagtgcatgcgcgtttgataagtgatgagcaagtgcattcggctgcttcgcggccttggccgcttcgcggcctcagacgggcgctttgcgcttctaaatattgtggactcatttggccgcttcgcggcctcagacgggcgctttgcgcttctaaatattgtggattgttgggaattttcggcagcttcgtggccttaggacgggcgcttcgcgcccgttttttaattttgtggggaacattcggccgcttcgcggcctcagacgggcgcttttggccgcttcgcggcctcaggacgggcacttcgcgcccgtttttaattttgtgggaacattcggccgcttcgcggcctcaggacgggcgcttcgcacccgttttttaattttgttttggacattggggcgcttcgcgcccgtttttaattttgtgggaagcattcggccgcttcgcggcctcaagactggcgcttcgcgcccgtcttttaattttgttgagaacaatcggccgcttcgcggcttcaggacgggcgcttcgcgcccgttttttaattttgttgaggacattgggacgcttcgcgtagaagaggtacaacag

SEQ ID NO: 15207 - DNA, 3321 bp, Heterodera glycines
  misc_feature (12)..(12): n is a, c, g, or t
  misc_feature (3216)..(3216): n is a, c, g, or t
aaatcgaaatcncggtgccaaaaagtttccataaattgacctttggaatccgaggccccgaaattgccgtaaatcgaaatccggtgccaaaaagtttccataaattgatcattggaatccgaggccccgaaatttccgtaaatcgaaatccggtgccaaaaagtttccataaattgatcattggaatccgaggcccccaaatttccgtatcctgtgccaaaaattttccataaattaatcattggaatccgaggccccgaaatttccgtaaatcgaaatccggtgccaaaaattttccataaattgatcattggaatccgaggccccgaaattgccgtaaatcgaaatccggtgccaaaaagtttccataattgatcattggaatccgaggccccgaaattgccgtaaatcgaaatccggtgccaaaaagtttccataaattgatcattggaatccgaggccccgaaattgccgtaaatcgaaatccggtgccaaaaagtttccataaattgatcattggaatccgaggccccgaaatttccgtaaatcgaaatccgatgccaaaaattttccataaattgttaattggaatccgaagtccccaaaatttccgtaaatcgaaatccgatgtcaaaaattttccataaattgatcattggaatccgaggccccgaaattgccgtaaatcgaaatccggtgccaaaaagtttccataaattgatcattggaatccgaggccccaaaatttccgtaaatctaaatcctgttccaaaaattttccataaattgatcattggaatccgaggccccgaaattgccgtatatcgaaatccggtgctaaaaagtttccataaattgatcattggaatccgaggccccgaaatttccgtaaatcgaaatccgatgccaaaaattttccataaattgttaattggaatccgaagttcccaaaatttccgtaaatcgaaatccgatgccaaaaattttccataaattgatcattgtaatccgaggccccgaaattgccgtaaatcgaaatccgatgccaaaaagttctttaattttcatcacttgcaattcgaatgccaatctttgtgataactttgacctacaaaattgttttctaataattatgcatttattgtccattaaacatcccattttggcacttttcctatgcatatctgtttaacaatttgccgaactgtatattatttattttatatgttatttagagttgattgggaccaggattttaagaaatcgggggacccgtgcctttgcgtggttctactgcactttatgagccaaatcaatttttatgagttttcaatggcatttttatgagtccaaataaattgttatggcgctttaattattcaaaattctaatgtgtaataaaaatttttttttataaattaatggcaaataaaaatcaaatttatcaactaaaagtcgatttttaaaaacgctttttcaattttgcacatttttcaaaagagaagatgaaatgccgaaaaagtggcataattatttagtagcaaaaagtccaaaatagtgattcctagtgacgaatagtggcatttaaatgagattttctatttttagtgcatttctcagctaaagaaagccgcagaaaaaaaagaagttaaaaaactaaaaatcccagcaataattatgggcccaatcacaactaaaagacataagactaattatgggtagttagttgcttgcttggactcattttgactcatcaaaatttgattggacaattaattatctgaagtcggcgttacgcgcaaatgcccgaactgtgtcgagggataacctgtaaaaaaacagttttggttcagaattccgttcttgacaacgctaattttcccgtggttttctcgattgccctaacgggcacttggctattcaatttggcaatatgtacccaaatcaaatcgtcatcattgttcaattggcttttctgttttataatcagctgctgtttatgattgttttaacatttgatcttgttgtattattgatcacacatatttaataaactttttttttataatgtgactcaatttgtaatcagcctgacaagcggtgtaaagcgggcatggaattccgagacacgtgaagcccaaaaaatttcttaaatcggaaatagcatttctgaggctaaattttttcgaaaatatcggaattccgtccacttcaatggcacgaaaatcgtaattcaagacaagaatgctgtatctctaatttattctcgtatattgaatggtttttttttgtttgtttaaatatgtatgtattgtatgatttcaagagaaataaaatatttaatattattcattttatgaatgtattcttctcaatgctctatcataaaatatgcaggcccgtagccagaaatttttttttttttttgctcttcgagatcctagaaatttttccattgttatttcttagaattatcagcgccgaagcgaaaaacagggatttgtagtgggcttgcgcctaaaaatgacaatttgaaaattttttttttggaaattttggtgaatttgtaacaattttgtataaaatttcaaaaatttgcccatttcttgaatttttttgtttttcattaggggggcgtgaatcccccccccctgctacaggcttgaaaatttgttatttcttacaaattcatgtggaatataaatgtatgtactagctattaaaaacaataattttaattaggtgtctttaattgttgaatgttatgcctatatgtattaagtttccatgcataattagtgtttcgttcgtttttcctatgtttaatgagtgaaaaattgtttattgtgccatcaaaatgtcacccaataaatttatttcgctacagaatgtcaccatgaaaaatttctgaaacgaaaatttcggaggttcagcccaaatacatacccactaaaaatggaaattttgaaaattattaaataaattagattaagccttataaatggtcaaacatatttaaatttttttttgtgtttcgcgatttttggaaaacaaaattcactgaaactttttttaaaaaacttcccagcgcttaccggaagaaaggctttcgtggaataacaaattttgaaaaatctaaatataataaatgaaaaaaaaagttttacggaaattttctttacattcgctaattttaaattcaattaaaatgcttanaaaattaaaatgaatcgataaatgaatatgcagaaaaccatttgctagtcatttaacagtgttgaaacaaagaaacaaaaaactgctatgattaaggaaaattac

SEQ ID NO: 15208 - DNA, 3958 bp, Heterodera glycines
  misc_feature (3863)..(3863): n is a, c, g, or t
aggagaagttcgggttcgaaacaccatttttatttcctttttattgtgattctaaaaggattacgtgcaaactcgtcgactccgtcaactgccgaatcagccgtcgtcgaatctgccgcgggtccgtctacctcgagtgggcttaccaatggcattccgatgttgagcattgatcgtcccgctgcgagttgtggcagtgcatcttatccaaagaacagggataccataatgccgcaaccgcccgtcactcctagcaaccaaaatgaagaaccattgcccgagggatgggagacgcggatggaccaatacggacgccgttattacgtggaccatactacaaaaagcaccacatgggttcgcccgagctctatgccattgccacccggatgggagtcccgtcgtgacccgcgggggcgtgtttattatgtggaccacaacacgcggaccaccacttggcagagaccaacggcggacatgttggcggcgcatgagcaatgggagtcgaaccgttcacaggccatgcatcagtgggagcagcgttttctttacacggtatttgttactgaacaatttaaaaatgccctcaaactttaagcatcacgatgatcctctgggaccattaccggagggatgggaacggcgtgaagacccaaacaccgggcgtcattactttgtcaaccatcagaataaaactacgcaatgggaggacccgaggactcaagggtcagagtgattagcgcaattatatttatgattacatggattactgtctttaggttaacggatgctccgctgccggaaggctgggaaatgcgtatcacagagcaaggtgtgccattctttatcgaccacaacaacaagacgaccacctacaaccacccgcggactggtcggcctgttggtgtgttctttttgttcctacccaaagtgattgttcaatttcagggcctcttggtggtcccggcttacacatggctgccgacaaaacattcaaaaacaaagttgctcagttccgttatttgtgctattcaaacagcgtgcctaaccatgtgaaaatttctgtgacaagaaacaatttgttcgaggattccttccaagaaataatgagaaaaaaccccttcgacttgcgtcgtcgtttgtacattcagtttaaggcggaagatggactggattacggtggaattgctaggtattttgggttattatttgtttttattaattgactaaataataataataactttcagggaatggtttttcttgctctctcacgaagtacttaatccgatgtattgtctgtttatgtatgccaattcgagcaactacagtctgcagattaatcccgcttcttttgtaaatcctgaccacttgaaatattttgagttcatcggtcgcttcattgctatggtgtgttgttgtgacccaatttactatcgtaactaactattagttttacaggcacttttccatggaaaatttatctacagtggtttcacgctcccattctacaagaaaatgcttaacagaaagatcactctcaaagacttggaatcggtcgacactgaattttacaattccattgtttggagtaagttaacagaaaacgtcataattataaattattaaaaataaaagttcgcgacaatgacattgatgaatgcgacatggaattgtactttgtggttgattatgacctacttggtgaggtcaaaacgcatgagctgaaggagaatgggactgaaattgctgtaactgaggccaacaagaacgaatatattgaactgctggtggaatggcgtttcaaccgcggaattgagcaacaaacagtggcatttttcaacgggttcacttcggttttccccctccaatggcttcaggtatgaacttttgtatttagcccttaatttatattgttttttagtatttcgatgaacgtgagttggaactgctgttgtgcggaatgcaggagattgatgtcgatgattggcagcgacacactgcctatcgccattacgctgttcaaagcaaacaagtgatttggttttggcaattcgttcgctctttggaccaggaaaagcgttcaaaactgctccaatttgttactgggtaacttacaattagtttttaaatttactgactgaatcgttatttcacttttcagtacatgtcgggtcccggtcggtggtttttcggaacttatcggttcaaatggtcctcagctgttttgcattgaacgcgttggcaaagaaaattggttgcctcgttctcatacttgtttcaaccggtaaacaaccgatgcttatcaattagcttcttattgtcttcatactgatttaatttaggcttgatttaccgccctatcggtcgtacgaacagttagccgagaagttgacagcagcaatagaaatgacagaaggctttggcaacgaataaaaatggggacaaattgagatatcgactctctctaaataaaatgtgtactgaccttgattcagaagcattgtggccttttatttttagtgttaaggtattattgataagcccaatgccacccgattgtgagccattcattgctgctgtttttgaaaccaaatatgcttatcttaataaccctgtgatataatatgattggaaacaacttaagcacagaaccaaatttttaattctgcatccaatgcatttcaatttgtaagactactttcaaagcatcctaaaccctccctagatcgattctgtcattaattagtcaattttttatattacattacaaatttgtattgaatgaattcgatgaggatcacaagcctttaaaaacattcttgtctttttgtttcacctttaaattgaaattgcctttattatacagcaattcgagtgctacaaatagttcgaaatggtaactgcggaagataccgttaaaacaaaggaagaagaccccaaaaaaacgacaacggacgacggatcgagttcagaggaagaagtgcccgagctcgaagagggcgacgttactgaagagcagaaaaaagttgctgaggcggccggactcagtgagcaggtggctgattgattggtggtgtcatgacaactcgtacaaatgcttacaatttgactaggcactttcgaaacacaaattggacaaaaagttcaaacaaattaacattttttgtcttaaaattttttaatgtaggagttgccattaacctgattggtttgggcagggagcccatcgaggcattgatgtgctaaatcaaataaatcggaacattttaaaggttgccgaaaagggctccaaacaatcgcgttctgaaaagaaggctcgtaaactattcagcaaacttggtatgcctttcaaagttgttcattttcttttgtttataaggcctcaagcaagtgcacggcgtttcgcgcgtatgcatccgtaaatcgaagagcattttgttcgtcatcaacaagccggacgtgtacaaaagtccgggctccgacacatacgtcgtttttggcgaggcaaaaattgaagtgaggcatttgccatcgttcgtttttcagcttggtatttttatttggaggatttggcacaacacgctcaaatcactgacgtggagaatttgaaaccgccctcaatcattcgcgatgttcgcaaccgaatcacaccggcggaggaggaaagcgatggcgaagaggtcgaaagagtactaaaaaaattgataggaacatggagcctggacattgcgacaatcttattctctctcacatctaaatactaactaaaattgtgcttttcaggctgatgctactggaattgaagaaaaggatattgagttggtgatgtcgcaagcaaatgtttctcgaaacaaagctatcanagcattgaaaaaggctgacaatgatttggtgaacgctattatggtgagtcatccgattgaatgagtgacattcttttcgtatttctattcataat

SEQ ID NO: 15209 - DNA, 2045 bp, Heterodera glycines
  misc_feature (1886)..(1886): n is a, c, g, or t
taaaattgaaaacgttttttttaatattttactcgtaaaaatcattcacaaaagtataaaaaatttttttttaatatcaaaattcgtgggcacttcgtctgacagtataaaaagtgccattcccgttattctcgacggcattttgatggtgccgcattttttgttgttgtgcccgacgaggctgtatttcacgttcctccggcctaagttcaatactttgatgctcaaatatttgtcgtgtggtgccaacattggcgattgactcgtggctaatttgttgccgaatttcatccaaattatacctaaaataaattaacaaacaaatgatgatctaattaaggaaattattgaacaataaattgcaattaaatagtaaattttctcattgccatatttaaaataaattttgaaataaatttaaagattattttttaatagggttaggtcccgacccgatgctgagaatttcaaatgtcgtctgttgcgctccaaatcggagaaaattatttttttaatgactttctaatagtttttcctgagaaaatcgttatttcctttttttgactttttataaaaattttatttattttttttgctttagaaaattttagttttttttttacgacccatctatttacgaaaattttgctccccgatgaaggagttgctcccctacatttctaaatttcttcagccagccccaacaaatttagtcggcggattgcctcgccgatccccgacttttctctccccgaaggtcggggcttaaccccatttaaaattaaaaaattattcattttttgcaaaaaaaaaaaatctcaacacaatttaattttctgttcatttttattttaccaaggcgccttttgccggtacaaaatttcacatgcgcgtgcctgtgccatttcttccgggttcttaggccgtgccggaacaaacattcgttttgcatccttttgaagctgtttggacacttcctgctcaatgtatggcttgtgcaattccagctatcaaatttaaaaattaaataatttttattttttcaaagttttataactttggcatacggtgccatccgctcggtctccatcagtgattgatgccgatattgcggaattcggctgtcctaaattaaaggtaaattaaattaggcaaatatcagttttttggataagttgttcaccactggaatcatctctggcgttttatgtgatgccacctgaaaatttgaatgatgtatttgcgaccaaaagttttaatttaaagttttcaaaaaggattaaaaacattttattatcattgaaaattagacaatttttaaatgttccaagcaatcaattgattttttcatgttagcttttaaaaaccaaattcaacaaaaaaacacagtcccatgccttgatccaggccatgataaatttatgagaaaaaaaaaattaaaatttcattttattttattttctttaatacaatttatttcaatttcctaattagccaatcatttataattgaagtggaatatataactttatttaccacattggctctaattagttaatgatccattttaatcatccaatgcttacaagtgaagcagtaagcggatctactgagcgccatttcgggaacaaaaattggcgccgagcaaacagcgctgcgttgacctgttcctcgtactcaaaaaaaatatatgaaattttttaaaaattttacaaaatttttttacttctttttgttcgctctcctcactgatccgctcctcccacattgatcgcattgaagacaaccgacggcccaccagcagctgtgttgcttccctctgctgctgctcataatcagtgttgtcgccttgttgctgatcaagaatgtggctgatccattgactngtgttcaacggaacaattccagcagaagcagcaccagcagcagtaagttgggtttggcaaattgtgctgaaaaaacaatggaaaatattaatattgtaagctaaaaattttataatcaaaattgtttatttaatttttaatttatctctttaggaaaag

SEQ ID NO: 15210 - DNA, 1625 bp, Heterodera glycines
atttcttcgcggcggtcacatgctgtgccatccgtgtcgaatgttggctcgtgtcaggcgggcttgcccccttgaatgttatgtgctgtgacacgtccggactttccatgattgatgacaaattactgcttgacaccatggatgatgtagcggttgaaatgtgatgttgaatatccataatttggaccaaataaatgtgaataaatataaatgaaaatttgtattttttaaacaaatattttttgataattaaaattaaaacaaaaagtgaaaattttgtattttttgataaaaaattataaatttaatgaacggataataattatttgtattttttgatatttagaattaaaaataaaagtcaaaaattatatatttaataaaggagataataattatttctatttaaaaaataaaaattttcaatagtaagaatgaaaataaataattattgttgcctttttaaattgctaaaaatatttttacaaaataaatatatcattatataaaagttaaattcataaaaatgaaaaatcgaaaataaaagaaataaaattcttataccattaaaaaaagaactttttttattatgacaaatctttgtcaaagatttatatattagcaactaaagtctctactggctttatctcttcaactgcagccgatgcttcaaatgtgtgtttgttaagcaaacatcgaacagtgagtgagtggggcttaacttgcagccgaaccggatcagctcagatcggatgtccacagaagcccatttgtattgattggtagcaaaaaaataatacattttttatttcattttttaacttttatatacatattttttgtttttaaaatggtagtatttattgtatttaaagtcgccggtagccaacattacataaatgataatttataattttaaagagttatttttgaaaattttaatcgatctaaatctgtttttttgagtttaaggggggggggggcggcggctaaaaaatgctaatgggcaaaagggggctcaaaaaatgattgattttttttttgtgatgagctattctactaaaataaactttaaataaaaataaaagaaagcttttttaatttaaaccaaatttaatatttacaagaaaatgaatttatttaaaaaatgccgtttaataaatggttttttttcaatagttttaatggaataaaaaatattttttatataattttcgaatgtttcatttttgaaaagtgccacgagcgtataaaataatgaatttgtcatgcaataattccatttccttgcgcaaagcaccaatttgtgtgattttatcatcaattagttgcatttgtgttgcattattgggaagcacctgcagcaagtcatcatgaacatctgtgaatataaatataaattaatctgataaaaaaaaatccttcttgataaaaaaatattttaaacaatttttttattatctaataaaaatggaaaactctgaattttgaaaaatttttttaagccaataagcgttgaaatattctcaggttaagttagtcctataccggggagtatgcctataaaatttggtttggttttattaattatagaaagtattaagttcgataaaactttttaaaat

SEQ ID NO: 15211 - DNA, 3626 bp, Heterodera glycines
  misc_feature (3618)..(3618): n is a, c, g, or t
ttcgttcacaaattcctgctttttcttttcataatcttacttgagtttcttttatttttatttaattttaattctcttttcaatttataaattttctgtcgactaattcccaattttttcgcaattttttgctcaattttattccaaatttttgccgaatattttccctttttcttaattccttctctaattgcgtgaaatttgtgaataatttcgattttttgttgaacatccaactgatcgttctgatcagttgattcattttgatcattttgatgaaaatttgcattttgatcagtctcattttcattttcatctcctccaattattatttcattttgccattcttcgccaaatatttcagcaaaagttggtcgacattttttacacagattaactgacaatgttttgtcagttgaattgtttatgattaagaacacaaatataaaaaggagaaaaagcatcactaaaaaaaataaataattaattaattaataagtttttaatatttttaatatatatatatttgtattaaaattaagctaatttcttcggaaaataattttttatttaatttttaatgaatgtggagaagcattgccaaaaatgcgatcaataagtgaaactgatcatcaatagattttcttaataataaaatattaataaataatattaaaataattaaagccatgaatttcatcataatttcaaatgccatttcgtaattacgtcccattggatgttttcacacttcatcactagggcttcaatttttatttgctgagctccctatggtctgaaatacacgaaaaacaagttgttgttgttttttggtggttgttaaggtacttttcgagttattagggcctattttctaggtttttctttttagagcctaaagcctaaaaaatttaaatttatataaatcataaaatttttacaattatttgtcagtcacaaaacaatcgccggggggggggagggtaattaggcgcgacagacacgaagacaagcaaaaaacactaataatatttattttgattgcgtttaattactcaagcatgttttttggtcaatgttctgtcacatcgaaatatttatacggtgacggaaaagaaaaattttttttcattttctccaattatttcatttgcccatttttcgccaaatatttcagtaaaagttggccgaagttttttacaaagattaactgacaatgttttgtccgttgaattgtttatgattaacaatacaaatataaaaaggcaaaaaagcattaaattataaataattaattaattatttttgaatattttttattaaatatatttgtatttgaagaatcagtcagcccacctaattacctaattaagtgacaaaatgagcggaaaaattaagaaaatgaacacacaatgaaatgtacagagaacagctataaaattaaaataaaatcagaaaaaccacatttttgagtggaactacttattttatttttctattttttattattttatttctcactcacaaaacatttgccgcggggggtaattaggcggtgcggcggacacggaagacaagcaaaagacagtaattaatgataatttatttggttgcatttaattactcaatcatgtttttttggtcgatgttttgtcaaatcgaaatttatatggtggcggaaaagaaaattgggaattttttttttaggggtttttctacaccgaaaacagtaaaaaaaagaaattgacaattttaatttgtattggtcaattaaaaaacaaacatataaaagagggaaaaattataaaaaacaaaaattagaataaaaagcatcatttgaaaccaatacaaataagaaaaacgaaaaattacgaattattttcctttttccatttctttagggtggcaaatccaattttcaaaatgccagcaatttctttgtcacttaaagacggattttctcgcttcattttataataaacattcattttgcgcattttttcttcattggagtatcgaattccatctaacataaataaataaaaaatattaaaaatttaattaaaaatatacttttgcccatttcaatgccaaattcttttttccatttaatgaatgtttctttgtgaatgcccaattctttcgcaaattgcttctgttttccattttcggacgttcttttaatctcgtcaattcgtgcaataaattccttctttttcatttcgtaataattttggtcattttttatatttaatccaatttcttttttccatttgtaaattttctgtcgactaattcccaattttttcgctatttttaactcaaatttattccaaatttttgccgaatatttcccctttttcttaattccttctctaattgcgtgaaatttgtgaataatttcgattttttgttgaacatccaattgatctgtctgatcagttgattcattttgatcattttgatgaaaatttgcattttgatcagtctcattttcattttcatctcctccaattcttatttcattttgccattcttcgccaaatatttcagcaaaagttggtcgacattttttacgcagattaactgacaatgttttgtcagttgaattgtttatgattaagaacacaaatataaaaatgagaaaaagcatcactaaaaaaatataattaataattaattaataagtttttaatatttttaatatatatatttgtattaaaattaagctaatttcttcggaaaataattttttatttaatttttaatgaatgtggagaagcattgccaaaaatgcgatcaatatttatcataatttcacgtggcatttttaaaagaaataaaattgagataattgaagtaaatttgatttgaaaattttcattaatttattagctttaactttgggttttattaaataaaaatttgaaatgtaaaaattttttttaatattttcattgaaatttatttattattaaattgattataaattaaattaaacaagttatttttgaaattcactgaagtcataaaatattacaaggaaaactttttctgtggttgaacaaattacaataagccattttatacaaattttgtaaacattataaaataaaattgttggctaaataaagcaaaaaaaaggaaataagaatagaagatatctcaaaaaaattttgtatccaaaatttatgggatggttcttaatgctttttgaactgagtcttcatagccttatatgtgaaaattaaataaatcaaagcaaaatataagaaaattcgaagcttttttatttaaaagttggttaattgtgtaaaaaaaatcaaagaatttagagagcagcacaccactaatgatttcaaacaaatggtattcaatttaattattcaaccataagaaaagatagaaacccataaaatttgaagaaaaatctaaaaaaactttcattactgagactgaaaaagtggaatgccataaaataagaagaaaagggattttaagcaaagaatatgggatatagaaatccaaaaataaagtggaatgccataaaataaaaagaaaagggattttaagctaagaatagacacattcaaacccgaaatcaagtgaagtgccaantaaaatca

SEQ ID NO: 15212 - DNA, 3226 bp, Heterodera glycines
ctgtaattatatctaattagtagcctaatcataactcgccgattgttcaaatgaccttttcgcgtatttcggacctgcataaacacaaaaatagtgtgctgatcgtgcaccaaaaaggtgtctttatccacagtaaacgcttcccaaaggcagtcatcgtactttggggtgccattgcgttgggttactgtaatgccaaagaactgaccttttggttgctcatggaagaaccctcgcgcggaattttgctcagctgatcatccgcgggtgaataaatgtgcaaatcatgggcatcatctgatcagcagaacatcactttgcactcaagaaatgttgttctccaaataccgtaaaaaatggtccgaattccgtccggttcactgaacaacattcggatttcggacgaatgtttgaagtcgctgacaaaacgaccatgggctaatgagtaataattgaggaagcgcgactaaatgggggggggcaggaggaatgttaatcccctggctttttattggccaatttggcttgtcccttttgacccgtgtggagtaaatgaagaatttttctgatagatcggcgtccaaaatcacatcacgcggattcgtctcgttggagttgggaaaaagcacgtcatttgtcatgtaattatcggagggatcggaatgatcgctttgggaacggatgatctgaacagagggcatttggacaataccaagcgatcagtgatcaaaagtaagagtgataaaatggtaagtgatcaaaagcgattgattaggatggtattaactttgtgcaaatgcacgcgattgtccaactgcgccattacaaaatcgcggttcagcttcatcttcacaatggtcgtcatatagtcatgttcgtacataaatgaagtgccattgcgcttgatttcataaaaccatgctttgctgttcagcacaatggcaatgtgtttggcaccgacggcgattagcgaaggctcaattttgatgttcaaattctgactgggttgctgaagggggaatagatgagctgatcagtttggcattgatcagtcttagcctttggccagatgagttaatcagtttggaaatgatcagttttcgatttggcattggtttttgcaatttgattttcccttacaatttctccgtcttggtaaatgctaatctccgtcaacgacgccaaaacggcgatatgagtggacgaagcggcggcgagcattggcaatttggtcagatatacacaaacggcacccgaccgtgccgaaaccgccgtcatggaaccatcctccgagcacgcgacttcgaccagtccgctgtcgtccgagtcgacgttgaccaagtcggaaatctctcccaaatccaccaagtcgcgtcctttgagcctaaaaagagatcttactcaggcatttcgtggtggcaaattcttacaaattgtcgccgatggaaaacattttgcccagcggctcattaaccgtaatggaggccaaattggttttgtattcctggatggagaacaattcctggctaatagactcagccgaccgctcagctgacaaacagacgataaagccttggtctgatcaaaagaaatgccaatggaaatgaaaaaattgacaaaccaaagccaaccaacaaatttccactgccaaacctaaatttgaaaacaatcgaatccaatcttctgtcagtgccacgccctctctcaccattctgtgcgcaccaaattgccgtatcgctcttggaattgcaaattggtcggtaggctgggattgttcagccgaacgatcatcaaattgcgacgagagatgatggcactgatctgatcggtgggatattttattaccttttcataggttgatcaaacattctccggcattttctcttgcgattggcattccatttgctaattacccccactaattgctctccgccctctcacaaagtcttcctcgcgttcgccggaaaaactgcggaaggtggtgagtttcaactccgcgatttcgccgttgcatgtgaaagtgttcagcgtttcgccctcggcgttgttcatcgtaatcgcagtgtcctccgacgcgagcacaaaaacggtgccctccctattccaaacggctgatctgatcgctttttgatgctttcccatcactggcactttccttttaaagagatcttgcttcaaaattaatgcttttttaaatggcaccgtgaaagtcggtaattgagcagaatgaaattgcctttgttgtccccgacgagtaaaacggacgaattcggagcccaacacaaaacggtcggaagagccctaaagagcggcaaaactcacaaaaacagtgccaaaatgatcaaattgactttgccccggtggacacgtcgacagtgttaatgtgattggtggaacattcgtagacaaccgaaaatggtaaattctgttaaatccacgctcatttgtcagtgccacgggtcggtatttcgacagggaaatcccacagttaattttgtccggtctccagacccctgcccgatttatgaaaatgagattccgccggtcctgcagtttacccaaagtaagccaaaatgctgggactgttcccacgacttttgttcgtcctcggtttttaaaaatgcaattcccgttcccaatcaaactaatgcttttccagcagaaatgttcatcgttcccaaccaaagttgaagcgcatgaatttgcgatggccaaaaggtccccagttgaatcccatttcattgtggtcacttccctaaataaatgattttctgtccaaattgccattctttgcttcgtcgctttactcgttgatgttaaactcttcggtcacttcgctgaatcggttaagcaatcgcaccgttccgctgcttctgttatgatcaaatcacttttcacacaattttccatcttcttttttgacaaaccccgcgatcgcaatgctattgcccccggggcgccattcaaaaaggggggcacccgggccgtacaattgggggttgtgttcgcggaagacgagctaaactaatgagacaattagcagggtgagtaatgaacaaaatgaacaaaaattcaaatggacgaaacggacaaaccttcattcgaagttctgctgatcaacagaaactgttcagaaataaccaaagctaatttgatgaatggttggcatggcgacgaaaggaaaagtggcgaaagcatttgaccatttttgggtgttccttttgta

SEQ ID NO: 15213 - DNA, 1067 bp, Heterodera glycines
  misc_feature (1017)..(1017): n is a, c, g, or t
  misc_feature (1021)..(1022): n is a, c, g, or t
aaaaattgagaggaaaattggaaaattattaggagcaaatcggcaattaatacaaaaatggaaaaaagaattaaatctaaataaaaataaaataaaaaaggaattttatgagatgaaaaagagtgaattcattgaacgatttgatgaatttaaagaattatatggccaaggcaaacagaaagaatttgcgaaggaattgggcatttgtgaagaaacatttttaaaatggaaaaaagaattggcaccaaaataccacaaaagtaagcgaatttctaactttttaaaattatttattattttcagcgctaattaaaccttcaaattatgacaaattaaaaaaagatgaagcaatattttgaaattaaaggaaaattttaattttatttgtttaattaattaaaaaagcaatttacaacatttgttggatatgaagccaattatggtcaattaattattttttttgaattatgtgcccaaaaaaaataaatcattttgagtaaattgctacactttccttttaatttattttttccataaaataaattattttataaattattattttttgcataattatttcttaaaaaatccgagtaaaaaaattgatttccatattatgtatgaattacgtcgtgaatcacatattaatttttaaaatattgttggaaagaaaaataattgcgtaataacatttaatgcgaataaaatattaaataaattcatttaatgcaataaattcaatttccaaaagtaaaaatgaatttgtggcatttattatttattatatttttctttatttttgtaattaaatccggcaaaatccaaccaaattttgaagaaatatttggccaaagatgggacaaaaatgaaagtgaagaaattgtgataataaaaattgaacaaaacgaccaaaaggagcaaaatgaaactacgggcattgatcaaattggtggagaaaatggaacggacccaaatgatcaaccaaaaagaaaaataattttgaaatttgaagcattnattnngaaaaataaagaaaaaggaaatatcaaagaaaagacccaagcaaa

SEQ ID NO: 15214 - DNA, 3009 bp, Heterodera glycines
aatatcaaagaaaagaccaaagcaaaatggagagaaaaattgtaaaattattaggagcaaatctgcaattaatacaaaaatggaaaaatgaattaaatttaaataaaaacaaaattaaaaagcgaatttatgaggagaaaaagcgcaaattcattgaacgatttgatgaatttaaagaattatatggccaaggcaaacagaaagaatttgtgaaggaattgggcatttctgaagcaacattttggaaatggaaaaaagaattggcaccaaattaccataaaagtaaaagaaagaatataattttagtgaaattaaaaatgtaattttttatttaagaacaccataccaatgatgacaaagtgaaaaagatgaagcaatattttgaaattaaagaagcaaacccaaaagtgagtgacgcaataattgccgaaaaattggcaattggattttcaacgatgagaaaatggaaaaaggaatgttcatgaaccatttgatcagtgattttatttgatcatgattttgatgaattatataaggataatttgaaaatttacaaaaatttatggttataaaaatcagccaaaaaaagataaaaagcccaaataaaatttataaaatagagaaaaatctctctccgctatcaaatagtaggggggggggggggtcgacccgactccatacgaacgaagtccaggggggagtcgacgggagtcggagaccaaaattttcgaagtactccagtcatgtaaatcaactttttttttttttgcttttcaaaacggctttttttggggcgcgctttttccaaaaaaaacttttggggaactggaggggggagtccggtggtgccgatagacgacgccgggaaaatttttaaaaattcgagtgcgatttgttaacagatttatgccaaaaaattatcaaattttgcaatttcaagctaaatttttgaattaaaaaacgaaattctatttcgtataaaattacgatatgttactcaatttcgtaaattttttgaattttttataagcaatgattaaattttaaaagattttgttaaattgtttaaattctttttgcctttacaaagtcgcctctctcttaccccttcgtctccgacctttcccaacatttttcacatttttgtcccaaccaatatgaagtcccctcctcttttgggcccctcatatgaacgaagtcaggggggtcgacccccatgatttctctattttgccttggctttcgccattccttcggtcgccgccttggccatttttttcgttgcctcaataaataataatttttaatttctaatcaattaatttagtcaaagcaatatattctgaaataaaaattattttcccatacaaataattcctaatttgaaatgaatttgtggcttttaatatttattatattttgtatttataaaattgagtccagcaaaatcctaccagattttgatgaaatattcggcaaccggtgggacaaaaatgaaacagaagaaaaagcgataaaaattgaacaaaatgagaacacacaatcagcagaagttggtcaaatggatgaagaaatggaaaatgatcaaaaaaatgtcaaaattaatcacaaaattaatgatgaagcaactgatcagcaaaagagagaaattgtcaaaaaatttgatgcaattagagaaaagttgagggaaaaaagaaaatttgattggaaaatccgaaacaaaattgagacaaaaattgcgaaattattaggaacaaatattaattcaatatggaaatggaaaaatgaattaaatttaaataaaaacaaaattaaaaagcgaatttataaggagaaaaagcgcaaattcattgaacgatttgatgaatttaaaggattatatgcccaaggcaaacagaaagaatttgcaaaggaattgggcatttctaaagaaacatttcgaaaatggaaaaaagaattggtgccaaaatatcataaaagtcaaagtaagaatataattttagtgaaattaaaaatgtaatttttatttaagaaaaccctaagaatgatgaaaaattataaaagatgaagcaatattttaaaataaaagaagtaaacccaaaaataagtgacgaaataattgccaaaaaattgggaatttcacgagacacgctgagaaagtggaagaaacgatttgctaaaccactaattgatcagtgattttatttgattgatcatgatgaatcgtcattttattcaatattatcaattattttgtgtctcaaacaattgcctctatctcataattggcggttcttttctttgatgacccctccccctttaattacgctctcggggtcttgctctcgatcactttattcacatcgggcctctccccccgggcagtatctgttcccgagccgaattattgtaggtagagagcctaagaattgtatcattcctttcccggaataaagtcgttactgttgcatactgtattgaaatggtaataatgggatataaaggagtctacagtaagccgagggcattcattgtcatggttttgaaagggaaatacaaaaggatttgacttttaaaataatttggcagcaattcttttttccatttttgtattaattttcgatttgttcctaataattttgcaatttttgtctcaattttgcttaggtgtttcctttcgtatttccttttttctctcaatctttttttgattgcctcaaatttttcgattatttctctcttttgcagatcagttgcttcatcattaatattgtgattaattttgctacttttctggtcatttctcttttgatcaatcgctgcgttttgactttgctcgttttgttcattatgttcaatttttatcatcaatttttctttgctttcttttttctcccatccgtcgccaaatatttcatcaaaattcggtcggattttgccggattcaattacaaaaataaaagatataataaataaaattaaatgccacaaattcatttttacatataa

SEQ ID NO: 15215 - DNA, 1916 bp, Heterodera glycines
ttgatgaaaaatggtatgcgattacgatgtgtttgttctcttgaatgcatttcttgtgattcgtcctcttgatcactatcatattctttttcatcttcatcttcttcttctccggcttcttcatcatcgttttcttgctcttcatcaattgattcattctcttggtcggattctgaaggggaatttggtttgagcgctttcagccttctttttacctccaaatttatatccttaattgtgtcaaggatttcgtcaatttccttaattgtttttaaataattatgcttttcccggaatattttttgtagtttccattcactgttccattctgttttattcatttgccttattaaattttgccatttttggtgcaaaatttttaatttttcaaaatttggttcaattctttgaatgatttctttagttttattaaaaattcgagaacagtcatcaaaattatttttatcatactcgaaattcccatcttctatttttgacttaattttctgtatttcttttattaactagcgggtgcgtgaaccgtcggctatttagctgggaaaaagcgcttcgcgctttcggagcttcgctacctagatttgatcgaattggttggagagatttttttgaatttttaaaaaattattaggggtttttagtccacatcgaggctcacgacgggcgcttcgcgcccgttttttaaatctgttgaacttatacgggcgcttagcgcccgttttttagcttgttaggcgcttcgcgcccgtttttcaatttttgttgggctttgacgggcgcttcgcgcccgtttttaaactttgttgggctttgacgggcgcttcgcgcccgtttctaattttgttgggctcataggggcgcttacaacagtgatcgccccgtttttcaaattttattgggctttggcaggcgcttcgcgcaggtttttaacatttttgttgtgcttatacgggcattagaagaggtacaaaagtgattagaagaggtacaaaagtgataaaagaggtacaaacgtgattagaagaggtacaaaagtgattagaagaggtacaacaacgtgaaagaggtcaacatgatttaaaatgtaataaataagtaattttttttattaaatattaaaaatcgaatgcattttaattttaaattattaataaaaaacaaagttgaaaattaataatatttattttatttaaaatgaaattaattttttaaaagaggtacaacagtgataaaagaggtacaaaagtgattagaagaggtacaaaagtgattagaagaggtacaacagtgattagaagaggtacaacaacgtgaaagaggtcaacatgatttaaaatgtaataaataagtaattttttttattaaatattaaaaatcgaatgcattttaattttaaattattaataaaaaacaaagttgaaaattaataatatttattttatttaaaatgaaattaattttttaaaagaggtacaacagtgataaaagaggtacaaaagtgattagaagaggtacaaaagtgattagaagaggtacaaacgtgattagaagaggtacaaaagtgattagaagaggtacaacagtgattagaagaggtacaacaacgtgaaagaggtcaacatgatttaaaatgtaataaataagtaattttttttattaaatattaaaaatcgaatgcattttaattttaaattattaataaaaaacaaagttgaaaattaataatatttattttatttaaaatgaaattaattttttaaaagaggtacaacagtgataaaagaggtacaaaagtgattagaagaggtacaaaagtgattagaagaggtacaaaagtgattagaagaggtacaaaagtgattagaagaggtacaacagtgattagaagaggtacaaca

SEQ ID NO: 15216 - DNA, 2132 bp, Heterodera glycines
cccccccccccccccaaaaaaaagttttttaaaaaagcgcgtcgcaaaaaaagcgtattttaaaaacaaaaaaagtcgtcgcctggctaaaaatcgcaaaaatctgccaattttcggtgaaaatctgttacaaaatccacttaaatttttaaaattttccccggcggcgcctgacggcaccgccggctcccgcgttcgcgaaatttttttgagaaaaccgcgccgcaaaaaaagaggttttaaaaagcaataaaaaaaaaaaaaggtcgtcaaattgcatggctggaccccttcgctaaaatttcggttgacccccccccccccttttccatgtatgttttgaaaataaggaaaaagtaaaaaattattaaaacattaatttgtctgtttaattagcgggtatgtgaacagttggatctgctgagctgcgacaaagtagagcggttggagccgtttagtgacgcctaaaccaggacgcgtatctgtccttatttataagatttgtccttatttggagggtccaaatcttacaaaataaaaatgtccttatttgtaagatttgtccttatttcgggctattgttcttattttgttcttatttcttaaatatattcaaaattttgaaattttatggcagaatgtcactattttatcaagaaaatataaggtttgcgcaaaatttggttattttttgacaaaaaactgttagcaaatcgcattaaaaattacaaaattttttcccggcggcgcctatcggcgccaccggaccatctccccccttgttccccaaaagtttttgaaaaaacgcaccgcaaaaaaaagtatttttaaaggcaaaaaaagtcgtcgcttggcttttaatacaaaaattggccttttttggtgaaaatctgttaacaaatcagaattaaattacaaaaaaattttccggcggcgcctatcggcaccgccggaccccctcccctcgcacttcccaaaagttttttggaaaaatgcgccgcaaaaaattgttaaaaatctgattttttttatcccgaatgcactaaaattttatgatttgctaatttcctcccaaaaattgttaaaatcgttaatgggagacaaaaatataatatttgatacatttttgatcgaataaattgtaaaaataactgatttgaagcaattttgcgaaatgttcttatttttgaccctaaaatcatattttttggccttgattcttattttgaaaaattttcgatacgcgccctggcctaaacgttcgtttttcctatttcggtgtttttctgttttcctattacccaagggtgcctgttttcttctattttgggatttttagaaactgcggtcatatgtgaatactattagtgaaattgtactatactcctccacattcactgctttcgactctcgatcagcccaaaagtaggagaaaacggattaaacgatacagaaaacggcaattgtcgaaaataaatcttccattaaataaattaggcgcttaacaattagctacttttaaggaatggataaatgtatatttgttttttttgaccaatcccttttatttatcgttaaatttccatccgaaacaaaaagcatgattatgggctgctaatcagtttgaacttttcccacgtgtcaatcttcgctctgttcgcaattagtgccgcgttcggctggctgagatcggcacacacaaatcggccattagccaccgcttggaatgcgacggagtcatccgaattttgaatgaggcgaaatttctcccatctgtcttttcgttgtctgtcggcgttcaatttggcccaatgcaaaaggtcagcacacacgaaattgccattggccattgagcgaagggacactgtgccgtcatcgttgatgaccatcagaaaccgctcccaatcgccggcactttccgctcgtgccgccaaagagagtgagtcggcattccatgccgaaataaatttgttgttggcaaatgcgtggatgaaaattggcttcctaaaagcttcctcattttaacggctgatgtaagggaaacaattaaaaataaaatttaaaaagcaactaacccgtcatcgcttttccgtttatttttctgctgcgaaaaatgctcatcaactgaaaaa

SEQ ID NO: 15217 - DNA, 1512 bp, Heterodera glycines
tgcgttttaaggctttggatggttccgtcctacagccatttggccacttcggtcccgggtccataactcggcccaaagtggtttccgccaaaaaattctttcggattcgtgcattacagaccgataagcatcgaatgatcgataatttggtgaggcactagtattcttcaattttacccactggcccggaaagccagagacgccggttcaaagccggcccgccccatagttttccctcaaaggcttcccaaggtcttcatatgttaagcctcattatgctaattggtttcattatgctaattggtttcacttcgtcgcaatgggcaaaaggcgcagcgtttctttgaccaccgcttcggtgtatttcaattggctcagctgctcataagttgggtccttgaaaacgggaatttatttattcaaatttctacacttctcaaggacgacacctcgtcgaagcacaccgagtcaatttcctcttggactttctcttgcacttccgcgtgaagggccaacgcgtggcaaaccaaactcagcgtatttgcgcttgtgtcgaagctgtacagttcacgtttagcgtaattggtggattaatggagattgggagacaattagagaaaatacggcggtaaccaatttttggttcaagaaatttaagaggccgtgaatttgggaattttttgggccttcgtaataccacaaacccggcaagcagaaacatcaaaagctgcgacgtaatctcttccaaagtgcaccgctttgctactctctgaaaatggttgttgtcttaacaagaaaaattaaaaaaatctcgtttcttgactctcaactcgagaaaagtctcggggtttttttggtcttggtctcgaggtcaagtctttgtttcggaaaataaaattataaaaaaaattggttaggaaaagcctaaaaaaattttaaatttgtagaaaattttaatccatttttaactaaacaagaaaaatttaaaaaaatctcggtcccgagtctctggttttttgggtctcggtctcaagtctcgggaaattgttggtctagagcaacattaataaataccttattattcaattttaatttttctggatttttcttttcgttttagagaattgaaacactgatcccgaaagcccactattttgctcgagtcgagaaggttcgagaccaatactctcgacttgactactagcgtcaaccagggatggcacggaattccgatttccgacttccgacattttcggggtcggaattccgaccccgaaatttttgatgaaaagtcggaaaattttcttctgataacaaaaacgcaaaattacaaaattttcccggcagcgcccaagcaaaatattcaaataaccaaaaacatttttgaaacaccttatacttggttaagaatttagaaaattctttattatattttatattttttgaaaaatttatattttttgaaaaatttccgatttccgacgtttttggggtcaaaattccgatttccga

SEQ ID NO: 15218 - DNA, 1621 bp, Heterodera glycines
  misc_feature (1381)..(1381): n is a, c, g, or t
  misc_feature (1498)..(1498): n is a, c, g, or t
cacgaattaaaaaaggcttttccatgtttgacgttgctttgataaatatgtaattaagcaacaaaaaaagaggaaaaattttcttatgaaaagcctcaaaaaatgaatttaaattataaagagttataatattttgaaaaaatctcgagtttcggctcgagaaaagtcttggatcttttttttgctgaggtcaagtctttttctcgtgaatttccatctagaacattatacatattaaagactaaatcattcatttatatttttctgtatcaaattagagaattgaaacccggatccttggaagccccagtattttgctcgagtcgagaaggttcgagaccaagactctcgacttcactaccgccaccaaccccttcccccttcctctcttttcccacctgctgaagtgcccttttacttggcattgcttcaccctcgttttggcattaataccttctttttatacaataactttgttgatgttcgaacaaaccctatgtttttggtatcattcgaaagcacaaaggataaagaagcaaaaatatataaaatctcagcgtttaggcaattgccaaaaagatttgattaattaattaattgttgtttggtcgattggactcataaagtgcaatagagccgaacttttctgtatcgaatttagaattgaaacgttcatcccgaaaagtattttgctcgagtcgagaaggttcgagaccaagactctcgaacttgactactagcgccaaccccttcccccttcctctctctccccacctgaagtgccgttttgcttagcattgcttcgccctcgttttggcattgctccgtcagctgctgctgttcgttctgttccgtctccaaaaacaggtcaatgaagtcgactttcgctctctgctgctgctgttgttctccgctttccctcagctttttgcgtgcctttaattcgtccattagctgcttcctcagtataattagcgggtctttgcgcaatattccgctccaactgatgaacggttccaaaaaatgaatgccgaaccacgggaaagcgaagccgacgtaatcgaacggagtgttattgtatttttgcatcgactcaatcgccaggtgtgccatttcagtctcaaactgtcgcgactcgcgctgccccaacgccacgcgggcgatcacatcgaaactcatttctacgaaatgcctacaaaaacggagggggggggggtaaataaattttgactcaaaacattgatggatttaattgatataatatccgaataacttggaacagaagcacccaatcaaagcacagtttgtccctaccgtaaccgtagggtcgtgaggcaaaaaggtatggtatacggtatgttaaggttggcgactttagaanaagttacagctaatagagaacatttatttgttagtgcaattgaatgatttcaaaaataaaaatttagttactcttctctttagcaaaataatgtttggcaattttctatttgatggntttgagaaacgtccgtcccatggcaccctccgaacggtgcgaatcagggatggtgcaaaaagaaaaataaaagcgaaaaaagcgaaaccaaataaaaaagcgaaagcgaaatgcccaaaaagc

SEQ ID NO: 15219 - DNA, 1530 bp, Heterodera glycines
aaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaaggaaaaaaatagttatttctgggactttttcagaaatcagaattaattctcccattgtggcccaaatttttaggcccccacccacagccccctgcttttcccagttttaaggcttggaatttgcaaaaaattcaaaacttcaaaaaaataattcaaaaatctcttaaatttttttgaacccaattcaaaaaaggaaaaaaatttggcgtcaaaaaa

SEQ ID NO: 15220 - DNA, 1744 bp, Heterodera glycines
tcactctccgccccctgctgatcagaccgatcaccctcccccttgctgatcagaccgatcactctccgccccctgctgatcagaccgatcaccctcccccttgctgatcaaaccgatcaccctttccccttggtgatcagactgatcatctccgcctcccccgtcagttactcacccggtcagcaactcccacagtacgacaccgtaactccatacatcgacgcgttcattgcatggcttgttggtcaacatttcgggcgacatctgtggtgtgaaaaattaaattaaattaatttaaaaaataaaataaataaaaataaaataaatattagacccgaaattttggaaaatcagaaaagatcagatcagtatcatgttctggaccaaaatagaaaaatgaaaaagtaaattcaaaaataatatttgtatgggtaaaaaaattcgtatgatcctctcaaaattactcgaatcacaggatcaaaaagcggaaattgacaaaacccagtcccgtgtttcaatctcaacaaataattatttttatttaatgaatagaaacagaaaattaattagttaattaaaaaaattatttattaattaaaaaactaacgctattaatgaataaatattttaaatgtttattttttttaatttttaaaaattaaaaaaatattacaatttcattttctgtaattattcacttcaaattttacccattgtgaggtgccgcaaacgctcatcacaacgctggccatgccttgcaaattttgggtttgcgagttaagccttaaaaaaattttcaaaaaatttctttgaaatccccctaaaataaaagccaagcccacctctgatcccagctgtacagggagccaaaatcgcaaattttgacggtgttatttttgtcgatgagaatgttgggcgatttgagatcacggtgcacaattttcaaggagtgcaagtagcacataccttcagcaatttgaacggaacaattgatgaacatcgactgaaaaaatgaaaaattgaaatattttttaaaaataatttttgctttttagggttcgattttttgaaaaaaaggctggaactgaattccatgcttaaccttggcctggatttttggaaaaagatgcaagaaaaactaggttcaggaaaaatccaggcttgtcatggcctcggtcggattccatgttagagctggacctgaattttccggaaaaaacccagaaaatccagttccaaattttttttttgttaaatcataaaaattgcaattaattttaatgaattaattcaataaattgctaacgaacaaaaatttaaatttttaactttatgaaaaattaattatttttaggttatcacctaataattattactttaattcaatatcaaaaattataattcctttttataaagtgacattctctcaacaatcaaacaatttaaaatttttatttaaataataaatttttaattattttaaaattttaccttcgaaatgttcggatttcgccgtaagtgctcaaataagctgcccttttcacagtattccatcacaatgcacgggaaatgctctttcgtacaaattcctctggaacaacaatttaaatttattttttggcgcctttcccaaacaaaatgccaaacaaagttttgatgacattggcatgctcaaggctgcacaaccgtttgatgtccacctcggaggtacggttcaactttttgagcgcaatcattggccacg

SEQ ID NO: 15221 - DNA, 2224 bp, Heterodera glycines
ttttaattaatttttatggtaaagaaaaaaataaaaaaaaaacttaaaaaaattggaaaattttgggtaatgcgcgatcgcaattcgcggcaatttttttgcgcgatccgcccccgcggcaaatgaaatccgcgggatcatgactatatactttggatttttaaggcgcgaaaaaggcttggtttttttgcccaccatctatttaaaatttaaaaaacgtcaacaaaaagcgcacgccatgcggatccattcgattatattttggcccaaagtgttgttttttaatgactcccaattccttgcagtgattccgacataattggaaaaacaaatcctaagaaaatgaaaaatttatctccaaaatttatttatttatttcttgacaagaatttattttaaaatttttttagctcaatactgatttgacctaatttttttacttttttgaataaattttgtcttttacacccctaaattcggaactttttggcacctattttgggggttttttagaacctaaaacttacctattttggcagtttttagcacgccttagatatcagtccttaggtccacagagtttgtcctccgtctatcgaacgagtttggcactcgccgcaccgtcgtattgtcatcgccactgtcgcccaaataggtgacgctcgccggcgatgcgctggacagggaaatggtagacaacgatggcgagcagttcagcccagccgccgagtccacaacagtcgcctcctccaccgacggcggcggcggcggcgacttcacccagtcgccgtcctcgctggtggtgttgtgattactgttgtggattacggtagtgttgttactgtcaatttcggtgttgttgttattgttactgttgctgttgttgccactactgctatttgtgcccgtgacgagagatggtgcgttacccgtgacggccatttgggtaattaagggtaattaggctgaggtgaaaagattcatagatggttttttcgcagtttgaaactatttttagctaaattttaagtcaaaattaattgaatttaaaaaaaaccgccgagggttaattaaaatcaattattaataatcaatttaaagtaaaaggttgatggttgggtttttgaccaggtcgagactcttgacatatatttgagtcgaacaatttaattgtcagggtaatgatatttttaaaaaatgattaatatgccttttgggaaggaataattaaaattaataatcaattacccctccccccccccccgacagccccccaataatcaattaatgtaaaaaatgacaaataaatcgatgaaattgattgggtgaacaaacaaatctaagtgctgagaaaatttgtggtttaaaaattaaattatcacaatattgccaatcattcagccaattttcattcaaaaagttaaatttttaaacctcaataatttaaaaaaaattttccttgaaatgttaaaattgcaattaaattttcaattaaattaaattgcatttgttcggtttctcctgcgggggttggcaagagggggctgatggaataattagtgatcaacaaaaaataaaatcggcgaatttgtggcaaattgatcaaattaaatgagacaaattgtcgagccaatcaatcttctagattcaatttagaaaaaatttcttactcaattaattatttgtttcacaatagaagtcgaccctgctctatcgaatggtaccaaatttatacccattttccgagttacagttcgcgaggttcccttgtaagtcccgaattcaaaaatgtcatggcaacgcatatacatatatcttgggcaatttgtaaacaaattttttttataattccaaaaaaactagatttttcataaaaatttaaaaacttgaaaagtaagcaaaaataaaaattaaattaaaacaaaaaattgattatgtactaataattagtcaattatacggtgctaggtcgatccacaaaaaaaactcagtgtgggcgatgcgaaaaaaaaaactcaatgattgataaaataattaaatttaataatgcgataactaaatgcaaataaacattttatccatcaattatatggaagtatttcaaatttttacccctacaatgaataaaagggttagtaaattattattttatttaaaattagtactattctattaaattcttatgaggggtacaagaagaaggtcgacattttccgcccataga

SEQ ID NO: 15222 - DNA, 2370 bp, Heterodera glycines
gggaggggggggggggggggggaggggaaggccgaaaatgagtcatgccttcttccacgtggggaaagtgggacaaaaacgaaacggacagaaaggggggagacgggggaatgattaaattggccaaaggtttgcaaatgaataattaattcgtcgcggagggctcagaataattgcacgggatgagcacaacactttcgaaccgaatgacgcgacgaggcaaacgacggaagccatggcgacaatgccaaagaataaataataaattgcggagagtgccggcaaaagcgacgaattcatttggcggatggaatgcccaaatttgatttgtgtaaacgtaacggaacagacccaactcaacgacgaattcgatgcatggaaaaggataaaggcacaatcgacgggggagggaattcaaacaaagtcgaaagccaatccaaaattggagttgcgattctttcgatttgattgtttccatagtgcggaattggtgtaattatatggaaactaataagtatttttaaaaaggatcaagaagcatttacttcttgtggatttataattaaaattagggttatacgggcacgggtgcccgaccgagcaagacccggacggccggctttttcggtaagggaaaggaaaactagaaaattaataatatatatttttttttaattctgtaaaatgatagtttatacaaattatatttaaatataattaaaagactgaacaaatcacattcacttcgtttggctaattttcggagtccatgaaaaatccgtgggccaatccggcacgggaaacaatggcatttcctcggcgccgttttgctgctgcacgtccattagtcggatttgaatttccatgctaagcaaacggtcgagctgccacaaacggtgaccgttcagtttcgacgacttttccgtttggcattttgcccacctcttctctgatggaatgcctctgaagggccttttggggccaccgcaaactttggattccctcaagccattgcaaaaactccgactcgtcccctccggcggaacacaaaaaataatcggtgtcttccgcaagagacggcggagagtccaactcgagacaaagcccaaaacttaggggggggggggctggaaagacgggaaaagcacgaaagaacggaccgaagcagtgattggatggcctttttgtgcactttggccccaaattgttggccaagtcggacagtcaaatcattgccgtggtaaacagcgcgaatttgagaaacggccaattttctaaaggaccaataaataaacaaaacattttcggaaatcaagttgtgaatgttcttaattttcataacaaattgtatcaatctttccaaaatttcttgttacagaatttttctgggtttcgtttttcaaaaattctttttttcccttgaattttcgtgctccgggggaatccccaaatgccttcgattcaatttcttcttctatacttttgtgtgtccaatgccaattccgaatgctttccgccgcccatccgacagtcccaaaagtgaaaatgcctttgtctgtcgtccagtcgccaaaaccaaaagtgactgcaaaggctttgctgatgcgaactctgtttaaaaggtcaatcaaaaaagaaagccccgaagagattcgattttatgagaacatttgcgctgttttgggcgttcgaattgttcactgtcagctgattactgttgagcatttgtgggaaaagacgtcgaaaggtgagacccttcttaagaaagttaatgcgcaattggaggaccatccgttcgaattggggccgcaaatggacacggagaggccgaaagggggggggggggaaatggataaatgaatggaaaaatgaaaagaccgggaaaagtccatgaaatgtatgggattgtctgatgaactgactgaatttgtgcgccggacagctccaactcttccctggccatttcctcccttttccaaattctttgcatgccaaaatacgaatatttcttcctcaacaattccccctccaatcgttccatcgtttcttcgtcctccgccattgccctttccatttggtcttgcacaacactcaaaacctttgccaggtcatccatcctataataaatcagtgattgtgaacaattgccgtcgtccgtgaaaatgccgccccccccccggcactttgcgtgcatttcgccccacgtccgttgaaagagttcgaccaaaatttgaaaaagcgcgtaaaaagggcgctcatttttcagaacaaaacgccaaaaaggcaaatggcaagggccgatgagagaagctgaaagaacacaaaacaaagaagtaaaaaaatgagaaaagcgccaaacccgaaaaaggg

SEQ ID NO: 15223 - DNA, 457 bp, Heterodera glycines
gaagcaattggatggcaaaaacgcactccaaaagggcacagacggccaacgacccggggggcgtggaaagggccaaacggcaaaattcggaacggtcggaaccccaaacagaaacgacggattggggagcagcatcgcaattggtgaacccattctgaaatcggaatttggattatttgaaaagataaaacccaccaaaacgtaagcgatttctttgtccgacggaattcgcagcgaaagtgcgcggacctcaaaagaaacgaacgattcgcaagcgaagcactaaacgaaaggaatgacctcgtcgaagcgaatgtgctgaagacgacccaattgttggcaaaggccggaagaagccgaggccaacgaattgggctgacttttgcgcgtcttttccaacgttcgcccaattgccacaatgaatgggcgttcatggagaatctgacaaaacggggaa

SEQ ID NO: 15224 - DNA, 2250 bp, Heterodera glycines
gctcaagtcggcaccattcagggaattggtcaaacatttgttcaacaactaaaagtctcagttggaaacactgaaatttacgacagcggaaatttgtacccatataaggtttacattacgaacactttcgtttccgatgaacgtcaaaaaaagcttcctcgcttcaactggtcactatgcgacacgcacacacgacagcgtcgctgatgagggctttaaagctcggtgtaaaatttttgagggtgggaagcgagcccaatttctttcacgtctggactttgacctgggaaaccaagaactttatttgttgaacaatttggatcttttatttacaatttacaaagctcgtgacactttcatcatgcagacattgaaagcagacgatactaccagataccgtgttagagtccatgacgtaaaactgtatgctaaaatgattgatgttcagtcatctttgaatttaagtatctacaaaacgcttgaaaaacaaccagccacatatgcagtgcgaaaaactgaaatcaaatcatgctttataagtgaaggtaggtttgaaattgactacaatgtattcagtgcaacaattcctcgacgtatgacaatcgcacttgtcgcaaacggggcatttaacggaaattatgctctctctccatttaattttaaaccgtttgacattcgagacattgcagtgtatgctggaggcatgatttacccaattgttccatacaagcttgactttgccaaagatatttttgtccgtccttttgttgacatgtatgaggcacttggcatggctaattcagagcgttctttcgacatcacaaaagagcaattcaaatctggttggaccttttttgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaattaactgtataaataagatgcataatgcgaaaaatgccaccataaaaatggccttcttaaacactacagtcaacgccagtttaaagccagagatacaagtactaacatttgaaaacaaaagcgttcatcctaacctcctcgtgcaacttctattgcttgcccattatctcattgcttttcccgttttcattttatgctggtattctttgataaattttcttaagagaagaggacatatttctcagcgtgatgccaatgagatgatggatgatttgcgaaattaccaattaccaaaaaattcatcaattatttttccaagtttatcaataaagaaatgattaacgcacaaatattcaaatttttttcacatgatcccctttcagccttgatgaagatcaaaactaaatttaggagtgctttttccttcttttgaaaaattagggttacgtgacaaacgcatatgggccaagcttttccaacaacgttaattggattgttatgaggagagttgacgatccaccactcggatagagccaactgcaaatctctctgtgctcattacgaaaaattgtcaacgtgcaatcctgtctcatggtgaattcacgaagaaaaaacaaaattgcaatcacatcaagaccattttggagtttgtgtctcatcatcttcaacaataaaatgcatttttaatggatttttaaaaaagtaaaggacacattaaatcctttttttttgaagctcacaacaaaatgaatccgttatctatctatctatctatctatctctctctctctctcaacttttctttgtttttttggtagcaatctcatcaacgtcatcatcatcatcatctttttcttttggcacatcactgtcattttttccagggcacttcttgaacaaattgacaatccaatcaaatccagtgtaagtctgactgttcgcctatgttgtggtttgtcaaatatgtaataaattgcaaaaaaaaaacaaccttaatgttgactttcgcaattatcttcacagcaatcaaatcgtccaaatgtttcgcaaggctctccggctccttctccttggcgagcaattcagcagctttcattcccaaaaactcttcggcaacactcgaaaacatggtgacacgttgagcaatgtctgcttgttcaacatcctgcagcagaagacggacaaacaccgtgtggatg

SEQ ID NO: 15225 - DNA, 5109 bp, Heterodera glycines
  misc_feature (1223)..(1223): n is a, c, g, or t
  misc_feature (1293)..(1293): n is a, c, g, or t
  misc_feature (1318)..(1318): n is a, c, g, or t
  misc_feature (1374)..(1374): n is a, c, g, or t
agatgaaaccctaaaaatggacaaatatagaacaataaataatatgacagtgaacttaaaaagtggtatttaccaagagcactgagcgaaaacttgaattttccaaaattgatgccaatacgaagccactaaaaagtaaaaattatgtagaaaaaacatccaaatttaaacatttaccaaaaggaaaaggatgataagcggcgaagcacacaaaacagaaaacatgtcagaaactagaacagatggtcggggttcagggctgcggaaggtgtgagaaatttccggcagaagatcgtaattgacatgagacgattttggcgacatcgaagcaacaaaaataaatgtacgacctaaaaatgccaaaaatcacacaagccttattctgacagaaacactaacaaaaaagtacctaagtccaagccaaaccccaaaaaactacgtaggttttattttcagcctttcgcagatttaaataaaaatacataatgccacattaaacttggcatttaaaagaagcactaattcaaatgatcagtcgaaagcaaaacaacaaatggacaaattgcttgggaaaatttttaaacgaaaacaaaattgaaagaggtaaattgaaattgaaattaggtacatatgtgtcatttattctttttttttattggtaatgcattttcaattacctaataaagtaatgcattaattttagtcattttttcgcatttttatatgttttcgttattcccgtctgctctttttttgcttctccaccacattgacatttattcgactgaccaaattgaggataagaaaaatagccacaaggaattggataccgaaatccgtacgctcttcaacgaaacaaaagtacggattttgattctttgggtttctttgaaatacaaaacaatcaattagagttcgacatttttaaaaaagcctggacctggattccttccatgttggcctggacctttggacaaaaaccctgaaaaacgccaggtcctaagaaaaatcccggttgaaaaaaaggacatgtacctggaaacaaggaaaacccatgcctacaaactctataaccatcaaaaagcgtgttaaatacatttaggattatattccagccgcttttcgactacatgacgacgaattgctgtgcaaatgcaatcattttgcgacctgcggtaaggtaacaattttttttttgcttgttttatttttattttccttanatttctttttcttgttgtcaggaaggtgtggcgagttatgttggtgaacagtacatggacgtgtgccggnctggtcgaggcggatactgtagtcnggtagtgtttttgaacgcggatggcacatttcggggagtcatcacattcgtgagtntcctaaaaagtttttatataggtatttttgaagagcgattgaaaatttaacaaccaagttttcccagtttatttatgatgaaaaatttgcagaaggagggaccaactccaattaacaactaattttaaatttttggttgaaccaaaaaaaaattgactaattttttgggggaagtggttggggaatttggtttttggggtttaaaatttaaatttccgggcctttttttttcgaattttgcaattcaaaaaggcccaaaaaaaaaattttaaaaacaaaaaaaaccttaaattggggccttaaacagggggattttttcttttttttttttttttttttatattttgttaaaaaagaaaaaaacccggcccccgggaagatatcccttttccctccccaaaaattccccccccccccccccgggggaaaaaaaaggggggggggggggggggggggcggggcaattttttttttcaccacccccacccaaaaaaaaaaaaataaaatttttttttttttttttttttgttttttttttttttttttttttttttttttttttttaaaaaaaaaaaaaaaaaaataaaaaaaaaaaaaaaaaaaaaaaaaaaatttcaattaaacactcaaaattttcacgaatcaatttttaaaaaaagggtttattttgggaaaaaaaaaaaattattttgcttgttttttggaagaaaaatgaattttctcttaaaaaaaaaataaaatttttttatgtaacaacgcaactccttttctttaaggtgaccaaaaattcatttttggacaaacaaatttaattatcccacataaatgtggcccatgtaaatataaacagaaaattatttataagttcattttttaatgctgaaaaaggaaaagtttgtttcaattgttggcgatggaaattgtttttatcgtacactttctttattactgagtggtgatgacaattataatacggctaaagaaatacacctagatttaatggaatttatctggggactcttgcggctattgcaattatttcggcaattgttctaactccaataatacttggttcggttgcaaccggcattgtaattggttatactttaaaagatggaagtggtcgtgaatgtatgaatataaatttaaatttaaaaataataaataaaatgataattaaaatattaattaataatttaattataaatgtggaggtaaaacagaaaattaattgttgattggtgattaaaaatgagagtttaggaattaatctcatgatcaagcagtgaaaatggtgaaaaatcattgctaagaatgctctaaaatgagtagatgtctacggatgcttggaagtggtgtttatgaaatgatcaagtaagtgtgtgagtgatcgtgtgattagggacgagtgagtgattaggaacgagtgtgtgatcaaagagagacatagagagatcggtgtgagtgagtgttaacagagagtaagtgatcagaaaatgatcagagtaagagttagaggtcagatagtgattgggaactaataaatgatcaaagagaaaaaataagtgatcacaagttagtgtgaaagggtatgtgagtaagtgattgcgtgatcagaaaaataatcagtgtgtgagtgttcacatgtgagagagagtgatcgggatgagtgtgatcataaagaatgaatgattagaaaatgatcagagtgagtgaatgtagattagagtatgattaaaagtgagaatgagtcattataaagtgaaagagtgattacaagtgagagtatgatcaaagagagatagaagagttatcagtgtgcgagtgagagtgtgattgaagtagtgagggattacaaataaatgattgcagaaagagagagagtaattggggtgatcagagtaagaagtgtgtgatattgagtgatcagaagctgccagagtgggagtgagtgatcagaagatgataagtaggattgagtgatcataatatgatcagactaggacaaagtgaccaaaagtgatcgggatcaaaaattatcaaaatgatcagataaactgtgcgaatgcgtgtgaatcatcggaaagagaaaatatactcagaaaatgatcagagtgagaatgagtgatcagaatgatcagaagatgatcagagtgcgaatgaatgatcaaaataacaagcggcccctatatcttaatgattagtaggtgttgtgatggggcttgtgagtgagcatgtgtttgtgtatgagtgatcgtgttaatgtgcttatgcgtgcacgtgcatgtgtgtatgcgcatttacatttagatgtgcatgtgtgtgcgtgtatgtgcgtaggtgcatgcgggcgtgcgggcgtgggtatgtgtgtgcgtgcgtgtgtgtgtgcatgcgtgagtgtgtggtgttgttaaaattttggtgcaaagtgcatgtgatgtgcctgaaagtgtaggtgcaggtggttgttaagtgcaaatgtgtgcgtgttttcggtgcagggcagacacaagattaggtgaaaatgtgtgttatgtgcacgcgttatgggtctaggcaggtatgtgtgggtgtgtcaggtacaggtgcaagtgtgtttctttgcaactgcaggtgaaatacaagttaaatgcaaatgcatgtggttgtgtgtgtgctatggcgtaggtaggtgtgtgtgggtgtgtcaggtgcaggtgcaagtgtgtttgtttgcaggttcatgcgttcagcgtatgtgcaaatgctgtgcgtgtgagtgtatttgtgcaatgtgtgagtgtctgcatgtgtaggtgcagatacgtaaggtgaaaatgcatatgtgtgagtgtatttttggtgcaggcatgtgtgtgtggtcaaatgcaggtgcaagtgtgtttgtttgcatttgcatgcgttccgtgtacgtacatgcgtgcgttctcatgtggtgttgtgtaaagttaatgcaaagacaagtgcgatgtgtgtgcctggaagtataagtgtaggtgcatgtcaggtgcaaatgtgtgtatgtcagatacaggtgcaagtgtgtttgtttgcaggtgcaggtaaaattgttgttttggtatgtaattgtaggtattcatgtccaaaagataggtaccaaaaagcaaaatacacataaaaataaggagtttcatatattttttgcaaaaaaaatgaaaatatggtaaaaagtagaaatgaatatataaaacaaaaatgatcaaaaatgcaaaaataaaatgaataaaaataaaattttaacaaaaatttattataatttaaaatctccgggaagtttcgctgggattcaaaaaattttaaatgaggccaaaaattgacccggaaattacgaccgatgacgtaaataaattcctagaaaaacagagaacatacacgattcacaaacccataagaaaaaaattcccgagactaaagacgataccgagcggcttccataccgattggcagtgcgatttgtgcatatttgaccagttgaaaaagcataacgacggttacaaatatctgttggtatgcatcgacgtgctgagtcgaatgatcttcagtgcaccgagccaagtcaaagaagagtgaggacgatgattgaggcttttgatcgggtgttcgaaaagtctaaaattatcccgatgaaaatatatagtgacggtgggcttgaattccaagcaggaaaaaatgaaaaaatattttgaggaaaaattcatcatcaaaaatgta

SEQ ID NO: 15226 - DNA, 3950 bp, Heterodera glycines
cagctgaactaccgatactgtattctccaaattgttcgattaaaaggaccaattaccgttcaattgctccattaatattcctctcggggaagcttcttctctatctcaattgcataaaatgcgccgttcgaaagtcttcctccggtcatgtgtttgattacgagaaatgttgcggacttttttttgggatgtcactctcgagtagcgaatcgacaaaaatctctattgggtctcgttctcgaatctcagggccccggttaagtctcgattcgagtattattttattaccattttataaattatttaacacatttttcactcgctcaccgtaaaaaattcgtctccgtcccggtagaagaaaatggtcttggcccgaaagttattatccgcggcagcaagcgagcgggacgacacttccttttggcttcgggaacgagcgagaattatctattaagtgtgattagataagtaattaaaattaaattgcatcttttttaaaggttcgtaattattctctaagtcaaccaatttttttagtcttttttaagctctgctaattattctgtcactatcagttaattacccaatccattagtttaatcatcacacaatttatcacaaccccattagtcactgcactaatctcccaattattgaccattgatttgcacactttgccagccgctggcgaagtaaccggcacgtttggaagagggcgatttgcagcagcaggaaatgggaacagattgggcaggagagaacctaaaaatgaataaaatgcattttaataagcacagtattaatgatcagaaaacaccatagatggctttaattgtccaacacaactaccgtacccttgttgacccgcccattttacagtaccctctagtgaatggcgcacaatttggctgcgtctacgcttctgctgttgtcgcgttttctgcgctctttttgagcgattaatattactaatatcgtcgccgtccaacaatggcagtgacggcttcgttgaatgaagggtgttttctgcaaattcaagaataattttacaaagaatttttttgttaattattttttagcaaaaaacgagagccgagaccgagaaaaagaaatgagtgagcctaggagtgtctattcttaacaaaatcgtaaaatttaaaaatctttgcggaacagattggcacttcgtacgcattttttttttgaattttttcgttaaaaatccggtaatagtatgcgtaccaggtgttttcgacagtgattggtttcgaaagcagttgatttcgaaagtactttttaattaattttctacatgatttattgtacacatgaatttatatgaatatacaatttgcatatacaaaatttataattgaagtaagtaataaaaaataagagttgtatgatttttttgcaaaaaatttatcgctttcactttttctatacaaatatctctcctgctgtaatgtagtcaaaaatacaacaaatttcgtagataagattctcaaatcgtgtgggaaaatctgctaactaatgccgggtttgtgtgccaaaattcaaatctgcaggctcttaagcaagaattcgaaaatctcgaacccctctgcaagtataagagccatgttcttatcattttaattgtcacaatttaacgagacttatgccatatagaacaaatttttttaaaataagctttactgtcgaaatcaatcattgtcgaaaccaacactgtcgagatccggtctacctcagttgggcgcgcacggttgggcgccagcatgttttcccactataacttttttcattgtaatccaaatccaacattgttggtatcattcgaaagcttaatatgtttagaaactttttctaagatattgcttcgcgatcagacaattattaaaaaagttataaacaaaaattgcaaaaaatcgaaatttttgaattttttccaggcgtgaaaaacttttcgcttttagtaaggctaatagagcatgtaagagctttcgaatgataccaagattgttggatttggatgccaaagaaaaaagcttaagtggaaaaacgagctggcgccgaaacaccggcgccgaaacgccagcgccgaaacgcgtgggtcccccccccccctctttctgcttaatttagtcttttccctcgtgccttcgcttccactttctctgttacgattctttgcggctccctctttcccatgccgccctttctctccctctctctctcctctttctcgtcctgaatttgtttcttctttcctaattacttattgctttcttctcccatctattgcttcatcttttcttcctcattatgctccccgtctcctttctctctccctctccttctctcttctcttttttctctctcactctttgctcaatttctctctatcctctctctctttctcaatccctttatctctctctctttctttctttgtttctttcttctttcctaattgcttattgctttgcttcatctatcttttcttcctcattatcccccccccgtctcccactctttctctttcgcttctttaaatgtaaattgttgctaatataaattttctgcttcccctacccgtcgccttctatgctttcctttttctcatctgctgattattccaacataaattatagtccccctggcgttttacaaaatcacagtgcattaatttttcggcgttttactccattttaatattttgtaattcgtcacattttcttctcttctcagcggtcacattttcagttagatttttcctttacgttcatttattttgaacatttacactttatatataataacaaaactatgtaaggttttttaacacaataattttcttatttaattaataacgaatctttgttttgcattttttataattagctaaattaggaatattggtgaaattttgaagttccaattcctaagtgtttctgaagtcctaatcggatcttcttttctgttaaaatgcatgaaaaaggctaataaaacaattataattagtcacaataaatgcttcttaattcattcattcatttagccatgctctgtccttctcttctctgctttcaacttaatttgttttgtttgcgattcctcgtgtcttttccctcatttttcatcatcatttgacaattattccacgaaaaactccgtggttatcattctctttatcatttgtgaactttttgtcctcttttcaaacgataaaattgtccgaatttggcggcggaaattaaaaaatgataagaaatgggcgaagaattaatttcattttccattaattcataagtgccgaaaataagcggcttatttttctgtttttaaattatgcctttcctctaattgattctcagataagcccccccccaactttccgctaattttaaccacctttttctgatctccgattcttccgccgattgtccactgattgttaatgtcaatcactaatcttgaaaacaacaatcatatctgtgccataataaggggcaaaaggtcaaatgatgtggtggattggttgtctttgtctttgcttgggttcgtctctctccccctcccccttttccccctcttccctcccctcccctttccgtcttcagacgatcattgcccctcccctccgcccactcacgacgatcattaacaatgcgtgggctgtgagttaaggtaatcatcccatttgtctcccctaatttatttcattatttttcattcattctttcgtccattcttttcttatctctttcgtatttgccttaattaaccaatgaatgcaacaattaaacaatcctttcccaatttggtctttctttgttaatgccattctcacgagggcacttcggcactttttcccttctattatttgttaatgctttcaaaaccttttaacaaaaaattaaaaatacttaaagaaaataatttttacc

SEQ ID NO: 15227 - DNA, 2745 bp, Heterodera glycines
tccaattttcatccgaattcatcagcattgcttcctttaataaagcagtcagaagtcagtcacagattaatgcatttttaattttaaatcccggattaacacgacaatctatttttgttttttctaatttaagcgcaattataaagatctgatttgtgtacaaaatctgactaaattcaaaatgcctgttaactaagaacaaaagtcagattcgtaatcagcgacataaatagcatcgaaaaaattaaaattattattttttttattattaaacccacattttcgttttgctatgattattcttatttacagagagaatgagaccagcaatttggtggacaatctgctgaaacgcatggaacaatatgcgaccaacttggaagggctggtggaagaacggacccaagaatatttgggtgagaagaaaaaggtaagaaattaaattaatgagatatatttggtatttattcattcgggttcggatttgattgcactgaaaattccattgaagcaccaatcaattgctaaatttaatagaaagatttggtttttccaagcatgagtctatttcaattctggttaagtcctcaatttgatgacttaattatgatgacaccgaaactgcaaaaaataaaagttctattacaattaaacgagtgccgcactcgattcgattttggcatcgagtcgagaacttgatcttcaagaagagtataaaatcgactgcggcactcgatttttaaaagtttttctttcaattcaaaaacgaattaaatcgaggattccaagtttcaaaagggcactaatatgacggagcaggacaaaactccgtcggccgaaactccgccaaaaaaaatttttcaaacaaaaatttttcatgaaaaaaaaatcttaggaaaattttttctaagaaaattcgaaggaaaaaaatttcgaaaaattttaacgatggaatttcggcggcggaattttggggtgcaccgctaatataacattcaatttattcgtgaattgtaagaaatggtgttggggcttaaagttggcgtctacgtatttaaaaaccgtgacacttatcttggccggctctgctgcatgcacactaattggtaccaaatccttgataggtggaagatctgcttcatcaactgttgccaccgtccattgctgatcagctaattgatggcaatccggtccaagcggagtcgtacgattgtgtaaccatctatttctctgacattgtcggcttcacctcactctccgctttgtcctcaccgatgcaggtggaccggaccattatgattgacagattttttttgaaaaatttgaaaacccttttctctgccatcaatgtgaccagctttattttcatgcctctgcagttttctctttccgaaaagtttcaaaaaaactgaaaataaactaaaaaatagttggatgcttttttggcatttatactaataattttcaaaaataaaaggggaaaatcacaataaaaataataagcaatttttgaaaattaaattttaggccgaaagtgggggattattttataatcctcatcccaaaaaaatgttttccattttttgatcaacatatctgatcgctctccattctcatttttttttcatttttctttgaggttgtcacactgctcaacgacttgtatttggcgtttgacggtgttgtggacaatttccaagtgtacaaggttgaaaccatcggtgatgcttacatggttgtttctgggctgcccgaacggaccacggaccatgcgtcacaaattgctcaggtcccaaaaatttgataatttacggttttgaacttcctaatcctcaattttgttttaattcatcaaatcccgcttgtacaatttcattggttcaaaagcttacaaaaacaagcggaatgcgtattttatgaaatttgattcagattatggcatttatgcatctataaaatagggttagccgacatttgcggaccgacttttgcggaccgacatttgcggaccgacatttgcggaccactatttctcgatagaactgtctaaataaagaaaaaaataataagaaattttaataaattcaatattcccaaattgaaattagtgaaggtaagctgatgcaaagcgatctgtctcaattggagagaagtcttatttgacataacttttttctttcttttttatagaatttcttggagagaagtcttatttgacataacttttttctttcttttttatagaatttctaacttataattaaactgtgaaattggcgaaaaaattagctaaattaaatataaaagtcagttcaagaattttataccaagaaaattttttatcttgtttcacttccacgctttagttaaccgagagcttaattttttccggcatgtcaaaccaattaaattaaaatgtcggtccgcaaatgtcgcactacgaaattaacggcttcctcggtgatttgtcttttctattatgaccccaacccccccccccccccaaaaaatgtcatgagcccgataaagcgctaaatcaaagttcttaaaaatttaacacaaaattcttaatttttcctcaaaatatattaaaaaaatgttttttttacgcaaatgcttatttcttggaactctgttctgcatgattttgtcatacatactgtataatgagatgtggacggatggtaaaaaaattattgttgcattttaaggttattcggcatttctgttctctgctcaaaaagg

SEQ ID NO: 15228 - DNA, 311 bp, Heterodera glycines
aatttttttaagtgggtcaaactgtataagtaccgggcgatgttcaacttggtaaaaatcacaaataaaactacttagtcactcaatttttgaaaaaattattttttttttgtttttttttgacagttcaacccagaaatagtggtccgcaaaagtcggtccgcaaatgtcggtccgcaaatgtcgcactacgataaaatagcggtgcacactaaaatatgctttcagctcgcgttttgatgacatttttttaaattttaaattaggaccaaaaccgtaatttttaatataaatatttattttgcttgaag

SEQ ID NO: 15229 - DNA, 2776 bp, Heterodera glycines
tttcgcgggttttttaaacaaaaaatggaaaatcctgtaattttttgcaagaattatgagaaatttttcatgtgaaaattccaacaaaaaaccgaaatcatattcattctgaaagatgttgtttaattaatctccgagttgcaccttgtcaggtcattgtgcgtctgctgcaattggtgtgcgacatcaatccggaactgcacacgaaccttcaactccaagtcaaactgttcggcaaagcggcataaactgaacggacggaggagggagttgggaaagaatgttttttgatgtgatcgtttatttaaaagacaacaattagttttatattccatcaaatataagaggttattaaaagtatcgtaaaatgctgctgctttgttaaagcttaattagctgtaaaaatattaaaaaaatattgattttattattcgaatcttgtaaattattccatcaaaaagctttttccgattatttggtagaaaatgtaaatttatttcggtgtttgcaatggttgaggtgtttgaattggacaaagggcaatactataagcaaaaaaggcattcaaaaattaagtttgtttggcactgtatgttcagaattccgcgattggaccactgagttggttagagctcttccggaagctttgcaattcggtggcgcccaccggcggcactaattttgtcgccacgccggacatgtccctgctaatagtccgtcggtggtactgcccgagggcggccgtgccgccgtgcgccttcgcctcccgtggcaatgaagcggacttctgctggccgtttagcaaagcctccgctgcttaaaggagtgttttgtgttgtgccgtttttgtgggccttttgctgtgcccacctccgtcggcggcactttccttttcttcctccaaaaatgcctttgtctgttccctctccaattcgttgttcgttgtcgtccctccgcttctctttttgccctttgtcgcttcttcgtcgccttcgccgtttccctctccgtcgttggcattttgtgagtccgaatcggtcagtttcagtccaaccgcgtggtaaatgacgaacagatcggtgatcagagagacaatgcgaagcccaccgtacgcaaagtgaagcctaggaaagggcagcacttatgttatgtaagaatgagtgatcagatgatcagaatctgtttctgatcagcccttgcttctctatcggaacattgctcaaattgctctcatcccatccctgccgttcaattaaatgatcgaaatggcataatttgattagcctgatcgttaattctctgatcaacctgtgctctcatttagtcatacaaattgagctgtcaactcattcggcatccttccgatcactttccaacaacatttaccaaaatcgaagtccgtccgtcgcgtacaaagcacaggcgcctttctcgccgcacttttgggtccaaaacaggcagaagttatcaatgattgtgccccatgcgatgggcgacggcaaagtcgcgagcagagagaccaaaaatccgttgaagccgagcgaaatgctccgatgctttggtggcactgatctttatgattaattaaccttttgaattgccatttaaattgggtgattacctcaacatgatcagtacaccggggacaacgcccattccgccgataatctgtgaaaatgatcagaaatgacaaaagtctgggcacaataatataataatgccgaaaagctaaacaaaccccgccgatggccacgttagtgaagtaccaatacctgacaaaatgctgctttcatttaaattctcattcattttgatccaatggatatgtacatttttgatcggcaattttcctcccgacaaaactctcgcgacacgcgttcagtcggtgaacatagacacgattcgaacaaaggcgttttttgcgtttccaaaatgctaaaggcactttcaccaagttgacagccggcatggcacggagaatagtagctgagaaggcaagtcaaattaacaattggcatgatccaatcggatttttaaggaattaattcttttaatatcactcacacggctccgttggggtcacagaccgggtaaagcggtgccaattcgcaatggcaccccacggcacaactgctggtgctattcgcgttagcaacacttaaacagccaattaaatgtcaaaatgcttaggcacttcaatccctgccattgctcacagcgaatcgcccaacgcagtcattgtggaagtgcagccgaccagcgaattgagcaaagaaaaacatgccgcaatggcaccggtcattgccaccttcagcaggggcgggcgagggaattaattaattagctataaaataagtaaagccacgggattcaatgagcataatggtataaacctcaaaaaccctgaggaataattacatgtgataattggctaacaaatgatcagaaacccagacaattgatcattcaattttaaaatgagttaattagtgcctacccaagcggctgcttttcgtccctgcaatttggccactcgcatcaccaaactgcccaccattactccgacggcaaatgtggccactccaattatcgcttaattataagaagtatcaatcagtccatttgcgtttgtacagacccattagccgattgacttcgtattggggaatgccgaattgcaattccaaatatttcggcatgaaaatgtaaaagccctgaaattagtttttaagctcctaattggtaagattccggtcacttgaaagcgaacacgtcg

SEQ ID NO: 15230 - DNA, 952 bp, Heterodera glycines
tccataccccacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaagagatttctattaccagattgccaaaaaaagagaaagccattttttt

SEQ ID NO: 15231 - DNA, 986 bp, Heterodera glycines
gcccgaaaatcatttttagagcataacaactgatgacaaccactgtcattgtttcaaagagatttctataccagattgcaaaaaaagagatagccattttttggaccgtccatacctcacatatactcaaacggcccgaaaatcattttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacataagtcaaacggcccgaaaatcatttttagagcataacaact

SEQ ID NO: 15232 - DNA, 2131 bp, Heterodera glycines
tgaaattaaaataaaataaatattgaccattttgctttgttttgatttttattttagtgaatttttttttcttttttgaaatttaaggcaaagggttttgtttttattatttttaaactttttttcttgaaaaattccccggttaatcccgcttcctatcgatcgaaaatccagaacccggtcccggtttttcctaaaaattctcggtcccttcacttttattttttacaataaattattttttaaattcgttttcataattttttcacataaaaaagctcataagagaatccattgaatttgtttagttttattctgagatttatcatttgcatttattttgacatgctgatacttaacaaaattgtagataaaaatattaatgaaaaattttcaatttaacttcataaaagttaaaaaggagcatggcataattttatatcaaaatagttttaaaaaataataaactaatttaaaaactttatctgaaaacaggtatttcctgttgattaagtcaatcagtaatacagttaatggtatcattaacggtctatgtgctacctgtttttgcggtaaattaccacgctggtctctatataaaaatcgacttgaaaaattcattccctatgtttgcttgactataaatttaggcccttaaaattatctcacttactaaaaataccgaaaaataaatgattttatctaatattgaaacagagaaaaacacagaaatatgtaattgatagaaaaaatgatttaaaaatccctattttataatttccgaattgatagaactttttattgcctaaactaaaggaatgtggttattagataatgtattattttaaatatattgtaaatttaattagaattgatctaaaaatatattttttcatccatactttttaccggtattttttaaacataaaataggggctttaccatttactgatcgttaggctttttggaatttgaacagttttaataaggaagataaatgttttaaacttattactaattaagaacactttggaggaaagcaacttaaaggaaggggaccggacaggcaaccacgaggctggtcacgccggggcgtgcaagcttaaccctcactgcactaggataacatacgtatgttttgaaataatgaaaaaattaaatagtcagaaaaatggtgacagagtagaaaattattttggcaattgtggaaaagaaaaaaactagtcaattttattataatttatattttaattcacagcaatgggattgttatactgagttattttttgaaaattttttcgtttttcagggttcttgaattaaagaaaaaaattggtttcaaaggtttacgttttaaatcatttgcttaaatagtatgtgtaacgaaacttcatttgtttataaattttaaaggttcgacaaattctgagagcattatttttcaggccatactcattataaaatccaaaatttcaatgcgggtaaataggcgccgctgggcctaaaattttctaattatttttaaaatccgtagccatgtgggctttgaacctcagaccctcgcttcattgggccctatttttagagctcgatctgttcttatttataaaaaatattctattggagggtctaaaaaatgtcctatttgataaaattgttaattctgattattgacaaagaatgaaattgttaattctgattattgacaaaaaatgaacttcaacattttaagatgaccaccatccccgatccaaggacgaacagcagagggcgcaccgactacaagacgaggccaaactacaacaaaaaacaactggaatcattcgtagaaatgtttctaggtaaacaaatttttttgaaaaatttttcgaaaaatttcttcctgtgaattgaaaaatttttcgtgtcaaaataaataagctcattgtaaagagcacaattttttaatcttcagaaaacaatgaattttttacagttaatatcgcaattgaatgcccatacctaagcggttataagtatacaattaaaagggggagggtcattcctcgctgacttcgtatagggtggggacttcgtatcgtttggacaaataatgtaatattatgtagggaaagatcagagacgtagaaat

SEQ ID NO: 15233 - DNA, 1151 bp, Heterodera glycines
ttttttctttgttatccaaatccaacaatcttcgtatcgttcgaaagctcttaacatgctttattagccttattaaaaaacaaaaaaaaaataattggtatttttccaaaaaaaacccctaacagaacggccccatcaggtaaaatggcctttttgacctctaatgaccggaaaatttttcgaaaaaggcattttttagcaaaattttatcggaaatattaattatatttaattaattttttttaaatgagttcatttttgtcaaaaaataagcaaaaaagcaaaagtttctcttttcaggtcgatttttcgctaaaatgagtaaattttactgtatcgtgttttttcttctaaattggtttctaataccatatatgcaatttttaaaactttactttgcttttagcgaatttgaagaattttgaattacatccatcaatttgggaaaatttatgtccacttttttgcatttttatgtccatatttcgcaagttttgatccacattttatggccatatttcacgatttatatccatatttttcagccctaaccatgaatatatttaatttatacaattcaaagcgatctttcactaagaaattatattttttcaggcggaccgatgagtgagggtgtcctcactgggccaattgactttgcaggccttcaaaacgacttgaaaatggcttataacatcacgtgtcttctggtaagaaattcaattacaacatcgtgatcaagtcactcctttagggtagtattcgtcttccacgaaagaaattttgcagccccataggaatttttttctgaaaattatttcagaaaaccctaaaggagtgatctgatcacggtggtaaaattgacgttttagtcagcattaaaagctatgctcatttatttttttcagaatttttcttgcattacaaaaaaagtatatttggtcttataattatgaaacgccgtttggggccactttaggaaaaatttttagatttttttcttttaattgttcaaattttttcatggggctcataacattaatggggcaggaatttaccgtgttcggtcattttgtcaaattctaaaactttgctcaaaatgagaagtatttgaataaatcaataattctaatattctcagagaaattgac

SEQ ID NO: 15234 - DNA, 3456 bp, Heterodera glycines
  misc_feature (77)..(77): n is a, c, g, or t
cattaaattttttataaaacccaaaattaaattaaaaactttgaattaaagtcaatttaatacataaatgccatggngacactaataaatgataatgaaaagcataattatgcatcccgttacattttatagccccattaaatttttttataaaacccaaatttaaattaaaaataatgttattaaagtctatttaattaaaagcataaaatgccatgggacactaataaatgataatgaaaagcataattatgtatcccattacattttatagccccattaaatttttttataaaacccaaatttaaattaaaaataatgatattaaagtatatttaatgaaaagcataaaaatgccatgtgatattaataaatgataatgaaaagcataaaaaatgccatgtgatattaataaatgataatgaaaagcataaaaaatgccatgtgatattaataaatgataatgaaaagcataaaaaccctgggataatataaaaaggtaacggtacgcgcatataaccgataaaaacccattaattaactaatcgccaaaataatttttggaaacaaattttaaaaattcataaatttaagcattaaaatcggcatggttcaaacttatggccattggccataatgaattggtgcgggttgccaagaatcggaaactatacaatcactttgacgaggttcaaattgggaacaaccatgacgagttcggcaaatacattgtgttcttgccgaattggttcaatgtctatcagtttatttttgcggatgacaacggcatgccgtttggccgcgagttcaaaagtgccataaagcaaatgaaaaagtaatcatttccataaattcttacacttatctatttcatgaaaaattaattgcaattaaatagcaaatttaaaatgttttaaaattttggcatgcatgaccaatctttgccttaatttctatcaaaatcaaaaacttaatttttcggattcatttaagataaacaccaaaaatttaatttcttccgagaaaggccagcaaaattccgtcattaatatccacaacaaaatattttcagtgccaaaaattgccgaataatcatccccgcaaaacatttttagtgtttttttagaaatcaaaccctattaattagttaattgattaattcttccatatacccatttttaatcttaaacataatgctacttgattaagatgtttggacgaaattgtagaggagcaagaatctccaacacatcgtggcataaaaacaatttgcatattgccaagaaaagtggacagacgatatgattacaagaattgggcaaataaaattgaccaattaaggaatggacaaaacatattcaaatgcaagaaatggacaaaacgccaggaagtggacaaattgaacaaaatattcaaagcaatttttgagggaaaggcaatccccgaaataatatgcgatcaaatcactctaagaaaagggtataaaagaaacaaaaatgggaagacaaacaatgcagaagctacaaagaatggttctgatgcggaaagtgaaaaatcggactcggatactgtacatatgaccccaaaagtggcgactacggctacggtaccgaaatcactgccaccgagaagcgggccaagtccaaaagcaatgattggatttcaatcaagtccaaaaatgccgagaaaattaaatgcgagtgccatcccatcgcatagttccaatgacaattattacggtatgcttggaccactcaaatcaactccaaaatcgtcggcaaaattaaatacaaatgcaaagccatcacaataccgtaacatcaatggtacagttgacgattattattacggtggaaataaggaggacagtgaaactgatatggaagaggctgacccacgcaataagagaacacctccaaaaaagcatagaaaacaagagaagctaagtgattcgcgcagactggcgcaatttcaaagtataaaaggatacggtatccatgatggaagtaataatggaggaaacagtattccaacaaaatctggtagttcttcgacacctatacacaaatcatcaggcaacaatagcccaaaaaaaagtcatagtccaaaccagcacagtctaagcaactcactaaaatacagtagcccaaaaaaggcggcctacagtacagtaaatttacctgtgaatccaccacacaaaaacaacacaaattataatagcctaacaagcgaacaaagaggtcgaaatcttcataacgcaaacaacggagggcatcatagtcataaaaatgaaggttatggtagcccagctggaagtacgaatatgaattcgctgtccaaaagtcgttctgccaacaatagtccaaaagaggcggcctacagtaaccctacatcaaatatacatatgaacaccagtcataaaagcccaaaaagcgagcaaaaaggccgaaatcttcataatccaaacaactcagggcacagtaatcacaacaatgaagggtacattagccctgctatgaaaaaaaatgttaatttaattccaaaatttttctttgacaacaatagccaagaaaaggcggataacagtaaccctgcagcaaatgtacctgtgaacttgaagtccaaaagtttatctgcaaacaatagcccgaaaaaggcggcctacagtaaccctgcagcaaatatacctgtgaacttgaagtccaaaagtttatctgcaaacaatagcccgaaaaaggcggcctacagtaaccctgcagcaaatatacctgtgaacttgaagtccaaaagtttatctgcaaacaatagcccgaaaaaggcggcctacagtaaccctgcagcaaatatacctgtgaacttgaagtccaaaagtttatctgcaaacaatagcccgaaaaaggcggcctacagtaaccctgcagcaaatatacctgtgaacttgaagtccaaaagtttatcagcaaacaatagcccgaaaaaggcggcctacagtaaccctgcagcaaatatacctgtgaacttgaagtccaaaagtttatcagcaaacaatagcccgaaaaaggcggcctacagtaaccctgcagcaaatatacctgtgaactcaatgtccaaaagtttatcagcaaacaatagcccgaaaaaaatggcctacagtaaccctgcagaaaatatacctgtgaactcaatgtcgaaaagtttatcagcaaacaatagcccgaaaaaaatggcctacagtaaccctgcagaaaatatacctgtgaacttgaagtccaaaagtttatctgcaaacaatagcccgaaaaaaatggcctacagtaaccctgcagaaaatatacctgtgaacttgaagtccaaaagtttatcagcaaacaatagcccgaaaaaggcggcctacagtaaccctgcagcaaatatacctgtgaacttgaagtccaaaagtttatctgcaaacaatag

SEQ ID NO: 15235 - DNA, 3889 bp, Heterodera glycines
  misc_feature (51)..(51): n is a, c, g, or t
  misc_feature (2768)..(2768): n is a, c, g, or t
atatcattcaataattaaataatacttaaaatcgcaattcatttatttttnctagccaaatctaaaacaaattatatttaactcataacaattataaaaattatgaaaaattatttgaaatttgtcaacaaatttgtaaggaaacccgcacagccataaacaggatattcagcatgcctctattattattgcatttgtttctttacaatatctttagtaatgacaatttcttaaattcatgtttgttgggttatcaaaaataacaaattccttaaccaaatttaacagatatatttttcgaaaaaaaatattcagcagtaaatgaacatttaaaagagaggaaaaaacaactatagaagcaaatttttcattcaataactcaacatgatcgacaatccaataaattaattaattgtctcccacataattaggcttctttttcgccgcattttaataactaaaatataaagcgtcaatagttattatattagtgtatgaaattattttatcgcacgagtcaaaaaactttaacttaaaaaagatctaatagtaaataataaattaaatgatcgagaatgtgatttgtatgattttgaataaattcatttcatatatataaacttaacatttgttattattttatctttcattaaataggatatttactacattcaaatttatcaaattttaaacgtcatagtttgcttcttgtatttctcacgctgaatggcttgcggtcttgatgataggctaaatactgtcattttagactacacagaaaacaataattttaataaaatattaaaatttttttatattttttttgaaaaaatttattaagtagttttttatcattattattgtcaaatttctccattattattgatagcgctattttaaatatcattcagtttatagttgaaaagcacgctgttgtgtaatttttcaatattcagtaatttatatggaacttttatttcttcgtactgcttcaataacatctctttttgttccattcattcactttattatttgactaacaaatattaaataaaaattcaatgaacagccataactaaagccactcaaaaaaagttaataaaatttctgaatcattttgacgcaatacattaccatttatatattaatttatttttatgaaatatttatgttttactttgcataaaaagcttcatttctatcgaagacgactacgatattaagcatttcactaacactgccacatatgaatttttaaaatttgcttatgaaatttattgattaattctcggaaaagctaaagttgttatattttaatattttttaactaagcaattacaatttacttctattttgtttataatttttatattattattttcgattttatttttgaccatttttccaaagcctcaattgctttatccaactgatttgaatggtcatcatttccataggcatactataatttaacatcgtcggcatacatttttatgccaaatgatgccgaatcatttgtaataaaggacggcagatcatttataaaatttaagaagagtaattgccctaagacacttccctggggcaccccggaaaatattttgaaactttctgacaattcttcgcagattttaaccttaaaactccgatttaaaaaaaaaaaaagtttaaaaattatatattttgccttcaattcctatttttttgattttatgaagtaataaatcaattggaacagaatcaaacgccttgacaaaaacaatatttgcattatatatatttatgtggatttttaacctttattttttttagaaaaatttaaaatcagtgatagcatcaattatttatcaatatatcgttgaaactttaaaaaaatgattcatcttcaatttctgtttaattaattcttgtcccattcactgttaccctctgctcaggtgccttataaatcactaaaggagcgcaagtagattacatttgattatttatttcttcgctaacacttttaataaagtttaaaaaattccttttatatataatataaaaaagaaacgcttagttaattgcatattttattaattgagtgattagtttatttttattgtataaattaatattttgtttttattcttgtaatataaaaatttaaacaaacatgtataactaatatgcaatattcaaaagtttgctgtaagaattttaattaaaatacttttataattttacattctttgtattttaaaatttagccatctcactaagagaaattgtctgaaactgctccaattcataattctgatttatgaattgaggtctaaaatcattctgcttgtaaatgaacaaaaaatattaaaatacaaaatatcctgttctttttccaaatcaaattttcaaagtatccagaagattttgaaaacaatgcattaaaaaattctttggcttgccatcgatatcagataaacaaataaatcatccataaaaaatatatatttattccaaaaaaccccaaaataaaattgaaaaacatattgaaatgaattctatagagattaacaattaatccttgtccattaaaccaagttcgtaatttcaaaagaatttaaaatataaattgataaatttattagataaaaaaaattcaactagaaataattcttacgaaaattgagacaatttacaatagagttttgaaacgatccaacataaagaatttattgcataatagtagtatatggcacattaatccggtgtaaaatcccccccccccncccccttcccttaccaaaattccccccccctgaatataaaaattttggcttcaatcagcgttatagcctttcttgaatgcatcttttcttcaagaattttgttttataattaggggcaaaaattaaacagttccacttatttccttttaatagcaaaaccaatgtaatttatcacgtaaatatttagcaacattggtgaaaatgttcagttattgttagggtaataataacaggagaagatctcgagaacataataaaatgatctctacggaacattctaatggaacagagtagtagtatatagtgccaaaacggcgcgggtaccggaaaacacccctccaaaatcccgcgcctattgaaggggtgttgtgttttcctttgaagatgccgcccgcgcacaatcccgagcttattgaaggcgtattttcttttgaagatgccgccttaggattattaccgcaaaatcccgagcctattgaaggagtgttttcttttgaagatgccgcccgcgcacaatcccgagcctaggatgtttgattacctttccgcggcgcggcggaaggggaagtgaaaaaaaaacacccgcgggatttggggaaacggatttggctgggcggcaacatcaaagtgggccaataggtttaggatagccggcaacatcaaaggagtacaccctcccttaggctttggttcttggcggcagcttcaaagcattgcacccctcccataggcacgggtttgtgcgggaaacacccgctcggaaaccgcttgctttaccaccaataggtttgggatttgcggtaaaaaaatcccaaggcggcaacatcagaggaaaacaacccctaataggtccgggattttgcgggaacctatcgcggagcggtaacttcaaaagaaaaaccccttccatagacacgggattttggagggggcctgtccggtacccggaaaaaagtttttttttcatactaatttattgtattcattttcaattttatttttaaattttttggaataattaatttttattgtccaatttattgcattaatttgctgacatatcaaaattccacaattcgcattatcgattactttgcgcggcggagcagcggcggagagag

SEQ ID NO: 15236 - DNA, 969 bp, Heterodera glycines
tgccgccggatgcgcggtggttccgcgctggcacgcggatagcatttgtatgtttagggggtatgcctttttattttcatttcttttttttttagttggtttgggaattttccttatttggggggagttatgtggatgtgtttgagtgcgttttagtgaccaagattaattttggattgaattttgcgcgttttggggattttggtgcctttttcatgcctttttcgggattttggtgccttttcgggattttgatgctttttcttgccttttttcggtattttcatgtctttttcgggattttgatgcctttttcttgccttttttcgggatttttgtgcctttttcttgccttttttcgggatttttatgcctttttcttgccttttttcggtattttcatgtctttttcgggatttttatgcctttttcttgccttttttcggtattttcatgtctttttcgggatttttatgcctttttcttgccttttttcgggattttggtgcctttttcttgccttttttcggtattttcttgcctttttcgggattttggtgccttttcgggattttgatgctttttcttgccttttttcggtattttcatgtctttttcgggattttgatgcctttttcttgccttttttcgggattttggtgcctttttcttgccttttttcgggatttttatgcctttttcttgccttttttcggtattttcatgtctttttcgggatttttatgcctttttcttgccttttttcggtattttcatgtctttttcgggatttttatgcctttttcttgccttttttcgggattttggtgcctttttcttgccttttttcgggatttttatgcctttttcttgcctttgttcgggattttcatgtctttttcgggatttttatgcctttttcttgccttttttcggtattttcatgtctttttcggggattttgatgcc

SEQ ID NO: 15237 - DNA, 3462 bp, Heterodera glycines
aatggcgaattttatggatggctttcatgctcaatttgggttcatgtcgaatgcgttcagcacgattgaactctgaaaaaataaaaattttcaaatattgtaaattttatgtaataaatattttattaattcattttttgatttttttaatcaccgtgcccggcacggacaatgtcagaagagaggcgttggaatgttttgctattgtgccgccattcatttgctgaatctcttcgatgggaatgcttctgccaaaaaaatgttggaacaaaacacttattttagaataacaaaaaaaattttgtggtaaaaatttctttaaaagaattttttgattttttgcaataagaaaaacgaatttgtcaaaaaactttttaaatttgcatagattctttttttaataataatgttatttaattttgtccaacaaatttaaattccctttgaaattctcgaggtaattagcctaactcaacaaaacccgaaaatatggcaaaaattcctagattttactttaattttttctttttagaaaaatccgcattatttttctgttttcgaccccctggcattttcatatttctttggatgttcgacttgaccccttccattaatttttcatcactcacaaaatgccgcgttcggatggcactttttttgcgcctgctcggctcccttaccggctgtgccgtcggagtgtgttcatccgagtgtgccgatgataacgttcgttgtccaacaactgctgctcgcgtgcatctttgctggtccattgtcgatcagtttcggcttaataaaaaatttttgaaaatttttgggcttagaaaaaattaatgaaaatttttaaaaatttccaatttttcgcctggcacctccacgtaaactgcgcaacattgacctcatccgatgagcattgtatgtgcgttcgtcacgctttgacatgtaaacctttttgccgaaaatcatttaatttttgttttaaaatctttgaaattccaacaatgacaatcagaagagcagccaattcagtgcacaaaaagctgatcttgaaaaaaaaacaaaatcaatttaaagtaaatattcaaaaaatgtttaaaatgaattttattatttattgtaataattaataaaaaaattaatataataattatagaaaaaattaaaataattgccaaaaataaaataatttaattatttggaaaaatttaagagaatagaataaaatttatatatttaaacatatttaaatattttacaatataaagtaaaaacatgaaaatgatttcatttaaaataattttgtttttaaaaaaagtttttgtttaccttcagcaaaatgaatgaaaagccatatgtgtaatcaaacaatgagttgtccaactcagaagctttgtacagcttatttccaacttctttggacaccgaaaaatgaaatttttgggaaggcaatttttattttaattaccttggcattagcttaattaatgttagcaaaaaatagaaaaataattttatactttacaaggcaataggtatattccttcgttcaaaaattccaaaatctcctaacaataaaccccaatttggtaaagcttttctcattgaaattggcgccaaaatgcatcaaaattttttaaaaaatcccttaaaaatcaattaatacgaccgatgcctcctaaagtcaaactcaatgggtcgaaccaaaaaatttctgaaaaataagcaatggaattttcaaagacttggcaatttttttagttcggttcatgctcagaaaaaatccttcagtaaatgcaacccaccgatgccatgtacagtatgatacagttgaagtcgaccaggcccttcattacagtaaccaagaaagaatacaaaaattgaaattaaacctattgtttttaccggcaaaaatgttggccaacgcggtgacaaacagagattggtacgggttggaccgcagaaggcacagcgtgttgcacagcaggccgagcacgtccaacgcgcagccgcacagcataaatgggaccgcacgacgaacagaaactttttttcgggagggggaacgatttttaaatggcaaaaaattttgaaaaaatgtgaaaaatttaaatggaaatttgggaaatgccatttttattaaggtatgtagaaagataaccaatacctgacactttgaagaaactttcttggagggatacagtttttaaatggcaaaaaaaattgaataaacttcgaagtggaattactagtaaaaaattaagcgattttcaaaaaacgtagaaattttgcgtaataaactttttctggttttctggttagtccaatttttgtcgatttaactttttggcaaaatatgaaaaattgaaacggatttcttcttattttaattaaatatcactccaaaaacagcaaaaatttctaaaaatcggtaaattttcttaataatttcaatttaaaattccaaattacgttccaccgatgtggtcacatccgaagtgtcctcttcatggttgaatgggtccactgatgtacaatgaaaatcggtgaccgctaaataaaaaatatctaataattttgatttgtaaattttccaaaacttacggtctgaccaacaaaatcgccatggtccaagggttgaattctaaaaaaacaatattagaatttcccaattgaaaccccaaaaagacaaaaaaaaatacaatagtaaaatccaagtaaaaaaaatattgagtccaggataatagaagtaattaagtaattagacagaaagcgtcaaaattttcgtcgccgaaaattcaaagttttgctattttaaatatgttaattttcattttattttaattttccaatgccttgtaataggtgggagggtaaagcttgtcctcattgtcaatggttcggttcgggtacacgtaatatttgagcacttctctggtgttgagccaattgtttgtgttgacagctttcaaaattaaaaaaatgaaaatttcgaaattaattttttattttaattcaacaaaaataaataaaaatttatttatgtttttaaattaaaaaattaacccaaccaattaaatttgcaacagcggcacacagtgagaaaacaaatgccgttttgatcaaacgaatgcgattttctgatcgaattttggtcagccgatgggaaatcacgggaaggaccataatcatatgaaaaaagagtttaattttaaataactatatacattaagaaatggtcgtggattataaaaaaaattaaattttttcctttggaatattcggactttggcaaaatccgttgtgctcgcttttctctgcgtcgaaaattgaatttcctcaattttggccaagcatttggccaatattcaaaaaaagtttaacacaaaaaaattatgcaaatgttcgcgctattacttttaaaagtgcatctccctaagggtgaataagaacagttgactgaag

SEQ ID NO: 15238 - DNA, 2946 bp, Heterodera glycines
aatttcctaaaaatagtaaaaaaatgaaaattaggaatagcctccagagtaagacctccaagccctgatataaaatatctataaaattaatcaaaaatttaaaaatattatccaataatttgtaaaaatatattcattttactatcatttaaataaataaaatttaaaaattcaaaacttatagaacacataaaagaaagcatatgatatagataatccaaattttgctaagtttgaagtaataaaatttaaaattccaattaataacaaaaaaatttgcttacgagtaaacttaaaatgctgaaacttgacaatagaaaaaacagaggcattaataagtagtaatagaatgaattagcgaaaagatttcttataaataatgaataaaatttcaaattcaaagagattaatacgacgaattaatcaataataattaagtaaaagaatacatttaaaaaatatagttaagacatttgcatgaacatatttatttcgatttgttaaaaaaagttttattttccattatataagataaaaagtgttacgttttatttactgttattataaattaagtgaaccttctctggtatagccgccagaggaacccgaaattttacaagcttaaatgaacaatattaaattatttgcctattgattgaaaagcccaacagatttgctctttatgcttcaactgacagaaaaggcaaaatggtggcggttaaataacagtcaatttggcctccgtcctcgctttatgattagtcatttctttctttcttttttcgtgcttcgtcatcgctctgcgaagcgatgacactccggccgcgcgaattaaagttggggaagtgatggccccggctcgccttcgttcactacaaatgccaaaagagtactgtagaaagcttccattgacagcaacaaaagggccattggtggattccattggcgcatgactccagcaagaccaaaggcatgctcccgctcctgtgctaatcggcgcaagaggacacgacgaagttcgactggaatttgaattcggggaaggggattccatggccaattgatagggagttgtgtttcctgttgttccctaatgaatggatgggaagcagttgttcggcctccataaggatgagagcgattcgggccaaaacgccgcggtgtgaatcggctttccccttcaattgccctttggcgttgattctgatgcatttggtggtgttgctgttgaatttggtgttgcggctgttgctgatgattttggtgttgtggttggctttgatgttgcggctgctgctgttggcatggagttacgatcatttctccattggttggcatcaattgtacaccattaactgaactgctcgaacaactctgctggttaaagagcaccaccaccgcagtacgcaatatctgtggattggggtacaagacagtgggcgggggtatgagttgatgcacctgggcccatttaagggcatcaaatcgaaacccattttgaggcaaacccgtttgtgcctttgcctttggctgcaaatcagtgtgtgacctttttactgcctttgctgatcctgaatcattttcacctcgaattttaaccaaacccactctctgatctaccgtaccattctcctttggtgccacagtttccacaccaattactgtacctccaaagcccttttctgaacccgaattttgagtgttcaaacatattatttgctgacccgccggtgtggaatgtgccgtcgaagttgatggacctgcttccaactctaattggcatgccctttcactgttttgagtattgttggccctcacattgtccaccacatggcccaccaactctctttgccactgctgcatttcttcggagaagtcgaactcactattctcatcactttcacaaaccggcctttctttttctggccccatggcccatcctccgttactcattagcatcgacccccacaggtacaagaccaaaagaaaaatgcttccctttattgtgccgcgacctttaaccttaatcacagcctttccttcctcattttgtgaacccaatttgctttcataatttaattttaaacccccatccttttccgttataatcaaacccaaattttggctcagaatttcaatccttttacccgttccgcttacatttctatttatcagcccactgctatcatttgcaccgcgctcgcccgcactctcaattccattacccgccttttcttccttctctttcataaatcccgcaaaaaagtcgccaaaatcattgaattcgtcccggtaatgatcaaaaaaaactccgcccagaggataaaagaattcaccggctaacaacattggtccaagggcacttccctgcgtccgtttgattctcaaaatttgaaaggcaaattggtgatgggagactcggggtcttaacccaagaaagggcctgtccggagtcaccatcaaattcaagccgtttaaatttccgatgtatccttcatccaatcgataccaaagggaagacccgcgattcaatgcctcggtgatccgtttcttcagacttcgtcgctccgtggtactcaataataccttctcgttttggataatatggactgattcatcaaattttatcatttcattttgatctttgatgctccgcatccctcccgtggacaaagaacaagaaatgcttacaaatttgtacaataaaattcctatgacaaatcggtaacccataaaatagggcagaaatcgtaagaaaatgtaaatggcacccattgctaataatagcattaaaatgaaaaatgtcatatttttaaaattattaaacgggttgaataaattttttaaatcgatttctaataaatcctcccatttaataccatctccatcctttattttaagtttctcaggaatttcgcactttaaattttctttcacttattggta

SEQ ID NO: 15239 - DNA, 3582 bp, Heterodera glycines
cccatttactcccctcatttacaaaattttaaatgcatttttggaaatgcttacacagagtttctgttaattaccccccccccccctttcaaccgaaaaggaacatcttctggaaactcgatgtgtgggaagacgattcgcgccggcgccgtcgttttgtgcaaaatccgtggggcaaacggcacaaattggctgccacaatgcaacaaaaagtggacgaacaaaggcaacagcagcagaacgaatcggagacggaacgggaacaatttctgaaggagttgtcacataaaatggttcgtccgtcctccaaatgatggcactcattttaattgtaattggggacagatcaccgctggcggacactcaaagggttcgtcggtgcacgagttcatggacgaggcggaaattgagaaatggctgaaggacgtaagcgatctgagcgagccaatcgaaggcgagcggagggaaaaatgataatggcacagcagtgttccaatcaatttgtttgtccatgcagatttgacgacgtacagcaccgtcggcaaactgatcacccccggcctggtcatccccggcacaatttcgttgaccgaaaccgacctgttcttcgacgcggacgaagaacatcccatgtacaggaagcagaacccgctggtgggtttccgcatttttaaaaatttttttaaataacgaaattttccacaattttctccccatcattcgtctgtctctcttccctttacaatttgctttactcaatgctcatcatcctttgctttgctgggaatgagttcctccacttttcttgcctttgttgtgtgacgctaattcgatgcgacagaattcgcgtggtcgtcgcatcccaaaattgtcgtgtcgtcgcttctctcttaagccccccccccaatttcttcgcgtcgtcctttccctcctcccacgaccttttcattcgattagcaacagcagtgtttactgtttgccgttcgttcctccaattgtactaccaaatattgagctgagtttgtgcaggagagaaaaggttagagcggcgccgagggggagagaccgtcgcattcattgcattggtcccccatcttccatcgttcatcttcggcagatcgtatcacagaccatttggcaccaataaagttgcaacacgtcattgtacattctcttcgaccattttttgttgtgatttttgtgtaaaatttggcggacaaagaaaatgcggaagaaagacgacagaatgcgggagagagagagagagaagaggtccatcaaaaaaagaaaaagcaacaaaaacaattgggcatcatcgatcgatcactcagcgatcaaccggttgagagggtgtatcatcattgatcattgatgttcccacaatcaaagctgttccaatgctttgccattcagcatcagttgccggaccaatgcccacacggctcgagcactttcgtctagcgatttgggcgaccggtttttcaacaggtccatctgaggcagaaaaaaatgggggcaccgccggcactgcaaacagttgaccatttgcagaagaatgccaatgattcggtcgccaagacagaaatctgaaaataccatttgcctgtacgttttcaaaaggtttaaaaatgttaccgttccattcatggttggcataatgtttttcgcactcatacagcacgagcacctgacaattatgttaaataatgcataataatggttattaattatttgctttgtgccaataatttcaatttaaattctcgacccaaaattggttcattcctttccccctttggtttgtattggtaatcttttgcctatcattcattgttgctcatctctttttgacctgatctgacccttcccttctctgctcactttgaccagctgttttgttgttgctgatccactgaagtccaagtgtctgtcgcgcaatgttttcagaatggaaaacactttttccctgttcgtgtgcgcttgtaacagtttgtcctccgcttgcactgtgctcatcaaccacgcgtcgccctccatcatcgtagtcgttgtcaccgctgttgttactgtatttacagtatttgtctgctgttgcggtgtctgctgctgttggtactgttgtgctttgttgttgttactgttgttataattgttgttgttttgatggtgttgaacagcagcatttgctgcactgcttgtggatgggctgctggcgcacaaatctttgcttagcaaatcgaagccctcctgtcgtatttctttggccatttcaatgcttggccattgcacgtgctggcttggccaatggcttgccgaccgtggccatatgccgctgcaacgaaaggcgcatgtgatctgttataatgctcgagtttgtatgttgtcataagttcgagaaatttttcgggactcgctctcggctcgacaaatcactcctttgactttatctgttcacctgaacgaaatatttgccgtagatgatcagcttaacatcgctgctgtcctgcacgacttggcatttgtcgttgaacggcgctttttccaccgtttgtgccacaagcgactggaagcgcgcgcgaatttttcgtgccgacaaatagccgcttgctgttatgaactcaacccacagggacatggaccgcttacggccgtcgctcagcttcagcacagcacagccaggaattgagccgtcatcaacaaaattgaaaacgcccatctgattgaggtacagaatgacctcaaattcgtacggagaatggaccagcaactgtagtgttgggttgttactgtcttgatgactaattaattaaatatttatttggcattagccagttagcatcattatatttatctgcttttgcaccaaccccatcataattgccgtttgaattttgcgcaaacgtgcaaatgaaccgcggctccgtttgttcaacgcttttcagcacttccttaacgatctccccaattgaattgatcactttctgtattttgtgtcttctcatctgcactttctccgcataaaactgattaatttgttgggtggaaatgaattgcatttcaaaattgcttctgttgctgttggtgatcaaaaacagtaataataataaaatattgtctctggctataaaagagcaattaaacatatcattattgtattctcattgtctcagctaccgttacattcaatgtgacaaataattattaaaaaaaagccgtcatcaaagaaacacttttccataaattttacgccgcataaattgttcttaattattaatgggatgttgtgggaggaagtggcaggcggtggaggaggaaggaaggcgcaatttactaccattaccgctgctcttcccgccgctgatggattaggaagtcgccggaggggcgggcagcggcaggggacgacaggcggagagcgctgctgctattagtgtgtgtatgtgtgataataatggggattgaaaggcgcagaaagggacagtcagtcaatttgggagtgaatttgggcggggaagggagggggaggaggaaatgagttgagttgctttctctgttgatggtggtggtggggtggtggtcgat

SEQ ID NO: 15240 - DNA, 2322 bp, Heterodera glycines
acaaatactccgtctgttttttgccaaaaaatgtgatgaatttatttctgtttcaaaattgtttttgcgttctttttgctctctcatttttcccaactctctctttttaagttacataacaacagagttttgccttgccttttttgacacaccaatcaattggaaaaagggaaaattgagccacaaaaatgaatcgacggtaaggaatttttttttaattacaaaattttcatttacccatacatttttttacgaatctcagttggctttgtaacgacgtgtggatggacattctcccatcttttaactatgccaaactcggcctcaaaatggcattgctttccgaccgtttcgatgttttggttgacacgcattttgatggaaaaagcgaattgacaatttggagacgtatcagaattcgcaaggacaaaggaccaaaagcgaaactgtctgtacggatcgatggcaaaagggtggaatttccattgccggaccatccgttgcccaacaaaatccgttttaaggaccttcagatttagtaaatcaaaaaatatacagaaaaccaatcttcattttttcactttatcagctacattgaccattctgtgctcgcatttctccgttccaacaagcaaatttgggacagaagtggcatcaaattggatttggttgtgcctttatatatgaccgacgtcaagctcatttgggatgtttttacccgcgaaatttggtcactttttgcgaccaacattcggcatttgagctttcataatgccgatgctttggacaattggcgtcgtcgcacttcgccaacatttctcactgatcttgatgaattggtttcattcacttcctatggactgttacccgatggaattgctgatgatgggccaaatgcaactgctggccaagcgttgtccaaatggttacacactccgagcaaaaatggccaaccgaagcgattgtatcgctataatttgttgggtccacagaatctcgaatgggtcaacaacttcaaagaggtgtgtctagccatattttctataaattgtttttgtttttccaaatttgtttagacatttatcagtgccaccacttctgtcagttacaatattcaattttatcttcgtgtggaaccaatgccaattgaaccatttgaattggtgaacgaagtgacaaatgagaagctgacactgacgaaggatggcactggtgaattcaattggcttttggagagatgcccaattattggggagactgcggcggcggttcagaaacagcagcagaagaaggacgaaaattcggatgccaatttgaacaaagtgttcttccgcctttacgatgacattgggtgagcagaaaggaggcctttttgtatgaaacacggatagggaacggtatcccatgtacagtactttcccagaatcttggcagggccatgggttctgttaagacagaacttcagtccttgttttgtcttttttgctcttgtccatcccgaaaaccctgctggtccgggtttttccaataattacgggctgtactttcgaaaaagttatccgattcaaattgcgcttaatttaggccgctgtctccgccgtcaaagcgacgaaaaattgttctcgattcccggaccaagtgatcagcggaagaagaaaaagtgatcattttgggaaatggccgatcattatcgagttatgatgaattggattgattgatgatgttttgtttgctctttgaattgttcaatttgacgctgacattttttgctattaaaaaaatggaaaatttggcactttttttttactttagataatccgatgttttttctttaggcaactgattttttggtcgtgttttttgtttgtgttcaagtttcaaaaataatttttttagagtaactaaacttgttttgggtctcggttttaaagtctcgggattttatagaggcaagaaaagaacaaataccaagcattcataaaaaaattacaatgaaaaaacacgaaattcaactttgttttccgagtgtatttgagaattattttttccaatagccttaggtaaaaatttaaaaaaaacaattcttagactttaagcttatcaattggtaccaagaaattctcacttgaaaaagaagcaaataaatttacataaattttgtatattcgaatgaaagaaaaataaaaaattgctattgctgctcaccaaatacaattactgccgccccaaaaaataaattggatattgttcaaaatggcatccgaattttcatctttcttctcgccaataattgggcatcgcttcaacagccattcaccacca

SEQ ID NO: 15241 - DNA, 1472 bp, Heterodera glycines
aaaaaaattgggtaaaacgaaattgtaatttttcaaaagaaattgcttaccgtctgttcattttttcgctattctgcatcaaaaataaatccttttctaaacaatagggcaatttttctgtttttattgtaattaataccgaaccattaaaaaaattgtggtttaaatatgaaaaaagtgttataaacggaggtcgaggtaatagtttagatggtatcacaccttttagaaaaaaaaattcattttttttggcgcgaaaaaagcgtttctagggttttctgggtcggtgaatccgattctgacatccatttcgaccctattcgaaccccgaacccggattccgacaaaaaatcgaaatttcaattttcaacaaagttcaacatttacgcaacaaaaccaattcaaatgcacgaaatattaaaataataacaaatggcacttattcgcacggataaaattgggaatttaaaaccaaataattaatgctttgttaaaggcagagtcaaggcgacagaaaatcaaagaaaagaattcggatcacctaggagcattaaaaatttgttcgaattttggtcgccattagattagaaattaaaaatttttcctatttcatggttatgtttgtgtttagggttaggcaagggggctatataaatgtcgtattcgtattcagcgaccccgaaaagcctaaaacagacccgttttccggttttttatgagctttttagacgtttggacaattcgtgggtttttactcttttggacaattcgtgggggcgccaaacaatgaggtatttatgtaaacaaaaaaacacaggagatagtgttgagaaaaagataacaaaaagagaaaaagaaagagaactaaaggaagaaagaaagggagggaagttggggtgaaaggaaggaagcgagagaatttaatgaaaagagagagagaaagagggagaagagagagaaacagggagagagtagagaaagagagaatggtagagcgaagagatgtttagtaaatgatgacatagagacaaaagaaagagacaggaagagaaaaggagacaaagaggagagaaacgagacttggatgaaaaacgtatttattaacagctggatttgtagcgatgtgtggatggacattctccagggaggcatgaaatgcacgaaaaacatgtttttagcttgtcaaaaataagcaaaaaaggcaaaatttcgctttttgggttgatttttcgctaaaaatgataaattttagttgtatcatgttttttttcttcaaaatggttttaattagagatcggatacggacgggatccgatcatttagcctcctcctcatttctgatataattagtttcgtttaatgacctctaatgcacaaaaattgcattatcaaataatttgcttcaaattttcaatcaaatgaaaaaatatttttataaaaaaattcattaataaaaattcaaatgtcaattt

SEQ ID NO: 15242 - DNA, 1577 bp, Heterodera glycines
accagaaatttaaacttctgtgattggtgggtaatgttgaaaattttggtgactttctttaaaaacgaaaattttatttaaaaagaaaacgtatttaaatataaattttttaccaccaaaactaaatgagaaagagtcaacatcaaactcatttgaaggttcatcctgaaatgattagattttatttccattaaaatttatcaaattacagttggcacagattgcgcatcatcagttaatgattgtcggcagattgggcatgttgtattttcttgaagccttgtgtgtaattaaaaagttaattatgcaaataattcaaataattaattaccatctattaatgcatttttcatgaaagatgtgctaaagtttttttgtttgaaattttatttattacttcaaaaactaacttggcattttatttgtttcgctttagaaccaatttttgataagcaaattgaacaacattcttttggtttttgttttttaactcctaattaaaattaaaattattattagtaattaatgattaattggtgcactttgttcaattttcgaacggcttttttcagaatctcgatcatttggcaaattcctgccagaccgtgtttctgtctttgttttctttattacagtatcagaaatgcctgatcgaattgctagtctttggatttctgctaacacttcgctctgttcgttcaattcatttcctattggatgccgattgtcagaagattgacttctttcaccaaaattcgcatgattatctacggtattattttgacgaattcctacagtaggtcggctctcatattcactatcgaatccttcttcatttaattgttttaaaattttgtcacgcctgtttgattttgttccagctcttacatttgccggagtcgttacagtatcgctactgtcagaccgtttttcatatacttgttttcccatatttcctacactgtgacggtagctagattgtactgattggtgtccggcatttgttcggtttgctactgtatcttcactgccctgccttgtcggaattctttcattttcacgaattcttacattattgcgtctgcttgattgtctcacttgttgtccctgccgatttgctactgtatcctggctgtcagaacgaatcaccaatggcttattttcacgcatccctacagtatgacggctgctatatcgatgcttttcggtaagaatttttccaggattttctttataccggctgtcagattgatttgttggtcgtcgtcgactatcggccgatttatcagccctgcttgtttccgcttggtaaataacaggatctctacttgttgaacaaccttgtgaactgttttgacacccaaattgccgattgcttagaccaatgtgttcaatttcaatacttgttgatgaagatgaggacgatgattctttaattgctttttgctttttatcacctaaaaaacttccaatttgcttccaaattttttttccgcctatttccttcatttttccttaaaattcaattataatttctaagatatttataaaagatttataacatcatattttctact

SEQ ID NO: 15243 - DNA, 2285 bp, Heterodera glycines
aataatgaaattgaatgaaaaaatatgtttataattttaccataaaagtcaaaatttaaaaatatttttgtgtattaattttaataatgtaatttttttatttcgtcaaaaatatttaatatatttttaaaagtttattttgtcctataaattcaaaatataattggttataaaattaattttaaaatttacccgcaaattcgaatttttgaaatgtaatttaaaataaaatgttaaaaaagattaataaagaattcgagcagcaaaagaaaacaatttttcgatatttcagggcctcagatgtaaatatgcgaaaataaattcaattttattttgttcaaccgatcgtatgcatgttaatataaaaaataaaaatattaaataagaaaatatttatcgtaaaaaaattaaatgacaatattatttgtttattatttaacaaatgtaacttccgatttttaacgttcgcattatggttaacaaaattttcacgtgactttcagcattttccatattttttaaaattttgcctaatgaattttctcctaccaacccaaaagctgaagttttgcctattgaaatttggcatgctagacaacacgccatctgacattttgccaaatggacatttcgcctactaaaccaaaatcggacatttcaccattttaattcaaaatcgaagttttcttttttaaatgacaaaaaagcgtgcattccttgatttttagcactttttaaatttattttttatgcttttttgtctggtaggcgaaatgtccagttgacaaactgccagtagacgcgatgtctagttggcgaaatgtcagttagcaaaacttggatattagtcacgaatgttaacaatttatggattctatattaaattggggaaataacaacaaatttcctcataataattattacattaatttatttattgaaatagagcccgggggggggggggttctttttcaacccccctcaaaaggtggcattattttatatggttttctaattagattaatacggtactttggttgtgattccttttttatttgtacaatccttattacttaaggacgccttaatttatgatacgtccacagagtaatttgatcactcagtcccttcaaatgattttttttctttctgtataaataaataggaaaattaaataaagaaattttctctgaaacagaaatcagtaactgttcataattcctaattgataaaaaacggatgatgaactaacttttataaaaataacctcaaaatttgagcaaagaaacttcattttttgttcctatccagataatttgttaccctcgcaatgtcgagattagaagaagacccgtactgacaaatccccgttttacatatctttattcatagaccatttaaaaaaagtttaatgtaaaattacattttaagataatcatcgttcttcatttgcaatttaattgatatacacataagaaaaatttcaaataatttatagccttttcattaattagtgaattaattaacaaaatttcgtttatcagtgctagattttcaataaaaacatttggtcatataaaatcataaactatcttttgcaaaataattctaggaaaaataggaaattctagacttgtcgaacttgtacagtatgaaagcgtccattattgtcacgcacagtaacgctcgttccaacgctagcttaattgatacctgcattaattaattgttttattaattaccatacctgcttccaagaggcgtactaaaataaaaaaacatgtcaatttctaaattcatattctaataattaattttacgctggtcagctggcagggtagatagaggtggtgcaccagctaaacggattttaataattaaattttaacaattactttatgggataaaaattttgaattaccataaaatattccgtttctttcattctctgtggcttcacctaatgattaatttatatttaaaatttaatgttaaaaaatcttcgtaaaatttcccaaaccattcaatatgtcttccggagaagtattgggagcatcaattccagaaacttaaattttctgagggtgataaaattggaaaaactaatatttttaagaccatttagcaagtgttcatatggctcccactctccttcatcatgcgataaatgtcctgaaaattaatttaattttttatgataattaatggtgagtatttttagtttaaaaataaattttttattttgatagaaatatttgagttgccagttttctctaaaaatataa

SEQ ID NO: 15244 - DNA, 2449 bp, Heterodera glycines
ctcaaatttaaaccttccgaattttggcacatttttccgcttcactgtacccaaccatctcttcgggagtgcaaactttgatgaacggaaactccgaatccttggcaatttgcgcagccaaaaaggatttgccagtgtttggaggacctcaattgtttaaattaagcggattaataaatctgctggtgatgatgattgactgccttttacccgctagcaaagctcggacgaacccgcgcgtgtcgggcgcagcggtctctttgatcagaaggcgtcccccctccaacactcgcgagacgcagtcgccccacaggcaaagaccgccgtacagcagccgattcagcgtcaattgcttcgtcgtccacctgaattggcccttcggcttttccttctttcgtccatttgtgtcctttacctgctgaactttgcctcccggtttgaccaatcggttcattgcggacgattgggcggcacggactaacccttccaactcggcacccgaaaaattcttggtcctttttgcgatctgctcaatgtttacgtcgctgtccaatttgttgtgttctcttggtgggaaaggaggttggaatttcttctctctctctctcactctctcttctctcactctctctctctctcactctctttctctctccctctctctcagtcattcctccctttctctctccctccatctctcactctttctctctctcacaaatcagtctcttatttttctttttttttcacacctcatcggtgccgtgtgaatgttcaggatttggatgcggccctgcttatccggcagtgatatttccagttgcacttccatccgtcccggtctcagcaacgcctcgtcgataatatccttgcggtttgtcatgccaatgacaaggatgttgttcagctgctccaccccgtccattttggtcagcagttggttcaccaccgtatcatggacgccagtagaagagccgccctaagaaatttgcacaaaatcctagtttaagcggataaaatggctttactgtcgaaatggtgtgactgtttttaccatggatcctctttgtttgcagttggcgtcaatttcgtcaaaaatgattatgtgcagccacgagttgggcccgcatcggcgccattcctcctcggcgtcggcgaacaatttgcgcatgttcgcctcagattcgccgacaaaccttcaatgtggtctaccgtatttgctctttttatatgccagtctccattaatctgccgtctccaattatatacccctttcgaactaggttgaaaaataatctcccagtctccatttatgtgccaggggggataaatagaatttttcataaaattttttggcacatttttcaaaaaaaataaaaaacaattcaacagtaaaaggggctaataaatgaacaattcgtcgtcatctccgactccatccatccctacatcatcatcatcagataagccggcttcttcgtgatcgtttccgtccatctttcgccgtttcatttgccctaaactcgcgcaaaaatttggtcccaatcggtccaattgctcctaccggcttgaagcaagcaattttttcttctcctgttccgtccaatggcgttgtcagcccacaaacttaaatatttaagcctttttcctgtatccatttttaactgaccctcaaatgatttgataataacttctttggagatttcctgccatgatcggtagatccaatcaagtagcacttgaagtgcaggtgccttagggttgcccgccgatgtgaacaccttttccgccccgttggacatccaaatgttgtagaagtgtcgaattcgctccttgaacggcttgttccacgagacatcgggagcctagggaagacaaagaatttcattgagaaagatgacttagcacctggatgaatttggtgcagccgccagggataaaaaccgtttgcactcccaattccttcacgaccttcgttgttctctcgctcttgtggctgccaaacgcatcccaaaccaagaggcgttcgccaacgaacagctttgcgccgatgattttgtgcaaatagtcctcagttgtgtcatcattcatccacaccgagccagcaaaattgatcaccaattttccagcaaattggtttctgagccttctgctatcggtgcattgccttcctcgtttgcgcagttgttgcacacgacctttccgccgaagccttcgttttcaactccgccagaatcgccacagaaggtgtggcacggcaatttgcagacggaacagctgtgacttcctccataaattgctttacaaacgcagcaaaacgattccatattttcttaaattttcattaaaaaagcaaatttttattcataccggaagcaagaaaatggcacatttctgccatttttaaatacaattttcagaagttcttaacaaaaatgcagtaaaaatg

SEQ ID NO: 15245 - DNA, 951 bp, Heterodera glycines
ttttatgttagttattttttgaactcttaagataaaaatttttggtttttaacaaaaacatattttactttttaataatttcaacatcaatcaattaaaattgttattttcattaataaattggcaattacttttaattttatataaattttgttttcatcttataggctaaattatcttttttaactaatagtaaaataaaattcacaagtatatgaaaaattgaacagatgacattgaaaatagttattgactcaaaaaaccatttactctaacaaaagtgtaaattcgcaaattttaattaatcaattttttaatgggtctaccaaaaatttaaaaatttataaccaaagaattcaaaaaatttaaacttactaattttgtccctaacttttttgaaacacaataataattttttgaaatttagataaataatagagaaatctttggaatatctaatcatatgaagaaaataaaattggttttgtttctgaaaaaagttattaaggataagtgtgacattttttatggcatccaaaaatgtaaggttgtttaaatgcgtgctagctcttttcttaaaaaccgccactatgggcgttaagacatttgcttaagttcaatcaaattaataattcttgatatcattcaatagctttaaatattgtctatcagaatattaatttagaaaatttttatacaaaatttataaaaagctattgtcacaaaattacaaaaaatcttgaatcataattttttggcaataacttatttgaaactcaatgaaatattttgaaattttaaagataaatagagaattcttaggtctattcaatatattaaataattttggctcaattgcattttaaggactttaaaatttaaatgtttataaataaatatgcatgaccatggcaaaaaaacatacatgttcaatgctttataacttttttc

SEQ ID NO: 15246 - DNA, 1283 bp, Heterodera glycines
agcttattaaaacaaacttaattttatttttgtatagaaatgtttagggtataatgaattatacaagattatattgcaataaattgaaaatttaaataaatacaatcgcacgagttgggcctagttttttcttgtgcacaagaaatatgacttcaatttgaaataaatttctagactttattcattataaatttaaatgattataaatataatattattctataaataaaattacgtcaaaagaaattaattattaaatatgaaaatctaaagaattattagtacctaataaaaccttttgttaactgaaagaagaagaagctcaataaaaatcaataaatgtaattatttaaaaaattaaattcattttcaattttgtttttatctaaaattcttaaatttagaaaattattattttttaaatttgaaggctctccaaaatccctaattaaggtgtaatatgctaataatttttttaaaaatttcgatgagggccggcagtgccgttaggcgccgacggaaaaatttttgaaacttagactagagtgcatttttataacataacttatccataaaatttagcaaattttgcaattttagccattgttttaataaatttaggaattttgggtacggcggcgctgacaaacgcagccgggatatttattaaatgagaaaaatgctagatgactaacaatatagcacagcactttatctccttggcattttggcaattttgggggtaaaaacccttaaaattgtacaaacttaaaattttttagggtttgaactagtttccggattttgagttttgcctttagaacccctgactaattaagttctcatgagagcaaatcaaaaactgaaaatatcatacccaaaatataaaaaatattttgggcatttacaaaccaaaacgaattaatctgaaaaaatttattttttattttttaattatttttatgtgttataatgctccaaataacgtatagactcttaaatataatatgctaaatattgcaatgaatttaaattattctttaaaaaattaaatttattttttccccaaccaaaaattttgttcatcaacaaggatgatccagagctaggccctgttcagtgttcacagggccctgcaatctattaaccttaattaagaaaattttaaacaatttttcatcataataatttataattttttaatacgagtataagaaaagaagaattactcatttttattattgggttgaaaattaaatattaaaaaaaatcatacaaaaagg

SEQ ID NO: 15247 - DNA, 1695 bp, Heterodera glycines
  misc_feature (13)..(13): n is a, c, g, or t
ttttcgccctcangacgggcgcttcgcgcccatttctaaatttgtggggctcgtaagaacacttcgtggcctcagtgcttcgcgcccgcttcaaaatagtgttacatggttacatcgaaaacggagggagttcatgaatttcctctcttagcatgtaacatgtattaacataatgaaagcaatgaattttgaaaagttattaaggggttgtaggcagctttacgccctaagatgggcgcttctcgtccatttctaaatttgtggggatcgtaataacacttcaagtgctcggagcttcacgaccgattcaaaagatgttagatggtacatgagaacgtagggagtgcatgattttcttctcttactatgatgcatgtactacatttcccccccccccccctttttgaggagttacgaaaatttttttaataaaaaaagaacttaaaaacaatttttataagaaaattcctgaaaattttttttattttttatgaatttttccaaaaaaccgctgaaaaattattcatttttttcaaattttataaaaattattttcgggggaaaacgtcctgctctgcctttcatagtagcccgaattgtatgaattctattcatttgatagcactgagtgttctttatttgctgggaaatttttaaaaattgcgttgagtttcaaaaaggaaaccaaaaacttacttatatattttttcttactcttcgacgactaaatttttgtaagtagtcatttttcaaaaaatttatatgcaaatttccatttacagattccctcccaaaacgctccacctgcacactcagtgggtccatcagcagtgcgtcgttctctttgaccatgtcggccaacgaccgattggacgcctttgtggaggaggtgaagccgaacaccgaggaaagaatgtcctccaaattgttactgctcccaccgccgcccttttgcatttgtttggggtcttaaaaaaatcaaaatttaaaaattaaattaaaaagcggatccaaaattgtaataaaacagagaattgatttaggcctcccggttgaaaaaaactcaatttttccttttattgtcttttggggtcagatggtcaacaaagtggagtcggaggttcgagtcccctccatgacatgtgacttttttaatggaaataaacttaaatgataaatgttttttgttcaatgttcaaatttgatgatgaaattaaggaggcacaaatgattatgaatttctgaatgcgaattcgaaacaaatccaaggatgtagaaaaaaattattaattttttacaaactcctgtcattaaaaaaacatgccagaggcatcgcaagcggttggcccttcgtccgccggcgccgtcattgtgctgactgaactcgtcgccgccctcgtttcggccgccggcatttttaagttgattaaaaattcagcgcccaatgcatcacatgccgcctgcacattgtccgctgccgctgttgcggaaggcacagtactgcttgaatttgttgcctccgatgtagacgttgatgctgttgcatctgatgacatgccaaggttgaacataaaattgaagtcagaacagtcgagagcatcctaaccagcatctgccacatacggtgtccttgttgtactgcttgaattcattggcactgctttttcggctgacaaatcgaatgctgatcaaaac

SEQ ID NO: 15248 - DNA, 1077 bp, Heterodera glycines
tccgtcgttgggaatttccatggatggccgcagagtggtcaatgggtcatcttcgtcgtcatcataaaggcctataaaaacaaaccaaaaattgtgaatgctttaaaatataagttaatagtgccagcaggagagggtttaaacaagttcgttcagtttcttgtcgaatgccttgtgcctgtagaacacacgggaacgcaaaactttccataaatttttcgggatgccagaatttcagtttcaaaatttattaaaattggattatcggcaccatcaatggctaatatatgcctgtgttatttgcaacatcttttttcgtgccttgctgcttttgatgctgtttctgtctcggctggtcgtgccgttgttgcggcggtttttgccgtgccgtcttcgccgccgcactttcgccaactttgcttctgccattgttgctgctactgcttgtcgtagtggtcgtcgtggtcggcgccgcggtaaaagtcagcaccggctcgtccagccgcacgtccaacgccagcgcaaggtgctcaatttgttcacagaggtcctggatggacggccgggagtaggggtcgggctgtagcatttgtcctaaaaatggaaagatggtcagcaaataatgcaactttttttttttttgaaaaaaggagattttcccctctccactcccaaaattgacacaaatttacgaaataaatcaaaaaaatgattccaatccaaaagaatggcattcgaaaatttaaaaaaaaactaataaattcaaaatttattttttgaaaaatcgaaatgcagaaaaaatcgaaaatacgatttttaaaatgtataaatttttgaaaaaattataaacatgactatagaaaaaacattttcccttgaaattttcaaaattttgcggaaaagaaatggaccaaattgggatgggaatggaatcgggaattctgtttttcatgcattacgtatcaaatcgtggaacactttgtactctgaatgggccggcagagtgtacttggcgttcagaatgcgtagtttggcactgtcctcaaacgggtggacacggtagcacagataaaacag

SEQ ID NO: 15249 - DNA, 1000 bp, Heterodera glycines
tacccgggggacctctagagtctcgccacgcagagagtcattcactgagaaggagagtaacggaatgggaaggagggatggaattggacggagttttcatggaaaggcacggataccgtgaaccaaacgatgaagacgatggtggggcgagaattgatgaccatccgccacagagttgtcgagaggaaaatcccttccaattattggaatgccaaacagaaaaatatgagagaataaatggagaccaactagtattccgacaacatcaaaaaagggaggaagaaaaagcaccgaaaaacaccgaaaaaacacagcagaaaactgaaaaaattgagagaaggaggtgagaatattggggataaaacagaaaataaactgaaaacgaaggcaccacggacggggttcggaggcacggcacactttgggtgttgacgtgagttggctgaagcgtttggtgaccagcaaacatgagcaaaaagagcaacaacaacaacaaatgggcataaatgaagtcaatgggagcggatgtggagaaggtattgataatatgaatccacatccttacagtacccaactaattaatttgtacattccttttttagttctgttgaatgggcagccccaagcgaattgcaacgggaagtgtccaaaggggtggccatcggcaaatggtggtcttatggtttgtcaacagacaaaccaaaagccactacccatgtacaaattcagaaaaatggcgataactacagcatgaatttctcattacgaaagttgcgattgtttggacgacctcagcaacagcctattgcatcggttgacaatgagttgcaacatcaaagacatacacatgaaaaggaggagacagatcaagaacagttggacgaccaaatcactgcttgtacggaccagcagaatcgacaacatttggcatcaaatggcgccgtgaaaacagcaacacatccaccatctgtgccgcggatgggattggggccactgataa

SEQ ID NO: 15250 - DNA, 1561 bp, Heterodera glycines
ttatatactgttgtatactcgtacacaatattttgatactttgtttctctggatttaaataaaaatattaaaatgtgttatttaaaaagaaacacaaatttgggcattttaatttaagaataaaaaacaaagcattgtcagttatgttttgttttactttcggtgttttagcattgcctatgaatgcccatccttgttttaaaagcactttgtgtggtgattcgagggtaaattcagtgccgaacctaaacaattctggtccggctcggttggtgcatgacagcagaactggggaagattatttgattggtcatttgcttgggagagtcagttgtttttcggtcaattctcactgtttccgaacttctttcgtttagggtggtttcgccaagtgttttttggcgtacaacaacagacaaaacttcgccctgaaagtcatttcgaggcgatcgttaaagtcgcagtcgcaaatcgccaaaattcggaaagaggtgtcacatttacacagcggcccaattttgggctctcagtgcaaataggtttattatttatttagtaatcagaacgccaaaactttgcaaaacttaaaatttttttgggattttcccttgtaaaaatagaagagccgatctcgagttaaaaactagacagctaaaaaataaactgtgattcgaaagaggggaacaaaatatgggcctatacaaaatttcaaaaaaagttacccacaggaaaaaattttttcccatggcaaacatttcaatactttaattcttttttagccaagtgcgcaatttaaaggccaaatcaaataaaactaacaatattctctagaattttcccttcaaaatgagcataaaatggttttatttgatctagtattgacaaagttataggctaaaaaatttcataaaaattatcgagctgtacgtaactaactcttattgaaaataatttttttttgacacgaaaacttattaataaaaaatatttctgccttcttctgtaaaagaagaaattgaaattaacacacaacatagggaggacttgaacctgggaccccccttttggtgactaactcacagaccactgagacgaaaaatccagcataattgtacttggagcccaaaattgggccgctgtgtttattggcaggaccaaaaataggaaatttaaattttattgcagatttatacacattattcgctccgtcattcgaacattgtggcattgtacaatacttttgaggactgtgaaaacatttacatgcttctggaatattgtccaatgactttggcccagcacatcgattccttttcttcacagggtctcattaatatcatttgtaacaattaaaaaaaccttttcaacacgtttaagaacggttttcgttggaacatgacgcggtcgtgctgatgcggcaattactgctcgctgtccgctatttgcacaatgactgcggattgcttcacagggatataaagccgggttagttttggtttcacttttttaatttaaaaaaggggagtttaaggaaacattctgttgtcttcgcaaatgacgg

SEQ ID NO: 15251 - DNA, 1032 bp, Heterodera glycines
tccatcgcatttcgtcgtctgcgccaattggccccgtcacttctcaaccattgtccatcacttcgctatgtctctttcggtgacgccattctgcccgcttttccacccgatgacagtgcaaatgcgtcggatggccaagtgatgaccaaatggctgtttacgccctgtccgaatggtgtgccgaaatttctcatatgctttgtgaattcaccggtggatcaatggtcgtcaacgatggaacagatgaaagtggtgattatcacggggcatttaattcgttttctgcgttttttttgtcccatttttaggcattttctaacgcttattctccggttactttttgcattcactttcggctgtcttctccaattgacttcgctgtgccatttgatcggatcaatgaactgactggagagaaattgatacttggacaattagcaaatgattgttgcctcttccgttgtccaattgcatgggacaggagaaagtggaaaaatgtgtgggaagaaatgattgctcgaacgaacccaattgacattgtgatcagcgatggcggatacgacgaccggtgaacaatttaaaatgcttaatgattttatgagtctaatcgtcgacaattgcttttactttgtgttttcaattcgtatccaaaaatatacgatttgttttgaaatggacagaattatggtgcaaaaaattaaggatggttagttgattggactcataaatgccattgaactcataaaatgccaatgacttataatttgcaacggaattcggtttttcagtcttctcgacgccgcttctcccgggccggcaacagcagaagaaatgaatgaatcaattaattgatgcgattatgtgaccgaaatgatgtttgtggcactttgccatttaaatattgccttgcctaattgtttgtttgtatttgacctttgcttgctcccaaatgtgtccatttccattgtattttatgtatatatgtgaaattgtttgaggtaattaatcgttgataaaatggctaataataaa

SEQ ID NO: 15252 - DNA, 2159 bp, Heterodera glycines
taaatgaagctgagcatcactttgaacacatgcgctaccatgtcagtgacttctacgggacccttcgcttcaaattcaaaaaaaaatttttttaaatcctaaatttttcgttattttttcacaccttctccattcgctgcttcattgtcagtcgcattttttgtggtgtcaaatcgaaacatcgcttcaaaaacgtccgaagccgaattcagaatcgctctgtgcgcgggcacatgcttaaagaaaagagactattaaattaaaattaatttaaaattaattaagcatttaaatttgtaacaatttccccttaaaactcgcctccttttcctctgcttgcccaaccaaaaagagaacgtccgcgtcatcgcccgagctcaacaaatgcttcatccgctccaccaaagtttcgggttttgacgacattttgacaaaaaaataacaaatctctgttaaataaaatcaaaaaaggaatatcttatcaagggtgacgcggcggtagcattagagtacgcgaaaatcagacaatggtaaagattattttaaaaataaattttgagaaaattgtatattttcaggaaaattccgaggcgcaacaatatgagtaaaaacggtactagtgcagttggtacgtcataaagaaaagttttaaactcgtataaaaataccgggggtttttttcgggggagaggggcgcgtgtttataaaatcacacaccctccattccagactaaattcagaagctccgcggacatcaaattaacacagtgtaaaagtcaaaaattctcaaaaaacttttaccaaataaatatgatcaacaatatgtcaaaaattagagcaattaattttcgcatggacaattttttacgtcgatttgattatctaaaaaagttaaagcacagctattccactgaaatggaccaattaaataatcattgacaaatcacaggatgaaattattgatacaagccatagatttgtcagttacgacgtcagattcttgatagaaagtgcatccattgttgggaaaatcatgacaattttacgaggggtagaaaacccgaaaatttcaataaaatagcaaactttaggaattaaaaaattcaacgggagatcgacaaaaaaatttaataacatatgccaatatttttttccttaacatcatgccaatatatttttttcaaacttaaagtgacaaaaattaagaatttttgactgcatcatataccggtaaaaaaaccggtcaaaagttcgccggacaggtttggcattttcaaaacgattgttttccggttcggcctcacaaagccagtcagatatgttctaattttttatttttgatcaaattttattgaatgttttacatttttctttattaaatattatttaaaaatttcgcgattttgtaaataaatccccacctattcatctccaaattttcagatttttcaataagatgggaaatgttcagacttcctcaattgccaaccaattgttgccatttgagtcgtatattgtcgagattcccgagctcaaatatgtggcaaggtcgagtaaaacggaaaaacatttatttaatttagccacttcagtgacttactttttaaggtaaagataaaatcaaataaaaaattttcggattcaagccaaggacaaattattggtcgaaataatagctatgatgtgcgaaatttttaacaaaaattcaagaacgggaagaaatgtgtcgaataatgaaacgaaaagtgccaattttccaatttttttcagtttgggcgccacgcggttcatgaaagtggcccgggttgagcacttcagcaagggcccactggtggtcaaagtgttcgtcatcattgaccaacaagtggcggtggagccgtaccgggaccaactgttgcagatcagccgacggctcatcaaacacccaaattttgcaccggtcaaccgagtgtttgtgagttttgttttgctttctggaccttttttgaaaattagagtcacaaattttgattcgttttttaaacgaacactttgtccagaggatgtaggaaattttcaacaaaaaaaaacagaaaggacgtagccaaaacttggcttcgggtttgggggggggggggactttcaaaaatctgtttttaggggtgtatttttctttttct

SEQ ID NO: 15253 - DNA, 2519 bp, Heterodera glycines
agtgacaattctagtttgcaatttagtggggaacgaatgccaaaaattaacccttttttggtgacaacttccccaaataaccataatgtttttccatcacggtaattcacaaattgcaccttgtcgccgatgttaaactctaccctttttgctccatgcttcttatcaaactgttgtgccatgcgttattgatacgggcctcggaagaatggactcggccgttccggtttcataagagaaagtttggtccggagtggtcggccgagaaacagttctgctggtgatcgattgtttaaaactgcaattgggatggagcgataagacaaaagtgattgtttcaaccaatttttatccccactgcatttcttcaactgtcttttgaagaaatcaacaaacttttcggctgctccgtttgactgtgcgtggtatggtggcgaaaagaggtgacaaatgccgttactgtcacaaaaatctttaaaatgggatgaactgaattgaggaccattatccgaaactagtgttttcggaaggccgaatcgatcaaaaagccattgtaattgctcaataacatgttgtgatgacgtgtggcgaagcataaacacttcgggccacctcgaaaatgagtctacaattaccaaatacgtgtttccatcactacaaggtcctgccaagtcaatgtgaacacgttggaaaacttgtgttgttgttggccatggttgtagcggttgtttttgcggttgttttgctgcttcttgacattggcggcattttcgcacgatttcttcgatgtcggaatcgatcgaaggccagtacacaagagttcgcgcgagatttttcatgcgaacgattcctggatgtgctaagtgaagtgccttcaaaacgcggtgcctgagtgatgggggtataaccgatcgaccattaaacaccaaacatcctgaaacaattgatagtttgtgccttcccgagaaaaatggtttgatttcgggattaatgccatggtttggccatttgttttgagtaaatttgatcacttccctgatcaattcgtcgtcctgttgtgctgtttgaatttcgtctactgtcaccggaagatgttccaactgcacattcaaaagatgctcaacttccgactcagtttctgcacacaactgagcgatgaccatgtcttcgcttgctgcggaattgcgctgttcactgatcaaacgactcagtgcatccgcctgtccagtgttgtcggtgcgaacgaattccaagctgaagtcgtaattcagtagaatcagtgcccatctctgtagacgagacgctgaaaaaatcgggattccgtttttggacccaaaaatccccagcagtggacggtgatcagtgcgtaaaatgaattttcgaccaaaaatgtattggtgaaatttttgaattgcgaaaatgagtcccagtccttctttctcaatttgcgaataattctgttccgtctttgacaatgttcgggcagcatgttgaaaaactttttcttttccgtccggaaaacggtgagaaattgttgcgccgattcctttgttgctggcgtcagctgtgacaataattggcaaatgcgggtcataatgcgttaatgctaaatcggataaaaggattgcttttgcttgatcgaaagcttcgcggtgcttttcattccattgccattccactccctgtttgagcaattcatccagtggtgctctgatttgatggatgtttttgatgtactttccatagtaattgattgcgccgaggaatgatcggagtgttgtgatgtccgtcggtgctggcatttcctgcagtgctcgtgttctgttttgatcaggacggataccatcggacgaaacaatttgacccaaaaatttgatttccttaactaaaaatttgcatttgtccatttgaattcggaacccgaattcttgaattcgtttaaaaaatttaaaaattgttgaaaaatgctcgttcactgtgcttgaagcaatgatgaagtcgtccatatagccaacaacaccaggaattccggctgccaattggtccattgtccattgaaaaatgcctggtgcgcttttgattccgaatgccaggcgttggcattgataaagtcccttgtgagtgttaacgcctaagagttgacgcgactgttcatcaacgctaatttgcaaataagcgtccttaaaatcaatttgggaaaatatttttgcgccgtttaatttcccatctgctgtagtcaacttttttgagaacacccaactttatcaatctgtccaattcggtgtcaacatcattttgaacacccaagggtaccggacgtgccccacagaaaaccggagttgaactttctgtactctcgctcgaatgcacggatccaaccaactccgagcaaatccagggagcctttgtccgtcacataaaagtccaacaatagttggcatccaccgcttaaagcaacataagcttggcctttgcctataaattggaaaatgtcgccccgtatatgatcgaccacacaa

SEQ ID NO: 15254 - DNA, 949 bp, Heterodera glycines
  misc_feature (66)..(66): n is a, c, g, or t
  misc_feature (76)..(76): n is a, c, g, or t
  misc_feature (83)..(83): n is a, c, g, or t
  misc_feature (91)..(91): n is a, c, g, or t
taattattctaaaaatttcatcaagtttaacaaaagtttctggttaataaattcgactaaaaaatnttgtggaatntaatacnaataattnataataaatatatgaatatgattaaattgttttttaatagatttgttacttcatcctggtcgttcagacgttgattgaaatctttctgtttgtcatttattataaagttattcgtttgtaattctcaaagattcaaattagatactatgagtcagtatattagttgtaaatcttttgtttgaactctttttattatttacaatcttaattaattttattaattattatttaaataaatttaaaaaagttatttagaaattgtaaatttttaatttgtttgtatttgattctttaatcgaattcggtaatacgacaatgatcaggcatcaatttcatattaataattgatacgcgttaatataattgaatgaagcagattatttatgttataaatgaacaaactataaatttgttctatatattatttacattttttttcaagatgcaattaaattttttttgtttttcttttttctattttcaaattttaatgaataggaatcaaattagcaaaaaataatagaagaattgctttagaatttgtatcgtagtatttaatatttttttagttttaaaatcaattttcgtttaacgcgctcgtttcaatttgcattactaaaaggttgggtttattaaatgaagaaaaatctttcatttcttaaataaaatatcattgcttcttttttttaatataagtgaattttatagtataatgacttaaaaaaaataaacatttatatttagcatacaaaaagctcaataaatttattataatatttattgatgtccattttgagctaattttatttaagtattttgttttaaaatgaacagactcctctttatataattatcaac

SEQ ID NO: 15255 - DNA, 1837 bp, Heterodera glycines
agcctgtccagtcctttgccaagtactccttttcttcctgtgtgattttcatcgtcaatctgaaattccgacccaacttttctgctcaacccttccagcgatttctcactttaactggtccctttccgtctccaaactgcgcagacgacttttcagtttggccaactccaaaatgtcgagcagttttcctccctttgtttccgcttctgttccctgtatttccatcccatcgcccaagtctgaccatcccgcgctcccgccagatccggcaccattgtcagggtcctcaataataaaggttcagttgtagagagtttatggttgctgatcatttcgacaacctccagcagagaggcgttttggccaggtgaagaagccgctgaactgccagaatggtccatgtcctgctgcttttcatctgtctttgttttttgctggcttttcctcctcccctcctctctctctttgatcttttcgccaattttgtctttgttcaactcagccacaacccccaaaagttcgtcgatttccgccgctttctcagtacattcgtttttcttagctgttatttctttctgcgcttcgcccaattccgcttttacacgttccaattgcaattgcgcctccttcaggtcctgctccaaatacttctctttgttttgcgactgtgccaatttgttgagtgcgtcactaagttcagtttcgactctttgctggacggaatccattttctggaaagaaagaccgattaattgaatttaaattaaagtatttattttgcaattcgtcataccttcaattccgcaagttttgtctcaacggatgtcttaagttcgacaacaagtgcttggctctgctccaattcatatcccatacttttgtttgcttgcttgacttttccattctcctcctctaggtcaaatgcccttaaattgttgtcatgtattgctattgcttcactttcccttcacacaccgtttctcggctgatttaaggctctcctccaatgcttcattccgtttttgcaaatgctccgccgcattcgcagcctcggcaaattgctgattgatggccatgtttttgttcgctttttcgatgatcaattcctgctccttcagtcgggtgatacaatcatggagaaggcgatgattgaagggagccggaccttcaaataaattaatcgtatgaaaaaaaatgctgggaaaaggtcacccgaattggaggcaaacagcaaattgaccaaatggacgacaagtgctgtaatcacaaaagcgagcacaatgagaccagtgtcttcaaaatgacagagaggttcaggcaaaacagaacgcaatgaagccatccattcgtgaaacattcttttgagcgtggaaggatttgatgacaatggttgttgctgtggatgttgtgtttgatcagaatttgggaaacggtcgtccaattcttgacaatcctctttgaaacaatatttctgaaaaatggaaaaattggttccagtaattttacgtgaatgttagctataatttggtcttttttaattaactttgattttaaatatttgcaaattgaataatatcagggtggccaagtgtccttatttctaagatttgtccttatttggaagggccggatcttagaaaatgaaaatgtccttatttctaagatttttcttatttttggctcgacgtgcatatttcgttcttattttggatttgaaaataaaaatctacaatgaataactttacttattttttttattgaagcgaatacttttaattaattcgattttcaaataaattatattttacttcggaccgagtcgagtttagtacgggcc

SEQ ID NO: 15256 - DNA, 1096 bp, Heterodera glycines
tttttaatttaatgttttagtgtatatttttaaagtaaacgtttaaaaataattaaaaattgttgccatgccccaggccgtagccaaaaaaaaatttaggagagggaaacctgaagcctttatttttgctcttcgggccaaaaatttcaaaaatccgaaagttggcaatttgatttgcccaaaaattacaaaaaagggggacattttagagtttttttagtgcattaaaaagggtttttaagcgaaatttgccaggaaaattgctccaaaggttttccaaaaaaatttaaatttctgttaggtaaaattaaatttttagctcaccgtttaaaggcgaacgcgtcggagaagtgcgagacggagaacagcagggcaagtgtggcgaccaatttgctgacaaagaaatgcatcagcacaacgacgaggacgcacagcgcgcagaacacaccgccgaccatgaaaaggcttgggaactgaaaacaaaaatttaaaaaaaaaatgaagcaaaaatgaaattcgaatatttttagtgccagtaaagcgagttaaaaatgggggggggggacgagcggtgccgaattaaaaatggcactaaaattgaagggggggggggggtggttagttagaagtagttccaccggcccgccaataattaatcagcgacggaaaaaaaggttggaaattggagcgaaaaaaactataaaacgaactaaaattttaaggggaggggggagaaaattcaacaaaaaaaactaaaaaaaaaaaaatttttttttcagggggggggggtaatgggtactccccaaatcttgccgccgaaattttttaaaattttcaaacagagaaattttcaagaaatttttaaaaaaattctttgtaggaattcactaaaaatttcaaaaaacgttcttttttcataattactaataaaaaaaaatttcttgatattttcttaaaaattttcagatttttcttgaaaaatttctgagtttggaaataaaaaaaaatttggcggcgagattttgttccgtctctgggtgaaaagtagggcacacccaatcggtatcatataatcatttgatttccatacaaactt

SEQ ID NO: 15257 - DNA, 3292 bp, Heterodera glycines
ataaattggaaggaaagctgccaaaaagcacaaaatttttccatggcagaaagtccgttggaaccagggatggcacggaatttcgtcttggggataattagagaggggggcagggggggggaatccaaatgcagaagcttttttaacagcttaattgttccggtccatccggtgatgatgatgactcataattattcttgtcaaattgttttttccaataaaataatgtcgctttgctggcattgaaacttttggcaatttcttttgtcggcacttttgggtcttccttttttattgtgtagtattcttttacaaggccaattgtttggttgtctttcgtaacttttcatttacaattttgaataatatgatgaaaatccattatgttattcatcaaaagaaatatgtgagcccgcgaaaacttttaaattaaaaaaaattaaaaataaaattcagaaaaaaatattttttgaatttaattgtgttttatgagacaatttttcgattattttttgtgccaaattcaaattgacaaacccacccacctaaaaacaaaagctcgaaggcttagaaaaaaaaaaattttcataaaatttaatagtagcttcacgaaaatttagttatgttatagtttttaatattttttaagaaaaatggtaaaaatcttagtttttcaacaagaaaaggaaattttttatggttcttaaaattccaccaaaagatattttttttataaaacttaacaaaagacaagcctaaaaactcaaaattcgaaaactgttccccttttctgacatactactcacagtccgtcgatgccgtcgtggtgctgatgctgtcccggttgttgttggcgtttgcgttattgttgccgctgctgccgccgccacctgcacttgtgccgtttgtgttgttgttcgccgcctgtgcagcggcggcgtacgccgcgttgacaaaggaagcgacactttgcgtatgacgacgatggccaccaccagcactagcagcagcaccaccactagcagcagcaacagtctggaaaatgatgatgatgatgatttttcaaaaaataaaaatcaaacgcatttttttttgttgctaaatttgcctatgttcaatttataaaaacacaaaaaacaatttttatgttttccggttaatccatgtgcagaaaacgaaaagatccttgaaaatttttttgtttttttttttgaaatttcattttttcccctagaattaaggctaggtaaaaaaagtcggccaattaagtgtgacaatttttgacaaatttgtatataaaaaatcccgctttcagccaccatttctcttgcggggcaggcttcatccacagtgaatcgaattgaaaaatttaaaaaaaaaactgtttttaccgtgttccggggacgcgaagcgcgtcgtgcggtgcgagacaatcggtcggccgactgcgaagtgcgcaggacggaattgctgttacgccgacgctaaaaaaacaaataaatttttagaaaaaaaatttttttttttttggacgattcccgtgacccaataaacaaacaaatttttaaatcaatgatgccagaaaaaatgcaatgaattttcgctatttgtgcttttttttcattcaccacacaccaaaaatgggcaggtaagacaaattgtgatgatgatgatgatttgtgaacaacatgcattgtatttgttgcactcctctttgtataaacagcgacagaaaaagaggagagagagagcaaaaaaataaaaattaataattaaaattattttggcaaaaaaagaaacggaaaacaaaatcacctaattatgttttgttttggttcaatcattcatcatcatcatcaattcgggacaagaaaagattctcagtggacaattagagagagagaaaatgcggcgctttaaatttgggacgaataaacaaggcggtttcgggacgacatggaaaaaaatatctcacaatcagtacacagagggggtctccccccgaatgggtacgctacattcctgggtgcaccccaaaatttcgccgaagaattttttttccacgcccacagaaaaaaaatttaattttttttggggggggggggttaagttgaaaaattgtaaaatttttttgttttttaaattaggaaaacccaatatgaattatttaaaaatttgttttttaattttttacccgctgctgcggagcatcgccaacaggcggagcagcaacgccggaagaacagttgaccaccacaaaaccaccgccattgtcgtcattgttgctgctgtcctccgacggcaccgcggcgacggcaccggtggttgtcaaccgcgcgttctccttggcaccgttgaccacaatttgatgcttctgccaacccggaccagtgccaacagcaacaactgctgaagatggggaaaattgtgtgttacagtgtaaaaagtatatttttttaagaaccatattcggacatttgtggtccaaaattttgtggaattttgcgacccaaaaaaaaactaggaaatctttttataaggaaatttcaagaaaacaaaaataatgattgataattttttagcgaattttaagaaagtttttgggaaaaacttagtaattcatcaaaaactttagaaaaattttcaaaaaacttttttataagatttcctaagttctttttgttgaaaaatttcttccgcgtaccagggcccgtgcgattgtcgacatcgcttccgaattccgaagaatgcattgggatgatgtaggaaggggacgcaccaccaccagcagcagcagcggcattggtgggccgacctttgctgcctgcacgttttttttttttttggggacatgagtggtccggttacccggtacaccccaaaacagagccgccgaaacacagtcgagacataacacagccgggaataaattttttaaaaaattttcaaacagcaatttttcaagaaaaaaatcttagaaattttttcttaggaaattctatgaaaaaaaaaattttcaaaaaattctcaggtgattttttcaaaaatttaatgacgaattctaagaatttcaaaaaatttaaattttcaaaaaaaatcgctaaaaatttttgaaaatttttttttgtcatagaatttgcaacgaaaatttttaaaaaatttgttaccggctgtgtttcgtcgacggctgtgtttcgtcgacgggtgtgttttgtcctgttccgccgcttaccacatttgcgcctatgtccaaaatcgggtgcaaacttaaatttttttttccatcccgaat

SEQ ID NO: 15258 - DNA, 3650 bp, Heterodera glycines
tgcaggtcttcaaaaacaaacttggcattttaaatttttgaattttacctacttgtcttcctcaagaatgggcccagactaatattgcaattgtttagaaaatcggtgggaatttcgtagaaaaatgccatttcggtctcaaatttaaaattccaaccataaaatataaaaatgccaatattcagctaatttgtagaaatttgccgaaaaactcaaatactttctgcataaaataagcttcaaaaaatcgttttggactcgtaaaaactgcaatagagctgcaccctggattttctcattttgaaggcgataactcctcttttaatatgaaaatccgcatttcagagcaaacaaatatcggcaattcgtcaaacgatgtttctggatttgatcaacgcttgaaaaagattgaacaaatgcttggcacaatgttgcaatttgaacgtgccgtgctcgacgttggacaactcgagaaacgcattgaacatattgagaatggtgtggaggcatttgagtcaagaatcaaagcgtgggacttggaaagacaaataatggaacataacccacgacaacaacaacaaatgcatgacaatccaacttttggtcaaattttgtaaaaaaatttatttatttattttgaacagccatatggccttgggcaaaccgaaccaggaaaaaatgtcgccagccgaaatgtcgacggacgaattttttgaccataacttttcgtactcaaccaaataaaatattcttggtttgttcgaaagcatttgaaaaactctatcaacctgcaaattttcaaaattttttattcatgtacaaaaaaatcagagcaaaaagaattcgaaaaactaggtttttgagttccttctggccataacttttttgaaacttcacgaaaattttgaaattgttcggggcactgccgacgaagtttgaatgacatgacataatgccaatcgatttctgttccatttcatgttccttccctcgcccataaatatgctcccattccctcttattaggtcttcctttcattcttttgcatttatatatttgttccccaaatttgttgtgactttcttttccttctccaataaataatatttaattggacttaaacaaatccctcggaccgaacaattggcgcagtcagctaaaaagcaaacgacataaagcgcatttgttattcatttattacatctccaggcgagagtaatattttggatttcgacattcagccgccggtcttcaagtggacgaacacaaatcgtccacatttcgaccgtcaactttcatcgcgtctaaaaaaccaatagaccctaaaagggtgaggttccgctaggcgcggttttcaaacgctgaaaaaactatagaccctaggcgggttgaggttccgcaatacgcggttttcagcgtccattcaacagtcaacgagagcaaccgataaccaccgaccatggcacaacaggcaacattcaacaattgctggacgcaattggtcaactcgtcaccgcacagcagcagcaacaaatcaacaaaccgaatccgaacaataatgttccgattccggtgctgcctgacatttcggtcttcgaaccgaccgacgaaaagggacgtattaccgaatggatcgaaaggttttcatttgctgtggacttttcggcaccaaacgcaaccgacgcagtgaaagtcaaggcattaatgaataaattgtcggaaacggcattcagcgagtattcaaaatcgtgtttgccaggaaaagtgacggacttcgacttcaaccaatcagttgaaaggcttcaaaagctttttgcaaagcctcaatctatattcatcgacagatatgagtgcttaatggccacgaaaaccgaaggagaagattttcgtcaattcgtcaacatacacaaaaggctgttgaacgatttcaagttcacatcacttaaggaggaacaattcaaggttttgatgctcttgacagctctaaagtcgccaaaagacgcaactttacgacagcgaattttgtcaaagctcggcgccgatggagataacgtcagatggcgatgtggatggacaaatcacagccactgggagtgtaagcataagtcagcaaagtgccaaaaatgttcccaaaatggacatttggaaggccaatgcgacaaggtgcaggaatggagacggagaaacaaattgccaattccaaaaaggaaaattggaaatttacgaattggaacgtccatgaaagtgaactccgcttcgcttttcaaaaccgacgtggcggtagatggcaaagacatcaaattcgtactcgacagcggggctgaaataattgtgatcgatgaactatcacatgaagtcatcggcagcccccgactccgcaaatgcaccgaaagtggatgcatgttcgatggaacacaagtcaaattcatcggaaagggagtcgcaaatttcaaattccgcaatatttgcattaaaggcgaatattatgtggcaaaaaggggatcgctaaatttgctaagtgtgcaaatgatggacgcttttggactcctgaacgaactcaaggccaaaattaatgcgccagtgaatttgtgccgagtcggagaagagacaagaggtttcacaaaaactccaaaagcgccactaaattcgacagtcaaagggcacatcgaccatcccaaagcgttattccccgacattttcaaaaacgaattgggccgatgtataaagttcaaggcgcatctgactttaaaagcagacgccgcaccggtctaccgaaaggctcgcccagtcccatacaacgcacaagaagcgattgatggagaattgaagcgatgggagaaaatgggggtgattggaaaagtcgaatacaccgaatgggcagctccgaatgatgaatcgagaaaaatctggtcgatttcaacacatcatggcaattatgaagttaaaagacttcctttttgcgtgaaatcagcgccagccatcttccaatcggtaatggaccaaattttggcagaatttgaattcgccacagcttacttggatgatgtgatcatcgtaagcaaaagcgtcaaagagcacactgatcacttgaagaaagttttggaaaaattccaagaatggggattccggatcaaattggaaaagtgttcgtttttccgagaagagatcaaatatctcggacaaatcatcgacagaaacggacggagaccggacccggagaaaatctcagcaattagcgaaatgcccgcacccacaaatgtgccatcgttgcgttcatacctcggaatggtgaaccactaccagcaattcgtcaaaaacatgcgttttgtacgaaaaccgctagacgatctgctgaagcatgacagcgaatggaagtggagtgagaaatgcaaacaggcattcgacaaaattaaggaaattttgtcatccgatcttctgctaacgcattacgatccaacgaaagaaatcgtggttgcagcagatgcatccgaactcgggattggagcggtaatctcccacaaatttcccgacggaacaacaaaggcaattgcacatgcttcatcagctctaataccggctgagaaaaactattctcaaatcgagaaagaaggattggcactgattaaaggcgtgcaaaaattccataaaat

SEQ ID NO: 15259 - DNA, 1030 bp, Heterodera glycines
  misc_feature (965)..(965): n is a, c, g, or t
  misc_feature (999)..(999): n is a, c, g, or t
ctttatttcctttttttgcactcacaagttttttttatttcacccctccttaacttccggtgttcacaccgtttacgctgtgatacaatcagtaggaacactttcccaccacattacggtattaatggatttccgctatttttttttctcacaaagcgatttttacattagttacgataaaggaattattgtaacacgggaacgacagccacgcccattatcgggggcctttaatctaagcacttcacattcattcattcattcttccattcatttgatttactgttctccactttagatactcttgcacaatcccactgctacttctcatctcacatttcctctcattatgtttcctttctctggtgggggtccacctaatcaaagcgctgcggcgtcaagcaatgctcagacagaccctgaggggctctccaaagatttgcctgagttatcagtggttgataaactgatgtttgctggaaagattctaagcacgccagcacgtttgtctgatgtgaacaaactccatatggacttaattaggactgaggatggtgtcaatcgcatgacacgtcaccttaacaagaagataaatcaaaccaatagggatttgactgaactcaaggatgatactcaaatcctaacgactaaagtaaacactctcgccaatagtaatggcacagtccaagtgttgcaaaaacctaaccaggcaccaaaagtcaataaccctcctatcttaaattatgcgactccctctccactcaagaatcagaacaatagctttaacaatgctaatgcttcggttcttgaagccatacctctcaacaacagtgaggaagattcccaagatgaagaatttcaattaaatccttcgggatccatcacattaacatgctttttgctcaaactagtcactctttcacattcacaattttctctggaacctcaccattagaattcgatcngtgggcaagaaagttcactgacttgcttgactgncatggcagaaagtgggatgaatctgaaaagt

SEQ ID NO: 15260 - DNA, 2222 bp, Heterodera glycines
gacttgctggactgcaatggcagaaagtgggatgatctgaaaagttggcacgcctcaaggcatgcctgatgggtgaacctagacgaatctttgacaattaattcctgcccacaaaggaacttcttcggaagccattcaaaaaatcaaggaaaatctggacacaccacaaaataaagaacttacctatcaggcactaagcctgtgtaaacaaatggaaggagaatctgtagatgatttcagtgcacgactaattcctttgattgaggccactacggcagaccttacggctagtgctagtgaggaggtactctgtcgagcatttttggaaaaattgagtccaaatctcaaatttctcactcgaaccctgagtggacccgtcagaagggatttcaagatattgaaaatgaatgcgcgcgaagccgagttgatgcatagagagactccagagtctattccagccccacttttcccaatttcggaacaacacaatccgagattcaacaatactgagccgccgaaccacccggaaggcaactttcgaacatgggctcccacaggttctaacagagagtctataggtaccaggcagaggaaccggaacaattgggataacaatgcacaaacctcgagaggttcctttaatacatcgaatagtcatcatcaaaattaccaaagatggaacaaccgctcttccagaaatgacagacgatggaataaccagtctcctcaaaatgatcgaagctcgtcagagaactgactaattccctgggtattatcatgaattccatcagaaaatctctaataatacagaatcattaggaactgcacctgcactcaccactaaccctcacctttcctcccctgcacagtccaataataatcaaagtattaaatataaatctttttatctaacaatctccgcgaaaaaaaagaaacatttggcaactttcatgaggattaattggttggatagctaagtttaaagcacacttccattttctcaccccttaatcacaccatattttaagtatgtggaccaaccttgagaagccacatcaacttgaaaaatgtaatgataaattgttaaaaaaaacaataagtcccgcgggactatttattgctttatctctcttttatcagttctgaggaactttaacacatcttaattttatttaaatataaaagctaagtctttgcaatttttggaacagactcatattactcacacacttctgtctaagccctgcggagctaattaatgaataaaaaaaaaagcagtgagaattgataactcaaagccaaaatgctcaaaaaaatattttttttttaaattaaagtagtgaaggattgatacatgaatcccgtgggatttaagtctttggatcaggacgatccgttgatatgaaggggaggtatagtcatacggtcacgcttggtcaaatcactccgtggtatggaactcggactcaacaccgcgaaatatatccaaatctaaacttcagtcgtttggacgcgaaacattaaatttataattttaaactaatttttaaactttcaaattttggcaatttttatcagtctcatatttcgaaaatcagtaaccaatttaattcaaattaaatttaatcagaatttagaaacatggtcaaaaaaaaaaagaagaaggttaaaaaagaggtggatttgttttggtagctcaatggtagagctgccgtgggttggttggaggaatgagttcgttccaatcaggggcacggcattttccatttctaattttaaataattaaataaattatcaaattattcatcatttcgtttaggctcaactcaaaaaaaaaaaattttcatcttaaaataagtttaaaaaaaggtctgaggacttcattcaaattttggaaattattttaacgaacagggacggtcttttggagggtcggaggtgtaaggcctggaccggaaatggcattttattttcccacgcacatttattactccgataaactcctcccatcccgaggggcgcttaaaaggcaatggagagccagtcaaaggggcagtcggatcagtcgggagccatttcagtggaacggccaatcgatccccgcctgggaggatcccccaggcatccatcaacatcccttcccttccaagccctgaggggcctaattacggacgcgtaagagggtcccctggactaatttccctcataagcactgggtagt

SEQ ID NO: 15261 - DNA, 1614 bp, Heterodera glycines
  misc_feature (93)..(93): n is a, c, g, or t
gtatatgtgaaattctgttgaaagaaaagttaaaaaataatttatagatgaactcaaatcctttcatgtccacatatttaaaaatattcatanataatgcttgttgaacgccaaaaataattactagagaagaaacggggtagccgacgcggcattaatctgcaattattaaaaaattttgaaatagcccaaaaccactcgtcttaataacgaaaatatttatcaattgcttttgtttaatattgacaataatatgaatgcaaataatgtaatcgtatatgcgaaaattctgtagaaagaaaagaaacggggtagccgacgcggcattaatctgcaattattaaaaaattttgaaatagcccaaaaccactcgccttaataacgaaaatatttatcaattgcttttgtttaaagttgacaataatatgaatgcaaataatgtagtcgtatatgcgaaaattctgtagaaagaaaaggtttaaaaataatttatagatgaactcaaatcctcatgtccaacatattaaaaatattcataaataatgcttgttgaacgccaaaaataattactagagaagaaacggggtagccgatgcggcattaatctgcaattattaaaaaattttgaaatagcccaaaaccactcgtcttaataacgaaaatatttatcaattgcttttgtttaatattgacaataatatgaatgcaaataatgtaatcgtatatgtgaaaattctgttgaaagaaaaggtttaaaaataatttatagatgaactcaaatcctcatgtccaacatattaaaaatattcataaataatgcttgttgaacgccaaaaataattactagagaagaaacggggtagccgacgcggcattaatctgcaattattaaaaaattttgaaatagcccaaaaccactcgtcttaataacgaaaatatttatcaattgcttttgtttaatattgacaataatatgaatgcaaataatgtaatcgtatatgcgaaaattctgtagaaagaaaagaaacggggtagccgacgcggcattaatctgcaattattaaaaaattttgaaatagcccaaaaccactcgccttaataacgaaaatatttatcaattgattttgtttaatattgacaataatatgaatacaaataatgtaatcgtatatgcgaaaattctgtagaaagaaaaggtttaaaaataatttatagatgaactaaaatcctcatgtccaacatattaaaaatattcataaataatgcatgttgaacgccaaaaataattactagagaagaaacgcggtagccgacacggcattaatctgcaatttttaaaaatttttgaaatagcccaaaaccactcgtcttaataacgaaaatatttatcaattgcttttgtttaatattgacaataatatgaatgcaaataatgtaatcgtatatgtgaaaattctgttgaaagaaaaggtttaaaaataatttatagatgaactcaaatcctcatgtccaacatattaaaaatattcataaataatgcttgttgaacgccaaaaataattactagagaagaaacggggtagccgacgcggcattaatctgcaattattaaaa

SEQ ID NO: 15262 - DNA, 5206 bp, Heterodera glycines
  misc_feature (16)..(16): n is a, c, g, or t
  misc_feature (5048)..(5048): n is a, c, g, or t
  misc_feature (5114)..(5114): n is a, c, g, or t
  misc_feature (5127)..(5127): n is a, c, g, or t
  misc_feature (5134)..(5134): n is a, c, g, or t
  misc_feature (5139)..(5139): n is a, c, g, or t
  misc_feature (5182)..(5182): n is a, c, g, or t
atataaaaaaaaattntcgggaggaaacgatatgggggctttttaaatttttaagaatttcaaaaattttctggatttgaaaaatagaaaatttaacttttaatttttccccatccatttaattaatttttgctttttagaacaacgatgccaagctgactttggatgagttcaaagaaggtaaaaatcggaataaaatttttaaattgaaattttcaatttacaggagccaaggctgatccgagcattgttcatgcgttgagcttatatgaaggcctggccacataaaaaaaacaatctttttttcccatttattgtaattaccaatttttttttacaacccaaaactgatcagaggcaatgaatttttacaaaattttcaaggtattgattggcaaaaaaattcatttgagagagatcattttgtgttgcaaaagcataattaatgtccattcatttacttatataacaattttaatgcgaataaaatattcggcattcaataaattcaattctaaaaaaaacagcaaatcaggcataaatttttcagaacctcattaaggtaaaaaatcgaacaaaatttctcaatttttttttctcgttagcacatgagggaggcactgtcggaaaaatgatcaaattttacagggtcataggccaaatttgtcaaagaattttactaaaaattcaacaacccttaaaaattattgacattttgcacaaaatttcctcttcgcccgacaaaaattggggtcgtccggcgaggcatttgagaggaaaagataattaatttaattggacgatgatttgtacattattggttggtcttcactctccaaaaatggtggtcctccccgtccgtcttcgtcccctcccccattttcacatttctccgattgtgtcaattcttcatccccccgtccttcgccgtggtggtggtggtggtggtggtgcacctttccatccatctcacggcggacggaccaacaaaaatttttcgatcgattgtccttcagtattaaaattaaaattactaagaaaatatatttatttcattttaattttaaataacagatgagggcactttgaatatcaatacatagtatgagaattgtccttggatgtacttaaaatattctttaattaaattaatttttcatttttataccgaaaatttttggtttccatagcccctggatgacgcaatggatatgttgtccttgaaaaaactattcaaaaaatttaatgcataatgtatccctgtcgaattattggaaaaaaaaatttaatttaccaaattttgccccaaaatttttaatcaatttcggccaatttaatgccaatgatgtcatgttttgtctttgtttaaatgtttaatttcaaaaatttcatggattaacatggcttcctccactcattattataaaatggatccatctcgagacaatccggacctgaccgaggagcgtcggaaggccaaatttgacccggaaaaactaggcaattttttctggcaaggccaactgaaacggcggcgccaaatttgtgactatgtgcaggcccagggcactgagttggcaccggcacagcccgtgccgttcatgacccgcatggagaagctggaggacgtggcccgattggttagtgtctctcagaatacttgggcaatgatttgccaaggacaatccttgaaaatcagtaacaaattccaatgaagtccttggaaagatgtttaatccatttttgcaaaaataactaactataaaaaatgattaaatttcgaacaaataaaatttaaattgttttttattcaatttttaaaattttcagtctgttgggatgagaaagcatgccgaaaatgtgatcgatgttggcagtccacaggaacaattttatttcaacaggtaggaaatgagtactggaaaaaattaattaaaaaatcagatttaatcagattttgagaattatttcaattgtgaaatgatatttcaaatgataaaaatgatatagagaattattcaaattgataaaatgataaatcttgggatattatttgaccaaaagatttatttattaatgagtgagtgaattaattattttcgctcatttgctgttaattaattaatttaattatatctttttttcttttgcatatctaatttttgccaatttttgtccataggcataaattttaaggactgctgatcactcaagcaaggacaatccctataaataaggacaaacattcctgatataattcatatttattaaaccattttaagcctgatctgcggttatgacggctctccattccatttgcatttcattatggcactgccagcaatgatcaacaactgtgatgaagaacaggcggccgaatggttgcccaagctgttcaactgtgagatcattgccacttatgtgcagacagaaatgggccatggtaagtggcactgatcagctgagtgatcggcaatcaaaaatttaattttttaatgatttttaaataataagttaacaatgcaatgtttaattgtgattttaaatttacggaacattttatgtcaacaaaatatactgtagcaaatgatcagagttgaaggcaaattagcctgatcattattcagcattctaatttaatttgattagaaaggtccggcttttttatgcgttaaacaattaatattcaaagccgaatagttgatcagaatgtataatatgatcataaaataatattgatcatcttttattaaaaatatatgttttttaataaattttttaataataaatttttaaataactttttttaatataattttaattaaaatactaaaaataaaaaatggtttcaaggcacaaatctgaaggcattggaaacaacagcaacttacgatgcttctcgtcaagaatttgtgttcaattcaccgacaatcacatcaacaaaatggtggccaggcaatcttggcaaaacgtaaacttttgaaatttaaatttaaaactgcctatttttaaaaatttagtgccaattttgctgtcgtaatggcacaactgtacacaaacggtaaatgctacggtgcacatccattctgggtacaattgcgagacattgagacacataaaccattacctggtaaattataattaaaaaaaatattgatttttaaaatttaaaatttttgagtgtaaatttgtatgaaatttaaattaaaataaattaagaataataattatataattaaaggcattactgtgggcgacattgggcccaaatttggcattggttcaaatgataacggttttctacggttcaacaactaccgtataccgcgtatgcacatgttaatgaaacatgccaaggtgcgattttacatatatctgatctgatagttaaaaccaaaaaattcttttataaaaatttaattaaaaaaagtaaatctaagatataatgtaaaccagggatggcattccgaggccacaaaaaatttggtaagtcggaatccaggacccaaaaatttttcggaaatcctaaatctgaagccggaaatcggaattccatgtcatccctgatgtaaccgtatcttttttctcattgtactgttctttttctgccacttgatcttctggtttccgaaaattatttattttcagaattagagttttagaaaaattcattaaagtacattttataggttcttccatctggtgaatatttgccgccaatgcactccaaagttggctatacgtcaatgatgtaaaaaaatttcttaaatttatatttatttattttttaaattttttaaggtacgttcgctcagtgatggtaaggagcttaatcaatttttaaaatatttattttttttgtgcttttttttttgatatttggcaacgcaatttacttggcatgtgccatcacaattgcagttcgttattcatgcattcgacgacagggcgaaattcggccggggtgatttttgaaaaaattaaaatgtttaacttcaaaaattttaaaataaatattatttaattataagtgccaaatttttctaaaattgaacccccgagggctttgttttcaacctccctcaaaatttgggcttcatttcagaggggtgaagttaattaaggagaggcactttattttagggaaatacaacatatactgtatattttaaaataccgcattacatacatatgtaataatgtgaaatatatccagtctatgccataattaaaatatttttaaaattacccaatttatcgcacgagaaatataaagtttataaaattaaaatagaaattaatttataaaaatgtttatttactactaattaccttcattatgctcttaagtgcgggagaagtgaaggtgctcgattaccaaacacagcaatatcgtctgttcccgcaaattgcccgtgtgtatgccattgcattcaccggcatttacataatggtctaattaaaaactaattaaggcaatatttgatgtatattcaattttaaaggacatgtacaaatcagtgatggccaatatcaacgcgggcgatgtaagaatttgaaaaatattttacatatcatctaatgcaataataaacgttttaattgtgaaataatttaaaaaaaaactttgcttaaaaattatattttcattttacattatttaaatttatttattcgaattacttttttatatgaaacgatattattgaatattaatattttttgataatttaaataataaattttaatttgtgtaacttaaataaatttaattaattttataatatatttcaataataactatgaaaatttgatttcgccaatggatttgattaatcctttaaatatttggcatttgaaaattcaaaattggcatttcgtttgttcaaggccagcctcctgtccgacttgcacagccttggttccggcctgaaatcggtgacttcatggcaaacatcgcttggcattgagcagtgccggatggcatgtggtggccatggctattccgaggccagcggtttgcccgcactgtacacaatggcagttgngggttagccatattttttgtgatttttaggaatttttttcaaattttgcaatttttatacaggatntttagcaatgttncgattanattanagaaaatttactattcaaaaaagtaataagaaaacttcataanttaaaatccctaaaaaaattatca

SEQ ID NO: 15263 - DNA, 2585 bp, Heterodera glycines
cattaaagcaatttgaaaatcggatccctaattgcttaatcgtttaggagggatggccgcggctgttttggccgccccgtccgtgcccgatacgcccaaacgttcgccgttcgcatcgccgcggggcattggccatggcgtcgactcgccccggggggacgtacagcggcaaaatgttgcagtggttgtgcagggggcgcggactgtggcggaacttcagcaaagagacaaaacggcacgggaaccatcggccaaagaacggagcaaaatgggcacaaatgaggggcaagagcagcagcagaaacgggtgggaagaacaaaatttggaagaatatttgtttaaaatgtggcgattcaaattccaaaaaaaaaaacatttggaaaatcaataaacattttcctaataaaaagtgactttattgaaaaaaaattgttgaagaaatcctcaatttggctaaacatttttcgaatgtgttatgccttctaagctcatttcattcagaaagaggctgacgacgccttaccgcactttccaatttcggccgagctgaaggcactgtttggccaaattgaagattatgtggcagaacgtgttgagattgtgccctgctggaagcccttccaaattgactatatccccgcggtcggagaggtcgacccgttcatcaaagtgccaaggcccgaccaagtgagtggcatcagctgaaaagataaaaagattatctggtcagcagcgatcacaattggtctgccgctgacttgagatgggtgcggggcggagatcctgcgccgtcagattttgcgggataaacaatccgcaactgaatttttggaaaaacttatcatatgaatctgctcttttttgaatggctgtgtgttatttaaaaccgggacatagtcaaatgatctgattgtttccgaatttcatgaataaaaatatatccctaagaatatgattacggctatcctaattggacatctgggcaatggacatttcaacagtggacacgccgaaagtgaactcatttggacaaaagtggacaattgggcaatggaaattacgacaaattttgcaataaaaatgatttaataagaagttcaaaatatttaaataaagagaaaagcataattaaactcagaaattctccgaagggattgctcgtaattaatggaaattaaatttaatttgtaataattgggccagaaatccatacaaaaactttttttagtttgcaaattatttttttctcattgtaagtccattgcttagttttcacttctgttcaaataaattcacaataaatgtgcggctccatttgaattgatccattttcaaaaaaatgagtttaaaaaattacgctttctaaagaagaaattttaaaatttttcctaaagtacgaatttttttaatcaaaatttggagttctaagataattgcattctttatggtttttcagtgggataaatactgaaaaccgaaaatttacctatttatcacttcttaatctggaatttttgttgatattccctttttaacttttggctttttattgccaaaaaatagagtccaagtttctaaggttttgatttttagaatgacgaacttttgctgggcttggccgtgctcgatgagcccgccacgcaacagtccgactcggccatcgtcgacctccgactgcaccaaatggcggggaacagtgcggcggacgcgccagtgaaaaagctgtcacgggcagacagaaacgcacatcaaattgtaaatggaaaactcacctaaataattacaaattgggttgctcacgaccttcggggaataaattctcgggaaattgagagggcaagtcgggatcgaggatccgacccgatcaggggatagtcaaaattttacggctctattaattaatttctttttttttctagtccatataattatttattttcccgggaaagataaatgaacaaatcaacaatcatttccaactttatttttcaggatcgctgggtccaaaatgtgaaggaactgaggaggacgaaggcaccaacgcgggtggtctacggaaagccaatgccatccatcgagtcgctgatgcaagaatggccagccgaactggagcaaaagctgaaggagatgaaggtgcaaatagatgccaaatcgtcgttttataaatttattcagctgctcataaatgccaatttggacgccgatttggaggattttgtcgacctttgccttggcctcgtcgacattccgttgcacaaaagtcgactcgagtcgctgcacgttttgttctcgctgtacgccgagttccgcgcctcccaacacttccgcaacatggcaatggacagagacgaagcgggcggagcgaactcagcaaacattgaccaatttgtgatgccggattagagaaggcactgttgagacacatatcaataatgacattgaaattatttactgcaaatcactttaatatttattgtaattattttgcttttaaatcaggaatttcttgggttttttgtccctggtttgactttgcccgttttcgttcaaaataaagcgctattaaaaactccagctgtgatat

SEQ ID NO: 15264 - DNA, 1942 bp, Heterodera glycines
tcacgggcagacagaaacgcacatcaaattgtaaatggaaaactcacctaaataattacaaattgggttgctcacgacccttcggggaataaattctcgggaaattgagagggcaagtcgggatcgaggatccgacccgatcaggggatagtcaaaattttacggctctattaattaatttcttttttttttctagtccatataattatttattttcccgggaaagataaatgaacaaatcaacaatcatttccaactttatttttcaggatcgctgggtccaaaatgtgaaggaactgaggaggacgaaggcaccaacgcgggtggtctacggaaagccaatgccatccatcgagtcgctgatgcaagaatggccagccgaactggagcaaaagctgaaggagatgaaggtgcaaatagatgccaaatcgtcgttttataaatttattcagctgctcataaatgccaatttggacgccgatttggaggattttgtcgacctttgccttggcctcgtcgacattccgttgcacaaaagtcgactcgagtcgctgcacgttttgttctcgctgtacgccgagttccgcgcctcccaacacttccgcaacatggcaatggacagagacgaagcgggcggagcgaactcagcaaacattgaccaatttgtgatgccggattagagaaggcactgttgcgacacatatcaataatgacattaaattatttactgcataaaaatcactttaatatttattgtcttttttaattattttgcttttaaatcaggaatttcttgggttttttgtcccggtttgactttgcccgttttcgttcaaaataaagcgctattaaaaactccgctgtgatatctttaaattttctaactcagttgcttacaaattaactctctcatattttttaaaacttttttctcatataagttttttttgtcatttgccgaaaaatggcctgagcctggaccctgaccattaaaaatacaggcccagaggtcaaaatctaaaaatttgttcaagcagaaataaatgcagatattagtttttatttaatgtatggaagtgcaaaattattttaaattgacacaaaaatcacaaaatttgaccaaaatctattccattttcctaaatttttatggttgattttgaattttttcaaaccaaaatgtacaataaaaaaatgaagtataatatgaacaaaaaaatgccgttgagcagtaacgtgtaaaaatacttactaaaatttttttggatgttatgatttttggttggtcgaattcattaaaaattggtttgacaaattattaataataatattttattattcattgctataatataaatgcttaaatttcgctggtttattgacgtaatacttaagcaaatatattttaaatatttacgcaaatatattttacaattttaaatgaatcaatgaaagtaataatatttacaaaaaaacgcacttatttaaataaattccataaaacattatcatttttattaagcgaaaccatggcatcgaaaaatgagcattattttttaattttattttcatttttaattttaattattcactcgtcagaaagtgctccaggtattccgaaaagattgagttaaaaatttgtaaaaaattaagccatcaattcaagcgataataaagcaatcaaaagtcaaggagaaacatcctcccaatcagaagatgaattgtcaattgaccaaaactattgggaagaaagcatttcaaatgctaatggaaaacaaaatgaaattgaaattgagcccgctaattctccagcagacaatcatcatcacagtttatcagttgagcatctgtccaatcaatcgccaaagtcatcggcaagcgatacagtacaacagaccgtaatcggaaccctattttccaccccaactaacaataccataca

SEQ ID NO: 15265 - DNA, 3670 bp, Heterodera glycines
cagattttaaatgttcataattcttttcatctattcctttccttatattctcatggtgatctttttcctccttttcattgctgttttttgattggtgccctaaaagaattgccaaatttaaattaaaattccttggctctgctggtaaaaagatggatgttctcttcagaggcagacaaaagtgccttttttagtcgattatttaatactgactaatatttaatcttttactctttttctcattgtctttactccttttcttctctccctcttctttattattccacttacaaattatcctttttgtggagggcttattaaaggtacggtaacacaataatcaatactttatcgattattatgaaatttaaatcaatatttaccctctccgctcgcatttggcattaaaaatctgctcttccgcgtgctttccatcgctttttcttcgctctcctgccggtgctcttccccgtgttcagtgctgatcccagtcaagagtcgtgatggactatgcaagcttatgttcgagttttgccgactttctccattttgttgcacatgacggtttctttggttattcgttttctccactgaccaactcccattcattgactgatcatttgcttcatccgccgtggatttatcgtcgcgagaaaggccaaggttttgcaaattttcctccgatccgatgctttttgcgcgttcattgtcatttatacgcctatttcggtggacaaccagtgaatctttccgctcattttcgtgctcaacagcggagagatttctcgaattcatcggaatcgacgcgtcccgggaaatcagcgaaggatttcggatcgtttcggtgctggaagcttttcgaggattttcttcttcggaatcaaatcggacgtcaaatgatttgtcaatagcagcaacagcacttcttttttgctcctctgcttgtgatttcgatttgttctgtggttcattttcagtcgtcactttgtttttgaatggtgattttttgacttgtgttttggaataggcatcagtttcttaattgaaatgttcagttattaaaccacaaattttaaaaacggatgttttattgaggaataatcgagtgaaatttctaagagaatttgtccaaaaacttaatttaaaatttattattttttgattgaaatgccaaaaatgggctaattaatcttaattaacgttatttgacggacggactggaatgatttaccatttcgttctctgcttgttaagtgttccttttcatcgcttattaaatcttccatttttatcagaacactacgatcagaaacttcgattcttcttggcgattttttcggacttttcacttaaattaatgataaattaaaaataatactttatacaatttaattaaaatcgaaattaaaaggacactttaccctttgtgtcactttcttttccggttttcttattttcgtgggtaattttgtccttgccatttgttccccgacttttttctccccgtgttatcattatgctcgtgtcggaaacctcctcaatctttcgcggtgatttcttcgttaccttttcgatgtcatctggattttaaatttaattgtcatttatttcctcacatttctcataaaaataattttcaaataaatttaatttcggttcgtcgattttcttaccttcccaactctcttccgactgcttcttccctttcctcacatttctgttttgggcactctttttatgttcgaagtttttggcattttcccttcttcgcggtgattctttcttcgtttgttcttttgttgtttgactatccactgaataaaaatatatttttttaaataaataaaaaataatatgtaataattaaacaaaaccatagttttctctgcgatgatttctcctattttcccctgctgctggtgatttgctttcttctgtgttcgctttccgtgttctttttgtgggtcgaatttctttttcttccccatgctttccctcttccattttgtgattgtcagaatgtttccgttttttcgattttgattgatctaaattaaaacaccaatagaaagaacatttaattaagctgacataaatggcttaactaaactaaatgaatgaatggaccaaagaattttttaaataattaattgggttttatttttggccctttcgcttttcgagaaaaattttccattctcccagttgaggaatttttcctaaatgaggataatttagacaaaaatgaaaaattgattcaatatagctaatggagcgcagacagaaaaatctcgcggtcgcgaatttaaatttgcactgtcgcaaatcgcgacggcgaactaaaggtggcacttcaccactctactggtcttgtatcagttttatcaaaaaacaaatcccgccttctgcgttgctttgtccctcatgtgtcgatattttgtcacaaattgctttgacggctttttccatggcttcctttccgttcggctccaattcgctggctcgcaaatgctccatcgattccaacacgtcttccacatgctcaacacagttttggtcgttgtgcatttggtggcccgcatcgaccaatggaatcagtgccaaaatcaatgcattcgttgcgtaagaaaatttaggttgaatttctttctcaaaatccggcacatattttgactcgaaagagtgatccgaattccaccggtcgatatatcctcgctgaaaagtttgaaagctttgaacttattaagcaaatttgatacaaaacaacgaaaaagtgcattgtttaacttttcagttgaagtgaaatttttcattttctctaaaaaaccattcaattttctcccctagaaatatctgcttacggttgggtcacgcactaaaatatgcaaaatgcccctttttaaacaatatttccgttccatctgtggccattgtttatttctgttacgacggaggtgggacgtttctcgagattcccttttgccatgcatttgtgcacctgaatcattttgttggcctccatctgtgccaggaggaagttcacagcaaattccgcgtcgatgccggccgcgttggcctggttacccacgtgtttcagcacggtcgcctccctttccgggtcgtccaccggaatttggtgcgcaaagcgatacagggccaactcatgtgcgaccatcaaccggttgttgatcatttggatggcatggtgaagtgaattttctaaaaacaatatgcaaatgcaattgcatttttagtttgctatgatcacactacgaccccgaatttctaaaggctccggaatgcgggaccacccctggaacgaatcgggagacttggtacgaattggctaatttgttattacgattcgcccttcttccgttgtttggctatcattttttttaataaaccatgcactgttaatttatcaatccgaactggtgaggagaatggccttagcttggctacagtaagttgctaccgtaaccaatcatatttcagaattaattttttgttgatttaaaattacaattttatcaaaataaatttacctaccagtgctaaccgtgcagcacattacgttctttgcggttacaaatgccccaacatgttctccgttcgcatgcactgctgctgctgccgctgggttgtgcggatgcgtttcgactcctcc

SEQ ID NO: 15266 - DNA, 3412 bp, Heterodera glycines
  misc_feature (6)..(6): n is a, c, g, or t
  misc_feature (18)..(18): n is a, c, g, or t
  misc_feature (26)..(26): n is a, c, g, or t
taattntgtccgataatnttggtatntctgtcaaacaaaaatcagtatgaagctttttcttttaattatatctgatcatataaaattaaaaattggaaaaatgattaaatatcataatagataattattttttcaaaaattttgtttaattataattaaaattcattcttttcagaaattagagcgtaatctctgtaaataaattatcttcaatagcgggacattaatatttaattattttatattaaatattctcattattaataatttttttttaatatatatttttttattctaatgtaagtatttaaaaacgtgctgagtcgtttcctaaaaaccgccaccatgggcgtttcctaaatccgccaccatgggcgtttcctaaatccgccagggcgtttcctaaaaaccgccacatgggcgtttcctaaatccgccaccatgggcgtttcctaaatccgccagggcgtttcctaaaaaccgccacatgggcgtttcctaaatccgccacccgaagtgaattaaagacaataaatataaaaaatagttattgttatacaacatttataataaattaatataaatctctgtatttttaaaagtttcttattctttaaagtgttcaccaaaaacatgaactgtcaagcataacaacgtctaaaaaatatactatttaaaatacaaaataaatacagacttttgttaatgaacattcagcactttcatacaaacatttgcaaaagtttttgtcgcaatcgtatcgttttatagatttgtttatatagcataaatcatggtaataacagcaatcatcgactatattattaaaaaatgtataataaatttaaaatactttattaaaccttttttaaagttgcaaaaccatattactggtgctataaagcatgagtcaaaaaatgaagtgccacaataagtgccacaatatttctttgcaactttcaaagggaaattttaattataataagaaaaaaaataaaaaaataattaatttatcttttgtggttttcttattagttcataatgaccgtcatgaaagtataaaaatattgatgcagtcgattccttttgttggaggttcgaaagctaaaaattatatgaatttgcatattggaaatatttctaaccgatgtttctaaatctggtgagtacacttgccaacggaaaattcgttcttgtatacgttcacacacaattatatttattcgaaacattttggtgactgctgctagatccaaattattcatccatttttcaatttcatgggcgcctattgcaggagcaatagcattctctatgtgttttcttatattttcaatactatcaaaaagcactaaaatgttggctacatgttaaaaactaaaatagcagacttacaccaccattcattatcgtgatgattagaaaaagaatgttggtaaacagtttcttccaaatattcaattacatcctttcttatctcggagtgatttgacacagtgccagttaaggcaagagagatgcttctccaaccacaatttccatcccctaaaatttctgttacctcacccggtccatattcagaagaaacaaattcaaacggttctgagtagtctatatggtcttcatctatagttattcaataattttcaccaaactaacgccttactaaatgtataaaaccacgtttcgcataattcttggcgttggtcttcattaagagggttaaacataaaattcttagtaactcgtgtcattgttcgaataatttgtactgtttaagaaaatattaaatattgaaaaatattacacaaaaacctccccgaatttgatttcttcaaactttcacacttaatacaataggcatagacagtatttgcattttcgttcgttttttggtattttctatattcgtctccatggccaataataaaaagaaatttattgtcaaattttgaaaaacattgcgaaatttctgcattttccatgtcttcctcattgttgacttggctgtcttctgatttacgcttgctttttatttttgaaagatgtctctccagcgtccttagacttatttcaactccaatttgggcaagcttttccaataattctccttttgtctttatttcttttttaagatactgatcagctaaatttatcgcaccagcattttttgcaaattcatcgaaaccaattccactgatattttttaagcagcacaacaaaagaaaaaatattaaatattgtgttgagctcatttataaattttattagttagaatttataagtagcaataaatatattaatattttaattttattgcgcttgacaatgatgatagtgttggcaaataaatggcgtaaaaatattattaagatttatattaattataacgttggcaaacaactgacataaaaattttattaaaaaggaaagatatattttcgaaatttttgctttgcagttttaggaaacgcccatggtggcggtttttaggaaacgcccacttggcggtttttaggaaacgcccacttggcggtttttaggaaacgcccacttggcgggttttaggaaacgcccatggtggcggtttttaggaaacgcccatttggcggtttttaggaaacgcccaatgtggcggtttttaggaaacgcccacttggcggtttttaggaaacgcccaatgtggcggtttttaggaaacgacctagcaccatttcaaattacgcttcatcaattttgttaatattgtagacagtattagaagttgtacagtttgatttggttttaatttccatatcaatattgaactatataaatccaaccctaatgattagggatgcaatttttcggctctaaaaatcgcaaaaaggtatattttagtcctaaaaaccctcaaaaataggcatttaaaatggaaaatacgctctaaaaaagccaaaatttaggtgtaagagcgtaagattttactcaaaaatcaccaaaagtaaccaaatcagtattgaaataaagaatttttaaaatctaattttgtcatgaaataaattaataaattttttagatgaattttgagaaaatttttcatttcatataaatgtatttttgaaaatttagtgtcgattcttaggggtatattttcgtttttattgcattttgttaataaattatccaaaaatgtcaaaataggtttttcaaaattaatattctggcaaaaattaattttttatcataatggcgcaaaatcttatagcactcagatcttcaaaattttcctagacgtggtctacccgcactgccggacacgtcaaatctttttaatatgcttttaaaagggctaatgtgttttttaataaaatttttaaaattatttttaaaaaaattaacattttgaaaattacggattacgggttacgga

SEQ ID NO: 15267 - DNA, 2618 bp, Heterodera glycines
  misc_feature (11)..(11): n is a, c, g, or t
  misc_feature (23)..(23): n is a, c, g, or t
  misc_feature (67)..(67): n is a, c, g, or t
aaaactcccancaattccattcntggtatagttattttgatttttcttggtctcagcctgcttctgncatataataaattgatttgtgttttttctgattcgattcttagatatacacaagcagcatatgcatcttttgatgcgtctacaaaaacatgcaattctgctttgttaaatttgtcagggattattctccgcatgcatttaattgatttattttcctacaaacttgtaatgtatttccattctttctgtttttcctctcctattttatcatcacatttcctttcttcttcccatagactttggaagaataatttagctggcaataagcaaggtgatagccatccacatggatcaaaaacagagtttaactcttaaaacacttctcctgcttatcctttctgtttcatgaacatttggaaatttaatttggtaagtatcggttttaatgtcccaatttacaccaagtacttttgggttttcctttactaaacgatccttttctgggatctcattatttattttttcagaatttgagatgaattctctaatgttcattcgtgccttttcaaataacacttttaaatttttatagcaaagatttgtctttgaaattggtttttgtatatccttaatccaaaggaatttgacaaagtttctatcattttcttgtaattcaagtgtccaaaaggccctttgtatatcgccccaaagcgcaattttaggcaaacgtgaccttattagtaaaccaggcaattctggcatatagattggtcctctgaataacatgtcattaagtgatttttgaccttttattcttgctgacgcatcatatacaactcgtggcttttttcctgcaactagcacacagtgatgtggtaagaaatgttcgtcatatccttttatttcggtttcttcgactatgtctccttttatctgttctttaaatatttcatcataatgtttaaaaattcattggtcttttttaatttttcgattatgccgatcattcttcgataggctaatgcaaaattagtcggtaattcgtcttttgggcctttccaaggccatcctaccacgtaccgtccatcttttcggtatactgagtcttggaacatttttagtgctacatcatcatctttttctacgggattatctttaacaccaatcatttctaaatcccaatatttttctggctctttgtcttcgttttctatgatcattgctgtgagcgggcataattttggccctgatgaaatcatttccccacagattattgttccaaaaactgtttgaactttaacaagtccttctctgaatggttcaactttttggaagaatctccaaaactctcttcttccgattaaaatgtcaggtttttcctcgacaagttcaatttccccagaaattattcgctcttctaattttctttgttataaaatcgatacggctcacaacaatttcttcaatttttccatccaaagtttcaagttttatgatatatttaggtgagtttaggcgcactgggttatcttttcgaatgggtaaaatgtctaaatttccttcacaaagtttcgctgggttgattttcctgattagctcatctgtaattagagacacttgacttccgttgtcaaaaaataccaaaacttttatatattttgtgccttctatgattttaacgcgtatagtcataagtaatgcttctctttcatttattcctctaatggcagttgctactaaatttgaaatttgaatttgcccttcgtttctcgagttttgttttcttgtgtattggtttgctgatactttttgaatgggtcttggacaaattaacttattgtgattcccttcacaattatagcacatttttcccgtacaatttctaatttcgtgcccttttttcaaacagcgatggcatctcccttgctcatccataatttttattcgagagtctctgtttaatatttgcctgcaaagagatgcccaatgtggtccatcacataagacgcattttggatttggcaaatttgtcctattgctctgtttatttcttatttcttgtgttaaaaaaactctttgattattttgaggatttctttcttctcttttattatattctctgttattgtttctgtaccgattattttgccaattgctttttggcctattgaattgtctttgtcactatcccagttttcatgttgtccaccaattgctcttgttatttttgtacatctcattgcttcttccctcatggttattatctcttctaatcccttaattaattgttcaacattccattcaattccactatctttctctgcttttaacccttctagaataattgttctcggaaatttatttttgattgtcatcattacaaagtctttatcaccggcaaatcctaaattatttaactgccttacgactctttctatgtcttctaaacagatacgaagtgataccacagactcatttgcttgcggcaaatttaatagttcatttgaagtgcttcttttatcaccttctcatttccgaaaagtctttttaatgcatttacgactagagcataattttcttctgtcggttgatagcctctcattgctcgggaa

SEQ ID NO: 15268 - DNA, 765 bp, Heterodera glycines
acacacctctccccacgcctccccctcccccccccacgcccggcctcaagacgggcgcttcgcgcccgttttttaattttgttgaggacattgggccgcttcgcggcctcaggacgggcgcttcgcgcacgttttttaattttgtgggaacgttcggccgcttcgcggcctcaggacgggcgcttcgcgcccgttttttaattttgttgaggacattgggccgcttcgcggcctcaggacgggcgcttcgcgcacgttttttaattttgtgggaacgttcggccgcttcgcggcctcaggacgggcgcttcgcgcccgttttttaattttgttgaggacattgaaaaagcgcttcgcgctttgggagcttcgctacctagattagctatgggttgtggagtaattgttggtccagaagagagttacaacaaatgttagaagaagtacaaaattggaagaagaggtacagtgggatttttaggctgctttgtggagaatagaagaggtacaacagcgattaaaagaggaagaacagtgattagaagaggtacaacaatgattagaaaaggacaacagtgatgagaagaggtacaaaagtgattaaaagaggtacaacagcgattaaaagaggaagaacagtgattagaagaggttcaaaagtgattaaaagaggtacaatagtgattagaagaggaagaacagtgattagaagaggtacaacagtgattagaactggtaaaacggagattagaagaggtacaacag

SEQ ID NO: 15269 - DNA, 1664 bp, Heterodera glycines
aggacaaaacgtcgccgggacgtaacgtcgccacaaaatttttttaatttttaaaaaaattatcaaaaatttttagttacctagcctggttcggaaaaattctagaaaaatttaaaaaatattttttttattaagaaatttaaagaaaaaattctttttcaagttttttaaaatttttcctaaaaataagcaaattagtttttattaacacatagattttcaaaaaagctaaaataatttttaattttcttaaaatttttaatttttttttgtggctacgttatgtcccggcgaccttttggggtgtacccggaacggcccccactcgataaaattagaaaaaaaaattttttttttttagtaaaaagtgaatctgcgaaatatatcactttttgaagctttcaattttttgggctacaatcaaatacaaatatttctcggtcattttttcctgaaaattcttatgtttatgtaaaaaaaaaaaatttttttaatttacacgtggggaagctgtaattgattgaaaaatgccttcattgttgtcttctgtttcattgttttagtcgtccctcaatactgcttcttcttctggcggcggcaacgacgggcgaacacggcacggcgagttgagtgccgcgactgttggcggcggcggcaccggcacaaagggcgacgatgacaacagcaaactgcgctattggacactgatcgcgtgcctttcactgatctgtgccgaaatgaacacaatgtgatttttagcgcctgggaaagggggggggggcacaaatttggaaaaaaataatcaaaaaatcattttttagcattccatcgattcaaagttacgccaccttggcttattcgttggtaagtgcgggcgctgggaaaatttttggaaaaaattagtagcaatttaaaactacgtaaatatttttcccattttttgaatctttcggtttttctaacattcattaatccgtcaaaattttcttccggtgtacaccagcctaaaatttgctaaaaaaattttttttaattttcaatttttttttcttttcattggtttttatacgtttcgctcaaccgtttaagttttctgttctccacgagttcaaattaaacaaaaaatttggaattctgcgaaaattgctcaccaaatattagaaaattaaaaaaaaaactggccccttcagctcacctaccatttggcactgactctctccaatttgtcccatccgctggccaattttcttccgctttggctcaagccgcgctcactctccgttgtgctggtgttggtctccatttgcacaggtaggcacaattttttctcgattttttttggggggggggggagttttttttcaaaaacccaaagagtgaaaggcctgctgtttggcgaatgttgctgatcatgaacaaagatgtgttagccatggtccgggctgtatgacggagtattgcctccacccgaaacaaaaaaatcaaaaaagaaattactagaaaatggggaaaaaatttgaaaaataacaattttttaagatggacaattcacatttctcaagatagtttctcgtgcgggcgccctttggcaccgtccaaccccaccccttctaattcatgaaagaagaatagatgaaagttcttgaaaattcttatggcgaatt

SEQ ID NO: 15270 - DNA, 850 bp, Heterodera glycines
atcgaattccctgccgatgacagtgccgcggcatcggatgtacaagcgatgaccaaatggcttttcactccacttcaagaaaacgatgtgccaaaagtgttgagatgctgtatgcacaagattggtgaaaatttggcgccaaggattgaagcaatcaaagcggtgattttcaatgatttatttggctcttttacggttttggcgttcgtttaaaaattttatgcccaaactaggccacctcaatcgtaaaagtgcctatttttagtttttcatgtcacatgtaatttatttcgtatttttaaaccaatttttcccgtatttaggcatttacctatgcttcatcgtccgtcaatttcattgttgtcttttcgtttcgttcatcttttgctgacaccgttgtgccctttgtgctgaccaacgaattgactcgggaacaattggcattgaaaagaactgaattttgtgaattttgcacctgttttctgctgattcgttgcccaattgtgcgtgacgcggacaaatgggcgaaatgggaaaatgaagcaaatgattggcgaaattcttttcagtggaatcaaattttcatccaaattgacaacgaggacaaagttggggacgggtaagcgaatgctttttcaaaaattcagtcatcgcttttcggtttttaggcttctcgatgcaaatccgggcacaagtgatcagcagcagaagttaatgaatgaatgatttgctgagaagtgatcgaccaatttgaattatggaattattgacgtgctcaaaaattgttctttttttagcatggaatggtaattgatcaacatatgtatatttgtgttttgtatgttataag

SEQ ID NO: 15271 - DNA, 1531 bp, Heterodera glycines
accaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaataaattcctgcagaatttcccaggaccacgcgcatctttgttataccggtgtttaaatggcattataatcacaaaatgtccgacagtcatgcttttcttgccatgatcgtataattaagaaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaagtgtccgacagtcatgcttttcttgccatgatcgtataattaagaaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttactatatatgttatattgacaaggagtttcgtttgcaaaaacaaaatctcccggccgaaggccgggagcgccctgaaagtagtggaaaggtcttacaactttttgaggcgcatccgggaaaaatataggttttccggtccaagggccaactgagtaccagcggctcaaaaaccgactttgccgccagtctcagtgttacgaaattttttgcttttgctttcagagcttagcggaccccaaaagcgaaatgccccaactatggcctacaactttgccagcaaaaaatttttgatcagatcaaaggcatgacctgtaggttaggcaacgtaagaatcactttttttggacacttcagtaccaagcgaatagctcgtaagggtttgctcggagcagggggtcgccagcggacttattgtagagctcaatgagctcgattttttccaattttaaaaattttgaaaattttaaaatttttcgagctaggcctaaaaa

SEQ ID NO: 15272 - DNA, 2985 bp, Heterodera glycines
cctccgcctccccaccatccgtcgttgccgtcgcgtccattgccccccgctgttgctgctgtccgtgccgttgttgttgtttagatattgttgccgccgccatttgtccggcaccgttttctttggcattgttggcaaatccatcgccgccaccgtcgtcgttttgcttggcataattccctgtcgtctccgtctcggcatttttgttggccaaccgcaacatttggccaattttttgcttggtcctccgttcccgttgccgttcagccgccccatttttgtcaccgccgacgtcgtccgtcgccaatgcgcgccgcactttccgcggaattggcgtgtcgcttgaaatcactgaaaaataaataaaatgggaacttttttagggagagggtaggcctaaaacggaaatttaaaaaaatatttggaaaatccaattcctcccaattttcttacaattttttagatatttttaaaaaaaaatctttgaaaattttaagttttttaaaaatttcggtggagaaaacgaagaaatgaagtaaatcccaatttctgagagaaatttaaaatgattttcgaaaaattacaaaattttccaaatatttcaaaaaattttcgatttttatggaatttatacttttttataaaaaaattgtaaaaattgtcagtggcatttaaaagtattaaaaaattgtaccccatttttaaattttgctaaacctgggtgtgttgcctcataaattcggttcaaaagtcggatagccgcacgttttcccatcggaccatggccatactttgcaagttcggccttaaattgaacaaaataatattaagtttgagtaattagaatttcaaattggaattccaaccaaaaaaaggcattaaaaatcggaataaagtgaaaaaaataggcaaaatttggaagttgatgcaaattttcactgaaaattgcattaaatttcagatgttcattagctatttgcgaaattcggctcaaaattttgtcattttcacagcaaatttttgtttggtcttaaaatttcattgaatatttacaataatttgaccacaaaatacactaaactttgccaataaaatgcaaatcaacagcccctccccactccttagtttttcaaaaaaaaattttttttttgtaaactaaaatgcacaaatgttctgtttttaaacaaaacgtggcacccgtcgcttacattcagctcactttcgctcatcatttcatagaatggggccggcgttttggagtcctccgccaaaattgcgtagcccaaagtgccgccgccgggggtcggcgattcggcgccgttcagcaaaacactttcgttgtcctccgcctcctgttgcagttcgtcagcagtaccaccaccaccaccaattgcactgctcgttgtcctcggcctcggctgttgtccggcgttggtggcgttgaaacggtcaggcgcagaaacggccgcctaatgagtttgctaattagttcagactaattaattaatgaattaattgcaatcaattaaaatggcataaaatgattaatttttaagagtaagtcaaacgattttttgatatattataagctaccaaattaaacacattaattcaagagattctttcatcatttcaattaaaaataaaaatttcgtttttacgcataaattaaataaattttcatttttacggttaatttaaattaaaatttcccattttttacggttgctgtcgcgtgggcttagtgcgcgttgatatttgccaaaagcatggacagaacggcgggcacgccaacgcacatgtatttggtgcacaaacagggaaatgggtcatggcctaacagaaaaaaaatatatttaaatttgaaatttaaaaaaaatgtttctatgctttttattaatgcaataaaaataaattgatgatttttttaaataaaacttttatgcgaaaattttttatgtgaaaatttcctttttcccttggtattgtgccatccctccctctctgtttttctctctctctctctcctccctctctctctcctctctccctctttcttacaacagtgattagaagaggtacaactgtgattagaagaggtgcaacagtgattaaaatttgaacaaaagtgattagaagaggtacaatcatggtttaaaatgaaataaataagaaaattgtattattggatgtattataaatttatcaaattaaaaaaatccttttacttattaaaaataaagttagaaatttataatatagaatatttattgaaattgaaaggaattaattctcgaaaattcaaattaaataaaacatttattcatcagaaaataatttaaaataattaataaaacaatattaaattaaataatttaaattaaaacatttgttcaccaaaataatttaatttaaattaaaaatttttatttatttttaataatacaaaacaaattaattaaaaaatgtaaaagtaatcaaaaaatgcatagaaaattaatgttacaccgtccggatccgaacctgcccccccccctcaaaatgatgtctcagaatccccaatcacacagggattctgaggtcttaacgatgtcataactgaaatctgatttcatattcgtgatcagcggcccaaataacccctaaagacatgtttttggaagatttttgtcgaaaaaattttttcactcaaaaatcatgtgcacccccctttggtcccgaatcccaaaatcacttttatttttataacatttttcaaaaaagtgataaaaatgtgaaataaaatttataaaatagagctaaaaattggggatttttgtagtattttacttttaaataatgacttttcagaaccgagttataaatttttttctgaaaatccgattttttccttaaattttgaattatctttttttcttttgaacataataaaatataataaatctcgtaatattttccagatttttctctatttttaatgcttta

SEQ ID NO: 15273 - DNA, 3589 bp, Heterodera glycines
aaaaattgatttggataatcctactgatgatcattcactaatggtttataaggcatagcgatttaataatttttataaatgattttaatttaatttatttatcaaatttattttttaagtgatattggaattttttattatttttatatataaataattgttgttaaattaaaaataattttttttttaaattgatactgtaatttttttttgtaaaatataagctttagatagagtttcgaacaaaagttgggatttttatttagattttttttttgctttttcaaaaaatagataaaaaattatttataccaaaatattatgaaactgaaatttctgatcattttagaatcttttcttttttttttcttcttcctaagttacccttttatgttttttgataaataggtataaagtaaaaaggtcactagttaaaacagaaatttaaaactatataaacaggaatttcgaaattctactaaaagcaaacatccattttaataaataaatccatcagtatttaatgcaaataacaattatcttaaaaaagaagggattttaataatgattatttaaggcattttcatttcctttttgtttgacaatttatattttataaagaaaaacataatgatgtttattttctttatttctttttttattattggttttcatcaatttttaattacattttcaattgcaaatccattagtgagttaattaattataattaattaatgaaaaattaattttaataatctatttttattaaccaggacgaggaccaaaggctaattgcagttatgaaaggcgacccgaaaatgcgactaagtgaatattcaacgcaaaaatatgaggcataccttggcattgtgtatttaatgagaaaaaattggaaatgtgacaaaattgcggatgaatttgaagaatatgaacggaaagaatgccaaaaatatcgcaaatatttggacattttgcataaatatttgttcatgggatatgccggaattcccacagtcaagccaaaatttgtttttaaacataaatttgaaattgaaggcccactaatttttgtggtgaattgtttgaccgaaatttcgaaattttattttacaaaagagacaggacaaaattttagatataaattgaacgaatttttcaatggttttcttgaaccaaaattgttgaatgagaagcgattgaattatgagccaaaattgccaatgaatgaaacgattttgcaattggcaattgacacagcgaatgaacggcaaacaaatgaaagtttggatggcattattcaacaaaattgtggagaacaatttgatgaaaatttggaggaaatgttcaaaaaagcggtagaacaggcaaaaaaggacaacccaaagaaagcaaatcaaataaataatgaaaaaaaacaaaaaagaattttgtgttcaaaattagatgatcaatccatatgggtgacacttttaacattcaattaaaattatacatataaattcaaaaattaggctgatgatgctctatttgttgaatttgccaaaggattagcgacgaaatttgagaagttttttaagatggcagaagaatattcaaatgctttatttcgagctaaaaaaaaaggaaatattaattgggatgataaaaaaatgatttcttttgggttattcgaaaaagaggaaatgaaaaaatatttgaaaaaaaaatatgaagcccaacttggcgttgtgtatttaatgcgaaagtattggaaatgtgacaaaattgaggagaaatttaaagaaaaatgcaaaacaaatcgaaaacatttgcacattttgtacaattatttattccatctttatgttgaaggtttttattcaatcattatttataaaattaataaatttttaaataatatttaaggtaaaagtggtgaatttgtcaataaattttcggcagttaagccaatgtttttttattattccggagataatcaaaaggagttaatttccgtcgtcgaaactctgagtaaaacttcgcagtgtttttggggaatacacaaattgagcatttccaattcccatgaaatggctttgaaaaacgaggacgatttgatagacgagaaaaattgggaggaacaaaaaaatgttgtggaaaaaattgacggaccaaaaaatgtgcaaaataagcaacagaaaattttaaatttaccaaaagaaaatgaaaaaaatctttggaaagaatttgagcaaaaaatggaagaaatgtcaaaaaatgcaaaagcaaatgtcaaaaaagaaagggcaaatttgaacgacaaagcagcagaattattaaaaaaaggcaaatatgatagcgaaaacgaaaaagtagatctattatatgatgaatataatgccaaatttgaaactttcaaatcgtcgccattttactaaaaaaaatccacgtttttcttgattttcttttcttttcatttcattttcatatttttcaattcattttcatttttctcgcatcaacctttctgtccttttttttcattttacatttttacaatttttctctttttatacatacatacatacatattttgttgcttggtcaaacttttggaaaatatttttgcatttttgtaatttattaattttacaatttttgacccagttaccccgaccgatttgttgatccccagagtactgacaaatgagaaggacgagaaagagaagagagaaagaaaaaatataaaatttgtaactgaaaaaagttaggacactttttaaacttgcaaggactcagttggcccgctcgttggaatttttttttaaagtaaccaaaacgaaaaaaatcttcgaaaaaaatgtatttttataggaaattttttaattacgcctaaaaatctaaaaaaaaatttttttttaaaactctgaaactaaaaagtctaaaatttttatgaattctctttttaacgatttttaaaaaattttctggggggaaaactccgtggggaatgtggagcgtatattctttcgttcatttgggcttataattgaattgatatactattgcgcaaacggtaccattaagccactgcctgtgccaccagtcattaatgttgaagcgggcggaagacgaaatttgaccaaaatgtcttccgcctcggattgccaaccaccgccggcggtggacaacggacgcgcggagacggcatcgaaaaatccaagcggaaattggacaggacgcggctcttaaaattaataaaaaaaaatttgcgaattatggtacacagtaatggagatttttcgtttgcatactgtatgtacagttgggcccctcaaatgccgtgttggaacagtcgcatcggtgcgcattgtgcgcgtttgaacaaatgccgccgtttcggcacggcgcggcagtgccaccgccgccgccgctgcgtggagatgccccaaatgagcaataatcaacagcaaatgagaatggacagccggcggacagaggagcagcagaacctttaaaaatgatataaacaaaatgccaaaatttttaattttctgtgacagaaaaagggttgcttgcaaatttgatttaaacgattttatcaatt

SEQ ID NO: 15274 - DNA, 1881 bp, Heterodera glycines
  misc_feature (1838)..(1838): n is a, c, g, or t
  misc_feature (1868)..(1868): n is a, c, g, or t
atagtaagatataaaaattaaaaatgtaaataaattataattattaaggatgcaaagaagcccacaaacaaaatagtcaaaaatagtttgtttgttgttgtaccattaaattgttgagaaatataataaaaaattataatgttttgaaaaagttgctgaataataacacataattacttcatccattaataaaatttgttttatacgctattcatgatttttttcaatctattaacaggaatatgtcaacaatggagagctgccacaatttttttgtgggttttcattgatttttgtgtataaataacaacaaaaacaatgtgaaacccacaaattaaatacggcataagcattacaacaacgacaccaacaattctaaatgtttacatcagaaaaattaacatcaaacataaacatgtaataaaaaatttaattcaaaatcaaattttacatattttggccaatttgtgcttaatttgcgcaatttgaatatcttctacaataatattctcactaataaaaacatatttaattcacaaacccttcaattcccatttaaattatatttctttaataaatcctaataaatttaataaatacatccatatttgatgatcctacaaaatctctgacataatttcctcggccttttatttcccacaattgctatattgctatttgcctacgaatccttatatttaaatatcaaatgcaactcagttttagatttaaagtgcttttactaattatattatttaaaaatgcaacaaactaatgcaaaaaacccaaaaaaaggtaaaaatgatcaaaaatttgattaaatatcacattaattaaacttcagaaatcaagtctcaaagccagaatacaagccaaggcaaagccttgcaaaaatcaccacccggactcacattcgttgacccaaaagaattgtaaagaattaaaacctcaaaaataatttatttaaaattaaaggaccctgtcgcaatacaaacgcacagagtttcccgccgcagaacgcccaaaaggattttcccaatactcgtcccaaccagatgaaaaagtcaaatcactaataaataaattataaaattcaataatttcagaagaagcaaccaaagccttggtctaaggcagcgttgggaatgagagtaataaaaaaaattaaaaaataattattaacaaaataaatataggattcattcgatgagtgcgacgatagcgcattcgttggaattgaccaaaaggagcaggtgcaatagcaatatatcctgtaaaaaataataaactatttaggacgaagtccaatttcaatacgaatgcaaatcttggtctaaacgttcgcgtggccaaagagtaaattaccaattaaaatgaattagttaacattaatttaggattcgtttgacgagggtgacgactccgctttttatggtccatcgaccagtaaatgatttcaaatgggctatttcacaaaacattgttataaaatttgaaaaaaatccgtaaaaaaatttcccttttgaaaaccaatatttatcaaaattattccaaaatacttgaacaaaatgcgcattgtattgaactggagtgagatacctccacggaaaaaaacttttttgtgacatgaattccaagcgtatgttgatatggtcatatgctggattttatgctgcaaaatttgataaaagaccactgcaagataattattccacatctattcattatttgtgtcgttgtgagcttatttttgcaacgcttctcttcaaaatgaaatttctactatataaaataataatctacgatttccaaatattcattcttgcaccctccaatanaacttcaaaatattaattaataaacacacnattattcttaata

SEQ ID NO: 15275 - DNA, 1310 bp, Heterodera glycines
gtttttgttataaattaataaatcaaatttttaaattcaatgctaatcatcactgtaaattctttacatttaagcctatgtcttcaaattttgcaaagaagacattttactcaaacacaattgctgccgaacctaactggcacatgtatatcaacaaaattccattggtaaactaagacaaaggaaaagtaaataaaaacaataaaaaaatccacagaagtccgcttcgggaaaacctctcgagaacaacataagtaaaccgacttatgctcaaatggttatacaaaaaccggtaatataattaattttaataaaattgaattacataaaacgatactcaccataacacagacaactatcgttacgaagccaagcaaagaaaatgtcgccaaaaaaagcgaataccagattattgatgaattgaaccacaaatcgcctatgttgaaaacatattgcgacattttgtttggaattaaagtaaaaataaaaaaactttcaatttattaaaataatttttaagaaaataattataattataaaacaacttatttagatcctgccaacaacaaatgtttgcaacaaagtgcttaaaatcaatgtggaaaaaacaacctctttgtctgtgtccgcggcaaaaaagaaaagcagttgtctccaaaattttgttaaaaaaatggtcagaaaaattagcattttgtcaactaaaaattaataatttatagaagtcgcattcaacaaagcgcagaatgataacaccacaaaaattagctgtaaaaaaaattcttataaagaacaaaacattggaaaataaggttaaatcaaaataaaaataaaaataaaatacgtagattaagatttcaaacaaaacgattgaattttccactcgagatgatgcacaaaatgctgcccaatttatggacaataataaatttaacgttttgacatctctaaccaatggtaaaatttaatcatttttttgcgaaaaaattatatttatcacatcggttgtcagaaattctcttcgacccaattggagttgcaaatgacagagcaagtgtgcttctttcttcttcaaactcaaaaaaatggaaacaattgaaacaaaaaatgaatggccggacccaatggattaagcttattcctaagcttaaatatgacatatttaaagctaatatcccggtaaaaaaacataagctaaaaaatcatttataaaaatttgcagcagcggtcttggacttctgacttgatccgagccatgctattgctgagagcttatatatttaattgcgacaaacattctttaacattcc

SEQ ID NO: 15276 - DNA, 3731 bp, Heterodera glycines
  misc_feature (34)..(34): n is a, c, g, or t
agaagcaggaacgaagcgaaatgtaattgaagcngaaaaggaaaacgaagaattttgaggtcgaagcgatcagaagaaaagaagcgcaaaaagcgcaaagagcgatcagaaaattgcagggagaatggagggtccttaaaaagaagtgaattttggaaatcaattgtaattacttcgatttaattgtcacataaatgaggcatgagttcaaacaaacgcccaccaaagccaccaaagccaaaatgccattgatggcaatttcggtgggaaccaatccggcatttttataaaggtcgtaaaactgaaaaggcattcaattttttatttttaaatcaaaacattggattaaaaacaactaaccttgtctactaattctgttgtcattttttgttagaaaaaagtccgttattttgcttattttaatccactcaaattaaaagtaaatttcagaaaaattacttttaatattgataggaatggcttaaaaatcaaagacagacccaataatcattgtccttacaaattaaagtaattctctagcaaattactggcctcgctgtactggtaattaaattcataaattcataatgtgcccgtaattaaattcatgcatattttctattacaataattacattggtagtaccagaacaggaacagctggtgttcattaattacattgaaatggtcaaatgtcattcaatcatttaatgaaaagcccacatgatgctttttgatataaaattatctattaaacaaattaatagcctttcattaattctcatcagattggtgctatgtcattacttaaaaaccatcataatgggcgttacttaaaaaaccatcataattaaaatttttgcttataactttgctctaaaaagcccaaatttttaatccttgctatcattcgatagatctaaatgttctttatgagcctgtaaaatttcaaaaaattttattatgtttaaaaaaagttatggccaaaaatgttcgaaaatcacgtttttttgagttccccgagctataacttttttgaaacttaacgaaattttttgaaattttgcagactgatagagaacacttagggctatcaaatgatatcaagaattaaaaatttggttgctttcgagcaaaattataaataatttttcgacaaaatttttcataatgatggtttttaagtaacgacccagcaccgattttttaaatataaaatatttttttttaaatttgatctttagcggtgtatttttgtaaacatctttggggctgtatttcgaagttttcggtgaatgccgaaatagggaaaaaatatcggagggtcgaattttaaatatggagaaataaaaaagcttcctagaagtttcaaactaacttaaaaacacattcacatctatttaatcacaaacacttttttaaacaataactcacattaaaaaaggaatatgccagcaatgaaaacgtcattagaaaacaacttatttgtaagtacaaaaatatttactcttgaccataccatttccgattagtccgaccaggaagatcaatgcatagaaggcagaatacgtcacctgaatgggcataattatgtcgaatgctatgcatatctcaatcagcaagcagacctgaaaatttgattttcctagccctatttgtactttgggaaagcggatatagcaataatttttatccaaattatagaaaaatgccaatttgctctggagttatcgtttaaagagaataattatttgaacaattcaatatttactcaattgctaaaaattcaaaattccaaaaaaatttgtaaaaaataaaaaagccaaagtatttaaaattctattaaccctctctaattcgaattttctcgaagaaaaattgttttatttaattacgaaaatatcaaaataatgatttttaaacttttatagagggttgttctaattgagattttttttacaaaattccaaaataagactcccatcataagaactttaaacctaatagttaatatatgattttcgtgaacatttcaggccctctctaaatttttattcctaattatttccatttcctccattgcctgcacttccgtcctcagagtccaatcgccgaacgaactcataaaggtgttcaggtcaacacagtgctgcttaattcgttcactaatcatcgccggcagcggtgaaaatacgaagccaaagaatttacacaaatacaaattctgaaatttcttaagaaaggtgggacaattgacaatttcaaataatgtaacaggcaaatttaactcaattaaacaccacttaatgccacaaaagcattattcaaaatggtcataaaaatgcactgattttcataaacatttgaagattctatttcaaaatttaaataaataaatgaaactttaaatttattaaaagtaaaataatatatgtttacgctcattcatatacaaatgttccagctgtcacttaaatgatgcgtcggcgtgtcatgcctttcggattaacctatgctcttagcataagggggcgaagatgactttttacttttttttggccaagcatggcaaatggagcccaacccaacctttcgtccaactcatgcggagtcaacatggtggactaaaaagtgtgctatagcccttgtcaaaatataagtgggccacgccatggccacaggaaggacggatggtaatcaaatcaggctcatttcggcggaggagtcgagaagagggaaattggcattggccggggggggggggaagggaagggcctaaaggaggaggaggagaagcggacagcagagggtaccaagtgtcccccacgcccaccgaatgagcaatgccaatgccaactccaattttcgatggttggcccccctttgggagaaggggaaaatgagagggacaattagaggagaaacagtggggataaagaaagcaagaaattttagaaatgataatgatgacggaaaattaatgatgaatccaatgaagagaagaattgtaatattcaatgagctggtcttctttctttgtcttaaacgtcccaaattttaggaggtgttttagcaacttttggagttgaaaagccaaaaatttagactaatataaaataaatattttatttgtttttttaatttaagctttttagtgtattttttaactttgtttaaccaaaaattgaataaatacacattttttggagtttttgagggtttaaagtagagatcggaccggtcggttttttttcggtatttttcggtatttttcggttttcggtttcggttttttaaccgaaaccgaccgaccgaaaattttttgagtttttcggtttttttcggtttcggtttttataccgaaaccgaccgaccgaaataatcaaaaaaccgaaaaaaccgaccgacttttttcaaaaaccgaaaaaaaaccgaatcaaattggagcgatataacctgttaataataataaatttattgcttttttgtgctctttttcattttgaagaattttttgtaaaatattttctgctattttgaaaaaaattattaacaaaaatgcaataaaaacgaaaaatacacccctgagaaatggaaaattttatcaaaaattcatattcaaaatctatttatttatttacttgactacattttttgatttttaaaatatttatctcatttccattttgataaaagtgaaaaaaggaagatttcgagcatttaaagagaaaa

SEQ ID NO: 15277 - DNA, 1171 bp, Heterodera glycines
cttaccttcttttctcggagtcaattgttgactcccaccaccccgcgctctttttctcagccacttcactctttcttccatctttctcaccctcttcactaaatcttttaacactttttgatggcacatacttttggccataaataatactgaacaattccatcaccttttctcaagtgttttgcaaataatccattcctttcttcccttccctatgctttttcttttccctatgcttttcctcttccgttgcttttcttcttcattatgattttcctcccctctatgattttccctttcttttcccctccccctcccaatcgtccgattgttctcttcttccacttgtcttcacttctacttattccctacccatcctcatcatcccattcatccaccccctcctcctcccctctttgctctctctcttcctccgcttcactttctttctcaaatttcaaattcccctcccccaccccctctctctccgccctctcaataatcttttatctttcccttccccctcatcaactgtccccaattttttttgttgttgtttcgacctttccaatgcaattttaacttcaattttgcccttatcataaatccacccccttttatgctaaaatgcaaatttttactcaatttgcttaattacccctaataaaaagtaaaaaaaaaaatttaaaaaccgccggccttttccatgaattaaagcgagaacaaacttctgacaatgagatagaatttaaattacttaatttttggtattttcatttttggaatattatccccataatgactaataatactttatccatgtaagaaatcatttaccaattctttttgtttgctattaattgcttatttattttgtctcactttttattttcatcccatttttcttcgttttttggccatgcgtcatcatcaaaattccctctttatggcactcgaggggacaatgagtgccgatgatatcgttggcaaatttggcatttgagggacagaatagggaattgggatgaatcgaggccattaccaatttcatgccatcctttcactcattcgtttggccattcaatgcgctttaaatcctccaaattggcttcatcccaaaatgacaactaaagcgaacggagtaatgagcttacaattagccatttttgaa

SEQ ID NO: 15278 - DNA, 1013 bp, Heterodera glycines
ccgggggaattttaaaaatttgggtgcaatttgttaacagattttcaacaaaaaaaggttggtttttgcgattattaagctcaattggtaggattttcatttaaaaaatgataaaatatgtatcaatttaaaaaaaactatgaggaaccatattttctttataggaaacccacgagtatacaaaaacaaattgaaaataatccaatttctgtagagggattgagccaggggaaagaagaagggaaagtcaaggagactagccattaggccatttgcacacctgggcagtgttacttttaaagaatatattaattattattttttatttttccctttgactccaattttcttcactaatttttcactcagacccccattcttaccagtgcttgtttttcccggttcccggttgccctaccgggaccgggacctcggatgaccgggaattcccggcccggtcccggtcccgtggcactctactttatatatttcttaatttatttaaaacctatcaaataactttttttcataattgttcaatttttaattgtattcaattaaaacataatcaattaattaattatgtttgtaatactcattgttttttttatcaaatacaaaaagcaaaatctgttccgcaattataacgctgacgtccgcgtcaaaaattccccaaaaaaggggaatttttgagtttttattgaaattttgtacaaagacagagagaaagagagagagagagagaaagggggagagagagcgagagagagagcgagagagagagagagcgagagagagtgagagagattaacatttttacaaaaaaatatcaatccaaagataaaaattaactgacaatgatttcccctcattgtccgttctcccccccccgccggtctctccgaatttaagcaaaaagcaaatcgctgctactgaagagaaatgtactcttagtaggatgaatgaatgaatgaattgattgtggaatgattataaagttaacagatgataag

SEQ ID NO: 15279 - DNA, 2200 bp, Heterodera glycines
tttcctcccgagcgatggaatgtatgtacacgcaaaattccacactcgcatttgcattgtctgttgagagacggtttttggcaaaacaccaaatttcaagaccaaaaattggcatttttgtttcaatttcattccgcccgcttaattaataaaatggtacacaaaatactttggacaattcttcgttattccaatttcttcaaaatatttcaacgttattttacatcgattcatctgtacgaatgccataatacgcgtgccaagacaaggcaagatgttggcattgctgagtcagtcagtcgtcagtctgtcggttcggacagaaagccgatcgacggacggactgccacagacactctcagctgtgctacatttggccatgtttgggcaagggcgaatattttttttgggggggggggaggcgacaacggaatgaaggcatttttttaacgcaaagacagacgaacacagaagagaaacggaacggaaatgacacaaagcaaaaaagaacaatgcaagttgggaaataattcttatttgaccgattatttaatgaacaaatgaatgggaagtgaatgtgccgtattcatttagtaattcattcagtcactccgtggcacttcgctttgcccggccgatgggtcgttcacttcgcgtaagtaccgtttgcccgagggcaattccaccggtcggactccgcccccaacgccggcgaacatttccttggccttcgcatccgtcacccgtggttcgaccatacaagcggagcccggctcaaagggaaggaaggcaaaatcagcggaggacgggaaaaatgccaattttgaataatgccgaaattggaaagacaaatcgaagacgaataaaaggagaagagaaattgccaaacaaaggagaattgacgcgcaaagaagcgaagggaaaagtgacgccactgattgatgctttacaacccttttgcccaccttccatccctccggcgttgccaccataaatttgtcagaaagctgaagagagtcaagcactcgcaaaatttcgctaaatttgtataaagtttcagtggtgacgtaaaaagggattcattactcaaaatttcgtccggtacttgccggataaagcaaagacagacgaagacgctttttggggtcgacgataaaaacataaaaaatttggcacgttaaaggccaaattggacaatttcaaaactcactgctctgaccgttaaaggcacaccggacaaatcggaatttagtgggtcaatcatgccgaatttaattgccaaaagacgctgctgatcagcaatgattggaaagggaaaatcggcttaaagtagacggacaacggtagacagaaataaaaatgtgagggaaggggaagagagtgagagaatagatgagagaaggatcgagaggagaggggagagagaatgagcgagggagagagcgggagaaaagcagaaagagagagtgggtgaaagaaggccgagcgggaaaagcgagtggatgagagggaatatgagatgagagagtagagagagagagagggaagagagagagggaagggagagggagagagagagagagggaagagagagagggaagagagagagggaagggagagggagggagagagagagagagaggaaagagagagacgtagagcaagagagagagagagagttgatgaaagtggagaaatggatgagaggagggggggggggggggtgaatgacggtaaaaacccaactcgtactattttagagtatctttttttctctgttctctgatgacttaacgctgtctcgcttttttctgtttctatatttactacataatagtacgagttgggtttcgtccatgaatgacctgccgacgaaatcttctcacttccgttccctttcgaattgccatacgcggctatgtcttcagtccaattgcgatgcgattctttttgggaatgcctttttattaaaacgtttaattcggtctcaaaaccactaattttgcatttttcagcgcaattaatcactcacaattcaaaaattgtctatgaattttaccggacgaatcgcaactgagtgcgatcactttgacatggcgccgcgcgaattcggcggtgagttgcgcggcacgtgccaattcggtggtgcaaacgggcgtaaaatcggcggggtgggagaagagaatggcccaactgacaa

SEQ ID NO: 15280 - DNA, 2070 bp, Heterodera glycines
  misc_feature (1394)..(1394): n is a, c, g, or t
gcagcatgtgtttgccggagaatcaaattacgtatattaatgctttctttcatattattttttcgaatatattctagattaaaatttcaccaaaaactccgataaattgcatgaatctttgttttacaagaaacaacaaatagacaaatcaaataaacaagttaatttggaataggatgggaattagaggtgattatgaccggccaatcattgggaaaaccgtggggagagagattggacatcacaaaaataatcgaaactaatcatgtaaatcctttgcgatgccaaaaccaccgttttcgatatgtctgcgtcatggaaattagtccaattcgagttcggagtcgattttctgcgccgcgtcgtcggcattgtccgtttcgcggttttcgccactgctcccttctccaccaattggaatcccttcgattcggtcggcctaaacaacaattaataattgcccgattagcataagaattacttcgtcaagcaaatattcagcagagcgagcataacctaaaaagtgaaattgacttaaaaatgccaattggtcgtatttacgttccgcttgttcttcctgtccttcgctgaagaaaacatcgccaaatttcctctgcagaagtgcgcatgccctcaacatttcgggctttcccttcgccgatttgagggcccagtcgagcgttttgttcaaaaatggaatgcgacggtccgacgatggactatcagagttaaatgttgaaggcaaattggaaaacatctgaaggatttttttgtttgaggaattttgtcaatttgaagcgcaaaccgtcagcaaaatttggagattttctgtgttcagtgtggcctcactttgtttgagtgtctccgcgtaaagctcggccaagtcaattgcgcttgtgtattcttttgcttaacaaagaatggtacaattgctaataagccatcctttacttttttgaggacttaccttcacacaatattagaacggtggactggatttgctcgagcagttcggtaaacctccgttccgcgctgagtcgcgcgtggaccgtccgcaaaatttgatgcgcttcataaaactgcttagaagttaaagccgcactcagccgttgctgtaatttagcgacctgtaaaaagggcaaaataaaaagaagcgcatccattttgtagaaactgaccttactcatttcgtgcagaagcaattagaaaaaattggaattaaagtttttaaaaaaataaaaaagttttctgcctgacggatcaaaataaagaaaatatattaaaaaatgtcagcacttaattataaaaaaattcaatcgcagtgagaccaaacaacaaaaagtgtgtgcaaaacaaataaaaatgatcgaaacggacagcacaaacactcccancgattcaatggatttgtccgctttcagccttggaattgcattccgccgccaccaccgcccttccctaccaccgcgtccaaatccgccacggcctcgtccgccgccccgaccaccacccacgaaaagcactgccgcgtccgcgaggcgcaccgccctgtcccatgccttgggcaccacgttgcgcacgaccgatgttctacaggcgaagaatgagagaggggataatgaaatattaattttaatattcggggaatattcgagacgcagaaactaataaatgatcataaatatacatcagtcacattttcctttttatgaataaataagttcgtggaatttttgaaaaaatttgttagttagagcagaccataaatataaaaaaataaattttaaatcgaataatcaaaaaagacaatctttgtacacactaacaataaatagccaaatacccggtcactaatttacttactttaaacatcggagcgttcttaagcgtatccggaaggaccgaaaaacggatctgtgagcctcgtataaacacgttatccaatgtttgggtgcgaccatcgcgaagagttaccttgaaaacggaggttccttttttacgatttgtatttggccacgagcgataatcttttgcactattattttgtgttttattatttaggaaggccaa

SEQ ID NO: 15281 - DNA, 1046 bp, Heterodera glycines
tggctccaaattaacaacctttgcgctgtcctttctttcccaagaaccctttggttatttattttttaaataagtcctttaatttgattttattccataaattgtccattttaaatgctttttctgaaccgatcctccccccccccccccacttttttttgtgtctccacatttaccatttttgtgcaagtcgtccaacttttttgtcttctcgctcggcttcctctgctgctgctgcttttggccaactccttggccttgtgtttgctttgttacccctggcgaaatcactattaattagtgttaattactcccgtccaattgctcactctttgctttcggcttttcatttccggcggatgactgctcctcgtccttcgcttttcccttccctttcaaaattcgttttccccttttggttgacttttcctcttccgacgacgattggctgaagtccatttcccccgagttgaggccgtgttcctcctcttcgtcctcatccgtcgtcaccacctttttgccgcccctttttcgcttcatcggcgttgaatattgcgttgtgccttttgatgtcgacgattctctcattaatttctccacgtccaaatccttcaaccatttctcaatctccgccattgtctcatcgtcaatttccttccctttcgactgtttcgatggtccgtccatttcttcgtcctcctccgaaaaggatgcttcatcttcgtcttcttcgtcactcattgtccgctccttctccttcgtctgtttcatgcttttcgactttccctttaaatttgctttgcgtttgcctccgtcgccactttctttgaaactctaccatttttgaacattttgatggcgatgggccggcatcaggtggaagagaagagacgacctcagcgagccgatgagtcgcgggcattgacgagaatgtacgggtgtggaaagatttattgctgatggaccgaagatgaagacggcacagaaacaacggcaggcatgaggaggaaacgagggggaacagataaggaagaggggacgaagtt

SEQ ID NO: 15282 - DNA, 2154 bp, Heterodera glycines
tgctttgacttgctcagaatcgaacgatgaatcggtctttgatggcacttcaatcggcgccgtttgtttgccctttgtctgtgccatcctttttttcttggattccatcgcctcgttctcttcctcctccccctcgccaatgtcctctcccaacccatacgatgcagacgatttcgacagcgatgccaattcgtccgactcttcctcctccgcatccttccaatcttcgtccgatgaattgtccggttcctcttcagatgacaactcaaactctggtctgtgataccttgcagaaggcgttctctgccttttcgctgtcaatggcacttccgctagtccaagtgattgttccttctgctgctcccactgcccctcccctcttccttccctcagctgttgcgccggtgccgtatcaaatggctccatttttggtacttttcgctttggttgcgccggtgccgtatcacttggctccacttttggcacttccactttcggtatccgctccttctgctcccactgttcctctcctccccattccctcgactgttgtgccggtgccgtctcaattggttccacttttggcacttttaaaagaggggggatgtccatttgctgctgatgcttctcacctaaagtggtgggcgagtgcgtctctgcgtgctcatccgctgccaattctgctgggttaaccgcatttaatgtgcccagtccgctgatcagcagaaaaatcattgtgaaaagcacatcaacaattattcggcgcatcttaatctgttgccaattaaatttgagcaagaaaatgaaatcaaaaaaagaaataatgataatttattatatttcattaaattttttaatatttcatgcaattaaaaacattgcgtaattttgtataaatccaacatggaaatatgtaagtgtatgtatgtgcatatgtacatatatgtgtggctgtttggcaagcatcatttgcattatgcgcatttacttatgcttttgcgtaggaaatgccacgcaatgaatcaatgggccttcgattttattgcctttaatattgtacaaatttgatcagtccagaaccggttgcccagaggttttcggggtcaaggacccgattccgggctactttacgctacagtacactcacgagatttctttgaaaaaaaatttcgcgaaaaaatgagaacttttaaactcctcctatagtctctccttctttcattcaaacagaaattgccaagcgcgagggatcaaagaatcttcgaacgaacaattggagttttgctgtggtgttaagctgattttgatttgtatttgcttggtgttttatctttgcaattgacctcagcatttttaattttgttaattaatacatattttgagcgattttatttttggtggatttaattttgtgtcgacgatatttcttattttttcgtttatgttttgacctttaatttggattttttgcattttatttgtattcgcataaatttatttgttgaaaaacatatttttgcaattcgtattttccatttttatcgcctccttaatttgtattcaaaatattaatatttgcgcgtggaaagaaaaaattatttttgttctacagtacctgcctgcttttaccgtatttgatgttgtgaatattttatttttgattgttaatcttaaatatttttgtttgttaatgtgacactttcaattttcaaaacttcaaaaaatgaaccttatatataattgtattgtaacttttattttatttttgacacactgtacaatgtgaagtaattttggctgtgatttgcttaaacttttttaaaatttaaaaaaaatgaaaaatacattgccataaaatcggatcggatcccaccctcaattcgtagggatcgctcctggaatatgactaccgggattgaaatcccaatttggtaggggccccgacgcgtctttttcaactaaaaaagccgggatcaggttcccgggaaaatcccggagggatctcggtcccgtcctgatcactagttattaacattcaaaaaacttattttctaccaaaaagttacctttattgacttcgggatttttcgtaactattttctttcttttttaaagaatttaaggttttgagaatttatagaaatttcttttcaa

SEQ ID NO: 15283 - DNA, 1969 bp, Heterodera glycines
caagcccagtgttagacaaaattgctcataacgccaaatagcgtaattggcgtaaattattgcgcgctaattcaaaatttacactggaaaacggtaggggtcaactccgtctggccaactccgtctcagcaatgtacaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaaggcagaattttcaaagttttttatttctatctttttttatagttcgaaattttctctaatttttagtaggctaatagagcctgtgaagagctttcgaatgatatcaagattgtttgattcggtcaataatttcaagagttatattgactaatttaattttttttttctccaaaaaattctccttcttcaccattccctactcttttctcacccagacccccattcttaccagtgcaaatttttaccggcggtaccggtactagacaaaccggtaccgatactttgatttttgaaaaaaccggtaccggtaccaaaaaaaccggtaattaccggtcggtaccggtaccgctcaaccctaattattaggctcaatttgtacggattttcatttaaaaaataataaaatatatatatcaattaaaatatttaaagaatatattaatatattttttaaatttttccctttaactctaattttcattctctaatttttcactcagacccctattcttaccagtgcttgtttttcccggttgccctaccgggaccgggacctgagcttttcaaaatccgggaccgggacctcggataaccgggaattcccggcccggtcccgttcaatgcacccggacagaaaaattaacaaagcccatcagaattttcgagtgaagccaaatttacccgaattcgactattttaaaatatatgaggaatacgcctaatcgatccaacgcttgacctttcattaaagttcatatttctcttttttgtcctcttttcaagactgatgctaaccaaaggcattattaactgtcctttgtctattctcaattttgtttttaaccaatctctgaatttaagacatgatcggaggtctttttgtttataaccacaagggtgaggtgcttatttcaagaatttatcgcgacgacgtgaatcggaatgccgttgacgcctttagagtttcagttatacatgcaaggcaacaggtaatttcatacttcaaaatattttttggttttgctttcagattcgttcaccagtgacaaatattgcaaggacttccttttttcacatcaaaaggggaaacgtttggatgtgcgctgttagcagacgaaacattaatgcatcgatggtcttcgaatttctcaatcgttttgcagacacaatgcaatcttattttggaaaactgaatgaggaaaatgtgaaaaacaatttcgtcctcatctacgaaattcttgatggtaaatttaaaaatatttaatctgttcaatgtagttttttttgcttttagagatccttgattttggttacccccagaataccgacccaggagtattgaaaacatttataacacaacaaggcgtccgaacagcggtaagaaaattatttaaattttatctcttactttgttattacagagtaaagaagaacaggcacaaatcacttctcaagtaacaggacaaattggttggcgccgagaaggcataaaatacagacgcaatgaactctttttggatgtcattgaatatgttaacctcctcatgtcgcagcagggtcctatcaattaattcgctaaaataaattaattctttgtaggtcaggtgctttcatctcatgttgcgggaaaggtggccatgaagtaatgtctcagcggaatgccagaatgtaaatttgggattaat

SEQ ID NO: 15284 - DNA, 1482 bp, Heterodera glycines
gatttgttaaccgattttcccaaaaaaatggccaaattttcggttttgagcaaatttataataaaataaaagattttaaggttccggcggttgcgaccaggcgccgcccggggggaaaaaataagaattttgactatatttttagctgattttcattgaaaaaattcgtaattttgtgaattttcggaaaagaattggttattttctagtttttatgaaatatttaacaaaaaacctcaaaatttctcaaaaaaccacaaaaagcctcaaagcctcattttgaaaatttagcctcattgacctatcaaaaaaccaccaaatggcagccctgcttttaaagtaatgcttgaatctacaaaaaaccaatttaggaaaatcaattacaaaatgcaatgaaaaagacctaattaagcttgcaatttagaagagaacattctgaattgaaactattttcgacaaaactgttaacaaatcgcaaccgcggcccttactattggcgccgatggaccctttatttccccaaatttttttttaaaaatgcgcgccacaaaaaaaacggtttggaaaaagttaatcgttttacttgacccgaccctttgcaaaaataattttggttgatcccctccccttcttttttcatgtatattatgctccgccggactctgaaccctaagccctattctaacgctcaaattcttttaattatggcttcatttgaagtaggaatttaaccaattcgattttttcttctttaaagtttctgaacaaacaccaagaagtattcaatttggcgaactttggccaactcaaccaccaaagtgtcgattttgtgctgattgttcaggtttgttcgttgatgattgctattttcatttttttggtgttaggttcacaacagaattgactatttgaattatttggtcggctctctgtcgcgtgccaagggaatcgaacgtgttctgttgattttcagttacgataaacattcagaaccgataaacaaactgatcagaagcattgacttttgcagagtaaaattcaacttaattcgtaaaaaaaattctttgtttttaggtcacgcaaattttctttccttacaatatccaactttttccaaattcgtttcccggccttgggccaaaggattgtccggaaggaaccaaaaagtacttcgatttttaatgattagttgtttatatttggattaagaagggaaggtctcgaatgtgcaaatgcggcatatcccgacacacatggcaattttagactgccgagatttacgcagattaaacaccattggtggtggaaggtcagcgaaagggagttaattcagtaccgaaaaattaacaattaggcgaattacgcatttgatgaaataatgccgaagtatggtttggagaataagacgttgcttttccttgaggaagatcatattgtggcgcctggactttctcctttcgctgaaactgatgacgaagagcg

SEQ ID NO: 15285 - DNA, 1280 bp, Heterodera glycines
gtcataacactaacaaatttttttctttgtgtgtgggacttttcacggccaatatgtaatcaccagaggctgcacaaaatacttttaaaaatataatgaattttaatttgttaaaatatccattaaaatttttatacataaaaaaataaaatattacaattttttatagtgaaaatgattgtaataaataagattctttcacatttttacatcggctttttcttattctttgggctctctaaaatttttgcattaaaaatttgcaaaaaaaaaggttttatgtaaattaattttacatcgcttcaaacatttcccatttgttgaccagaatggatttgaatgccaatttgaattcgtcaaatttagcgcttatttcttccatttttggcattttgaattttttgttacttttatttttgcctccattctcctcggcattttccaatggattgaatttcaaaaaatcttttctgattgtggcgtcaaattgtgccaacaatgggttcatttgtgcactgtttacgttcgaacttatgccaataagccaaactttgcaaaaattgggccttaaatttattaaataattttcaaaaataaaataaatcgaaataattatatgtagatatatttaataatttatcaaattcataaaattctttacataaatgccaatgccaaaaattcatttgccatttcgcagttgtgctggtaaatgtcggggtacaaatgtgtgccaatgtttggcccactttttgggtccaaatcgtacacaatttgccgacggattcgcccgtcaacgaactgacaaaatttatcaaaaatttgcgtttgttgctcagccacacaattgatcaacacaaaatatttatactaaattaattattaaaaatttattttaattattttttttaattttgaacatttttttatcaagtaattattaaataataaatatttgtgttttcttcgtgccttttctataaacccattattttgttcatgtagcaattttttccattcaaaattaagtgtcatttcaattaaatttgtcattttccatgctaaaataaattttttttttttttatttacaaaattttgtaaaaattttttttttggcctttgaacattttcatttccgaatcaacttgggaactgcaatttgggaaccaaacttgccacatttaattccacgaaaaattggcgcatacacaggcattttcctgttcctctggattttgaaaaaaaaaggggttgacactgtttggattttgccaattc

SEQ ID NO: 15286 - DNA, 1904 bp, Heterodera glycines
  misc_feature (1757)..(1757): n is a, c, g, or t
ccaggtccgacatggaaatccaggtccaagtcaatgcaagaaatttatttattatatttctcgggtcgatgttattatttaaatatattattaaattaataatatttttgattttttttaattgaatactttttgcccataatttcatcactaaaaggagcattcggaaattttttgcatttttattaaatttttgatgaattttttggcgttctccttctccgtcatccatttgcagcatttcttgtttattttgtccatccaaaatcaaattaaaaatgtaaaatgttgcgtgataacctaaaataagtatatacataattagtgaaaaaaaaatttaaataaaaaatttaaaatttattaatttatatattatattttacttttaaatataatttttttttattttataaaacaattatttttaaaaatattttagagatcgattatggaccggatctttccgtatacggaggtattttagggacctatagcccatattttttccgagtttttatgagctacggcttttacgggttctttagcccgtatgtccgtaccccgtaaagatatagatagatgttcagcccgtaacccttaatgaactctatggtaaattttttgagaatttttttcattttttttataagttaattaatatattacccgaaagtacacggagcatttttgtgttattttcggttggctttttgaattttgccatcagttcgtccattgttttgtcatcaatttttgctggcaacattttgcgttcgggaataatcacaaaagtcacatcgtacggcacttgatcaaagatgaatttgatcaacaaaattggagcatgtggaaatttgacaaggtcagtcacaaattcattctaaaaaattgaatttttttttcatttctttcaaatttaaaaattatttttgaattaaaaattaattaattcaatttatttaactttataaatattatttcatttcgtttctttttattaagaatatacaagctaaaattattatttttgaaattataatttatatttcattatatgtatttattattgttaaaaaatctacgaatcttattttttgaaacattaaaaattttagtatttttgttaaaaattagttagctaaaaaatatttaactttatatttttttattaataaattacttaaacgtaaattattgtttgtttattattctttttactgaatttaaaagaaaatattaaattgaccagaaatctatttgagaacttaaatgtttttttttatttattgaaaatataaccgaacaaagttcacaatacaatgaccaatttgtgccatcggaacacgcgtgttccatatgttggcaaattgttgtatcatagccaaaaatatgcacttttttgatcactttgcccggcacaatacacaacagatcaatgtcagaacgaattgtatgagtgccaagcaaaaatgagcccgaaacaagcagtttggcatgcccttcggactgaaaaaaaaattcaaaaattaaatttatttttaattaattaaatttaataaattttattccattaaaaatattttttaatttcacaaacccagtcatcgaaaattttacgaatttttattaatgaatttttcattttctcctcatattcagcgaagcctttaaatgttttttctgccagataattttccaactgaacattttattgtttaattaaaaggtaaatatatttaatataaaattacatttancattttggacgttttgtgtatcatttttgatgctttcggcaaaatttatttgttgcgaaaattttggaaagtttgcatttaaatatttgtttgaattttgttcatttcccacaatttgctgaacagcgattgatctggaggaaaaaa

SEQ ID NO: 15287 - DNA, 872 bp, Heterodera glycines
aggagaacccccctccaaaaatgaaaaatttaaaattaaaaaaaaagtagatttttcacaatattaagcaatggtcttagcaggttcatgaaaattccaaagaagtttcccgacgagcgccttgcggtcactgccgaaacccccccccccctccccccattatcatggcccgaagagcaaaaaaaaaaaaatctccgaacccccttccgaaaattttttatttctggctacaggccgttgttacttgtctaaatattctagtttattaattatggcataaaattcaaaattttgggatgccaacaatttccttatgccattattaaaggacaggaaaatgccaaactaaaccaacccaattgaatttgtgcttccatcttttgccaacgcaatttcaaattgtcaaaacggatgtggccacaacgcattcccgttatttcttccaacaatttttgtctctttttggactcattttgttcccatttgccgctaattgttgccccattagtcaaaagtgccattgcaaaattttgcaaatgaatttgggccttcacatttttaaattcattttcaaaattttcaataacaatttcatttgctgcttcagccaacattaaattggcttcgttgttcaaattcagaattttccacaaaatttgatggaattgccacggcaaatcgcatacaacatccacattgttatacttaaaaaaaatttaaataaatatttattttaatttttaaacaatattgcataaaaaatttgttggtaaaattctcctaaaaaatgtttaaagggggtggaggatattatctcggttttgtaccttcttggggtgtaatttttcaaaatttcatttgagaattcagat

SEQ ID NO: 15288 - DNA, 3519 bp, Heterodera glycines
cgatttgtgcccgatttgtcaccataaacagcccatggcgttaaattgataatataagtaattcattacatagtagtgaattgattttatttttatttaaaatatatttaagattttcaaatgagctacagtagaatttaaatataaatttaattttatttaatcattaccaattggcaattgttttggtcagtaggataaattattattattatttctttgaataaattcatagaattatgatagatgtcagttttgaataagaaaattttttattcatttaaatgcctcaaaaaaatattgctatttaattggaaaaaaaatttataaagcattttggggcaacaaaaatgaaaatatttccgctattatttttaattatatttttaaccagaattggaacagaaaagaaaaaattgcagcagaagtcatttggcgaaatattaatttaaatgttacttttcaaaatgtttatgtaaagaaatccgttggccatgagtatgtcctttaaaagtgcaatcagctgaccattgatttattttagacattctagaattaaaaataattgttaaaataataactatattaatctaataaattgttgcaataattttggggcctgtctatttttattctcgacgtaagtgccactttctgatgaaaattttcttggaatcaacaaaattaactgatcaagatattattattcaatagctcatagaaatatctttacaagcctgcaaaattttaaaaattttacaaatatgttaaaagtatattttatgtaaaagttttccttcattttatttccggtacagtatatgctgtcctgagagaatatgttaaaacaaaaattttaaatcgacatctaaataaaaaaaaaattttatttgtggattttaatttgtctattcattttcaacaaaatttgttggacttattttctaatatattttcctttaaaagaatggaggaagaaaaaatgtgaagaaaataatgataaaataaaattatgcctctctttcactattcgtgcctataattatttatttattcgacaaaatttagcataaatttttgaaaatatttctgtgctatttaaagaatgatttttttttaaattttattataaataaatatactcccaatattattatttttaaatcatttcaaatataaattgcattttataataaaaagcgaaaaaacatataaataaaatttattttaaacaaattatgtaattattagttgagcataataattttggcaaaaacgatttgggcataaatttgaaaaaaatcattgaccatcaaaattgaagttgttgaacaaattccgaattgatcaatttaaatttattggaaaataaaagtaaaaaaccaaaaaacgacattaaataaagaaaagccattcatttctaaaattctcaaaaatacaatgtttttttgtggcatttttgtcaccttttttgaaatttatgacaattttacaatgtccttttttccgtttatatccaattaaaaagcaataaatttaacaacaaaaaaaacagtgcaaatattgcaaaaaatagaaaaaacttcgataaattattatacaaaattaataattataattctaaacttgagttgcacgggccgggaattttgacaaaaactgggaccggaacttaccgggaccagaaaagtcgggaccgggacctcgattttggtccgggaccgcgagaaaagccgggaccgggaccaaccgggaattttcccaagagaaaaattttttgaaaaaatttgaaaatttgagtacactttgttacgaaaatttctaaattcaaaaatgtacccataaaaatgaaaaaaaactttaaatgaatacaaatccatttttgtaattaaaaactatttttcaaacaaatacatttttttgtttatattaaatttggtccttttttctgataaaattatttttataaattgaaagttccagcatggaatcaacttccaaatttaatcatgtatgtattatatattaattaagacagcacaaatgggttaaaatcggagtaattaaggagaaagtggaaaaattttgaaaaataattaactcattagagaaaaaggctaactccgatttttttgcaaatttcggcataattttgtcgccattctttggttgaatattttgttatttgcctgaattgattattcgctttaatgaattttcgtattcaattttctgtttatcagtttttaatttatttatttctccaaaagcctctcttagaattctctcggaaaattcgattttttgatttaaatatttatttaataattcggtatatttacgacatttgaaaaaaatagcaaacctaaatgattttataaaatttatcaaaaaagttttcatgttaattctaaaaatcgaatgattttattcagccacaaattgttttttccaattggaaatattctgttgagaagtgttcacaatttttgcaatttctttgtcagtcatttttgggttttctttttttgtttgccaataaattttcattttttccattttttcgttctccgttatttgtttcttgctaattccaaattgtttcttccataacatgccttgcgacgcgcgctgtctaccttgaggcaacattggacctcacatcggaatcattcatcaatgttctccgtcgattcataagtcgacgaggaaaacccgacatcatttggagcgacaacgccacgaccttcaaactcgctcagaaaaccctggagcttctcagtgctccgggtccggatcaggaagtacaaaacttcctgactcagaacagaatccagtggcgattcattgcccaaataagtccttgggcaggaggcttttacgagcgcctcgtgaagctagtcaaggactgcttcaaacgaaccttgggtcgaaggatcctttccttcgaccaactcaacacattcgtggcagaagtggaggccaccctcaactacagaccgattaccgcggtctcagacgcagtggatggaccagttccactgcgtcccatcaatctcttacaaccagagattcagatcaattgggaaacaacaacagacccaattgattcagaggaacagttttcctccacacacgaacgtttagcttcccgaatacaagcacttcgggaagccaacgacgttttctgggccaaatggcactctgagtatttgacattactcagagaaagagcccagtgggaccacaaaggcccacgactccaacacttcggagaaccgaaggaagggatggtggtcctaatctctcaggacctcgtccctcgcaatcaatggccaatgggacgaattgttgaaacacacggacggcctggagccatccgaagtgttaaagttgaaatccctgtccgagggaccaacaacaaaaagccaaaggacatgccacgaaagacagtccttactcgtccagtgaaccgcatcttccctttggaagcgggtcctgaaatgaccaaccaaggaa

SEQ ID NO: 15289 - DNA, 3361 bp, Heterodera glycines
aaaatccttatttcctttgtcgttattggcccccccacgtccatcgtttgccacattcatttgccaattttgtgatggatagcattggcactcgtagtgaacagcagagaattggctgggtggagcggagtgggcgcgaccaacaccaaaagcaattgtgaatattagttgcattagccgaattggcactgtttaattgtccaatctcaatattgcttacccacggggagttcgtctgctgttgccgcctttcttctgcttttgtactgctcgtgcctccgttcgtcggtgggagtgccgttggggagggcaaagtgccatggagggcgagtgcgtgaaggtcctgttgggccgtgctggacggcgtgggggaagtgacgttggattggacgatggtggaggtgacgctcgtccttagccgtgagtagctgcgcgtctctgcgtcctccggcagcaacagttccaccatcaattcgtccacgttggccagtccttcaaccaatgccaagtgccattgattgtttccctccgtctgtccgcaatgactcaccaaagagtttggccaactgcgcctcctccaccaaatcgcgcgcgatggccaccagcggaggcaaaagcagcaaaaggttgcccagccgaagcggcgccgcccgacattcgcttctgcgctgcacttggtgctccaaggcggccaaaatgtggtgacgcattccctccaccgctccgaccgctgactcatcaatgcctttggccactgaaaggaaatgagtggcaaatgtaaacactgagcgactgactaactcggatcgaaaaaggccaccgctttgagtgccacaaattcgcactcctccaatcgtagccgtcgcattgggctcgtcaaatggtcgagaatgcgggcgaccactcggctgaacagaaaagacaaaagatcgagcacagtttgaaacattgcgcactttatgtcagggattttgggcgcgtcgcgcggaacgcagcgatcgttggccaaccaaacggcgtcagaggcagcgacacggacgagcgaacggaaggcggcacaaaggatgagatgctgggcagagaaatgccgaagcagcgcaatttgggaacggaggggcaaacgacggaattcgggcaaatgtttggcccattggacgagcaaaatcagttgctggtgcatcttggccaacaaacggtccgttctttccattccctctctccgttctttctttccttaccgaatccgtcacgtcgcccgtcgtcgccgtcctttggctgtcctttgacttcgtctccccgccactttctctgctcgtcgtcgtcccctgcggctgcttttcccttctcattgtcgtcactttcgttccctttagcattcgttccgcctccattaatcgttgcacaatttgttcattgtcaattgcagacgaagtgccaaattcgtcgtcggcaacaaaacaacagccaatggcactcgccaccgttgatgtttttgctgttgtcgctgtcgttgttgggttttgcccgttttggttgccaattttgccattccgtcgtgttgccgcaattcgatccctctccaattggacggcttccggacgcattccgttgctcagacatttgtcgaagcgacagcgtcggcacgcattgcgttggtctgagaatggaaaaagctaataaatgttgatttatgttgcaaatgctcacttttgtccacgacgcaatttttgctaaaacggcacaagtaattgtgcttttttcgaatggttcgccggaagaaacataaaaaagagaagcaaaaagtgaagcgacagaaagtgaaaagcaaaggacaaaacctttgcatccatcgcaagaaatgctcccgtaatgctttccttaaggcagttttacccaaatgagaacatttttgcccacccgtggctttgtcggcacaaatcagacaattcgtctgcgtttgtccgccatttgtcccggccgcggcggacacttttcgctgcggggacggagtgggcgccggggggagggcggccgaagtgccgcggggcgacggagtgccgggggcggaaaaggacggaaaaacatctgccgaacattttgagggattaatgctaatcatttgttctttttggcttgaccagtcgtgcacaatcccttctccgttttgtccgtcgcatttgctgcgccgccctcgcaatttccgccgttacattccattttcattttcgtgtcattaaaatacaaaattggaacactcattcaaagaaaaagtgaacgaagggtgggcttgatcaaagaatgacgaaattggcaacaaatgccaatggatttgccatgaaatgggaaatggcccaaagggagggggaggggacagtcgtcggctgactctattcactccttcccctccttatcagcaaagtcccctcgtcattcatcaacaaataaataatcaacccctccccccccccatcaatcgaccgactgacaatgagtcaatcactccccaaatgatcactcagcccatccgacatttgaatgaacaaaaaaaacaataacgaatacaagtgaagggagggctgatttggtgagcgaattggaaacggacgttcactttttattttgctaaaggccaaggaatggaggcgacatgaatgagtgaatgaatgtaccgtttatcgaaaaggtaatctcatgggaacttatcggaattttgtaacaatttaatgcaaaatgggggggggggattaattgtaatcgatcccccccggggggggggggggaatcacgtcgttctgctggtggtgagaaggcaaaaatgaaaaaaaaataccgtaaaaagcactccgctagcacttcgggagtttaagaaccaatttattcttacagatggattccaaagaaaatggttgaatttataaattgcttcctttaattaatgcatttgctaattgactaagatttgctaaaaaaaaatcaccgcaattgaaactagaatagagcgggaccgggaccgggaattcccggtcatccgaggtcccggttcccggtcccgggttttgaaaagctcaggtcccggtagggaaaccgggaaaaacaagcactggtaagaatgggggtctgagtgcaaaaattagtgagaaaattggagttaaaggaaaaaatttagaaataataagtaaatatattcataaggtaccgagaccaattgtgcaaatggcctaaaggatagtctccttcactttcccttcttctttcccttggttcgatccccacaacacaaatgacaatattgtgaaaatttctttttttttagaatttttggcctttcctattcgccaaaatatgtttccttatttttttt

SEQ ID NO: 15290 - DNA, 1350 bp, Heterodera glycines
taaatcttatgcaattttctataagcaatcgatagtgtaacaaatagagaagataagttctgatcaagcacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccacattatacgataagcatttcctcgcacaccgctctatttgctctgttttaaacaacaaaattttcccaagcattcatacctactttcttaattgcactgggatcacatctaaacgactatgctaaaaacggggaactaaactgtattaatatttttaacaaattgccgcccttttcgcctaccctgttaagagaaatcttaatttcactaataatttctcaattttcttctataacagattaactcttctatggtgagtttttcaatttctatgtactttattaagtaaacaataattatcaaacatttttctatgattgcaaagcatttaaaaaatcataggcttgtttattttcattatgttttggaaaaggtcaattaaataaacaatttttttttgtaattttattaattgtataaatcttatgcaattttctataagcaatcgatagtgtaacaaatagagaagataagttctgatcaagcacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccacattatacgataagcatttcctcgcacaccgctctatttgctctgttttaaacaacaaaattttcccaagcattcatacctactttcttaattgcactgggatcacatctaaacgactatactaaaaacggggaactaaactgtattaatatttttaacaaattgcagtccttttcgcctaccctgttaagagaaatcttaatttcactaataatttctcaattttcttctataacagattatctcttctatggtcagtttttcaatttctatgtactttattaagtaaacaataattatcaaacaattttctatgattgcaaagcatttaaaaaatcataggcttagttattttcattat

SEQ ID NO: 15291 - DNA, 859 bp, Heterodera glycines
  misc_feature (817)..(817): n is a, c, g, or t
atttgccggtaaatcgttgataaatattaggaataataatggacccaaaacgctcccttgtggtacccctgtataagtattatagctttcagaataatggtcttcaatttttaccctaaaacttctttgtgacaagaagttacgtaaaaacaccaaaattttcccaactattccagcatttttaatttttgcaagtaacaaatcaataggaacagaatcgaatgctttggaaaaatcgatataaatgacatcaacctctttttgattttgtatggcttcgtaaaaatcatgtaatgtctgtaatagttgggttgtcatcgaaaaaactttattatattaaattatagaattaatatccttgcattaggttaagtatctctctatttgtattaattgttcattcatttctttttcgtcattggttcgagcagaatcggtaatctggacttgtgtccagtttggtagcccttggaattggaaaaaatttaaaaaattaaatttaattattagataataattaattacggctccgtccaactggcgcatccatgcctcccactccaattctccaacgccccactgaatgttgcccatgcgttcaaaagtgtgctccattttgccattctcttccggaacggctgttcgattcattccattggctaaaaattcgaaaataatacactaattaattaaagtcgtgaaggtaaatgataaaataaatataccgtatttattgaattagaaccccgcccccctgaaataagccaccctttataggggcggttgaaaatagagccccgggggttctaattcaatnaagatggggtatttgaattttttaataacaatttgacacgaa

SEQ ID NO: 15292 - DNA, 2988 bp, Heterodera glycines
ctgacttttttgtcgcccaaacttttgacaatttctttccgttcttgtacatccgttagaatgcccttaatataaaattttcgcctttttcaaatgttgttgaaaaatctcacacgatattcatggtatgccaccggacccaaaatcattgcttctataaaatttttgaaattatactaattttaaatttttaaatatttaaaaaatttcaattttcatttggccgcaccttggatgatgggcaaaagtccgcatttcattgccgaaactgcggctgcggacgcggtgtgcaagtgcagcacacagttcacgtcatgacgcgccgcatggatggcactgtgcaggacgtagccagcctggttgatgcctgagacaaaatttgtcactataatttgaggcagttaaaagccgaaattttgaaacaatcgaaaaccgataaaagtgaattttctcatgataatgtactaagaatgtagtcccccaaaacaccggttattaacccgagagtctcaagtaactttaaatattatgaaactcgataataaatttgtaagtaaggtaagtggactaaaatcccgaaaatagacttaaaagaaatttccaaactgaggccaaattttcttcaaatgcattaaatttaaataatatgaaaactataatggttaaatgtgataaaaaaaaattattttacaagaaaaaaataaaaaattattaatttttagcggaaaaatgcataaaaatcgaaatttcattgattcaaattaatcaattttggtgaaatttaaaatttaacaaaattctcgggaaaagtaactaaaacattttttgaattctgatctttaggggccacaaaaaagcaatttaactaggtgcccctctaatcaggattttgtgaaaatgccaaaaaatggaatgtaaaatatgtaactaatgctaaaaccctcgctccctccacacagtccatgaaaaaaaaattgaatacccaaaggtgttgatcccggatcaataacgcatccgtcaacactgatcttggcaaatgagctcgcagtgatctcgcgatatagcatgccaagcgggttgatcaggatttcattgtcgctcccaggcagacgaaactttttagtgttttcgcaacttttaaatttcaccaaatattaccgtaatgtgattgtatattgactggctccagcggaaatggtcgatgaggcgataaagagcggccaatttgttacggcattccacctcctccgccgtgtactttttggtgccattcaaatcagcaattggcaccaatggcatttctgttgtgaaatttctcatggaattaaacttttttttttatctgctggcatggtactttactaaaagaaaactactaactaaaaatcagtttttttaattgccaaaaaaatatgagtatttttgataaaaaaatataccgttccgcaccacaaccttattttatgctcgtaccacccttttgcattattcaatttcaaaaaaaaaaaaaaaattaacttaaatctgacggtaatttcgctaaatttaataaatatcttattttaaagtacccccgagtccgttgagtgacaaggaaacgttcatattcgggcgtatacagaagacttctttatattaatttaataataagcaagctaattgaaaaagtaaaatttttctctgtttaatattgttaatgaatcattaattaaactccttgaccatttaaaatgtatattaatgatgacagtgcgattgatgcgctgttattttgattacatttatttgtcattcaccgataagtcatcaaaattatggtaaataaactcattatcactcaattaattacacagagtcactgtgctcgttttgtttgcattaaaaattcattattatatggctaaacagaaaaaataaaagaccaaaatgatggtggtccaaaactgtacttttatttgggtttggaaaataaattaagacaaataattaattctccattcatttataattaagcttaaaaagcagtggtgaacggaaacatgtatttacataaaaaaagagccctgaaaatgaattatattttatggttatttatttattttccttaatatataaaaatcaaaatttaatttaaattttcgaattttcgaattttcactttctcagattcatttattgaacttcttacacttgaaaaataaaagttgcattgatatttttgaaagttgtgcttatttgtcaatatgttaagataataaattgtgtaaatattttttctttctaaatgtacgggcatttttttcaaaatttaaaatttattcgtcaaatttataaattgaaattgctgaatgtttttatacattttttcacatcaattagcacgtaacggactaacagtggcggttgtcgtgcgcttgaacaattttttgtatgcatctccataattactgctgaaaaaataactaaaaaatttaatgtttcatatattcctttataataattaaggagtaattaatataattttagaaaaactttgattgaaatcattaaaacgaatgatgttatgacttaactcaaaaaacaaacaaaaaatttttatttagaactttgcgaaaaagcagccatatttttaattcttaatatcattcgatagtcctaaatgttctctattaatctgccaaatttcaaaaaatttcattaagttttccaaaaatatatggctaaaaatttcgaaaaaaacggaattaaataatttcgactgatcaaatttacttcttcattagaataagtggtccgctagcagaagtctaaattggaatacaagtcaaaattccggcaattatatccagaatggcgcttttattttcaattttgaaagctttagtgaaaataagcataaatgaatccataacattgtcacgggaaactgttgtgatcagccagccgaccaaaatgatcaatgatagcagaaaaacggacttcaacatt

SEQ ID NO: 15293 - DNA, 2931 bp, Heterodera glycines
  misc_feature (2891)..(2891): n is a, c, g, or t
aatgccaaaaaagtgccataatttttgcgttggatgagcacaaaaattgccagataacaacaggtgctacacaatgaaataatgaatgtgccggcgaagaatttatgcccgacggggccccgaaaaggttcggacagccttccagtggttggactgaaaatattaaaatttaattaattatttaaatttaattgcgccatactttcccgcattttcaaatgcatttgcgagcacataatttaaagaatatgccgcataaattatgcaaattagcagataactgaacagatacacatatttgaactgtaataaaatgtccatgtgtctaaaaacataaaaataaatataaataataaaaattaaaaaaaaacactcatattttttcgaagtataatactttttttattaaataaattctcaatttttattattttttcttaattatttttatgtttaaaattttgagtcaaacctataaactttcctaactttagaggtgaaataacagataaaagtcgatcaaccgcagaacaaagcattgccattaagccacaatttatagcaaaaattgaaggcttaaattttgaaaaatttaaaattaaatttcaaaaattcaaaatttaccgccataattaagtcagcagtgagaacactgacaaaattagtgcccgaaatgacaacaaccaggaaaaaagtgttcccattttggtggaccaattcacaaatacaaatcaatgccatcagaaaattggcggagccgcggagggaactgaaaaatgggaaattaaattaattaaaaatggaaagtttaatttaatttatcatttaaatcattataaataaaataagaaaatgccatgacatttgcctggatttgacagtgaccaccataactgtgccgttcaacagaatgccaaccaacgaaaccaaataaagcgcaatggcgggcacaatcaaatcggccgacggaccggcgaaacgaaaggccaaaaaaagctgaaatcataaagattaaaatggtcttcttttaccttaattaattgattaaaaattatgaattaattaatcacttttaccggatcatttgaactggtgttaattgaagccatttgtgtggcaaagttatgggaaaggttaatgaatatcattatgagaactttttacaaattttagcatatgtagtacaatatcatttttcaaaaaaaaaaaaaaattctttaaacaattttataatgtaaattgtttatttgggtatgatatttaattgtaagcattatgtcattttttaaaattctttattttatgtttccattttttccggcatgaactaaacagtttaaaaaattttagaaaaatttggatattttaattgctgattatgaattttatttgatttattcagttctcctatgatgcgagaaggaagtcggatggagtgtgggacaaatttggaaaaaaagctttatgagaagctcaaaagtggggaaatgcccatagctcagtcggtttgagtattttcccacgctgtaagggaaggccgtgggttcgagtcccaccgggcgattaaacttttatgttttttactcttcattttaaggagtttccaaaaaataaaataaattaaatctctaaattaattaatttttatcaattcttttcccttttgggttttacgcatataatcattttcttattgctgtttgaaagagattataatgcgaaaaaattgagaagaaatcattttatttgagagctgaaaagatgttgcttaaatttcacatcacaatgaaaaaaccatttaattaaacaatttgagcgcaatgctttcgaaagtgtcaaatctaatttggcattggcatttttagggctataattaaccaattataggcattcatcactaaattaatgtaatgtctggccaaataaatgtcctgggcaaataactttaatttatataattttttttagctttctaaccaaaccagagtaatttttaaccttttaggcattttaaaaattggtttaatgtttcttaaatctttgttttttttactatataaagaattcatttgtcagcgagaattttcaggatttatattaaaaaaaacggaacaattatgggccaacagcacttaaactctaattgcacaacgcttggcagataattattacacatttaaatttctgtttgccgcatttaatctgtgaaatggtgtaaactggggaaatgatttttggtgttttaagctaatttttctttcattttatataaaaatatttctttaatcggaatttgttcattttaagtcgttgctattttcaaattaattatgaattaaatgttggataatacccacatttgggacgatcacaaaatattcgttcgcttaatggaactcagaaagtgctttgagaaatgtctttgccgtagaattatgctaaaaatatgttaattgcaaggaaatgccatttttattagcatgccatccccgtaaaacattgtaaatggcacttaaattaaataatatggttaatgaaaaaaaagtttttcgggtaaggcaaaaaccttaaaaacaggacaactcattaagagaataaaataagcaagaacaaatgctactttggtttatcaaaacattaagataaacaaattagaaaaaaaaagaagaaaaaaacattgattttttaaaattatttagaaaaattaaaacagtaatttttcgaatttttaaataaataaattaaggtattttaaatttttaaattattttcattttgtctgagttttatgcattgatgaactctcaggatttaattcaaaaaataataattattaagttattccaataataatttaagttggctcaaacccggcttttctgtatccaaanaggttttatgaatctcagatctttcccattatgacctgca

SEQ ID NO: 15294 - DNA, 5341 bp, Heterodera glycines
gaacatcccaaaatcaacgaatgcccgtcacctgctacaattgcggccgagtcggacacatttctcggaattgtgagtcggaaccaatgcaaaggatgtaccatcaaaatgatgagccgccgaaaagggaaaatttatttattggtgccgtaaatttagaacaccgagtctgaaatagaacaattcttcggaaaaacaacgaatttgtcggaaaagggtagacttttggaagaaagcccggctgttggtaaaattttggcggccaaagtttcgattttcggtcgacatttggaagcaatgttggacggcggatcccaaatttctctgatctcagccaaattcttctcacaaatcatggataaggtaagccaaaaagacgtcatatcccgctttgaaaacaggattatcgccataaatggaaaggaagtgaagtgttttggagttgttgccttacctattcgacgtggaaccttagaaacgaaaatccttatgttcgtcgcacaatcagcttttggatacgatttgcttttcggcacgaatgccttgaaacaattaggctttaaaatgatcgatgaagttagcaacaacatcgtagacttctcacccgcttcaatgctcgagaattctccaatgatcgttttcaaaacatttgttgttgatggccaaaacttggacaagacaccgagaaattttggagggaagagaaagaacacgtcggaatctaaaaacggcactgggaccaagaaaggtaataagggacggcgacaacaaaagcagccagagacggagaagtcatcagttcgaaatgccggagaaagaaggcccttattcaccaaaacatttgtgccccaactgaaacccaaggaaattccaatcaaaaattctgaaaattttggagaaattgaggcgaacaaacagcgagtgagttcggttcaaatgaaagtggcggttccaaacgacaaggcaaagtgcgtatggagaaggaaaaatttgggccagtttcagttagggacaactgaaaatttgggtagggggaaggtgagcccaaaaatggcttcgtcggcaaatgggaggttggatctatgcgatcgccgccctgactcttggtcccaatcgtccttccatcgaggcgatactgacgtcaaatttggccaaagaattttttgtcgcggaggaaagcgccgaaaagaacccgaccgtggaatgttcaaagacggatgctggcacaggcttaactcgcccaccacctatcggatgccgaatgagcataaaaggcaggggacgcctttttcttggagggtcgggatgtgttaatatttgatttttggcgtttaaatttattttaattatattgtcccttcataattttgtctctttgtctgtgattgtactctctcgcctatcgatatttgccactcccttcccagcagaatatgttcccccatcttgccttcagttcattctgttggcagtgcactttcatatttgtattttgttcttattttcctccgactcttctcccattttattgttgcggttttaaataaagtgatttgtctccgtcttggaaatatttgtggaggagaagcagtgtattagcccgacccgaaaagcattatttagcacgtggcgctcctggcgaagagttagctgtgccggcattgtgggatttttgactgctgagtagaagccgattcgagaagcgtccagaacaaacgcattgttgcggttctgcaattttcttcgttgcggacagaacatacgcattgctgcggttctgatatttaacgcattgttgcgattcgtcaattttggtaccactgttaacgcattgctgcgataagtgaggattggcgccgacgtatttaacgcattgttgcgaatttgtggactggaacgccgaattttgtgagtcttggattgccactgcggaagaaatgcaaactgatcgatcgccgtctgaagtcgacgagaacgaaattaggcggcgtcttcttcaagtaatgatgagacaaaatggaaatgcagaattgacgagacacggcgaacaggacattggccgcagagaaaacggaaggccaatctctgatgagacccaacgaccaccaattccgcgaatagcacagccatacgccgactcattgcaaatgccaaatgaattccgagagaatgaccgatctcttcaccctgggcttgtatttgatggcatgatggcgcaggcgattcgaagcctggacggattttcatataccatgactctcaacacaattccgactttggatggcagcaaaggctctgattcagtgaacgcctttttcaagcaatttgatattgcgactgaagaatggcctgaggcaaagcgattgcgggcactgcgttcgaaatgttatggcaaagctgagagagctttcaattccgccgttgctgaaaatcgccatgattatcagctgatcagaagagcgatcatccgacaattggacgacacggacgccaaacaattgacggcgtttgaccaactgatgaaaggagtttggcttcggccgaatgaaggcattgatcagcttggcgaacgtgtttcgcgcttggtccgttgtgcatatccggggctcagcgaacagctctacgacgaatattcggccatgcatttcattagggcactccctaactcagaattggcaatgactttggagatgactcgtaaaccgggtgcaacattcgatgagttcatcgcacaagcagcacgagccgaggcagttcaaaatgccgcacgaaattcttggcgacgcagccaaaataacggtttttcttcgacttattggccaagacatggaacatcccaaaatcaacgaatgcacgtcacctgctacaattgcggccgagtcggacacatttctcggaattgtgcgtcggaaccaatgcaaaggatgtaccatcaaaatgatgaaccgccgaaaagggaaaatttatttattggtgccgtaaatttagaacaccggtctgaaatagaacaattcttcggaaaaacaacgaatttgtcggaaaagggtcgatttttggaagaaagcccggcggttggtaaaattttggcgaccaaagtttcggtgtttggacgtaagttggatgccatgctggacggtggatcccaaatttcactgatttcggccaaatttttctctcaaatcatggataaagttagcaaaaaggatgtgatctcccgctacgaaagttaagtcatcgacataaacggaaagaaagtgaagtgctatggaattgtttctctgccaattgagcgcgggcctttaaacacgaaaattcgtgtattcgtcgcagagtcatcttttgggtacgatttgattttcggcacgaatgccttgaatcaattgggcttaaaaatgctcgatgtagtgaacaacaacatcgtacacttcacaccagcttcaaagcccgaaaattcgcctttaatcgttttcaaaacatttgtgtcccatgacaagatcagatacgatagaaaagatgtgatcaaaagtcaaattgttgttgatggccaaaatttggacaaaacaccgcgaaactttggagggaagagaaaggacgagtcgggcccaaaaaatggcactaagacgaagaaacataataagaaacatcggcaacagaagcacacaactgtggagaaaacgacaattcaaaatgccacagagaatttaggagagcggaagaagcagcgacagcggaaggaaaacggcgaaattgcttgggcgataaagcgcgtttggagacggaaaagtttggaccaatttcagttggggacaactgaaaatttggatagggggaaggtgagcccaaaaatggcttcgtcggcaaatgggaggttggatctatgcgatcgccgccctaactcttggtcccaatcgtccttccatcgaggcgagactgacgtaaaatttggccaaagaattttttgtcgcggaggaaagcgccgaaaagaacccgaccgtggaatgttcaaagacggatgctggcacaggcttaactcgcccaccacctatcggatgccgaatgagcataaaaggcaggggacgcctttttcttggagggtcgggatgtgttaatgtttgattattggcattttatttagtaattattttgtcccttcttaatttttgtctcattgtctgtcattgtagtctctcgtctaatctatattttggcactcccttcccagcagaaaatgttccccccgtcttcccatcagttcattctgttggcagtgcgctttcatatttgtattttgttcttattttcctccgactcttcccccattttattgttgcggttttaaataaagtgatttgtctccgtcttggaaatatttgtggaggagaagcagtgatttagccccgacccaaacagcatttatttagcacgcggcgctcctggcgaagagttagctgtgccggcataatggattttggactgctaaaaaactgatttggagaagcgaccagaacaaaacgcattgctgcggttctgcattcgtcttttgcttctgacagaacaaacgcattgctgcggttctgctttttaacgcattgctgcgaatttcaccgatttcgtcccactgctaacgcattgctgcgagaagtgaggattggtatttaacgcattgttgcgaacgctttgagtttggaatcgccgacttttgtgcgcgtcttcaagaattatgcaaattgttcgaccgccgttgcttagagggatgaccgaacgcaatttcgagcagattcgcagtcggacaaattcatcgattgtccatgaaggaaatgtccaattcgccaacgaaaacaacggaattgaaatggatgaaaatgaaattagacgccttctgcttcaagtcaagatgcgacaagatggaaatgcagaattggcgagacacggcgaacaggacattggccatagagaaaacggaaggccaatctttaatgaggttcaacaaccactaattccgcggacacagccaaatccccactcactgatacagagtggccaccaaattcaccaacgacaaaactgcagccaaaatattgccacaattaaccatcggccaaacggattcgaagacaacgagcgacccgttccaaatccagggcttatatttgacggcatgatggcacaggccattcgaagcctggatggtttttcatacacaatgacgctgaacacaattccgaatttggacggcagtagaggctctgattcggtgaacgcctttttcaagcaatttgatattgcgactgaagaatggcctgaacagaagcgagttcgggcgctgcgttccaaatgtttt

SEQ ID NO: 15295 - DNA, 1236 bp, Heterodera glycines
  misc_feature (1210)..(1210): n is a, c, g, or t
gtgcgcttggctgttcctaccgcttcttccgctgtcattggcatcggatggttgtgattctgcagacggaaaagcgcgttgtgctccggcacgaacagtcccctcagcgaacaattgtacgcggaacacaagttgcgactgctccatttgcagctgaaattgcgcgcgccgtcctcgcagtacaaatctgagaagaagagaatgaggccaatgaatatgaggcgtttcaaaatggcaaatgttcccagtaaatcgcatggccatgagtttaattttctcttatttgattggtaattaccaatcaaataagagaaaattaaaatgtaattagttaatgattatttcgcgtcttgtgtttacccgtcgccggtgccatgttcgctgccaacgaattcggcatgtactcgttgttcacaatgtggtccgtcaactgcgcgtccgtgtccatctcccacaacacttggccacactccaaacacagtgccccaattgtgccgttgcggaaatggtgccgttggaagagaccgaccgaccaaacgggcgacgaacagagcagcccattgttgcttaaagttggggaaaataaaaaactgaaagaaaattttttaaattggaaaacgaaatctaagccccctccgtttcagtaccaaaaggtcattctccgaataattttgctgatcagcgacggcaaaagagacaacgggtcgacgagagccttctcttaatcaaatgggagaaagtgaaaatgattagcaaaattgagaaaccccacctttcagttcaatgttgacggaaaaatgggacgcgtcgagagaatcggcaggcaaaacggagaacagattgagcggaaaaggaaaagacaatggcaaaagagagatgagggtgtcagagtggtataaagccgccgccttcagcttccagtaaaactgcttgaccagcattccatggtaacaagttgtgtggtggtgctgcgttttcatctgctaaaatgaaagcaattataattggtttttgttgttttgacggctttaccaaaatcatcagcagcaggtccatcatcttcaacatttgcttgtggaactgcggccatcgcggcaacttgggctcgcctatttttcccgaagacctcgagatgatgacgatggtccatttgtttgttaatttcatttaaaaaaaacctgaaaaaaattcagtttctgaaggggagggngtgggtggtcatgaacaaaaatcggt

SEQ ID NO: 15296 - DNA, 1358 bp, Heterodera glycines
tttttgcgattttcataatagaactttttggctaattgtctaatcgctaagcaatagcttgaaaaaagcttctaaacatgttaagctgttgatttgtttttctctatcccttccccacaaacaaatcccaaatcttgtaaaaatttcgttaaggttcaaaaaagttattgtcaatattgtttgaaaacatggttttttgacattctgctggctttaacttttttcgaatcttaaagaaattttttgaaattttacatgctaagaggacacctagggctatcgaatgataccaacaatgtttgatttggttggcaaagaaaaaagttgcagccaaaaacttgtgctcgtacgaaaacggcctggtccgaaaaattctcgaattccccccgcccccccccccatcaccgaggtccttttccctattcgcccatctggcattttgactgataattgcccccatttttcggatatcaaaacagaagttgctgccatttacaccgaaagcattgttctttgccagctttgacctcaatttgttgctgttgttgctttttgagggaccgtcgcttggcccaattgattttgcagccaaagtaatgaattttcaggaacacccttcacgaaaaaaaacaaatttttattgaaaaagccatccagaacgaaaataattttgcaccatttgagttcgctggccgcaaggtcggcacacattgacaaaacggcgaggcctaaaaaaatgaaagaattaaattaaattattttactgaaacgtaaaaatgtattaccaaaagtaacgaacacaaaaatgtagatcagtgtcataagccgagaaatatcggttggcatttcttaaaatggtaaagtgccaaaaaggtaaatcattttattttgcgagatcattcattcaccgctcatcgtaagattggccaccaaattgaaagtgacgaagaagccttcgatgaaattgtggtcactgcccgccgctgcaatgtaaacgacgccgccgagcatacagaaaagcaacagaatggcggcatctacggaaaggggcaaacgacgtttccctgagggaagtggcactaattgctcataaaagccacacaaattaccctcattaaacactgaaaaactgacccttcggctccgttttgcctttttctttttgcattttgtccactccgccgtcgtttcctcctccgtcttcgtctctgtgcttttgccgtcctttcttcttcgatatggccaatgcaaccctattataaaatgagtaaagtaaaattgtccaaacaccagaaatttgtcgtacgaaatgagcaccacgtcggacagaaagcgaccgatgtccaccgcggcgagta

SEQ ID NO: 15297 - DNA, 1753 bp, Heterodera glycines
  misc_feature (56)..(56): n is a, c, g, or t
aattgtggagggataaaatgaaaatgaacaaagtttgacccttttaagcgtaatgnaatgaatgaacccagcgggggaagcctaaagaaacaatgacaagacaaacaaaggcataattcaattcaagaaataattaaatttgatgaaatcagtcaattagtgagtgagtgagtgactcgactgatttgatccgctgaaggaagcggaagaattggaatttggaaaatgagagaagcattcggatttaaaaaaataataaaaaacaaagaatgaatgaatggtcatggatggatgaaatgccaaaatgtttagtccagtgcagggctgcacgcaattacggattacggatttccgtaattgcaaatccagttgcgtgcagccctggtccagtgccaaagatttggtcccaagagggacaaaaggccgaaaatgcaggcagacggatggatgaatataattattagtagaattgtgagtggagtcgagaaaaatgcatcggcatttttttttttggaattggcatcgaatttaccccaacattagtccatacattatgaactacaaaatttcaaaagcaacaaaataaatgaggatgcattgtaaatgaattcgacagatcgttacttaatttattagctgacaaaaattttgaaaaaaaagttggcataattgaaagctcttaatgagggctcaagccaataaatttttgtctggcattataggcaattaaaaattttattcataaatttgaactttgataaggacaaaattcgtcgagagaaggagagaattgggacgataaaaacaaataggaaaaaccaattaaacaattttaattgtccctccaatgccccgagccgagcaatgtgttcagatggatttgggcgggggatcggcgacaaattaagccaataattaccctaaacggctcaaaaaatactgaaaatggatacggaggcgcaacgggggacccgttttctcattgaagcgcgatggtcacacacaaagcaaatgtgtcggagggagggagggtctggcgaagacgagaagacacaaaacggacaacaacaatcaatcattaaattgtaccgcgatcaatcggttggcgaggggggggggggggagaagtccattgtttagggactgactctgatcagtcgtcatacaaatcgccgatcaattgaagagccattgtttagattttttaactccgatcagtcatacaaatcgccgatcaatcggtcggcggaagggtccattgttttgcgattgactaactccgatcagtcataatcctcattaattatgtgccgatcaaccagtcgattagggaggggtccattgttttgagagtccgatcagtcccctccccgccgccccgcccccaaaaaaatgagggagggtaaaaaacgggttgtttctctgtccgtttgtgggtgtgtcaatgttgctgggcccacccaccttgcattttctccgccatgttctgctgtaatgtgtccgacatattctcgaactgaaaacaattttattttttcatttttgcagaaatttttcaattttagattttttcatggataaaaaaataatttgttttttcttaaaaatcttacaatgcgtggaatgaaaaaaactagaattcgagaggatttccaaaaatgccgggccgggctgacttttccagaagtaaccgggttccgggcccggcctctcaaaacccggtcaacccggattttccaaaaatcgccgggcc

SEQ ID NO: 15298 - DNA, 2082 bp, Heterodera glycines
ggagacaacttttgggtgggcaaattgtggggagataagctcccataattattttggtataaatacaaattcatttgcgcccattttgggcggggaaaatcgccaaaaacgaagagccacccgttattttttaagcagttttaatttttaaaaaatgaaaaacactaaagcaaacttagaaaccttttggagggagcaaaattcgcaaaaaaaaaacaaagattttttttcactttttcggaaaaattttaacaaaagtctggcagtgcgaggaagctccgctgcgctatgagaatttttttttaatttaactaaatttattttgaaattgccctcccctttgcccaattttctcataaaattttgtgcccccaaccccacccccaatctgtcggtttatggggcacctggcaaggcaatttttttttatggagggcaaaaatttagaaaaaaaaatgctaaattaaaaaaatgaatcacttttcgacgagggaaaaaaggttctacgaaacggagaaggaattgaatgcgaaaacagaattaattttgtcgccgagtgaatgagtgatttgagtgagtgagggaggaaagggatggagcggtgcagcaaaagacggacacttccgcagaggtcaaaactcaaaaaaaaaccggctcaaactcatgctgctgctggtgcactacaaagcccgaaaaaggagggaatgggcgggtgttgtggtgattgttttggtgaaaactcattttgacaaccaattttatttaaaaaaaaatcggggaaaaatttttcaaattttttttggcacttttatagagacggggtcgacaaaaaaaccagagagggatcgaaaactaaggggggggggaccctgttgaaattttttttttaaatttttggcacttttatagagtaggagggttgacaaaaaaaatcaaatagaggccaaaaaccaaggtgtgacccttttgaaattttttttaaagatatgtaatgagaattagatacatttttaaggttgctgatacctattttggtcatttttattttctaaaaaaaattttttttgagaaaaaatggcataaaaaattaaaagtgctggctgttaatacattacagatgtataataaatttgaaagcgcgtgtgaacgaatttgaattcattgtcagctcaaatcccccacccagtgtaatgtttcctttttttcccatgggaaaatgcatttttgcacaaaaaatgggtagacttaattttaaaaaatttaaaaatacataacgccaagccaaatttaaattaaatttgaaaattttttttttaaatgctgtatttttctagccatgcttcttcttcagcgtaataatatcggaataattaaattaattgttgtaataaacaattgccagactaccccgcataatgaatgataattatgataattagggaggaattgggcggctgaccctaattgattttttgatttttcgtcgagagttacataaactgacaaaatgatattggaagaagcgaccaacaatcgtaaaagcaccaccacaaacactcacccgcattgttatcagctggagcaccatttttacgcgagataataaataaataaattttatttattgttttttagcaattaattttaatttatggtcggtccgtcgctcgctgaaatgtaatcgatccctcgttggtctgttcaattgtctgtggtggacacagcaacaaattagtatatacataatgtacaaattacaaattatacatatttacataataacacagtttttaaaatggtggcaattatgcaattagcaagggcgtagccagacccttggctttggggggggggctgaagtaaaaaattcgatttttaggggtgtatttttggttttttgaaatccctaattatggggtgtattttacaaaatttttcgccgtttttcgccaaaaaattaatattttttgccatttttgtctccatttttcaaaaatatggtaaaatgggggtccggcgcgccgggaaaattttttgagtattttaatgcaattttgttaagaaaattgcttaaaatttcaa

SEQ ID NO: 15299 - DNA, 3348 bp, Heterodera glycines
  misc_feature (49)..(49): n is a, c, g, or t
  misc_feature (58)..(58): n is a, c, g, or t
  misc_feature (61)..(61): n is a, c, g, or t
  misc_feature (73)..(74): n is a, c, g, or t
  misc_feature (92)..(92): n is a, c, g, or t
  misc_feature (99)..(99): n is a, c, g, or t
  misc_feature (104)..(104): n is a, c, g, or t
  misc_feature (107)..(107): n is a, c, g, or t
  misc_feature (110)..(110): n is a, c, g, or t
  misc_feature (114)..(114): n is a, c, g, or t
  misc_feature (120)..(120): n is a, c, g, or t
  misc_feature (127)..(127): n is a, c, g, or t
attttgcaggatttgcacttgcaataaaacaattaaacctccagagacnctttcgggncgnaaattttgtgtnnactgacctttataagatnaatcttnagttngtnaanattnaatggnactttgncaactgcttgggccgcgtccgtgtggaaatgcacattctttttgcggcacaattcgcctgggtttggaagaaaaaggcattaaaagaccaatgcttttttaaattaggaacgctaaaaaaatttttaaaaatgggaccaatttttgactgtatcccctgaattcgagtccagggatgaccagcgtttttcagctcctctttaagtgtggcccaattcagacaatacgaagcatttgtatactgtcggagttaagtacctatttttgtttttgttcaacatttccccaaaagttgtaaaaaaattttcaataaaaatgaatcaaatttaacatagaccaactgaaaattgcttttcccataaaaaaataaaataaacatccttttaagctttttttatcagaagaaagcattttaaagatctataaaactatagggcattttcgaattaaaaagtagggaaggggaagcggagaaaatgtttaaacttttttttggaaaaaacagtaattcgtgcataaaattctaaaaaacgctgaaaaattttcaaattaaaaagctttaccaatttccttgagcggttgccgcacgccaatttcgttgttcaccgccatgatggagacgagcgatgtttcggggcgaatggcctgctcgagcacctccaaactgatcagtccgttgttctgcaccggaatgtacgtaacgtggaagtcgccctcgtgctcaaggaaacggcacgagtccaacacgcacttgtgctcctgcaaaataccaagtgatcaatcggcaaattttttgccattttttcactcattttttctatcaattggcaaaaacctcattttctaatattattaggcgcagtgcacgaacaaataggattttgaacggattttttgcccaaaaatgaccaattctgcgcattttttggatcgaattaaaaaaatatatcaagaaattttagagtccagcggtgccgacttgcattaacttattcaaacttattaataaaatgaataaaatattcaacaaatgcgtatttcttggtgtgtacttcattttcacggcccctgagtttttttaaaccacttatgttagaaatttttcaaaaaaaaaaatcttagaaagtttttaagaaaatttcaaaaatgctttttagcgatttcttggtaaaacagtttgttagtaattgattataaaaattttcaaaaatcgccagagaatttcttagaaaaatttcaaaatttatcgaaaaatttcaagggtctggaaatctaaaaatttttttctggcggatgacctgctccgatttattgtcctcccccttccctccccccactgaccgtctgtgcggtgatcacatggtttttgttggccactttgtagaagcgtgccacgcccttcaccgcaatgttgttggactcggtggcgcccgaagtgaacacaatttcgcgcgggtccgccccgatcagttcggccacctgttgtcgcgcgtgttccaccgccttttccgtctcccaaccgtaggcatgctaatggggggggggggggtggtacaattaaaggctgatatgttgtacggcataataaaaagcgtgcaatacgtctccccgaaccgattttttaaattttgaaaattttttcaaaaatgaattttttttttgaaaaataatggaaagaaaaattcggggagagcgacgaactgctctcaaataataaaaattcactcactgtccgactgtgcgggttgccaaagtcgttcaactgatagggcaacatggcgtccaccacccgtgggtcctggcgaaaaaatcagggcataattcggtgatagatagccagaaattgcttgtcaacaacaacacgacggccaatcatttatatagtttttaaacctcgaggacaaattgtccaaaaaattagtgaccaattccatcaaatcgccttcctcacccagggtccgattttttttaaatcaaggaagcaaaaaatgaagcaattttcctacgtttgccatcgaacccctttcaaagaaagagacaaaacaatttttggttcaagcaattatacaaaaacgtttgtttttaatagggcgcttgaacggcatcccctcggattacaggaaaaactgtcgaaaaaataaaaccgaaggcgtagatagagatgctggccattttttaaatttcggcaggaccacagtcccgaaaagttattaatagttgtcacattgactcctcccccgtccgcctcaccatcggtgtggtcgcctgcacgtccatgtacaagggacgggcggtggcggcactgctggcatgacgacaactcgccgcaatctccgagggcgtccaatggcaccgcaaaaacagctgtgacaaacgacgcatgagaagagagccgtccgtcggctttcagatatccaaatttaattaaaaccgcgctggcaaaacaaacaattcaaattgaaacaaaaaatggtggcataaatttcaaatatgtatgagaaacggaaaccgaaatggcacaaaaaatggtggaaaatgcgtgtggtgttttttccttacattttatttttctcattgacttttaaactttcaacgcgcaaataaaactataatatttggtgttgttgttgcaaataatgtgtaactgaaaaaaatgggtggtttctgtgggcgaaaaaaatcataaaaagagaaaaagtacaacggaacaaacggagggagagggactggggtgggggaggagacacaacagagaaacagagaggggcagagagagagaaggcggcaattgtgccgaagacgacaaaagcaaaacaaaacaaaaaaaaacagggggaagcaaacaaaatgtgtgacaaacgatggaatataatattgatggagagagaacacagcacagagggggagagggtaaccagtaaacagaagcagcgagtccagggaattttcccaaattttatggaaaaaatttaaatggaagagggattttgtggctaataaaatccaatttcgcgttttcatttcatagagctcgcacaatttggctaaccatggatttttactgaaaacccaggccaaggttttttcaaaatttattaataaattggaaattacaaatgtgtgtcagccagggatgggccaaattgaaaaataaaaagcgaaatgcgaaaagcgaaactgaaaaatgcgaaatgaaaaaaaagcgaaatgcgaaaagctaaa

SEQ ID NO: 15300 - DNA, 3279 bp, Heterodera glycines
ggggacctctagagtcataaaaagtgggccttttattctcctaaacctaacccataaattaactcgagtagttctttcaagtgacaagggtcgtagttaattatcattaaaaaatggtttaaattgattaagcctttcaccagaaattttccaaaatattgatccgggagttgcgtgccatctgcaaaaaaatttcggcacatttttggctattaaaacttattatgtagcaatattccctaatctgttatatgcacattttgaatatatttttgtcatttttggttgcatttaaaaaaaaattattcaaataaataagtgggacgttacttaggtatttgtcaccctgtactttgaaattggaggatcaatttcgtaaaattttgggcaaaaaatcgaaaaagacaggtaaatattggaaaattactaaattggaaaaagcaaaatttttgtgccaaaaactcaaaacctttacgttattgaattgtatttcgttgaaattttacgaaatttattttattttttccaatttgtaaatttttcttaagaaatagatttcgtttttcaatttattaaatttttacagacttggatttgtaaattttcaaacctatagatattttttatgaaatttgttcaaataaattcatgaaatatttaaaaatcgcaagtttgctcatttttctggtgtaaatctgttaactattgcaatcaaatttcgctgaacagtagtgatcactagggctgtgaattttagtgacaaaaaatccctaactaaaatagtgagtaaaaatgttaaaatagtgacaaaatagtggcaaaaagtccgaaatagtgacgaatagtgacaaattttcagccaaaaattgagcaaaaataatttttattcactgattgcagttgcaaatgagtaggactgggatttttaagaccaaaaaacccaaaatagttacctaaaaaaatttttaaaattaaaaatttttgccaagaaatttttgatttcataggagtatattttgaaaaattttagctcgattcttaggggtgtattttttggttttattgcatttttgttaaggaattttccaaaaaatgtcgaaatagtgaaaaaatagtgacaaaacgccaaaatagtgatttttaactattttagtgacgaagtcgccaaaatagtgatttctagtgaccgatagtgacatcagaatcgaaaatttttaatgcagaaatgcgttttttgagctcctttcttcaaatcaatcgagcaaaaaatttagttaaaacctaaaattcacagccctagttattactagggatcggattcttagttttttaactatttgctcatttttctggtgtaaatctgttaacgattgcaatcaaatttcgctgaacagtagtgatcacgaatattgcgctatttgaaacccagcaggacccgaattcgaacaaacagtcaaaaatacgaattttcaaagttcaatgttttaccaaactgtatgcatttttctgtgtattgtaatactgtattttagcccgaaaaaactctaaaaagcattctcaaacataatggctaatttgctatacattcgcatgaaagccaacgactgtccgttgatcgcttttatccgatccggtgggtgggttttccattgttgaagaagtgctgggttcagtttacaaaaatgcattttgtaaatatgttgttgggtatactgtcggacctactgtatgccggcaaaaaccatagccaggaaaaacatttcggaggggggaccatagatttttttcaaaaatgtcagcacaggagaagcaaaaaaaaaaaaacagggatttgtagtcttttcgtcaaaaaaaaagtgattaatttttgcggttttggtgtcaaaatttcagaaaataaagtaaaatcggcgttgccgataggcgccgcctggaaaaaatttttattttaaatttaatgcattttttatggaaattttgggaggggattagtccccccggcccagggtcagccaccggtcggtctctttgtttttatttttattttccccgctacatattttacaggttgtaccacctcattcatctccgagtcgttcgcccggaaggccaaccttttgggcaacattgaccgttccaattgcgagacaattcccatacctggcaaagtgcttggctggtgagtggtggccaaaaaaaacaaaagttttatgatgcactactacgttttttcaaaaattttccctaaaaatcgctggaaaattttcaaataatttttttttcttgaatttttcatatggaaaagacatttgcgcctttgtccaaagtcgggttcaaattttctttttttcaagccatgatagcctaaacagctttaagcgatagaaagtgattataaaaattaacgttgaatggcgcaaatattggggctcttatttttaagtttttcaaacaaaaaaaatttttttcgaaggcatggcttaaaaaattgggcaattaattctcttattttttgacttaatttctttgcatgttttgcagggccaacgatgttcaaattcgaattgatgagctcaatttgcaatttgtgcaccgtttgggggtgatggcggacaaacatttgccaatgtatgtttggcgtttttttaattttattaaaatcaataattaaaaaatgcccttttttattttttgtttttgaaattcattttttaagatattgcaagaagaagttcgacatgctgtaagttcagacaacaattaatgaatttaacccccaaatttttttttcattttttaattttccaagatttttttttgaaaatttaatgtttttaagacgttttagctcgtcacttcgccatgtctctctcgatgacggcattctccctgaatttccggtcgatgacagtgccatggcgtcggatggccaagcagtggccaaatggctgttcacgcctcatccagacaatgtgccgaactttctctactgcgatgtgaatttgtcgatggatcaatggtggtcaacaatggaacagttcaaagcggtgtggttttcacgcggtgtttttaattcaattttctgtgtattttttgtcccattttcaggcattttccaatgcttcttctccgattgctttccgcattttggttcactttcagccgtcttttccgattgactctattgtgccatttgatcggatcaacgaagtgactggggagaaattggcactggaacaatatggaactaaaatattttctgctcagccgttgtccaat

SEQ ID NO: 15301 - DNA, 5634 bp, Heterodera glycines
ataaggaaaagccggaggaagcgcaaggggagcagaaggaagagaaggagacccaacgggagaaggagaagcagttgggagagaaggaaatgcaaattgatgaattaattgtgttagaaagcgatgatgaagagaaggaaaagcaaggggaagagagggagatgccggaggaagagagcgcaatgcaagggaaggtgaaggaaaaacaagcggaagagaaggagacacaaggggaaaaggagaagcagcaggaagaaaaggaaacgcaagtggaggagaagaaaatgcagttggatgaggaggaaaagcagcaggaagagaaggaaaagaagcagacagagaaggatgttgaagaaataattatgttggacagcaacgatgatgaagaaatagaaaaggaaggggaagacaaggaaaggcaagaggaagagaaggagacgcaaggagaggagaaggaaaagcgagaggaagagaaggtaacgcaaggcgaggagaaggaaaagcgagaggaagagaaggtaacgcaaggcgaggagaaggaaaagcgagcggaagagaaggagaagcaatcggaagaggaggaaaaaacggataaaatggaaaagcagcaggaagagaaggaaatgcaagttgaagaagtaattatgttggatagcaacgacgatgaagcgatgaaaaagcaaggggaggaaaaggagaagcagttgggagatgaggataagacggaggaagacaaggaaacgcaaggggatgagaagaaaaagcaattagaaaatgacgaaaagcgggacaaagagaaggaaacgcaattggaagataagcaaaagccggaggaggagaaggaaacgcaaggagaggagaaggaaaaggaaaaataattttgttttactgattcatggaattttgatttttcatctgattttttttttcaaaataaaaggtattgtaatttatttataaataagagataattataatttcaaaaaataattcatttaatatttcaaaatttattgtctttcatttccttcaacgtgattcgaactgtcattgtctttgtccaattgttcccgtgctttaatcagttggtcacaaattgagttcaattcggcattctctttgttctaaacttgaaaaatattgtaaaaaaacagctgctcttgaccaatcaatgcatatatgtcgagactgacttttaattccaacgccgtttcaagcgacccaatccgaatttgtgcccttttcaatgccattcgaattgacagtgttttttgctcgtgctccgtctcggcatttctcagttcagcattcgcgctcaaaattttaatgtggcaattattaataccttagctatttttttattcgaaatattttttcaaattaaaaaaaaaattataatatagacaaaaaaatgtacttccttttttcggttgttttctcacataataaatttacaggcttttatgagatttttaaaatttttgaccctcaatttgtgggaacttgtgtcccaatgcccgtatttcgggatttttgctcacacggattcttttttgcgattttatatatccattaattgacagcagccctatttttcaattgaattcatgcgcgtactctttcaactttttctgcgcttcaaccaacaattccatgtacattttatgcaatgcgccgtattttctctccgcctgttccaattgggtgttaagcgattgttgaacctgaaaaaataaaatgcttaattttaatggatatgaatcccggaaatctgaaatttgcagatcccactggacgggatgggaattcaacaaattttcgtgatggaatcccgcgggattaatcccaaaaacttatagaggaccgagatcccgaaaaatcccgcaccggactcaaaatcgaggagcacctccttcaaatcgacgcagttcagtctcattttctcgtacaatttgaacaaattggaatagttgtcctccagcgaattaatctaaacattggatgtgctgtttgaattttggggggcatttgggtcgaaattgaaatcgtaaatccccgactttgctatattccggattttgtacttcccttttaaacacaaaaaggccgaaattttcgttgccgaactcgaagtttcgcctgtccctgatcccacttgcgtttttgtccatttaattaaaattggccacatttgtcttttttaaacttttgcttttttaaaataaataaaacacattcctttggcaaaaaagttgaagtcgaattaatgggtttggatactaatgagtccatgcttatttgttagcttatgaactgaatgaagtgccaacaacctctccattaagcgcgtaattttcccgcactaatttggactcagtttcgctgtgatttgccgaatttgtcaaatcttcatcattcgcgcacagtggcgaattcgggaattgcaaatgctgtcgaatggaatcggccgaacggtcgttgagtatggcatcaatatctgatcagtggggcagggagaggggtggcaatttttgacaacaaaatgcgcaaatagaaaaagtaaattatgcataattaattaaatgaaaatataaaaataattacgcataattaattaaaaataattatgaatattcatctttggaataaatatttatatttggttagaatttttgaaattattattgtttttaatttaacgaggaaatgatggagaaaaaatatatttttttaaattataaactgaacaattccatttcggcccatattttgaacagttccgttgctttttcactgttttgatttgctacattcaattttaattcaaaaaattgacgttccattaatttgtctttctcatacttaattaaaaaaataaaaattaatattaaaaaaaatattatttttattaattttttaaaaattaattttcccctaaaaatttgattaccttttcgaccaattcattccattgtttggccttctgattggccaactccaaaatttgttctgaaatttcatcggccaccaaattttcacgcaaaatgcgttcaaattcaacaaaatctgggcaattctctatgaatttgccattttttgaatgccttaaataattaatttaattaatttaaaaaaattaaatttacaaatttttctccacattttgatcgatcatttggctattgttcggcggcacagtcaatgcttcaggcaatagtattggccttcgcacgcttttcttcgtgatgattattgtacgattcattaagctatatataaaatgaacaaaatatttaaaatcaattcaaattaaatttaaaataattttaaatccacaaatttgaaaaaaaaaacatacgattgccgtggattcagtgcagttgtttccattttggtgactcaaaaaatgaattaattcttcaaaaaatagcggagaattttggttgtacgggaaaatcaatttggatgggcctgaaaattgtgaggttggccttattggcagcaatttaatattaatacatttttggggcatcacaaggggaagagggcttttgacaaaatgaatggagaaaataaaaaaaacggaataattaaagagcgattttttgttgggacaaaattaatttaaaatatttttaaaagaaaaacattttagcacccacccctccccccaagactcccgcccacccacaaataagagaaaaatagatttattgttgaaaaatttggatttttcgagttcgtatcccgtctaaggtgaaacatatggacaagttagagtggatttatgaatttttcaaagattttttttaaatgcggaaaacattttgaccgcccaagagaaagttgcactaccccctccaaatcccaaatcctcggactgtccatgcccccaccccctccaaatcccaaatcctcggactgttcatgcccccaccacctccaaatcccaaatcctcggactgtccatgcccccaccccctccaaatcccaaatcctcggactgtccctgcccctatcccctaaatcccaaattctaggaccgcctcactacccctaccaaatcccaaatcctcggactgtccctgcccctatcccctccaaatcccaaattctagaaccgccgtccccataaactaggcgcgtggcggggggggggggggggtaattaggggaataatcgaaggattggaacaataaattattctcttttgtgtatttatttgtttatttattatggtggtggctgtggtggtcatcgggtggtgagccgactagcccaatgtcaacacaaattattatttatatgaatggtaatgggcaaggcaattagtgacgcgcctttcccaccgcccatttgtggtgagtgacagcgggagtggccatggatacgccttttaagttctgctgctgggccgcggaccattctgtggtgaggagtgaaaatgcataaaatgggaaaacaaattttctcctcatttggtccaatccataaaagatgaaggctttgaaagtcgagattttcctatggaaaatttcaattttaatgcgaaagtcgagattttcctcttatgggccagggaaaatttaatttgatgcaaaacttgtcgaggttttcctcttacaggcatcggaaaatttcaattttaatgcgattttcctcttatgggccatgtaaaatttataagagctattgaaaatttcaatttaagccaaaatcttcgaagttttcctcttacagactttctatttattgtgataatttccaaaatcagcacttaattatacgggaaaatcaaacaacaatttatccttgcatatgagtgccatcttctgatcattccgctcgttcaaggcaaaaattaacatcagggccctgtagagattttgcgggaaaaatgcctatttattaccattttgagcaaaataaaccgggaaagtgcccccggcaaaacgggtgattttatcacggattctccagaatttgctttaaaatttacagcattaggcttgttaaggttgggaaaatgagggggaacacaaaattggggaacccttgaggcgagggggtaatttaaataggggttggcagcgcattggcgggatatgttgggatcggattggatgggatgggatgacctcgtcatcggcgtcccattgtaagccgaccccaaaaatatcagtcgcaaaatgtccccgaaatatatgcgccgccgcgcattttgaagtgctaaaacaaatagtacatatatacaacaagcaaactgtgtacagattccgaatggatctaagctttacgggggagggattattatatttttttgcaaaatgtaaaatttaatttcaaattttttaaattataaaatttaaatttcaacttttaaaatttccgctttattggttaatttttatttaaaaaagaggttaaaatggtggtggttacttctagtaatgagagattaaaccattgtgttggggtaatcaaggtcatatatttaacaaaagattattatgaataaaagattatggcttttatcagtgtagcaacggtggttcagtggtagaatgctcgcctgccacgcgggcggcccgggttcgattcccggccgttgcaacttctttttgctttatttt

SEQ ID NO: 15302 - DNA, 3965 bp, Heterodera glycines
ggttatactttaaaagatggaagtggtcgtgaatgtatgaatgtaaattttaatttaaaaataataaataaaatgataattaaaatattaattaataatttaaaaaatcaaaaaatttgttcagataaggagtacctcaaactttttttccccatcaaattttcgtttggcgaccgcgaaatttcaattgatttggaaaactttaacaatgaatttttgtttcgaaaaattggtgaaatgtggtccatgccaaatttggatgagatttgtttttttggtatgaaagaactgataaaaaaccacataaatcagccttcctttcagatttaaatcgaacaaaaagacgccacactcgatcgggacaaattgaaatatttttattttatctgtcaaaaaatggaattgcctgtttcactgaattcttgttgattgctattttttctcgttagcccttgagaaaggcgaataaatttaaataaaaatttcattgaaaataggttaaataatatttgtatatgaaaattggttgaataaaatagaatttaaaaaattaaaaaaaataataattgttattgataataataaataatttataatgtaaaaaaaagacaaaaatggtagaacataaaataaaaatcaaaaatcaaaaaaaacgaagaactgtgtatacagaaagtatttctatgtgtgaattttcaataaaaaggtttctttttaaaagagggttttttatataacgccctttttgacggttttttatataacgcccaaaacacaaggaaaaatcaataaaaacacaaaaaaaaccatttgaggattttttatataacgccctttttgagggtttttatataacgactcagcacccatatttttctaattgtattcattactttgttttccgctataagtgcaactatgttgccttgcggtttgttcaaataaataaaaataaataaataagtctgaattttagagaaatttagtcagaagaccagaaaattgaaaataacattaaaataaaataatttacaatgccgtcaacatccatggcacgctgtgacttcatgtcgacaccatcgacatcaaaaagcgccttcgcctttggtctcgatgatggtgagagaaattcaaacaaaaatttagttttttgtcatttcattttcataattttagtccatatgttcgacgagctgcggcggcgccacatttggaccgaggaggaactgcaacgacagcgccggtcaaacgccttcctccggaaacagctcaaggcccagcgcgaccggtcgacgagcctcgagcgttcgtcttcagcatgccgccagcggagagtcctttccgacgtgaccaccaacccgcaggaggacaaaaggctgagcgcggcgaatgatttgctcatcacattggatgcaggcatttcgttcaaagcccgtgaagcgtgaaagcggtcattcaccgaccacggacttgacgtttgagcaccgacgagagcggtgaagcgtctgaaggcggagctgttcgaggttttttgatcaggtggcgacatctacaaaatcctcgaccacgaaaacttcgcttcattcaccgtcccaattccacccggaccattgaaattcttgctaatcgatgctatgaatgatctgcgcaacattttcgtttgtctcgtgccaaaattcttcagcccagtgacctcaaattgacgccgctcgttacccagtccgcccaaagcttcattctcgctgctcacgtcgttccatttgcacgcactcatctctggtggggactgatcagtgaacagggaatggagcatatgcacagaatgtgcaacaatttggtttaatgaataatttttcccattaaaattataaatccaggtcggtcgttatgctcatctcggcactccagagaaggttgttgagaagttggtgaaacacgtgacactgctgaatgcccttcacgatcgaggtgtcgaaaaaaatcaagaaaatggaaacaaatacccaaacttttgatcaaaatttcatttttccaaacattttcaccatttcacatttccactatctgaatattatgttgaacacatcttttccgctttctataataaatgcgctatttggcgttatgagcaattttgtctgacactggcgcgtacccatagtgctgttattgacttttcctctccccctttctcagtcacacactatttcaattgtctctctctctgcctatctattccaaatttctcggaccccacgtctttataagtgtgccaattccctcactcatggctctccgctccattcattctcattcaacatcagagaaatgaaagcaaaaatattctattataaaatcaaagcaataaaaccctacattttttacatagttttccttgatttgaattcccagtaaaaataccggaaattaaaaaatttaaggttaaataaaacaaattgttcttattaacccattcaaatggcattcttaatcaatatatataaaacatgcggagccatcattccattgacatagttctaaaagaaaaatgcgttcctcaccaaataatcattttcactcattcgatattttgcaaaaatccaaaatgtacaaattagtcaaaaatacgaaatatattcctaaacatgtataaaatccacaataattctcaaatagcaaaaaaattaaaatttaaaacatttcaataaattcaaaacaaaaattaaaaaaaatgtataaacaaataatttaatttatttaattacaaatatgtttgacacaaaacaaaaagatacattcgtgtttgactttaatttattataaaaaaaagaaaagcctattaaaacaaaataatgtaaaattttaatgcacataattaaattaattcgtgtcattagtagtaattttgttgaataaaatttaaaaaattgttaataaataagaattgttttaaaaaattactgaaacaaataaaaaattaattttttgaaagcacaaaatgatacgacaaacaactgaaccgccctcaagaagaacactctgaaagaataataagttgtggagaaaaaatttccataaacacaaaaaacacttaaaaaatagcttaaaataaaataaaatacgtaaagatagatttataacaaatttaaatatctataaagaatagaacgcataaatgaagaaataaatcctttaaaaacaaaaaataaaaatattattttcggaataataaaataaatttaaaaaattatttaaattggaatatataaataattcttaagttatcataaaataaaatgaataaaccgcaaaattccggccatcataaatattttacagtaaataacaaaacaagtataatatttctaactaattgctttatgcatttcaaattattttagcaaaaaaagataattaataaatagtaaataacaagtgaatgatgcttcgtttattgaattatgaaaatagcggaatgaataaataaactgaatattaatgttaatataaatccaaatcaattcttccaaatatggaatatttcgtcggaaaattctgcgactcaaaaccatcaaagtttttgaagtaaaaaaattaacgagaaaatatttttaatgcaaaaacttatttgaaaaattataaactaaattaaataaaaaatcacagccaaaaaatttccgctaatcttacagacaattatatgttaaaataattaattaattattatgcatttgtgtgagtgtgaataccctcggagcgatttcaaaaaactaattaaaaaaactcattcagttttgaaaataatataatgaaatttattattcatatttaatttcaaaaacacatttatttaaaaatgaaaaaaatataataatttttagattcgtgataaaataaattagttttataattaaatcataaaatatgagatgaatagcattaaacaggaaaatgttaaagaaaaa

SEQ ID NO: 15303 - DNA, 4445 bp, Heterodera glycines
aaaattttaccctcatcgacctatcaaaaaaccacaaaatgaggctaaagcctcagatatgggacccctgggtatgtagaagaagagggtaaaacgaaaaggagggaggaagaggtgaagggggctgtgaacttaaatacatcacggttctcgctgtaagttaacggctcaagcgtcctctttgttgagcgacgcaagtgtcgcgccccaaatggtgcggcgcagatgtctgcggcgcaaaagtcggctatccgatttggtgaaggttttagtgtatataaaatgcgtatttatgggtttcaagaagaggtgcatattttgccatcttttacatttttagagcatatttcagcatattctttggaaattctcagatagaaaaatggaaaaaagtcgaaaaaatacttccatatgaaatgccttttttcgtacatatttcattttttaactttttttgagactttttttgagaattatagaaacttcttatgaaaaattgaaaaatatctttttttgataaggtacgcttaaaatggattctttttttaaatgagatatcaaaaatttttaagcatcgaaaacgttgatttaagatatcttaggttcgtcatcgcattcttagtcaaagaatcgtgaaaggccaggagttcgatataaaatcagtgctgcacctcctaagggaggaaattgtgccatcggaaattaagtgaagtattcttgaaaatcaccccacccccattaagagctattaaaattttgcaccaaaaatatacttgataacaaacttggtcttcaaaaatatgcttagtttaaatacctagatgcgagatccgtgatccggcacctctaatcagcaggaacaatttccattactagatcaaaccgaaagagttcaccttttggttttcaataaaattcaaactcggcctatttttaaaaagcgccattttcttttaataagagaaatggcctgtacaaattcacctctttcccgttgtaaacttttgataattgttgaatttccgcaaatcgattgcgcaaaatgttggacgtgccaataatgtcctcattttgttttgctgctttttaaaaaaagccatgttttattgcttatgagggtttaaaacaacaatgcttaactactgctgatgttcgctatttctctaaaaaaataattttgaacagttctctttcataaaaacatacattttcccggcggaaagggcggatgccgtcgtctgaaaattaaaaaaattcgaccaaagtaagacatttctccattttatacacagatagcctcgagcaaacacacttaagaactatggttattacaatatttttgaagattttgtccatatttttgttcttttcgaaattcaatttttttttttgtttttaaaaatacatttttggccaacatccactcaaataaaaaaacaatttatgaaaatgccaaaaaatggataataaacaaaaaaaattcggaatttaaaagttggttagataaattaagactagtttcaacaaaataaatcattttaatcatcatcagatcccccaaaaaatatctgtttgttcaccattctctcatccaataaaaaaggcattctcagagacaaaaatcttcacttctttcgcctgtcaaaacctcactgatcgatcacatgatcagttagtactttatcattcattttatccagccatttgggtggcagcaatagccgtttttccacaccatcaagcatttgaaattttgtttcacccctttggaaatgagtcgatgatgacgaagttgaaaagttgatgatgggcctgctgctggtttcgtgcggcttgaacacggccaatttctttggtgccggccgcttaaaaactgaagatgataatgataatggaccgtcagcttttcctccctttttgttgtttgtgcttgctgctgcatttcctgttgtttcttgaacaattttactgaattcttgttgctcaacatggataactggtggctcattctggtaaattactgttggtggtgccgaatttgtcgattgtgatgccgtttgattgttttggttcttgtcattgtccttcaccgcttcacaaattatggaaaaaaacgcgcaaagcagcaaaaaagggacaacaacagtgaattgttgtggcttcgtcatagaatttttttaggattttttttggaaaatactgaatttctattaaattgatcagccttaaaatataaatggttttttattattattgatgctgtttggacatggctagacgtaagtattaaaaaggattgtggattatgactctttttgactccacataatgaaggatctcaagaattttaagataaaatcttatcttacgatgccaaaggttccataatttagtggatttaagaaatgttatggcaatattcgattgaaaaagcctagtgtttagagatatttcctgccaatattgagaaatataaatttttttaatttcttttccataaaaatatgatggttttgggcagcaatttctttttatgctattaatttgccatctttttacaacgcagcatattgattacgtaatgacaaggcattaaatttgcagttttcgaaaggtttttagcccgcttttcatgcgttatacgaaaagtgtttttgtttttgctgaatgagtacgagtgccgagttacatcgtgccaacttttttttagtgaataaataaataaatatttatttccacttaattcgaatgtccactggtgtagcggtagtgcgccagtcagcgttttttaacccccaggttggcttcctctacatgcaaattctttttttgctttttatgccaagtaaattatcaaaaattgtttataaaacaaaacttttttttattttttcattcattttatacataaaatactcaataaaaatatttttattcaaatcgacatgatatttaaagcatcattgtacctttatgtttaatgtaatttttaattttaataaaattaaaataaagattttgcttcataaaaaatatttttaatatttaactttgcataaaaagcaaaaataaaaattgtaaaatgtattagcatgcaaaggattcgaacctacgacccacaaaaacttgactaacgcactacctctaaactaatggctactgttgtaaacaacgaaataattactctttttcattaatagtaaaaaactataaacttttggtacatcataaaaaacgaaaccaaaatttaaaattttaaatacgaataacgaaacgaaaattgaaatatttaaatataactttttgacggacgaaaacgaaacatgaaacttaaaaagtgacgaaaaaggggggcgatacgaaacgacaagaaatttcgcacatcactggtcccgattatgccgcgagtcgactccaaagtgggcctccagcatggccaattacgactttgaaatagggtacagcaacggctgacgttctctcgcgcctcattgccaattagccccaccgggggaggaaatttttattatgaacatttgcaccgaaaccgagtgctatatcagcacaattctgcaaaccaagaccatccagcttctagtcactgcagaagaaatcgcagaagctacacaaaaatatgaaattttagcgaaaaccttggcattcggtcgatcgaattagccaaagaacgcagcgattcgggcaccgtgccgtatttaccgaaaagggaatatattgtgggaaggcactcacccgccaacacgtacattggcctggcatcaattcacaaattgaaaggattgtcagtcagggtgaagaaaatcaaatgcctcaaaaagcaccgattcattttggtggactcatactccaaatggccggacgtctaacaaatgaactcaatgacagctgaagcaatcgtctaaaaacactctgtcaatcatctatcgactcgtcattccgaagaaatcttttcggataacgggaaaccaattttcattcgtcagaatttacggcattctgtacggagttcggaataaagcaacttttaggtcaccataacatggacaagtcgagtgcttcttttgtcggaatcaaaaaacttgaaaattaattttttgtttccgcaattgattccattcttagaaacttttttatcatttaaaagtttaattcgttgtaaataaatttcaaaaatgcttttccatttttcctccgctttggtcacaaaaacaaaagaattagctaattgattaataattaacttcaatgaaaacattccaataagaaaaattaattaattagacaaaagaaaatgataaaataaattgtgattaaagaataattaaaaaatgactatatttataagattatttgtttttaattaatttatttgattgcttttgtattgttttaattttttgagaaaattgttgccccgcatttatgat

SEQ ID NO: 15304 - DNA, 1732 bp, Heterodera glycines
gaggaatgtattggaagcgatgatcagaacgaaaatggcaccaggaggggtgtggcgatggggtgggggtatagcagaggaaaaccggggcacaaagtggaggaaaaaacaggggatgaagcggggataaaagccggaaaaaagccgggggcatagagaggggcgaataagggggtggtgggtgactgccgatggcagctgtttctgggtgggcattttagcagcatcagaagcaagaaaatttgtcggatggaatcctgagaattgacaaattcgccggaaaaagagggggaggggattaatatttacaataaattgatgcaataaatggtaaatggaatagcatgagaatgaaaagcaaacggaatgcaaatgatgagacctttaaaaaatgaaaaataaaaatggaaattttgacaaaaaatttctgcgatttaatttaggtttttggcgaattgttttttgaatttaggtgtcattttttgactgcgaacttcaaatcattcgttaaacatacaaaaaaataaataaataataaatttcattaaatttctttgttcaaaaacaaagatttgtgagaaaagaaatccgaatccgattaagtcattttttgcaattaaaaatgagacaaatttaacaaagttttatttatcaacaacaaaaaaatattcaacaatttggcactgtgacttcttatttgggctttggcacggattcgaatttcaatttgtcgaaaaggaaaagacggcacggaaaacaacagaaaaaaactcattaactaattaataccagaatttcaagcggatttaccgtaaattcttttgaaaattttggtttaattttggtttctcgaaaatggtcagtgatcggagtgtgcgggagagggcggtctctttttcagtgtatctccaattcggacatccgccgatcggtccgaatcccgccaacacccccagtgatgtcgccagctgatcagtcagtcattcagtccgactgattgatcactttgcttgttcactattcactattgctgctggtcgccgttcgcctcctctgctgtcgacccaccaatgtccgcttgcatttcgccaatgtcgcgcagccacgccctgcgcacgattggccactgctgcgcgtcggcatgcgccgatttgatcaaaaaagtgggcagcccgggctcctcaggccgaaacaccagcgtgtcctgctcgcgactgtgctcgcgcactgtgtacttgtccagctgaacagcgttttgtgaagagaggcagcagaaatggggcaaataaagataccgaaaagataacaacacacgtacccaggggataagtgcattcaccgcttggagccgtgggttcggtcgtttcgtaaaaagtgccagtttttacagattttccgaaaaaatccatcatacttttccttaaacgcaaccaaattaaaaaatcttggtatcatgcgatagcttttgattgctcttggaaaatttcagaaaaggcaattcagacgactttgtttcagaaaatctgtaaaattgtcacttttacgaaacacccataatgacactttttatgaaacgattcccccgaggcatttggttgtaatggataggtcgaaaattccaatcaaaggtactcaaaactacatcgtgaattgattccttttcgccacatacggtactcttcccattcttacttaataccgtactcgaaatgaggaataatggcgaaacact

SEQ ID NO: 15305 - DNA, 2319 bp, Heterodera glycines
  misc_feature (2305)..(2305): n is a, c, g, or t
  misc_feature (2314)..(2314): n is a, c, g, or t
tttgtcagcttcgatctctgaagtgggatgtttcatacatggggggggggggggggaaggatcactcgaaataaacttccttttatctttcattattgtttaattaatgatcattatgctcatcacgtgtgtgtaaattcggcctaatcgcccaatgtctcccgaatagtccaacagattcttcgtgaattccatctcctgcgcccgtttcggcactgattggatcagctccaatgccttctgcatcactttggcgttctgttgttgctgaacacgcaacgaatatttgatgatttcctgcaaaaataaaatttaaaaaaaataatttttgaatttgaaaacgaaattcgaatttttgcattgccttgaagtaatcttcgtattgtctgattcgattcggcactaattccaaataatagctgtactctttcacgtcggagcccgcgttgcctttgcactccttttaattgtaaatttaaagaataataatttttaatttaatattcatttttccctaattgaataattataaaaatgattacctcgaggaatttttgtacggcgccattttctgcgacgattcgttgcgcattgtccaactcgcgcagaaatgccacgtgttgctcaaaatcgcgctccaagcgcaaaaatgtctgtccgacctttcccgagtcatccgaataatactgtaatccattcagcatcgcactgtaaacatttgagaggaaatgaaggaaaaataatacgggaggtggtaaaatggcactaattggcaaacggagtaaaagcgatgacaaaaaacattgggtacgatacaagaaagaaaagagaatacggtaggaagggttaatacaattttttatgagtgatttctaattatattactttgaatgaaaattgcatagctcgcgcatgttcaaggcaattcgatgtgtgcgaatttcgtccggtgcctcgggcgcttcgaaagcatccaaaaagtgtttggaacagtcgcgcaattgggcagtgaattgctcttcggtgcgaagcaaatcatggaaaacttgtctgccaatgaaaaagataaattaggcaataattagcggccattaattaattgccccccccccctcctcactctctcttcagaagtgtctgttgctgttcactcaaagtttgctcatccgctgtcaattcacgcgtgctcttccgctgtgtgtagtattttgacggtgtctcgaagtacgaccccggcacccaacccgtcagcgggggtttggcctaaattctgaccaattttgaaaaaaactggcgaatatgccaaacaaaagtagtccagtgcccaccttggtcctgaccagccaatttgccgggtttttgttgtccaacacttccacaatttggccttgctccagcaacagcgcctcccccggcgcttgtcctggctccggcacgtagtcttgaatggcgacgaaaacggccaatgaccgatgctcagccgtggccggcgttgtcgatgagtcgtccttctgctgttgttgttgttgctggtggtggtaccgtttgatcggatcgccggacgaactgctcgaatcggccgtggagggggcgcgagagagaaaaagctgaaatgccattttggattggcattttatttagccgagtttaaaattccgttttttccgcttcacctgctgatcagttgcgccagtggaggaacgcatctgtgtcgacgaatgtgtggtggccaatccgcgtgttgtggtgtttcgctgttcttcggcagcaattcgtctgcaaattaaatttgaattaatttttatttaatttttaatttttgctgttttttaatccaaaaagtaactggccttaaattgtcatattttctctccagttgccgctgttttcttgatattctgtccatttgtggcacagcttaatgcgattggtacccgcgttgattggacccgttggtcaatttaaaaaactttcctttaaaaatataataattgacacgcattaagcagtggaaatggcacagaaattagaacttggctttgccttgtcagactgatcaatcgaagcgatcgcttttttctttttctcacgcctacggcaaaaatctgcccgaggctaaaagctggctgtgttctctgccccatttatctatcttctctcgcccgttttttcaccactctctccgtttctccatttctctgcactccatcattgcctcattagaaaaaaagaagaagcattaagcgattgaacctgtcaaaagattcgcttatgttaggctgttgatcacccgcacatatgtaantataacaanataaa

SEQ ID NO: 15306 - DNA, 3169 bp, Heterodera glycines
attttaaataacttttaataattattaattttccccaaaattccacctccgatcaggcgaaaacaactcacaggcgaacattgatctgagggcagggacgtccagcacaaatatgaccgtggatgggcttgtgtcgggtgtgaacgacaagccgggcggcgcatcattctcattggcatcgggggatggtgggcattcttagcaaaaaattggcatttttatatggggaaatgaatctcattggcatcgggggatggtgggcattcttagcaaaaaattggcatttttatatggggaaatgaaaatggcattttcttttttaaattttattttcaaaccaattaatttgttgcaaatcgtgaaagttaaggaaattgaacttttttatttttattcaaataaaagccttaaattaaaaaaggaaagggaaattgttaggtgaaatctaaatttagcgacctttttgaaattttttgttgttactcatttttctttttgattatgcctaatttaaattctaatttactaaaggaatttggcaaaaacacattttctgttaaggcactttgatgaacaattcggcagcgatgtcctcggcactgttgggtgccgtgaacacgaccagcggcggcaccaaaatggtcggggcgtccaatttgggaagcagcggcacacagaacaaaggcggtgggttgggaaaagctaattgtgattagaaatgtgatcatgtgatctggggcatgagcctggtcccaagactcgagacaattgagtccaagagatttggccgcaacattttgatgtcgagagtttaccaaaatccaaatttcgctgcaaatttgctagtccctctaaaagcggactaagccactgatttgatgcactccaattaatttaagcaattaacacctttggaaatctgcaaatgaacggcaccgggccgagcaacggcggcttcttgtccaactcaagctttggccccgacggatcgtcaggcgccggtgtggcggtgtcgggcacgcagatgggcagcaacaaattcatcagcgtcagcgacggcataaattcgaatgatcggcagggatcatccggtatgtgttacgtatttaccgtaccatacttaatctcacagcgtccaatggttacggaaaattggagggcatcggcaatttggcggccaacggctcttcgtttgtgctgagcggataccaaacggacagaggcgcggcacaaattgtggagacggtgggcaaatcgattgccacgaacaacacggcagcagagttacgcattaaaaaccaaggcaccgaagtgatcaatggaacgatgggcacaaacagtgagtgatcagaaaaagtaaggacattggaaggacagtgccaaaaagcgattcggaaactaagggcatggaaagtaaaatgacgaaatatgatcagaaaaactaaaaaggaccaagaaaaaattccaaaatgaagaaaacaaagaaagtgccaaaggtaaggatattaaaaggaactgccgaattattgtttgttagccatcttcctattaaaagtttaagtaatgaattattcaaagtatttctgatcactaattaatcgattgtttctttttgtatttttcgtttgatcattttgccactcttttcttctccttaagcgaccagcaattcgtttggcaaatttctcggccaaagtggttccgtgcaaggcaattcaatgctcaattcgagccgtcccggcggacagaatgccaacgcgaacactgttgcccaagggggtggggcaggtaaaaacaaataccaaacggacgggggcaaacatcaaagaattttcattgaatttcattttatttctaattgtaaggcccatccagcgcaatgacggacacgggactgcttctgaacggcccaagaacagcgtaaaagtactgtagcagtatgaaaatacaggaaaaagggaaataatcaagaaaaatattgtagtcatcagagacaaaagtttgtcaattagtaattagtcgtaattttgcatcattcattatcagacatatgtaaggtcatgaatctggatttcagtactgagtcgggattttcgcattgactaaaaaatgctcaaggaaaaaatttgaaaaataattcaaaaatatgcaaaaaaaaaaaaaaaaatttcccctcctcaccttacaatttatttttaaggaaaacgccagcgggcaacaaacagatgccaaaatcccgattttgccaactgagttccaagcaggatttttcgggaatttcagaaccagaattttcgttataacattgtttgaaattatcggatttggcccatatatggcaagccctagcttatggaaaatggaaaccattccaaggggtccaatttcaagtcacgcttctttggcattaaattgttatcccatgaaaatcctgacagcatgttgcttttttcattctaatttgttcagcaacgaacatccgtggcaatgtgaacgccaccggtgatcagacgtatgtgcaaagtgtgtcaagtgtgtccgatcagaacagacaacaggcgctgttcaactctcagaatggtcagacagccgacaaaattaaataataaaaaaatgcaaattttaaataaaatgcataaaaatttagcaactgtcaaatcggccggggaaggcaaagcgacggcgagcaattcggcaatactcaaacggcgacggcgccacacgcgaaatttggccacattaagcgctgcggaggcgaaaaattggtggcaaaatgtggcgacatcggcacaatgggaaggaagtaagttaaaaacaccaattaattaataataaaaaattcttttggttttttccccaattttttaagaaaatttatatgagcaaaaaaggcgccgacgaagcgatggtcaaactttggcaaaaagaatggcccaaaaacaaaatttggtggaacggaaaaaagctggaaaaatgaatgatggcaactaattaatagaagtggaaattggcatgaaatatttaaaattaatttgtctgaataaaaaatgttttttatacaaatatcaattaaacgacataattaataagtgaaaagaaaacaataattgttgttgtttgatggctgtcatttaattgtaaactgatcattaagctgttaaagtggaaa

SEQ ID NO: 15307 - DNA, 2595 bp, Heterodera glycines
tttcttaaaccgccagggcgtttcttaaaaccgccaggtgggcgtttcttaaaaccgccaggtgggcgtttcttaaaaccgccactttgggcgtttcttaaaaccgccagggcgtttcttaaaaccgccaggtgggcgtttcttaaaaccgccactttgggcgtttcttaaaaccgccagggcgtttcttaaaaccgccagggcgtttcttaaaaccgccagggcgtttcttaaaaccgccagggcgtttcttaaaaccgccaactcatatgattatgtatataaatatatatatatatatattagaagtttacataacaataaaaaatttaaaatacatatgcatatctagtgacggtaaaataaaataattatttttatccttctttaaaacgttctccaaaaatatgaactgaccagcataatatattctaaaaaataaaatatttaagatatgagttggagaacagacttttgttagaaagcaattaggatattcattaatgcaattgcaaaatttaatatcacaatcgtaacgtttctgatatttatttatgtagcacacatcgtggttatagcaacaattatcaactgcaaaattttcgaatataaaattgctaattcgtaatttgttacttttttgaaagttgcaaaaccagattacaggagctattagacaagagtctaatagagaggtgccacaataagtcccacagaatttctttgcaactttcaaaagggaatgaatttttataaagattatcacagaaataaaacaaaataattaatttatctttgttggctgtttaatcagttcaaaatgtccatcattataatacaaaaatactgatgctgttgtttctttttgactcagattcgtaagctaaatttttaatatgaatttgtataatcaaaagagtctaaccgatgtttctaaatctggtgtatacacttgccaacggaaaattctttcctgtatacgttcgcaaactattatatttaattgaaacaatttgctggttgatgctaagtctaaattgttcatccatttctcagtttcgtgagctcctgctgctggtgaaactgatatctcgatgtgttttctaatattttcaatgctattaaatagcacttaaaattaataattaagcaacaccccaaaaaattaacacttacaccaccattcattttcattatgatttaaatgcgtgtgttggttaattgattcttccaaatactcaatcacatctcttcgaatttctgtgtgattccattcagatccagttagagctagagatatactacgccaaccacaatttccatcacctattattgtttctacttctcctggtccatattcagaagaaacgaaattaaactgagctggatattctatagtggctgcgccttaatttttagttatttgcgccattgtttgaaacaaattcatcaaagctaatacaattaataatatttatgaatgaaaagaatataaatgctaataacattggattaatttattaaaggaattaaggcaataatattttttataataaatgtatgttaaagaaatttagctatttataccatttaaattgtaataaaactgccagcctcatatttcctgctgacacctattggtacaaccaaataaaaattaagtaaataattgtgaattaatttaataaagatttttagtctgtcactgctagactaataatatttccggctgacacttacttgcacaacaaataaaaattaatagatattattgtatatttaatttaacggatatacatacataatcatatgagttggcggttttaagaaacgcccaatgtggcggttttaagaaacgcccaatgtggcggttttaagaaacgccctggcggttttaagaaacgcccaatgtggcggttttaagaaacgccctggcggttttaagaaacgcccaatgtggcggtttttaagaaacgacctagcaccataaattggtgcatgatggtgcatagaaaaagaagtatcgcgatgccgacgcacggattcttcgtctcgtccaacgctataacgatatcaataacaatattgtccctcaaaatgatcacaattatgccaatgccaatgtcaatcccgaaaaccttaacaattttctcgctggtattttccgaaattatgagatgcgacctagtttgtcccggattttgttattattataaagttatgaattttctacaaaattttatgaatgggaaacaaaaaatgataaattttggttttattagttcttaagtttttctatttgaatctgacgcttgtacaagaactcgtacgaaaatgtcccccgtacgaaaacggcggtacgaaaacgaccctgaccgaaagccagcaaatggtagtgccaaaaatgatcagtgcaatttttgtcttcattttggtccgtttgttcatctgctgctgtaattaataagttagcttgaaaaatgattaataattttgataaataaaattcacatttttaaatttatttggagaattcttcaaaaaaaattttcagtatgtttaaggaaataatctctaagaaagttagaaaagtta

SEQ ID NO: 15308 - DNA, 929 bp, Heterodera glycines
atccaaattaaaacaatccaatgtctttttaccctttcttctgaagtgcttgtacgtcctcaactcgcatgccaaaaatgaactgaaaaggaattatttccaagatatggcgatttccgtcttccctcaccatattttcggcacccatttcctccgccatttccacatttgctccgtccaaagtgccaattgtcaatgagccattgagcatgaatctggagttgcaatgtgcggcattgtgtgaaatggcatcaaaaactccaaggaaatatatttacttcatgttcccggttcccgatgcctctgtgcccgcggtggaaatctgttctgacaaatccgccgccggaatgattttttcggccattgaaacgcggtaattctccaaataaacgacctgagaacagaagggggtaaataataaatgaaaacacctggaaaaaagtataatcaacagaaaaggacgacacactttcaatttgtcgcccacaattgggtcattgttcacaacggaggcaacggaagtgatcagcttgatgatctgtttggccatgtgatagccgggggcagcctgaaatagcgagtgatcactgatcagattagtggatcaccaccagcacccattggcacctttcctccgaacatcactgtccgcggcaccactttcttcgccgggtccgccttgattcggttgtacagcgttatcacgtgcagtgcgttcaacagctgtcgcttgtactcgtgaatgcgcttcacatggacatcgtacatgcctaaaagcacacaacactttcgtcatggacatacccaaaaaacgaaggggaccgataagggactgaaactgttacccaatcagcaaatttcttaatacgtccaacccccgtgccatccccaacaacaattcatcccatggctccccccccccggcctcc

SEQ ID NO: 15309 - DNA, 1862 bp, Heterodera glycines
caaacagcactacgtccaataaatcgctgattgatcagataaattatttccaaatgacgcggcaaaaggtgttcgagcattgcgacgggccatcgctccaatgcttctgaaagaacggacatttttcagagggagaacaaaggcaaaaaagccaaatgatttggctaaatttgcccaccgggcaaaagtgtgtgattagtgtaggcgaaagtgcgcacgcaaatttcccatgccttgtcgaaactcagtccttcgacatcgacgagcagacggagcagttcggggattccgatagacggatgagtgtcgttcaattggatggccacctgagagcagggaaagaatggtaaatgatcaggaaaaagttgtaattagagttgaactggatccaggtctggattattctggaccttttttttgtccaggggaaactcatgtccatgtcaaataagaaaaaagtccatgtccaggctagtcacgaaaaactggatttccttgataatattttagagtttgtcatttcgaatacccatgttttactgccaattattaaaaaattattattagtttgctttttaaaacaaatttaaaaaaaacaagatacaggccatgataaaacacacttttgggcgtctgtccgtccaatatgaaattccctattgcctccccttttcctcttcctccatgcatttgcttactttgtccgggaaggtgtcaaagtcgacccgaactgggtcccggcttccgtaattgctggatttgaaacggcggatgatatcctggagagttgcggccaccaaaaagtattcctgcttcagacgcaattctttgccgacgaaaacgttgtcattggggtacaaaacgcgagtgatattctccgaaaggttgcggtccatcaccgcttggatgtaatcgccgtcattgactaaacggacaaaaaggcataaacaaaagagcactttaatagagagagggggggggggcaaatgggataaaatttgagaactataaaattgtatattttagagatttaaatgttccaaaattattaaatttccaatttgggctcacaaaatttcagggggaaatggttctccgccttggccgaccacaggcgcagtgtgttcaccacgttgttgcggaacccgggcaccggcgtgtcgtaaggcatcgcaaaaatcaaatgggtgtccctccaatggctctgaatgttttttttaatgtcccgcgtttcccggtgaccctccaaacaccttcccattgacgtccttttccacgcggccgtaaaggttcaccggaagcatatactcgggccgcgccttttcccacggattgccgaaacggagccaatcgtccggctcttcgatctgattgaaaggattttgcatcttcgagtagagaattttaagaggcgtaaaaataaatgcaaataatacaaagtttgcttttttggaatgtttctcggctctataataatacagctttaatgcaacataactttttttagaagcatcaaaattaaaaatcttagtcatttgatagccccttaagatctgtattagcctgcaatttcaaagaatttcgcatgtttcaaaaaatttatgagcaacataaaaaaaaatttttttgaacataaacttttgaattttgagtgaaattttttaaaccttcgtagactaatagaggactcttggggctatcgaatgatacaaaaaaatgtttactttcggtgcttctagaaaaagttatggtgctttaaagttgtcatattattttagtcgaggttatggtcgtgtgaactgcactagagccttgtcccccagaagccgcattttcacctgccatccgtcgcggatcagttg

SEQ ID NO: 15310 - DNA, 1669 bp, Heterodera glycines
ggaatgacagccggtaattcttcaattaggctcttttggccaagatattttgcgggcactttttaaaaaaccttttgggaacagaaaagcgtccgccgaaaggctcacaatcaatcagccggataatgaaattcagttagggttttttttatgaaaataagaagtttatagtctgtcgaaccaatataaatcacgcgggaaaattgctaatttaacgaatttcttagaaaatctgttctaaatttaactattttcccattcccccctttttcacgtgtgatttgttatccaaaaggacgagtgcttgaacccttttttatgcttacaatagtttttgtgttttttttctcgaaatttagaaaaaaggccgatgcattattattagtaattagtattaattgattgggttttcatttagtgatccacgaccatcaaagccaaacttacaaagaaccgtcaaataaaaaatgtaagcatttgttggtgaaaatgaaagaattaaccataaaaatttagcaaaagaaaagttaaacgcttcgattgcattgacaaaaatggaagccgaccaaattgggaaaagcatcggaagtgatcagtcgaacatccaactgataagacagaacgaaaaactgacacgtgaaaatgtgcagttgaagcagagaaatcaggtgggacaatttaggagattctaggagaattatttcattttaggggggggggattgaacggaataatttatttttcaaaaatcaggaacaacagcaacaaatccaagcactgatcggcgccaatcgggagctaatttgggcgttcaacgaaagtcgaagggaacacgacgaactgatgcagcaattacgggtcatggccaaattggtgaacaacggaagttcaacgcgtcccgcgggggtcgaaaacaccggcgaaacattgcaattcgaacagcaaaaaacgaagagtgttcgcccgaaacaaatcgccaaaaagaatgccaccactgcttctgctgctaacagtggcggaggagggggaggacgacagagaagtgggaaatcaatcaccacaattttgggaaggggggagacggagtttgaagcaaacaccaaagggatgggagtggacagaaccaaaaacgcgttaaatatgcccagatattttagggaatacggtatattatccgtgtcccgacatttacgcctatgttccaaaatcgggtgcaaacttaagcttttttgaatccctgatatcctaacaataagtagcattatataaatgatggaaagtgattgtatctgataatttgatagttagtaaatttttgaaaaagtcatcaagtattaaaacagcagaattaatgctcctattttcttaatttcaatgctctttaggctatcaaggcttgaaaaaattaaccctgaatccaattttagacataggcgcaaatgtctggacacggccaaggttaccccagaaattcgtggcctttttttggtgatagtcccccggggaaagcggcggagaacgcattcattatttgtattttcatagacttaatgttttttttagaaaagcaatgcacgggaatggtttacgttgcgcaagaacagctgccgccttcgctggccatccttaagaaaaagcccgacacttccgcaacctttcccatttctcc

SEQ ID NO: 15311 - DNA, 1588 bp, Heterodera glycines
cgacgcttgcctcctgactctgtatctatcaaccaaaaattaaaaattaggtgtaattttttccgtaaaaatataaatcaaagaaaaatgaaaaaaaatccatgaatttaaggattggcgttccgtcatcagcagcgttttgcgtaagcaatatgtgctccaactgttcgaggcgctttgccccgaattcaccggctcaaatgtggtggatttggcagtgaaaaatccaagccgtgccgacttcatccaaaagtcgctgaacttcgtcttcgatgccgaaaatgaacttttcggctcttccacttctcgcgactcttattttatggcaatcgctgagaaaatcttcacattgcgcgaggcgaaagaccgtcaaaatttggagaaaagttgccaaaatgggacgactgaacgaattggcgacgcggttcggaggaggacactggcggatgtgctgaagccgaaacacaccaaatcgagggacgaagacattttggacggggacgaaatttgaaggaggacagagtgatcatttgcttttggtattttgagaaaaattgcttaatttgtttgtccgataaaaatggacattgaaatggtatttgatgacaacacaacgatctcttaatttattgtaatggacattttaaccgagaaaataatttctttttcgccataaaatgtgtgtggaaaaagtaaatttgagaaggaatgaaaacagaaaatgtttgttttccgccggtggttcctttccttccgccattttccaccggtttccatccatccgtccgtttctcctcactttccgaaccgcgcaattgcggaccgatccaacggcgccctcttgccgaatctgtcgaatttggggtttcaaatcaacaaaaattggatgccattgctcaccgtgccaacgcggaacggtcgagcggtgcgcgcttaccaaatctgtgggggatacggtggggaattgactgcgttgcgttgccttcctactgtacctggccattgcggaacggtcgagcggcgcgcgttttgcaagactgaaatggggaggacattaattggagaacaattaatgagggtggaggggactgacctttcgaagggatagtcgcccaccctaccgtaatcctccaaaaggccttccatttggggccttaaaaagcgaattttcaaatgggcaaatggcactttcttttcttttttttacccttcggctaacattccgccgccgtattgaaactgcgcattcgttttgctgttcaaaatgacgaaacccaacaaaagggaggcgaggagaatgttggcgacggggaattgggccatttgagaagggaaaggacgaattggagaagaatgaacgaatgggaggaggaggtatctaaaagaagcatttgcaataaaccgaaaaagtgccgttttgggaaaccaatcgcaaaatgcaaaggcaaatttataggggggggggcgggaattggcaccacagggaggggcaaaatcaaattgaattatgaggaaatgccaattggcaattcgttagaaaccaagggggagtggggaaaatggccaattaattcgattaaattaaaca

SEQ ID NO: 15312 - DNA, 1643 bp, Heterodera glycines
ttatttttttttttgcaaaattattcataagtatttttcagaaaatgctttggaaccccaccaaattttaattaaaagttaaataaggctctctgatgctttttctatcaaaagggagatgaataaatatttttaaaaatttttaattcctttttaaacaggccaaaaagtttaggcttatattttaaaagtctcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattca

SEQ ID NO: 15313 - DNA, 1145 bp, Heterodera glycines
agtgatcagtgtggtcgatcagtttttgggtgggctgttggttgggtggcgagtaaacgaatgaatgaatgaagcaaacgatcagtgaagagggaggaaaagctaatcaaatcaaatcaaattgggcggaaagaaaggaaagggcagagaaaagggggggggtggaattaatttgcgcaaaagaaggaagcgggagcaaagcggagaaaggagggggaaaagcgggaaaaaagggtaagggaggaaaagaagaggaggaaaagaggaggagaaggagggaaagagggggaagaggaaaaagaggaaggaaaagaggaggaagaggaaggagggaaacgaaggaagtaagtggacaccggggatggggaagagcaaaggaagcgaacgaaggaaagaaagatgggaggaagaaagtgatgaagaaaaaagtggaaataagcacaaaagagagatttttggtggctggtggaagagcgaattaattgatttggtagcgggacaattgaaaatgaggggacggaaagaagggaaggacattccggtcttcggacaaaagaggaaaaagagaaggggggagggagggaaaaaagcatagggactgactgatcatgatcagattataggaattggaagaaggagaatttgcagagagaatgggaagaggaagagagaagaggcaaaagaatgtgagaaaatgggaaacataggaagaaaaggaaaagggagagagcgaaggaagtcgcgatgagaatttgataaaatttgaaaatcaaatgaagcagggaagtgaagaccatcatcggaatgtcaccatcacatggcaatgaagaagggaaaacatctgcgagaagcaaaaggaaggggaggggagaggaagaggaagaggaagaataagaggaagagcaagaggaagaagaaaatagaaggaataggaagagaaaatgcgggggaataggagaggaagaggaaaaagcggaggaaaaatgtatgaagaaagagaggaagagaataaggaagagatagaggaagaaaagagaaggaatagcatgaggaagaggaagagaaaaaggcgtgggaagaggtaggaaaaggaagaaaggaggtaggacgaatgagagaagcgaaggataaacgaactccgctga

SEQ ID NO: 15314 - DNA, 2697 bp, Heterodera glycines
ccatttccctctcctccccccccccccccattttcccccctttatgcctctttttttccctcctttctttcattttttccttttctaattattggtccgacttcctcacacacatcatacacatttctttcattcatccatctgtgattgttttttgtcaatatttgcttatttggcctttttctgtggatcgatggggggggggggcgggggctctgcaactgaaagatccaaccgcagcagagggcctgggccggacattcatccaccaaacgccaaattgcctcacgcgcctccatcccttctcagaccgaccattctcccaccttcccatgattaacataacatcttaatcatcattcactcgacaattaattaattaattaattaatattcgccttcgggaaattcgtccggccgttggcccaatggccaatttgactaatatcctctcttcatccttccttttcttcttcttccttcttctcctcttcctcctatgcctttccggatcgtcgttgtactacctcctccccccccccaaactttttccttcccaccccaatttagcccaacttccctcctcccagccgcgctggcaatgcccaaacaatggcacttatttcgatgccactccctgtgatccaaatgccgctttttcctgtccggcgctgtacaaatgccgaatggcagtggaaagagatggtgaagagagtaaagctgaggaaatgaaggccgggaagagagtccaatggatttgctgcgaaagtgctgggatgggaatcagagagtgtgcgtttgacggagggcggacggggggtggagggcaatccgaatcgaactgtttttgagtcgcgacagatctttcgaaacaattcttcccctctcacaacgtttacatattttagggcttttggagttgggcctagcgccggcggtgtttccaaaagtgcccgattcgacgttacggcgcgtctttctaagggacgaacaaagcggcaaagtgatcgccgtggacggcaacggggcggacatttcactactgccttttgacagctccgaatcggccaattacagccgattggagggcatcgaatttggcgaaggggtgccgaagaacgggggcttccttcactttttggtggccataagtgagcacctccaccgccatcccaacaaatgctaaacaaacaataagacagatcagctctcttccccgtcggcactccaactctatttcgactattcctcctttggcatcgctcaaatcgacttggaagcgtaaaacggtcgcttcccacgcggttttgccgaggccattggcagtgactttgtgccggcggatttggcatgtcagtggcagcaaaaagcgtccttttcgctcagttactctcccattcaaaagatcgccgccaaaatgttttggccgttttccacactgacgtgccaatggccaatctttcgcaagaaatcgatcgccaaatggcggacagtgatggcaaattgcaaaaggcaatgtttggcagcaacggcggaatggccaaattgttgggtgccacgccaatcgccggattcatttacacggtgagaagggaaaggcaaaaacggcgaattgcccccggcagattaccacgcgggccagcattttcccactgacatacgaccagcgatggaggaaagccgagcaaagcgaagtccaagcgccacagaaagcagaagaaacggcacaaggcacaaaaaacggaacggagaaaagtgccaaatgggagacgatgggccaattggagtataatgccggagggattggcacagtcgcaacagaaaacaatgagacaaaagtggtggcatcagccgacactcaaagggggacacccctcagggcaattagcatgataatgccagcaattgttgccattttgaatcatctgcataggacgttaccaaacatgaaggatttatagcaaagaagtgcgaaaccaataacatttcaaatttattaaatcattttcatcgaaaacaattagaaaacatgcataattgcttagaaaaacttacaattaacggagcgacaatattagtttaggtccaaataataaaaaagaattggaaaatgagaagcaaaaaggatatgaaaaatgattaaaaatagaattcatcttcgtcctcctcctcttccgggtattttctggcctccttcttctctgccgcctgttctgtctcttcctcctcttcatcgccctcccgttcctcctcttcgtcttcttccccctcgcctatcatttcctctgcttcttcttcgtcgttggcggtcgactgaatatttgagcatttatcagtgatagttttctcttcccttcccgccctcttcttccttttccctatgtttcttctccccttcccccaatgtctgtccacctgctgttccgtttcctcctcttcttcctcctcctccttctccacgtcttcttcttccttttcttcttcgtcttccccatcctcctctccgtcttcttcttcgtcctcattcgcgttgtctttgtccatcgccgcttcttcgccgtcctcctcgtgctcgccctcctccacttcctcgtctttgtcacagaccaacacttggtcgctcagattcagactgtctctcagtttttctatgtcctaaaagaatggacaaggttttattactaccttaattttccc

SEQ ID NO: 15315 - DNA, 4290 bp, Heterodera glycines
tctgaaaagccaaaaccaccgtctgtgatacttgaaaagacggaagttttagagccaaggtctgaaaatatactttcagcaaaagtcgaatgttttccaatggaacaaaattttttggtgaaaggaattaagcttaaatatcccggaataatcgttggacgaactttggtttcaccaggaaatagtaagaatgtaacaatacaaattttgaatgcgggaaattcagcggttaaattatatggtcagtcacatttggcagatttggaatcagttcaaattaatgcattaccaggagacgaaatcccagcaaaagattacattcctccagagacacgatggagcgaaaatttaccaaaattaccggaaaacggactaaataggctaccatcaaaaagaatcaattttgagggtaaaaaattaagtaaaaatgtgcaaaatgatttaaagaaaattgtggatgagtgttcagaagcttttgtaggggatgatggaaaaattggcaaatataatggaccgattgtgcataaaattgacctaatttctggttcgctaccatttcattgtcgaccatatcggtacccaccggagactcagaaagaaatcgaaaggcaaatcaaaatgatgctggaccagaatataataagggaatcggaatctgagtttgctagccctatagtgatggtccctaaggctgataaaaagtcgtggcgttttgcgattgactacagagcactgaataaaatgacaaaaaagagagtatttcacttgccaaacattcaagagttgttagatctaatgggggcaaagaaattttacacgtgcatggatttacagcaaggatttatgcaaattccggttgccgaggaagaccttgaaaagacggcattcatttcaaacttaggcatttttgaatttataacgatgccttttgggctaacagcggccccggacacgtttcagagagtcatgaactcgttgagacgacggttaacggcggcgatgttaatttatttggacgatataataattggcagcgaaactgagaaaagtcatttaacggatattaagaattttcttttattactaaaaaaggttggacttaaattaaaattggaaaaatgccattggggaatgtccgagatacggtaccttggctttttgctaagtgaaaaaggtgttagaattgacccaaagcaggtcgaagcggtacaaaattttaaggcaccaaaaagcctaacagaattaaagtcattgttaggagcactaacatattttcggcgctttatacacaattttgcgcatattgctcgaccattacagacattgactcaagataaatttgaagggaaaattgaagaaaattgggcccaaagcaggaacatgcatttcaaactctaaaacaaatgctcacgacagtaccagtattacagtccccatgattcgggagagcattcacaattgagtgtgatgcttcgaaaaaggctattggagcagttctccttcaggaaaatggtcctgttgcttacatttcaagagcattaaatcggcacgaaacaaattacccttcaattgaaagggaggcgttggcattagtttatgcagttaaggaattctcgccatatatcgttgggtctggggttacaaaagtaataacggattgtagtgccttaacaggcatgatgaaagcgaaggagctaaaagggagacttgagaaatatcaagtaactctccaaagtttcgaattagaaattatttatcggcctggaaaaaagaataaagtggcagattttttgtctcgatataatataccgggaaatgaaaaggatcctgaaccaaaacaggaagaaaattcagatgagtttgaccttcagccaaaaattttaagtgcaaaaaatattaatgaaaatttaattgccgaaaatgatggaattttgaatgaaaatccgaaaataaccttaaaaacagtaattgaggcacaaacaaaggtaaaggaattggccaaaattttctatattttaaaaaccgggaagtgtccaaatgatgttctgaaatggaaaagagttgtttctgattattgcctaataaatggggccatttactttataaaaggtaaagaaaatatggaaagacctaaattaataatccctcattcattacgacaaaaacttttcattattttctattcagaaggccattttggagtcgaaaagacttggcacgaaattaaagagcgattttattgggtcggaatgaaagaagacgtaaaaatgctaatcgaggcatgtgaaaagtgccaaatgaggaaaattcagccagggcaggccaaatcggctccgagtgtccctatcgaaccatcaaatggcccatttcaaagaattcattgcgacttaatgggtcctttaaagagaaccgaaagagggaatttgtatattttcttggccattgatagtttttcaaaatgggtcatggccaaagcaatcccggatcagaaagctaatactgtatcagaaaattttgttgaaatggtggtccatcaacattcaactcctgagattgttgtgactgatcagggaagacagttcacttctggaatttttaatgacttggccaaaatatacggttttgagcatgtcactacaacaccatatcatcagcagtctaatggaatggctgaaggggctatgcgaatcatggctaatattatttctcaaatggtcaatgaaaaagggaataattgggatgaaattctgccgcacgctattttttcatacaatgtttcaatacattcagctaccaaattttcgccattttttatcattaatttacgacagccaaaattgccaactgatcggttacttaaactcccatcccccgatgagcttgtgtccgatatttcggtctatacaagaattcagactgaaaaagcagctaaagcgtgggaaattgtgcgaagtgaaattctaaaagcgcaggaaaggaacaaaaaagagaatgatcgcataaggaaagcgaatgaaagagaatttgaaatcggtgatttgtgttgtttaaaaaagaagttttgggccataaatttgatcagcgttggctgggaccaatgcgttgtgtgggggttgaaaaagaaaagaaaaatgttgttttacagtcaattgatggaagagctaaattaagaaaagtacatcaagaaaaagtgaaacattttaatggaccagcaattcttcctctaaggcagtcagacaaaccattaaattgggaaaagtacgtagatgatccgaatttagaacaggaagaaattgaaggtgaaagttgcgaaagtgactgtgaggaaacgcaagacaatgaaaatacgcagtcaaaaaacaaaatgggattaaaagtttcaaaatatggctttgagagttctgacgatgagaatgattggaatattgttgcgtttgtaagagaaaaccaaaattctgaggatgatgaaggcccggaagttataatggacagaaaccccgaaatcgaaataatgccaattttcacaatactcgaagtccttattgagggttcatttactgaagtatacaccggatggagagaccccgtaacaatctcattaatctcaagcatacctgaaaacctagtaagggaaaattgggaaatttatgttaatggaaatggctcaagatttgttatggcatggatttttggcgaaagttttgaaattttcattgtcaacgaatttgatcaaattatgttgggaattgatgcgcaaatgttgttgggtgaaagatggcgaataaaaactgaaaatgaaattgagacatattgggaaatctacttcgatgaaaatgggcacgaatttgaaattcccagaattcctgaaatccttttttcagaaaaggaaaatttggaaattgggtatgggtcaaactttgcaactctccgaaattcagaagaaatgttaagtgaacagaatgatttagaggaaggaaatgatttttcaagaacagacattaatgtgataaattatgtaaaaccgtttaaaagtttattggatttttcaaacgaaattgatgaagatgaaggaaatgaagaattagtggaaaatgccggagaaagggagagaaatatgaataattctctagaaattttagggagaatggaaaacgaacagttgaatgaaaaagggcggctaaataaatcggataaaaatcaaaataaaaaatatgcgagccattcgtttttcaaggaattggaccgaatgacatcaccggctccattacacttcgaatccttgactgatga

SEQ ID NO: 15316 - DNA, 2398 bp, Heterodera glycines
ttcaaattggggtgtcacttgataaagagtcaatgcgcccttgcccagtttgagcttgaacgaatggagccattgatgccgaaaatggttgatccaattttcggctttttgtcatcggcgttgtggtcaaattgtcctgctccaggtcacagaaaacagcaacttcggactcttcttgtcttgtgtcaatattggaagacggagacgtccctactgcggaagaagtcaatgtttttcgaaccaaattcttacacacattttgtcagaggttctgccggtgtattgttcaaattgtcatgatccaggtcacagaaaaccgcagtttcggactcttcttgtcttgtgtcaatattggaagacgaagacgcccctgcttcggaagaggtcaatgtgttccgaagacgagaattggcttcgcgtttttgtttacgctcttgccgagtcgttaaagatctctttctaggcataaaaatggtaataactttaatctgaaaaaagaaattatagttaaaagctattttgtgtttgccaaaataataatataaatttttcggattaaaaatggtcttatcgtcagtttaggaaaatttatactgtgaatcagcaaatgaataatgaaaacactaaggaaaagtgaagaaggagagattgattttaagctggtaaaagatacgaggtcaaagatcatagttagtaggaggaacacataacgtaaaacaaaagagaaaataaaaaacaatcaattttttaaccacctgactaccgggtcgcttgcctcctgctcatttaattcccttttccctttcattcttttttggaaaaaacccgaccaaaagtgcatattttatttttttataaaatagttagatatgtaaaaaatatattttattttaaaaaattaattaattaaaaaacataaaaatagattaaacaaattaaaaatagaataggtaaacaaaaaaatgtaatatataaaaaacacagaattaatgggagtcgaaccctcagccatcgcagcacaaaagtcaggcacactaaccacttgaccaccgagtcacttgccccattgccatttaattcccttttccttttccttcttttttggaagaaatcccgaccaaaagtgcttgagctccttttttagggcacttcccggacccggaccaaaacaaccctggtatcattcgaaagccaagagtttgtagatgtgcacaaacatatttgttttttgatttgaccacttttaaggcatgcaaaaagcgttcaaaaatgggacattcaataaagtgtgattttttgacttgtttttcgaatgcagttcgaacagttctaaaccgatcgaaaccgcactatttttcccttatagcccttaaaaaactacgtcgatagaccccacgatcgacctgtaaaactcgctagaaagtcttaaattagtttttatgcttggatcatgggtataaatttcttatatagggaatatgtaaaaacaattttagctgtcttctccagtcaattatcactggtaaaattaccatcgaaaagaagttgaggaattcatgaacatcattagatatgacgttctgcaactggtaattaatgaactttatataattaatcatttttcaacaaaaaatattcaaaaagcaaattttgtgtatcggaattctgttttttttaaattttaaattaaatagaataacaataaattcgaaagttagatcggtaatattttatgaacaaatttttcagttgactttcggttccatttgcgccaacatcacatttgaaggtgaaaaagcaagaatggagtggtatttggggcgtctttccaaaaatgctcaaatgatactcgacaacgtggagccttccttatgtgtcaggcgaacttgtaagatgattcttttacattaatttaaaagtagtgacaaatttgtagtgacctttatttctacttaaacaatttatcactttttaaaaaattttatatttcctaaaaacctagatcagccctattatggcacctttaaccaattaataaaagcatttacaggtataaagctttcagatttttgaaattactattttttaaattctaaagaaaaaattaattgcttcttggtatcggagaatgccggattaatagggcttaaaaataaatgcatataaaaacctctaaaaattattttaggaaaaactttgtaaaacatgaaacttttcatttttcccttttacatacattcatttatagtatgaagtaaatgtttaccattttttaaattccatagaaacttttttgtgaatttttattgaatttgttgtttaattttaagctaaaatcattccccaaaattgaaaccgcgatggctaaggaagtttttgatgatatgtcgtttactca

SEQ ID NO: 15317 - DNA, 1733 bp, Heterodera glycines
  misc_feature (1587)..(1587): n is a, c, g, or t
  misc_feature (1651)..(1651): n is a, c, g, or t
ttccatttccccctctccccctattgccccgggacgaatcggttcacccttccccagctaatcacacatattacacattatatattgtattgatcacccttccgaataaaggatattattccatcccactcgtgtaattatggggaggggctaagcaacgaatgccaaagggcatccgagatattcatggaggtcccgccacggggcaaaaatggggaagaatttaaatagaactaattatttaatgcctttattaaagaattagaaaataagcaatgcgatttatgattaaatgaatattatttaaggggatattttaaagccaattgagaaaattgaattaaaaaaagagagagaggaaaatgtgatcggaatgtgaataaaaaaattaacaagtgaaggcttgagaagtggcgaatgaattggcacaaattgctgcctcagacagaagtggccatcaaatggggcttaaaaactttttggaggtgctgcaaaatttgattgaacttacaaccgaaattgagttcgaagagcgcaaagccgccctatcacgggctcctttccgagccgatgtggtgatgccaaccgggttatggcgagactaataaaatataatattgtaaggaagaagctggctgggcggttaaaacgcggaaagcgggggttaataagatccataaaagaaagggcggatgtgcctcggtagcttaatggtagagctgcccacggaaagggtgcatgagtgggttcgattcccacccgaggtttaacattttgcccatttcttattggtagcaccggatggttgccccaccgcgccagcagcaattaactaatggaccgagggaccggtcccgatgaggatggagctgtaaggaagaagctggctgggcggttaaaacgcggaaagcgggggttgataagatccataaaagaaagggcagatgtgcctcggtagcttaatggtagagctgcccacggaaagggtgcatgagtgggttcgattcccacccgaggtttaacattttgcccatttcttattatatagaccttttggctacgccgcccggctttgctggcccggtcaatctgagcggtttccagctggacgttgagcgcattttcgatgacgagcgggcggaggacgaaagcagtgacgacgacggcggtgccgacgcggttgcacgcaccgttggcggtgcccacattggcacagaaatagggacggcacaacagcaacaattgttggatgtgggcgccatgcttgacgaggcggcggcggcacaaattggcgggctaggcgacaacaatggcagagcggacgctaccgccgccactgttcggcatcaaaaagtggccgtaatcgccgccgagaagggacaccaaaacaggaggcatcctgaacggactgatgctgtcggtgttgacaacgaggaggaggaggtaaatgcacttcatttcccctcgcgtcttttcccccgaaaatttaaaaaaaataaaatttttgataaccaatggaaatttttataagaaaattacaacaacaaaaaaattacatcaatgcccgtaatccaaaaatggtttggnggagggatgaaaaaaaattggaattctcaaatttacggcttaattgtcaaaaagttcaaataanatttcgaagaaatttcccagatccttttcacattttcatccatttcacagcagataatcgcggatgatgccgctgctctgcg

SEQ ID NO: 15318 - DNA, 1399 bp, Heterodera glycines
ttttgaataacataaaacacaacaaatatataaagagatcaataagacacctgaaaaacttcatcaaatggaaggattatatactttatttcccatttaaaaaacatagaaaagcaataatgttaatttggaaatgtttgattgccgaatgatgctcatcattaattaattaattgatccgactctctctctctgtgccaatgttgtcatatgttccgacttttcaaagctcatccgcgctcggtttgatcagtttgtgcagctcaatgtcaaagtagagagtggcgccgccggggatattgtcacggcccttgtcgccatagcctaattatgataaataggatgaattcaatttaaaaacaaatgaaaaagcataagtaaacagcatgattaatatttatcaagggggtggatgacaatttgaattttttcattgaatttatattactttttaatagatttaagtcgaaaatttaaaaatttcacgagcaaactttaaatttcgattattttaattaacgaaataaatattagtgggtgggggtatccatccgaccattagtctcgaccaatcgtatcaagcaataactaattgacaaataattcccacccaatgcggccgggatcacaacgcgacgacgttcgccctcgcacattgaggtcatggcacggtccattccggcgatcacttcgccgtggtggagacggaaaatgaacggcttaaatggggatgggatgagtgagggtaattaaatgaacaattttggctcaattaaaaaaataattaagttttgggccagagaatgtaattttttggcattgcgattcgtttagtgtgtattaaaagtcaaacaaaaattttaaccaaatggcaaatttgaaaaaaaagcttggaaaagtttgggccggtaagttggaacaaataacggatgaaattaggttgtttcccgaccttcggtaaaagaaatgttgtggaccgggcacaaatgcccgacaaatttttcaaaaatgacgtggatgaaatttgttgcaagaaagaaaaaagcaacagaaatattttcaccgaatttatttcccgtcacccgccctgcctttcccaccgtatattttccccctgaaaataaaaaaactttcaattaaaaatttttcaaaaaatcgttgaaaattttttatgagaaatcaagaagaaaaaaattgaaaattttcagcatctttttgaaaaatttatttattttttttgaaaatttcatattcattcaaattttggaaaaaatcgctagaaaatttttcaatttatttttaaattttttcgggggcggggggggggggggggcgagctgctcccgtgctatggtctcttcttcatactttgctgcgtgaagaagacgagtcgatgaat

SEQ ID NO: 15319 - DNA, 2729 bp, Heterodera glycines
  misc_feature (107)..(107): n is a, c, g, or t
  misc_feature (136)..(136): n is a, c, g, or t
  misc_feature (275)..(275): n is a, c, g, or t
ttttttaatgaattgattgatttcgtttacccggctgtcaatcgcataattaaagcaaactagggagggctactgtaattatgtatatgtggtacggtttttgattntcgctcggtaattataacttacgggacanttgattcgcccagcagctttatttaatttaacagagactattgaatgtgtggctttatcacaatttgtttatggcctttagaaatttggttatttgtttgtttgtttttttgaaaataaacacaaaaaccataggggtntgtttatctttgaaagtcattccgaaaattttttggacccaaactttcttgtcttattgttagaaaaactactgttttttaggactaaatttatggaattttccaccaatcctaattaaaatccgtattggatgttacttagtttttagagctgacctataagttatttgactttccttttcattgttgagaaaatttcgacccaatggttgatttccaatttttccaaccctgataaataacgatttgaaatctcaaaagtttttgccattccgaggctccttcaaatgtgccaacccaaccacctcaatttcgaggccgtcctcctcacgccatcgtgggccgggcgtcggacgaaacaggtcgacaagttgtacaatgtaatgcagcacctggtccgacttgatgccatccctttttgaaaaaaaaatattttcaaatttaatttttaattaattttttttaaatttgttattttcaaatttaatttttaattaactttttttaaaatttgttttacctctttcgcccaccgtcgccgaagcccaactttccaggaatggtcacacggcgtttttctccaatgcacatgccggtcattgctctgcaaatacgaaatttaaaataaatgtaatatttaaatttttatttcaaaatatttttccaaaatattgaaattcgaattaatttataatgtctagtttgatcaaaacaatggcatttccgggtcaaaacaatggcaccttcggatcaatgttaacgattaattatcccaaaaatatgcattttattagcctcccaggaaaaagtcataaattttcaattggcaccacctgtccatgccttcgatgacctggtgcatgccgagcgtgaacgagtacctgttcaaaaaatggtaaatcattatcccatggaatgagaaaaaaatagagtgaaaaccctctgagggtgtactgtagcggttcctacggtttttcgccgaaatttgatccaatttctttgccctccggatcagtcagtttgtagtactgcttgaccgtgtcgcccggccgactcttcagagcgcacttctcctgcgcaattggccgaatgattttcacctcaaggccatcgtcgtccttaaaaatgttgcacagttttctgtatatatttaaataaggacaagattgcgcttttcccgaacgacaattgtactgtaatcctggcccaatttaaaaattcatggggacttagtctgcgcttcagccctgatcactttaattatgaaaatgaccgcaactgggaaacacggaggagcaatgtttagtcccgattcaattaacaaggaagtttcgtaaatgggaagattttgggtcctttttgttccgatcgaaccagcagcacttaatgaatgaatgcacttgccttccaggacagtttttgtccttgaaaatctttgctgctgctgtttttgtctgcatccgctgctgaagaagcactgtctgtcgcagaataaacaacactggccgtgcaaccgatcagaaacaagcataaccgaatcatttttgtttatctgcttgcttaacttagaaaagaaaaaataattaaaattttcaattaaaaattttttatcatcaaatttaaaataacctataaacatgcgcaaaatgaatgatttttttatgtaaaagttaatagccgaaaaccgaaaatcatgcaattttttaaggagttgcttaattgcaccttaattatatgtatccttgaatgttaggggcataaatgccgatgaggtcgaggacagaacccgggcatggctgaaaaaatgtccgggacaaaatttttcaacataaaatttataaaaaaaggtgaaggaggacttctcggccccatttgctgtgcaacgtaccaattagttattcccccgattcctctaatttaattatagcaataattattaaataaattgggaatcatttatttatgaatggagagagatgcccaaaatggcagtgtgtttaaggggggacagcagcagaaggacacgtctccttcttcttcaccaattttgcgctgggggagatttgtgtgtcgtgtacaaccaccacaaccgccgcagggcagcagcagcgcaaaagtgacgctaattaaatgccctgcgccacgtcaccggaggaagagaggcgatcgatcacctccattctgcccatcccccatccccccagcctaaacagagagactgatcactgatcagcggaggagggaagctgagtgatcactctctctctgctgatcagcccccagtgggacagggcagcagttcggcggggtggaaagtgttgtgtcgtcgctagagaggacggatttctgccgctaattgtcgtccgtctctccgcttgccgccggcgtcttcgtccgttccttcttccacctcacaccccctgttcctccaatgatgaatgaatgggaatatgt

SEQ ID NO: 15320 - DNA, 2987 bp, Heterodera glycines
cgggaacgggaaaactaaaatgaacggtgcgggattcccgacgtgattcccgtctttttcccgttcccgtaaaaatcccgtcaattttaacgggaatcccgccgcgaacgggaaaacattttttcgaaaaaatattgatttttttctaaaatttaatttacttatatttttaagtgaaaatattattttaaataattaaaaaaatttaattttatgtaaatgattaaatattgtatttattaaagaacaaaaacttaataaaatttattttattcccgtttttgtgaaaaaatttacgggaacggggttcccgtcttttcccgcgggaatcccattcccgccggtctctacttaaaataattaatttaaggccatcgacgacattagcatttccccgaaccctatcgggaaggaaattttcataaaaaaaactaaaaaaaatggaacttatcaacaaaaagaaaaagaagtcagaaattaatttaaagactatcgacggcatttgcaattcccagaatcggttcggggagaaaatttttatcaaaaaacttgagaaaaaagataatagaaatttttaaattaataaaaattcttatcaactcatttacccacttgttaaaaaattttaaaaatattttatctaaatatctatcaaatttttgatgaattcaccttgaaaatgtgttgatgaatgaatgcctgatttttattgtttttttcgccttttttattcatatttcgtgggtcagtccttcgcatttcattttggtgttctcttattttaaaagaatgcccgtggaatttcttttcgctaaatttcagacgtgcagttggttcaaattttacataaattttcttaacactcgcttctttggcatccagcctgttcgtggcaaacgaataagcatttgcattagctaaatttattttgaaatatgcactgcataattaaaagaaaagattttaaataaattgaaagttagggcaaaaactgattgcagaaaattgaactttccatcatacaagatctgctgagccagttaagtcatggtatcgggtagagcccggaaatttcaaatttgcggtaaatttcaaaaaatttccaaaacaataaataagtgttcaaatatatttttaagccaaaaactgatgaaaattaatatgagaaattgacatcaggaatagaattatgcaaaaatatcaacatttcagccgtctctggggaaatgcttgaccgacggtagtcatatatgtatcttgccacactaaaaagctgttcactggaaatgcttgtgcatgggggtgacaaataacgacgcgcaatcattgaaagtttaggaaatttttttcattgttgttccaccactgcaacggatcaaccaacacccatgaaaacacaaatgtcgtctttgtatgtgagaatttcttccgacatgcccatattttgaacgtgaaacgcgcgcaaaaaatatgtcgctttcagaggaaaaacgatccttgatgcgagggtcgagaaaagtgctcaacatacaaagtctaaatgttttatttataaaacttactagtattttaagtaggtatatacctattttctttttgtaaaaaacgctttttaaccgcctcaatcagcctggtacgcatttccctcacttcgtttagtattttcatttcgccatcaattgtcacagaaagatcacctcgttcccaagtggagaccaaagtgcgagtgagcggaatcgggcggagagtgtttttttacaataatataaagagacttcttcggtgggtttagaagttcctgaaaattttaaaacataaaaatatatattgaagaccaaattgccttaattaatttgagaatggaacattcttcttgactttcggtagttagcaacctgaagcaatttagctttcggtaacccaagttcgtcttgaacaagtcatccatcaattttgccgaatgttttaaagttccaacaatttttcgacatttttcgaaaatttgagccatttcgtctttttcttttgaaaagctgtcctttacacataaattgaggtcatgagcggcacagctgattcgttcaatgtgaattaaatccaatgcctctaaaaaatgctatttgaaatgaaatgttgcataaactaaccttaactaaatttgctgccgaatcagttacaaaacaatagcattcttttacattccaactttcgagaagagcttttaaaatttcagagatgcgttccgaagtgtgggccccatgaaatttttgaattgcgagtgtaaattttttgcgcgaaaattttgagttgacaccaacaacagtcaagctaaatttttgaatatttaatttgtactaaacaaataaaaaccttataaaggcatcttttgttgtatccgaagtccaaatgtcagaggtacaacaaatttgctcaaacttcgcaatttctcccttgatctggtgtttgacaactttgtaaacttaggcagaacattttttcggtaatggctttcgtcgcgtaaattttccgaaggatttcggagcatttttttgaaagttttgtggttgattatttggaacggcaaattgcaacaagcaataaaattgataatgtccttgtccatcacacataatctgactaaaatggtaattaattaaaatcacaattttattcttgtacccgaactccgtgttgtataatcagtgatttttggatcatccttctttgacttgccttcatccagctttaaatatttttctgcatacggcgtgtctttgtgcttggcaaacagatggatcttgagccctttgagactccgattcgacaatttaagagcaaaattactcacgtttttttgcttacactccaagcactcgaccgaatcttctttaattcgtttaaaaagatagatttgccaaattggctgggctgataataataacttaaattaaagtaaaaataatttttatttaaattactttgcaaaa

SEQ ID NO: 15321 - DNA, 1528 bp, Heterodera glycines
  misc_feature (1465)..(1465): n is a, c, g, or t
aattgtaaatgatttatttgtcgatatatgcatctatcatttatgataaagttataaaaaagtgtaatgcaatgttttcctatcacttcctccggtcatttctctaattattccacttctgatcactctctccgatcactgcccttccgattgcttctcttttggtcactctctccgatcacttttctgatcactcccactgtcccctccaattgctctgtccttttttctgatcactgctcttttcttcccgtccgttacattacacaacagcacttccttttgtgcaccgccacttcaccgccctccgtcgatgacggtgccatcggtggcacttccgccgttccatttgccttttcccccgtggcactgttcccggccaaaactgcacccgctgctggcgcatcgtcgagcaacgcattttcactccgttgagcgacagagggacgacgattgaaattaacacggaccttaaaaataaatgatgacaaattaaggaaattaatgagacaaaaagataatcagcaaaaattaatttacattaaagaaaggaaagaaaatgagacagcacaaagaaataaataatgtgacttacaatcagttaattaacgagaccaaaacaattgccatttttattaaccaaattaattgatttatttttaagtaaattttgaaggataaaaggctttttttcttttaccataattggcacttttttgattttatccttttccctatcaatttctttgtcatcattaggaaatgccgcgcggcattattctatcagatgtagaaaactccaatttcactaactttgtcggtaaattcgcttttgccctcccaccgacctgctccaaaagcacttccacgtcgggccaatcgctcgaatcggtgcacaaatacgaatagagaatgtgcccgtgccgattgatcaatacgcatccgctgtgttcgccgatcgcttttttctccgccgtcggcgtttctccggcggcattcgccggagactgtttattattattgctatttgtgctgttactgttgttgttgttagccagttccaaagtgtaatcattgcacagaaattccgtgtactaaaatgcaatttaataattaaatttattttattattttattcttttttggcatttttatttgatatcctctccgaattttgtcaaattatcttttttagtctcagcggaataattgtgccattctctgctggacaatttatgaccaatgcccgacagatttatgggcaaaactttgcccacccatccccagcagaaattggacgtaaaaaaggcactcataagccattggtcggtccattggtggcatcttcaaatgccatcagaaaaataagcgcagcggtgctgagacaaagaaaatttacaagttgttttttaaacggtcaatcgtgtagctaaatcttttatggcattcgaattgctttttttanaacaaagtgcccaatttaattccagggacggtctcgtccatgagggggggggggggggggggg

SEQ ID NO: 15322 - DNA, 1005 bp, Heterodera glycines
ccccccctccctctctccccctcctccttctccccctttccctgcctcgccacttacccctgcccgtttcgccgagttccgtctggatgtttggcccggccacccgctccaactcgacgtcaagccgtgccaaaaaagtctcccactcgcgaaatgcttcccgaagttcggcaatttttctccctgcaaagattgaatttggtttttccttttggccactcggcccactgacctctcctctcatccccggcacttgccaattcttccatcctttgctcaaactcttccgcctttttcacttccaacgcatcgtaaagtttggccaattgtccgccaatgtcattgatgacgacgcgactttgcaaaaaatttgcagtgaaaatgacagccgagtgggcagagatcagctgaaattttgcttttttaaaacttggcattggtccaacaccctttttaaagggcacatttgtccccccccccccctcctccgttgcgcaccccctcccctcccccaagggatgcttttgctccctttcttttgtctttttgtccctcctccgcttttacgtccttttcatccatcacccgctcaatttttctacttttcatccatttgtactaagttttgttttcagcaagaagatgctccgtccgatgcgttcttccgttggccctctcttttaccccatttttcctttttccctccattttcctttctcccgcttatccctccgcttcttcatctccctatttctgcttttcaccctccaattcgaccccgtcagtcccctcgaggcatgtccccttcccccctttgtccccccaattccctcactttggcaatcctcagattttttgggcggtgcccagccaaacgtgcgtgaacagaacggaccccccgttggacccggcaaaattcggaattcggacaaatgccggacaaaagtttcacgggacagaagtaaaaggggaaattgtgttgctattgaatattaacaaaaggtc

SEQ ID NO: 15323 - DNA, 3970 bp, Heterodera glycines
gcctgcggtcaattttttgacacttcatattttttcagtacggggccgtacttcatttgcccataatctacaatttcaataaatcaatttttaattaattaattattttaattgtttcaaccaatttttaattatcatttatccccttaatgatttcaaatgctcatttttaccgttgcatggtcgagttcaagtccattccaggctttgcaccatgcaaaggctcattggtcaaggtcagtccccaaaaattgatgttatgggatttgtattcctcgaaaaatctaaaatttaaaaaaattaaaggttttcaattgttttttcaagtgttaccgtctaaagtaatttgcaaatgcgcgatagtatggaccatgcaattcgcccctgaaaatttttttttatatatataaaacatttccttggctttgtgatgatcttttaccaaaaatgtcatttagattgatttgtaaaattcagtcttaaaaattaataaaagcaaaaattaacacaaataaaaaatttttcaaaaaattgaaattatattttttattttgggaaaaataaaaattatttcttaaattaaggaaattaatttattgtataaattgtttaatcatattttagctctttctttctttacttaatatttcacattttctttgattgaaaaaattttttatttccaataaggagaattagagattttcaatttagattcaaaatttaaaaaaaaaacgaatttcttttactatactaaattttagaattacggttcaagtaactaatatagaccaacttgatttgtccagcgccgaccattcgtccgttcgttttcatccaaccaggcgcggaccaaggactggagaacaagcgtaactgatcaccactcatttcaatggcttgttgaatgttggggatcttcaaaatcaatttgataatcaatttaattaattaacaaaatagttttaattacaataccttccattccgtgtcttcctttggtaatgcaaatgtcttcaactcaaagtcgtccggcgtgtcgcagtaagaatattcgcgcacggagaagtcacaagcacccatcacaacacggccaaccgtgtacttaatgcctttgaacaaattttaaagtgtgaatttttgggaaattttttttattaggcttagcagtaaacatcctgtcagtgtttttaccatggagttgggtatttttaattcggaaatattagtaagtcggaatttttatgccgttctaacctctattttattttctattttttttattatgtcttccataaaagcgtaaaaaatgtcgctgaaatattaattctcatatttttgaatgctgataagaataaccagcaaaatagtttaaatctaattacactaattttatgaaaaattccaatttaaatttaaggtttctattgtgacaaacccaccaatgtccttgtcaaaataggcacgcaacagtgttgcacgcgtggtgttgctcaacgcgttcaaattgacgccagccgcgtcagtgaacgcaccgccaaagccaagaactgtttggtactcttttgaggcatccacaacaatttcgatcccttcatctgaaaaataatgatggtttttggattttttttttcatttgaggaaataaaaattattaataagtaacttatttaaaaaaatttttttagcattttaattttaaaaatatttaaaataatccaacattttttttcttcgaaatttgaaaaaaattgcattttataaggagctaaaacagcttcatcattatttacttttctaagggtcgttgggacttatgaattcgctaaagcggatttcttacattttttttcaattttttattcgtttttcatgcctgcttcccattaccggtaaaatgtcttatattttagaaaaattgatgattttatgttaaaattaagtaagcaaaacggaacaacaaggtattttaaaaaaataataattaattgtttatggttcgcttaatcaatttcttttaattggcatttgccaggtctgaattattactgccaaaatgtgctggtttttccataccttcgtcatccgatgagcaaatgcgctgcggcttatccttccgacgattttggtcactgtattccacctcaattggcacttgctgttgatggagacggaatttggccgggtccgaaatgtacacaatggcattgttgtcatttttgcccagccgatggggcccaattggcaggtcgcagaatgtccgattgcacacacagacaaatgattcggagccgggaaagcgccgttcggcacagtccgaaattgaaacggcatcactaaaatggaaacaatactttaaattaattttttaaatcaaaataatttattaattaagaaaaaataattattaaataaataaaaataattattttagatatttaattccattaaaaaaagttttactgtttttttaatattaaattataggcgctatcaccttccaatacagaaaaagatgaacacaatgccggcaatattgacaaaaagtgaaattctttccatttttaaatctaaaaataaataatttaaagtttccgtttaactcaatgaaaataaattaattaaatcaaaattttagggaaagggaggcaaaaataaaaataacaaaaattgtttttattttattgaatataatattttgcgagcgttgaaataaatagctgagaatgttaatttgttgggccaaataaacacattaactaatacaaatatcatcagcacatgaagcacaaaaaagaggagtgaaaaggcagcaataaaattgtcaaaaataaaataaataaatgataaaataataatgcttttttattgtgtctataaatggaattaatcacattggggagaaagaaagtcgacgggaaaaacaggggaaaacagctaaacaaaacaaaaaaaacacagaatgaaatgataaataaacaaaaatattctagtaaaactgattgacaaaataatttgtaaaattttgagaataaattatattttataaatccaaagccaaaaataaataaataatattatttttttcaaaaaaaaaacaaaaacaaaagttgtcgagcttattgtctctctttttgagtgcaatcatggttagatttaaattataattatgcattcatttctttaatcactgacgccttacaaaagtgaattttcttagacaaataattcgaaaaggcgtacaaaaagggcaaaatgactacaatttataagcaaaaatcgttcacagaattttgcgcgggaacaaagattaaaaatgattgaaatgaaaaatgtcaaaaaagagaaaaaacgatgattaataaaaaattattaataaaccaaaggataaaatataattttataaatttaaaaatgtctcgaaataataatttgacaggcaaattattttgatcctgactgatgacagagctaatttgagttaaaatcataaaacattttaaatttgattattaattactcaataatttctgagaataaaaacaatatttttttgaaataaatgggaaagcaacaaaaaagattttttacaatgaacaaaaacaggattttttactgcagactatgtcattcatacgcatcaaattctttatcgacgttcacattaggattatgagttccgaaaatatcaaaaatttacaatattaattgtactttttcattttttcattaaaaaaacggcgattttttacatttcaaattaaaaaaaatattttttaattaaatgataattggtataatcgctaatacttaaatttttcgatggtttttgtttctttgtcccaaatttcttaaaaaaatctcatcctctaggacaatttaattttgataatgatttaaattttattttcattgtttatttataatgtctgttcaagatatttgtattcaaaaaacaatagtttaaagt

SEQ ID NO: 15324 - DNA, 3705 bp, Heterodera glycines
ttttttctttttttaattggttttttttttggaaatttttattaattttttcctttgtagggtttaaggcaatcaaaggacttttaacttgaaatttttaacaaaatgaaacttaataaaaattattagtagttaattattgtaaaaatataattttttataaataagtttaaattcatttattaaaatctaaaaaataaggataagaatatatgtatccttcataattatatatcattttattaattaaattttcaatataaaatttctttcttcccataattaaaatgtttttgcttagcaataagtaaaaaattccatatatgcacgctacccctctccgcctcccatctgatatgaaattcttaacgcttttttcttaattattattatttttttcatttatttccttatttttagctatcatcaccattattattattttactaaatttattttaatatttattttttctacaactcttcatctcttcattaggcttgggttatgacacaagtaccatttgccacccctccagtcgccacatgtcaccaaacccctcaaataagttttgggttatacgaccaccatttggcaggttgccaactaaattgttcatgctatgccacactacactaaaatgagtcgccgtctgaccaacattttatgccatccacggtcagtcattagcgcttaaatgaccaccagcgggcgctcagatagcccatgcgggcgcttaggtgacacgtgcgagcgctcaaatgacccggcatcgcttccctcccgaagctgacgcccacccctccccttttaaacatcagcgaagccctataaaaacattccaataggcatccgccaaaactaaaccaatttctcaaattcaaaaataacgaaaaattaaagtttgtaccagattcaaaattttgacccaggattgactactcaaggagtgaaacggtcggactcaataggtagcgccctctcgagcttttttatttgactattataatttgtgtttattattattattattattattttataatttatcaatttcttaaatttttttcatttatttttaaatttttatctattattttaaatttatttattaattttttaactattattattttaacaatttaattttaattaaatttaattttttaatttatttattattattattatttatatctttgtgtggtattagagagagcaagagaaaagagagagagtgagagagaatgagagagagagagagaaagaaaaaagagagagagagagaaaaaagagagagagtgagagagagataagagagagagagaaaaaaagagagagggtgagagacagataagagagagtgagagagagaaagaaaagaaagagagtgagagagagagagaagagagaatgagagagatagaaaaaaaaaagagagagagtgagagagagagagaaaaaagagagagagtgagagagagaaagaaaagaaagatagtgagagagagagagaagagagaatgagagagatagaaagaaaaaagagagagagtgagagagagaaagaaaagaaatatagtgagagagagagagaatgaatcttagcttttttattcaattattttttaaattataaaaaaaattttttaaatttatttatttaatttatttataatttattatttaatttatttttaatttaatttattttttattaatcaataaaaacccttcaataggtttaggttcactcccgcacccattcaataggtttaggtttaaatcaataggttttagttttgggattgtttatttatttttatttttattatttatttatttttaatttaatttaattatttaaatttattattaatcaataaaaacccttcaataggtttaggttcactcccgcacccatccaataggctttggtttaaaccaataggctttggtttggaacggtggttttccaacaacggaaatcgcccggagtaactacttcatagatacaaattgattgaattaaatgcttttctatatttattagggatttattttagataattaattataaattagttttatttaattaatttgcttaaatttttgcgggtttcgcgcaacgaccttgcgccaggaattaaccctagttttgacaaagggtgtgcgaaacccaaaaaaataattttcgaaaacgaaaacgaaaatatttatttttcacaaaaacgaaacatgaaacgaaaattaaaaattttgaaactcgaaaacgaaaacgaaaaaataaccgttctcgtacgaaacgaaaacgaaaaacacgaaaattttttgaactaatttaatccataattaaaaagataaaatttttaagttatatcctcaaactaagggaatgaaggtcctagtaggtggaaaagcagggctctagtaatttaatttcatttttcatttcaatgaatttttgaacaatttcaaatttatcttcatcagtttttgatttgtagcatttatttttttgaagaccaattctttaatccatttttgaatttttgtacaatttcaaatttatcttcatctttttttgctttgtagcttttgagatgtttgtttttgaatttaatccatcttataatgtaagtaggtaagtatgatttatgcctaaacttttcgctattttcgtattagttttattccattcttttttttaatattttcttcacttttgcttaattttctctccgatgttccaataatatttttcagagggcataattccttaattagaaaggcgaaacgaaaattcattttaaaatagagcaatgataagacggaaaaagttaaataatcataaacagcttttcagctgttcattttgacacaaaaaacgccaatttcaaattttccaaaaattttttcggtcgttttttttggtataaaaccgaaaaatgatcaaaaaatcgaaaaagtcgaacccaaaaccgattttaggtcgtttcgtgcttcgtgttttattttttgattcgcaacaaccctgctgtcgaagtaagtggttagtgtcgtcaccttgttagaaaattttaataaatttctaatattaattgttttaagaaatttaaaaactgttatttttagcactttttttgcttttattatttttatttaagtattattatttataataaatttttgaatttttttattttgatataattagtttaatgccaatgtttggaattcaccctttcctctacaatttcacagaaaagtaagttataactacttttattaaggacaaaactatttttctggacatataattttttcgtaaataaatttttttgagtgattttttctaaaataattatttactattctattatgacagacagaattacccacaaaatttatcacttcaataataacaacaaaaatacaccatgccaacaattgtggaaatgaaaaaaccaaaactttagagataataatcgaaatgacagcgcaacatttcagtgtgtaaaatttgtttttgatcaaaatcattatgaaaatccattaaattttgaaaacagaggggaagaattgaaaaaatttaatcctttttaaaatttggcattcttttaaaaaaaaatccctaaaaaatgtaacagtgaaacagtaccaaaaagactgatgctaaccaccgaccaattagattcataatca

SEQ ID NO: 15325 - DNA, 3789 bp, Heterodera glycines
  misc_feature (3781)..(3782): n is a, c, g, or t
tttaaatggttattttttgggaaaaaaccttcgtaaagtgttaaataggcgtaaaatggcataaaaatgacctaatatatttataatcaccttttaacatttaaaaaattatttttggaggggtacatttaaaaaaagtttttttttttaattttttcactagaaatttctaaaaattttcaaaaattctcaaaatatgtataaaaaaataaaaaatttgccaaaatccttccgtttcttaaccctatatttaatttctaaatttcaaaggtcacagcaacaagcacaggaaatggtggcatcgtcggaggaggaaggtgcggaccaaactgacactctttcggcatttggagacgacgaaatgctcatgacagagcttctggacgaagtgccaccctttgacctaattaaccaaggggtaaaaatgcataaagtgatcaaaaattaaattagaaaagtcattaagataggaatattttcatttcctcagttgaaataggaacccaaataaaaaaatgacattaaaattttccttttccataaaatttgggtacgatttgaagtgatcattttgaaaaacctaaaaccgacggcgccgaaatttttgaaattttaaaacgcttatgggagggtcataataagataaaaatggaaataatataatgctgagaaacaattgttttgaagattgttgacaccatacacctcgcaattatggctcgccatggagttttgggcggcaacataagaacagttgacgtgagagtagttgacggacacggcaattgcatctacactccgccacctgcagcgcatgtgccgcaactgttggagcaattcatccaagacgtgaataatgtgattgggcgagcttcgacaggactgatggaggcacgcgttgttgccgcgtgggcgcattaccaattggtaattggggtattacctttaccatttaagacaaaaatttgtttaagtttgcaatatttttggccaattaaaagtttttcattttatttatcaattttgaatcagacttttgtattattaaggctatgctttaattggggttttcgctttgaaatttttgattgttttaccctattttcccactttttggccttttgaaaattaattgaaaaaaagaattattccaatcttaatgatcaaacgcacgcaagtttcctaaaaatgaatctaaaattaaaaaaatgaaatttttctacataaatattattttcggaaaatgaaaaaaataatgcatccacaaaataattttttgatacgtcaaatttttcataccttgttcaaaaaataagtcaattcgtcagtggaaattcgtcagaaaatttttttgagcaatgttcaaaaattcttgcgaaaatgattgttaaatgtaataaatataatttttatagattcttatcatttctagttactttatacttcaattaattgactaaattctttaaaaagattatttcataattattataaaatatcacaaaatattaatcaacatttttagcgacttaaattaattatcacatggttttaaataaatctgtggtttaaaaataattagcttatgaattagttactgacggattgtccactgacggattgtccacttactgacggattgtcactgacagattgtccgggagccatctattttagcgtaaacctgttaacaaagcgcatacaattttcggtcacagcaaggcaaataaacttcaatgtaatttcctttttgcgtcctcgcgttgcatggaaaaatgctgctgttgttggggtctgggttccgaggatctaaaatttttcggaaatcgtaaatcggaattccgggggtcaatgccttccattcctttttcttcttctaaaaaatcccccaccctgcaaataattgttttggttctttttcctatccaaaacattttcaaagatttttaacattaataattttggccttaatatttttaaaatttttttcaaccttaattttggcacatgtattcaaaatcgatttttaagggtatagtttataaaattctcaaaaactcgatccttaggggtgtatttcgtttttttttttttgcatttttcttatgaaaatttgctaaaaatgaccaaaatatgctttaaaaacgcaaaaatgtcgaaatatgcacttattctcgaaatccccaaaaatgcttttatatgcattatacgcactaaaaactttcaccaaaacaaaaaattttaacgcagaaatgctatttttgagcccctttcttcatagcatatgcttagaaaaaatatgcaaaatcatacaaattataaccctactgattagagaggggatttttatatgctaaaaatcctaaaaaaatgtgccaaaatatgctcgaaataggtattaaaattgaaaaaattcggtgtctttatgcataaaaatctagaaaaatttctttcattatcattttctccccattattgtaaatcaatatatttatcgatttcattaccatttgctggattcaaattcgggattcgaatcgctttaaatatgtgttttatgctaagcgcatgaaaggctatggaatggttttcgaaataatttttggataagttgacaaatcatcgcttttttgctgagatgtcggatcattgcgcgccaaaatgccagttttttaatgctgaaatattattatattctgctagatcccggtgggaaaaattaataaagtgattcgaaaatataaagttaataaattttgttcgaataaattaaaaaaataatttatttgaagtaatttgaaaaaattttctgtttttcgaccctaaatctgttttttattccaacttttctgcttgctaaatttttcaacatttaataaaaggattgcccttcaaatttgtaattaaaaatatttttgttgagtttttaattgaattttcgaattccctctcccgcagggattcccgtaaaatttctgcgggatttttacggaagcggtatttttacgggattccctttcgcgactcccgtccaggaaaatgtgaactctcgctctcgaaagtttttcccaaaaacgggagtaaaaatgcactggtaagaattgttatgtttatcattttcaaaaaaaattattttttaaaggaatattgaaaaatttgacatatcaaaaaatggggtaaacccaactcatctaaacccaactcacatgcacaaaaaatgccacggccaagaccgcataagtagaaaggccacgacaattactcgttgtgttatggatgagttgggtttggatgagttaggggtgactcaaaaaaatcattttgtggaatcattatttttttttctaaaataatatttatgtataaaaaattcattttttaaattttaatgttcatttttaggaaacttgctgagtttatcggggaagggaccagaaaagtcgggacctggaccaagttacgacagggaccgggaccgcgagaaaaactggtgccgagaccaaccaggattttttccaagaggaaaattttttgaaaaaattctaaaattttaatctaaattcattaataaaattaaacaatttaaaatatttctctatgtaaatgatttagtattttaactttcatggaatttaaaagcattaaggttttgtatcttatgagtagggcatggctttcttcagcaattattttcgcccttatttcgcaattttaaattttttcatataaaattcacaatttctttaaaaaaaatgtaatgaaaattttttttggcagaccnntgcaggc

SEQ ID NO: 15326 - DNA, 2154 bp, Heterodera glycines
  misc_feature (2139)..(2139): n is a, c, g, or t
gttatacaataaaattagaataactgcagtaaagcatttatttaaacctgaaaaagaaatttttttagtccttttagaatagaaagaaatagagaaatattttattctatatctaagtatatttaataaaaatttaataaataatattaattttttgtttagtttattatgttataaattaaaaagaaaaatataaatttaatatgaaactcctaaattatctttatacctcatattatgaattttttttcaaataacaaatttattatattcaatatatatgtatggtatttttaattaatatcgctctcttggttcacggctcatttccttattttaatttatatttagtttattgtatatttataatttaaaaaatcaaaaatatttttaatattctaataattcattcaacttttacgatatcgggaatcgcccactttctttatttttgctccctctctattagacaaattctttaataaatattaaataacaaggtgaaatttacagtgtcaccttgatatttgaaaaattgtgtatcaaaattgcattcatttttgaataacttacatttattttatttcgtaaatttataaagatttattttctccatatttaatgataaaatatttgattttagtatgcttttgtttttatttattccttataatttacgtttttttttaaaagcgaaaaaaattttaaatgtaaaaaatattaaataaagaaactgcgcaatcattttcgagtaaatgaaaaatgttctccatttctcgtcttagcggtgcattcacaacgttttttttcgcgggaaaattattcttcaaataaattgaaaaattattcatcaaataaaatttaattataaatttttttactgatttttataaaaagtatttttcaattaaataattatatttcatttcacttttttgaatattatttatctagctaaaacacaattcccttccccgggatttagtttagcttatttttttcgttttagcgttttcagtattttatttttagcgttttcaatattttatttttcttgtcgtaattagataataataatagtattatattttattgcatttttcgtcaaaattgttttctcaacattaatttccataactattctcgccatcatcagataaccttttctcattttttattttgcttagcatttttaatttttaattttctattaattatttttgatcttaaaagtttaaattaaaattaattattattctttctccatttctcgttttataggtgatttttcccagtgttttttttcgcgagaaattattcaccaaataatatttaattatatttgttttgatattttttcaattttaaaatcaattttctaaaatttactaatcgtttttacaatttctcaatttcactattggtaaaaactaaatatatgaatatatattttaatgtattttaggattgaagtttgatttaatttttgcccataaattataatagaatttataatttttcattttttgtaattaacttttatttaattgatatctttatttaattttagtatattatcttattatttctagtatcaattttttaaaaacattaaaaaaatatttttgaaattaaagaacgcaatttgctcacgttttgtttttttaaatttatttttgttttttcttaatttttaatatattattaattttcattaataatatttccaagtccagaaagtccaaataattggtggaatggtcaattgtaggaatagctgaagaaatatgtctcaatgagtaaaggccctaacatttttgcggcttaaaagttgattgattgaaaaatgttaataagttttttgctctttttattatgtatataatattcttttttgtcttttttagttttattatattttgagattatttattttttaattctcttaaatttatttgtattagatttttaggctaatatttgaaaattaataactcacttcagcttaggttaatttaagtaaaataaagctttataaatagggaaaaataagaagaattttatggatttttctcggccgcttcgcggggccattgggttttccccgcgcttaaggtaccagctcggccgcttcacggnctcgtacgggcacgg

SEQ ID NO: 15327 - DNA, 1379 bp, Heterodera glycines
cccccctgcccgctttccttttttctgcgcatttatttatttataatttttaattagagcgagagtagtgcaagagtagtgcaggagttgttcatcagtggttcattagttgttcgtgagttgttcaaaagttgattattttacataccgagatgcacatgcagtatcttggtgagagttgaagttatatccaaaattaaaaaaccgaaaaaaaccgaaaccgaaaaaaaccgaagcaaaattttcggtataccgtttcggtttcggtttttttgaattttttaaatcttttcccaaaaaaacaataaaccatttttatcaatagaaaaagcgaaagatcacctctgaggtgggggaggggggtgtccggcggtgccgaaagtttttcggaattttaggaatttttaattatttttattaagaaaattgtacaaatttaaaaattttcaagagtccccaattccccgagttagtgtcggggggtcgggggataaaaagtcggaggtagggggctcggggtcggggagcaaccctattataaacccccaaaataggtgctaaaaatggaaatgagttaaatattttaaaaatcaaaaatgtagtcaagtaaataaataaataaatcttgaatatgaatttttgataaaattttccatttctcaggggtttatttttcgtttttattgcatttttgttaataatttttttcaaaatagcagaaaatattttacaaaaaattcttcaaaatgaaaaagagcacaaaaaagcaataaatttattattattaacaggttatatcgctccaatttgattcggtttttttcggtttaaagtcggtcggttttttcggttttttgattatttcggtcggtcggtttcggtataaaacccgaaaaaaaccgaaaccgaaaaactcaaaaaattttcggtcggtcggtttcggttaaccgaaaccgaaaaccgaaaaaaaccgaccggtccgatctctagtttgaatataatgaatgtaattatcattctttctttcttctgaattaattgaattttcattttctttcatttaatattttaaataaggtctctccatccatcgtttagagtaaaatttaaacttcgattgcttaggaatttgtaaaattttaaattaatgttgattttttaaaaatttaattgcatcaattttagatttcataaatcttactttacttattgagcaatcataatattaatcacagcgttatgcttttattttaaaaatgtaactgttgttgaataaatgaaaaaactatcacatttattttgatacgaaaaattcttgaaaattttaatgaagaaagttatttttaaaccaacctattagttgaaattatataatttaa

SEQ ID NO: 15328 - DNA, 3077 bp, Heterodera glycines
attcttggactaattccttttttctcaacatcttcaccatttatcaatttgtcttgttctgtcaatgtcaaaagcaaatgaatgtgcggtagtccccttccttggttctctaccgggtacatccatgcaatcacttcaccaaagatctttttcttgcttatctcattcataatagctttaacttttaaattaaaaactctgacaaccaaatcaggtctatcacttgatgtctgttcatgaaacaaattgtctgaaatctctccccattgcgggttgcatgtcatggtcaaaaacatatcaggtttaccaaaccgtctaacgacggccattgcatcttggaaatgcttctcaacatatctagggctgtttgtcacacttggaggaagaatgaccttccttcccagtggcaagcctctttcttgtgctcgtctcattaacatattgtctacattcttatatgcatcagccaaaatctttttctgattactttttatccagttcattctatctccttcaatcttaacatattcatcaacacaatactgttgaaagagttttccaccgtacaaaatagggttaaactctctttctctaattgctaatgtgtaacacacatactgcaacctcgttactcttctgttactatttctatgcttcatttcagggtgccagccaagcgtaccacgcggataaaacagcgggtaagtcattggagttaccattgaattagtacaattcaaaatcttcaattcctttccacgttctctcacaacaatcttggcattaggtacttcaccgtcagctccaggtacataaactgcagcaacttcatttactcttggtacattgtaccccaaacgtcggtccaattgccttccggtctcaaacaaaagtttaatctcggttggctctctgttctcatttctcgctctctcagcttcatcattttcttcctctttcatcatcacataagcttcagcaaatggattcacatttctaataacttcataagcagtcctcagcaattggggatcaatagccacattagcatgtctcattgctctcactgcatgctcagtatctacgatgaaaatttgcccataagcaggttcatcgccattttctgggttcaaagccaaattcattctatgataaacttgaccataaatgcgaaagcaatacggtcctcggttcgggtatctatatctaagcggattcattgaagcaaatgaaacgctgctattcaaatgtctaatattctcaaaaaaattttcatgtcttgcatcaaatttcatgaacaaatctctcaattcctccggaaaatcctgttcaggaatttctgggacaaaaactttaccatagtgacagcaatccttgaaggaattgccgcgaccatgcactttctcttctgcaaaatgcagagcatcacaaaaatcacatctcatattcattgggctaaggctatgttcatgagcattctcgttagaccctgctgcataaacattaataactccttgtcgaatagctctctgtctaattcttttctgttctaagcgcaactgtttttccatcacattttcatttgctattatattgctatttctaattctcatctgttctaagcgtagctgtcgctctaacacactttcttcagatctttgactattatttctatttctcatctgttctaagcgcataattctttggtcttgtgactcgtttgctcttctcaatctttcgcgttctctttttcttttcaaatactcattacttcttctttcttcaaattgactatcactcatacgtgatggtcctgcaatggcaatatctaagctcagagatgcctggctggaaccttcatccacaaatcttggtctcttagcataactgtgctcctcaaacacagcatagtttctaatttctatttcattttcttggtctatgatctcaacacattcttcaacttgaacaaaatctaaatcataaacataatcataatctcgaacataatctaaatcatttattgaagccataataataaacctgaaaattaatttaaaataaaacaaaaagttttgaaggtattgaaacaaaaatctgttgaataattaaaattattaagtgtttatgttttctttaggtttttacattttgcaaacaaataaacaaaacaaaaaataatttaaaaagtccaatgatgagaccgtgcatgtttcattgcttcacgcttgtgtgggtttctgaaatttgagaagcacattaagtcacaaaacaaacactaatgttttatcaatgtcatgccagactttagtgtctcatacttaagtcacagaacaaacactaatgtcttatcaaaaacatgacacacataattgtgtcgcactaaagtcatagaacaaacactaatgttttatcaaaaacatgacacacataattgtgtcacactaaactcaaataacgaacactaatgttttatcaaagacatgacacacataattgtgtcacactaaactcaaataacgaacactaatgttttatcaaagacatgacacacataattgtgtcacactaaactcaaataacgaacactaatgttttatcaaagacatgacacacataattgtgtcacactaaactcaaataacgaacactaatgtttatcaaaaacatgacacacataattgtgtcacactaaattcatataacgaacacaaatgttttatcagatatttggctatttggcaaatttaccacaactcttcccaacccacttacaaaaggggccgccaaagttgaagtagtgaatttcttgaaagtgagcaaaaagttgagtggccgaccgacaggttcaacacttcagagatgaaatcacaaccaattgtaagccaacagcatttcttcaatatgatggttctcatttctaaattttacataataattaacataacaaagcaaaatataattcgaaacaaattaatcccagataaactttgatgaggcacttaaactcaatctgggcaagctgttgaatgatggacagggcagatttcaaacttgtgaatgaattcacagacgaa

SEQ ID NO: 15329 - DNA, 3731 bp, Heterodera glycines
  misc_feature (3712)..(3712): n is a, c, g, or t
agaaatccttaaatttatttattcgtctaccaaattttccaaaaatttcccaaagtttcgtcatataaattggcatttccttaattcgttcaataaaaaaaatttcaggaattttacaccccaacggaaaaatacgcgctgaaaacggcccacaagcgtccgcgtcggcccaaatcgttgcgcatttacgagacgcatgtgggcatttccagccaggagcccaaagtgaacacttaccgcgattttgccgacacagtgctgccccggatcaagggacaaggttcgggaaagcggaaaaattttaaaaatcaaaattttttgagtccaaattttattattttttaaatttttccaaacaaaattttttttattgttagtaatttctgacgggtagggttggatgattgaaatgtggcattttgttttttaaattgaaattattaaaaaaatttatttctaaaaatccgttatggcgatagacattctgaatttcgattttaaaattaacagtttgatggtatttgacagtgttgccacacgaaaatttctttaaaaaataataataaattttgaatttggttgaagtacatcaccttttttttcacttacacattttaaaatgtcccaacttttcagggtacaacgccattcaagtaagtgggccggccattttcatccaattttaagggtttttgatcaattttcattttatccaccattttagctgatggcaattatggaacatgcttattacgcctcatttggttaccaggtcaccagcttttttgccgcttcaaggttttgcaattaggaaataaatatatacaaaattgggatttacgaaaaaaagaaataaaatgtttgtcgaatttaaatgattcactaaaaatggcacattgacgactttatgacaaaaatacaaaagcttggaccaaaaggaaatttcgagtttactttttttgcttgacatctgattaggaattcgaatttttttttttttgcaaaaaaactcataaattaggttttatagactttaaagtctaactagcaaattttggcggtttttcatacaaaaaataaaacaaaaagttgaaataaatgagccctaaagctcgtccctttttgtaatttattcctcttttttaatataaattgccattttttccacagtcgttttggcccgcccgacgacctcaaatatttggtggaccgtgcccatcagttgggcatcactgtgctgctcgatgttgtccattcgcatgcgtccaaaaacgttgcggatggactgaaccaatgggacggcacaaatgccgggtcagttttttttttttgtacaaattcaagcccttggggtctcgtaaatttgtaaaaaaaaatttttttcaaatcctttcgttttcattttcagaccattttcccgatttcctttccacgccatcgtttcaccaaaccaaattttgagtgtctaaaattaccaatttttttcaaaaatttagtcgagccttgtaaaaattaagcattttttctttgcattttgtctatatttttgccaaatcttctatttttctccacttttcagctacttccatgacaatgtgcgcggctatcacacccaatgggactcgcgattgttcaactacaacgagtaaattatttgttattccttgtaaaattttttttctttattccgtgtaaaaaatttacatttaatcctttaagaaccgaaactttgcgctttttgctctccaatttgtgctggtggattgatgagtacggctttgatggtttgtctgcccattttttcgtttttttaaattttttttttgaaggtttccgcttcgacggcgtctcatcaatgctctaccattcccacctgatcagtatgttgtctaaatgattaataaaattttgtttttaaacttaatcgagactgggatttgataatagaccccagggtttgtgaaaccctcaggcccataacaaaaaaaattacggaaaggagagggggggggggcatccgaagactttttttgggtttcaaattttcaaaagatatggtaaaatgggcgtccgaattgtaaatgttgcgaaataatcgggatttgtttcatatttgggcctggtactgaaacctgaccgatagatacttcatttctcaactacgttccatttcaaatttcctaaatccattatacaacccaatcccccacccccccaagatgatgccccgggcagttatgacgactattttggactgaatgcggacaccgagtcgattgtctacctgatgttggccaaccatgttttgcacacggtataatatttggaaaaaaggttggggaggatcaaccgaaatgataggcgccgccatcgaaaaaatttaggaacttaatgaattaaaaaaaaattgttaaattttttccgtttccctccttcgcctgactttttggtaccatcccatgaaagatcttttttggagcaggattaaaaagaattcaataaaaaaaatttcctataaatcgctgaaaatttttcaattttgtgtcggtccagtactatccggatgtgatcaccatcgcggaggaagtgagcggaatgccggcactgtgccgtcccgttgcggagggcggccaaggctttgactaccgactggccatggccatgtacgttttgtgcattgctttattccatgggggaaatgtgctaactctgacatggcgtccttcaatctacgaaatttgtttaaaaaaaaaactaatacaaaaaaaattttctgaaaaaatttgaggttttcctgaaaaattcccaaaaagcattgctaacgctattttctctaccgacaaaaaattaaaaattcggcatcctctccacttttcagtccggatgtttggatcaaaatgttgaagcatgttagcgacgagaattggccaatcgccgacatcgtgcaaacgctggagaaccggcgctacggcgagaacaacgtggcgtatgccgagtcgcatgaccaggcgctggtcggcgacaaaaccatcgctttttggctgatggacaaaggcaaaaaacaaacatacaaattaaacaaatattgagagaattcgacctgggcctgaggtcctaaaaaattttttgggatttttttcgagaaaatcttcgaaatttctgaaaaatgtcggaactttttataaaattacaaaaaaatacataatttttatgcaaaattaaatattccgaaggctttctttaatttaggatttgcaatttgccaagatttctcttgtttctgatttcacccgtttttatccagaaatgtacgacttcatgtccgacatcaacaccccgttgactccgatcatcgaccggggccttgcgctgcacaaaatgatccgtctgctcacctacgggctgggcggcgaggcttggctcaattttatgggtaaatttgcgaaatttcttgcatttttgcatgtaacttaatgacaatttttgggttaaagactactccccttacaagggaacattccgagctgtgagtgggaaaatgcatataagctatataccattggatagagcggggtcgacttgtattgtgaatttttaattttagcggtgcattccgcctgcttcaaaagttacagggcctcgaaatttgaaaatttgtgcttcagggctcattttcaactttttttcacatgatatcaatttttctccactnttacaatgacagaacacat

SEQ ID NO: 15330 - DNA, 3865 bp, Heterodera glycines
  misc_feature (89)..(89): n is a, c, g, or t
  misc_feature (464)..(464): n is a, c, g, or t
ttttgggacggaagggtccgaaatgcggattgctgattctttcaagcgccgcaatggggattgcgcgtaatcagaactcggttggtgcncagccctggtccgatccctaatgacaattactgtggatgagcttcacacattcaaaaagctaatattgcttaaattcatataaaaataaaaaagctaatatttcttaaaattcgtaaaaagcccattttctgcttacttatgcaaaatcgatgcttctctagatattctttgttttccatttaatagcgttgacagcaatggcaaaagatgtggtgatgtatttgaaacaaagaaatgaattttgcaaaaaataaaaagggcactcactaatgcccatgtttgggcatgacaataaaaatgtcatttaatatttggcatcatgcgaatgccacacgtaaccgagcgaatgtgggagggggggggggaggcgttgnccgtttgagcgtgtctctttaagcgaagaattagccaccaatccatcgaagacattcagaatttttcaatagcttcattattgcaaataaagctaaagaaaatcggaatgactgtcatcgtatttctgctatgtctcatagagccaatatgccaacttgcattagctgatctccaaggaagtgtttccagaatgggggttcgtgaaaatggcaatttgactaaaaagaaagtgcttcataaagaaaataatattcctgcacttaaaaatgcttcgcttacaagttctaagcatgaggatgatgacttactgagtgaggcactgattaatcttcataaattgaatggtaaccattttttaaaattatttttctccacgattttttagaacaaacacaaaatggaagctggtcagaaaattcggagtaagcattttcgtttaaagtttcattgtttgggataagtttaaagtttcacggaagttgatgggagttttttgagcttttgcaatacaaatggagaaaaaaaggaatttagaaacacttttgttttggtcatttttgagaataagactaaaagtagctttgaaaaaacggaagaaaaatgtcctttaaaggcattttcagggaaaatgaaacttttattcagtaactttttggatcggtataacgtgaatattctttaagaagccgggacctgtggagaatacaagtaccaagtttaggtagacatgaattttcaattgtccacatagttacatgcattatcgtatctttaattcccaccagcatattggcatttgtctttttggtataaatcaaatatagcatagaattgcgatttcatattttgttatttgttgggtcggaattccggtttttgataaaaatcagaattttcacaaatcttttttacattttttaccaatttaaaatgatttatttttatagggtcctttttatgtcattttgactcccaaatgaaactcaaaagcataaaattggtcatttctgggcaaaatttattaataaaatgcaaccaaaaattttcctggccgcgcctacgccgcaaaaaagtgttgtaaataatccctttttcaaaaatgtaataaatgtaaatggacatgaaaaaagtttctgatgaaaatcatttaatattttttaaatattataaaacatttttaaatcatatttatttttaattttttgttaagaatttaaaatttattaattaatttcttcaaaaatttccgacttccgctttccgatttttggggttggaattccgatttccaaaaattttttgggcctcgaaatttcatttccgaaagagttttgacctcagaatgccacaccttgtacaatctgtaacatatggacctttctatttttcccaccgttgcctattaccaacgctggttcccaacttaatgaattttaaatattttatacggcgctgtttgacccttttctacataagtgcaataaatgagtctgagatttgttcaaaattattatgcaagttttttaagtgaaacattgacaacgctgtattcattagtggaaattgaaactaaactgaccaaattcgatgaaaaagctgcaaagactatccaagagctcaataagaaccttatgacgaactccgaaaatgtgatgataggcgaaagtcaaagcttaaaagaactgagtgaagaattgagcaaaactattgacacgatgaaaaataaggaggacaaggcagcaaaagttagcattgatggagtaaacggcactctggtacaaatattgcaaaaggcaaatgtgcacaaaaagtcaataaggttgcaaatatatgtgcaagtgatgaaactgctaaatctaattcacgagagaatcgagcaaagcccggaaaaagacacaatcggaaaagtcatcggaaagagtacagtcgcaaacagcgtgaagactgtaatgccaagtcaattagtgggattaataagggaactttggatacattttttgcaaagaatccgtaaacccgaccaaaataaagctactcaaactaacccaaaggtaatacttataatattttaataaatttaaaatatatacaataaattattattcgaaaattacaattattttagataaaaaaatcaattcagattaaacaaaatgaagtgatcccaaaaaaacaaaagcatgctttgtcaaataaacaaaaacaagagacacaaaagcatctagtttcgcttggcgataaattccgacgacgacgacgttccccactgcccatcgcgataattcgctctctatcattagcctttgctatactttgtatcactgtaattgccttggaacatcataacccatgggccgttgttgtaattgcgtttcttgcactatattcccaacaggaaaatactcgtaactttcccacacaaattgccgatggaattagcaatatcgtgaatcgaatttgtggtacacgtcacacagagggaggtccctgtctcaacggacacaggaacaattacggacacgaatcacatagaaacatctcacaaacagatgtaccgcaagcctattcttgtggcaattacgtacaacacgattggcacaaccttgccccacaagcaaatgagctatgtgcgacggtgcgaaatgccaacccgagtgccagcggtaacccagctaggcgaagcagcaatgataacaacggcagagctgcggctggctcagttcggcagcgattaattacccctgatttaacgcttgaaatcaactaccgggcgccagccaatcggaacaaaaataaaaacaacagtcgcccgggtgttgagccttcccgaagtcgacggcctaatcggttcgctactaattcactggctagcagtgggaacaatcagcagaatgaaaggccgccatcaagaatatcagaaggaagtggcgaggagacggatgacaacaacagcatacgtagtagtaaatgtactgcttgcaagtttgaaaatagcagcagttcagaaaacaacagtcggcctggtcgtgaatcttcccgaagccaatggcctaatcgggtcgctactaattcaatggctagcagtggaaacaatcagcagaatgaaaggccgccatcaagaatatcagaaggaagtggcaaggagaaggatgacaacaacagcatacgtagtaaatgtactgcctgcaagttggaaaatatcagaagcagtagcagttcatcagatatgagaaatgcaaaagccgctgagaaaaatgatgattccaatgatcatgatgatgacaaaggagaaaatgatgaggatgatgacataaaagacagtgatgatgatgatgatgatgctaatgatgatgatgatgaatgtgataatgatgtcaaaaatctcagtaatgataaggag

SEQ ID NO: 15331 - DNA, 3043 bp, Heterodera glycines
ttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaattagttcgataattgggtaaaaaagaatgaaggttaacccctttttacaaaaaaatgattattctattgttattttggataatcattagcacattacttagttaaaatttgctttatttttgttattttgaaaaagtttttcaagcctagaaaaaattttattgagaaaaaacttaaaaatttcgacttttttaaaattttcatgtgtaacttttttgttaattgtctaatctcggagcaatagcttagaaaaagcttctaaacatgttaagctttcaaatgatacaaacaatgttgggatttggttgataaagaaaaaagttatagaaagatagtgtaaaagcttgctggggccgaaccgtgggggccgaactgacgtagaccgggcactatcacttatcttttaaaatttgattatagtacgaaacgccaaattgaaacattgtacgaactgcctttgtacgaactgcccattgtacgaactgccatgaccccgcaatatccgcggtgcaactgtctgcaagcaaatgacgcggcgcatcacggtgggctcatgacgaaaatggccgtacgaaaatggcccgtacgaaaacggccgtacgaaaatggccgtacgaaaacggccgtacgaaaacggccgtacgaaaatggcccgtacgaaaacggccgtacgaaaatggccgtacgaaaacggccgtacgaaaatggccgtacgaaaacggccgtacgaaaacggccgtacgaaaatggccgtacgaaaacggccgtacgaaaacggccgtacgaaaatggccgtacgaaaacggccgtacgaaaacggccgtacgaaaatggccgtacgaaaacggcccggcccctcaaattcttcccaaatgcacaaaaaattttcaaaattttctttttagtatttttttgaaacttttcatgacttttttaactttaaaacagggtggccaagtgtgcttatttctaagatttgtgcttattttgaggggtcggatcttagaaagccaaaatgtgcttatttctaagatttgtgcttatttcagcattacgtgcttattttgtgcttatttttgggtttgaaaataaaaatgaaaattttgaatgacagttttgacttatagttttttattgaagcgaatacttgaattaattcgatttttgaaaaaaaaattacatttttattttaatggactgacacgcggaatttgttgcaagtcgaaacagtcaaggcgttggtccaaaccaaagccaattttgatctttcttgcccacaaatgtaccaaatgctcatttccaatcacaaattgttggagaaaatcggcggatggggaaaatacctttgataatcaatttcaattgtttttacgctaataaaatattgttttaagtcgatttttcatggtttttttgcgtttccctcgcgctactattagttttagaaaaaatcttatttttggggtccaaatcttagttttagcctcgtttgtccttattttgaaaaaaaacttggccaccctgtggaaaaagccttttttgtattttttattataactcaagtcctaaactgctgatttcaaccaaaatgcgaaaactaatcattttctattgattctaagtgttcaaagtgattttgtagcatataaaccaaaatttttagaattagtgaatttgatgttttttcatgtgttagagacatgaaaatagtacgccaaaatgagaggaaaagaaatgcaaaattttcatcatcccttaactttaaaataggatagaaattcattaaaaccttatagaacattcgatgcagaatttttttcataggaaaaagcgacatgctaacctggtggtatgtccgaaaaatacgggcccgggcgggctctaattttcccttctaaatttattcgttttccttaaaaacagcttaataaaagtttttgcgaaacaaaatggctgatgagaagaatatggtcgtggagaagaatacttcatcttcaacttctgctactgactcttcaccagacggagggaactatatcaaagaggaaatgctccagagagaggtcaaattattccagattatctcaaaaattctgactttatataagtcgactatgggcattactggataatcttggctccacccaaaaaaaaaaaaaattatcttcgtgttatgaaaagatcaacattatcttcaggttttttgtgagtgtcttggtggcgaccgtgtttc

SEQ ID NO: 15332 - DNA, 3807 bp, Heterodera glycines
gaatttcagcaaagaattattttttttcacaacacgagttcaaatcgaacaaattttcgctcaaattgtctactctctattcacttttaataacttaagtattgttctgcatcaaaataaagttttaggtaaatgattcgaacttttccccagaaaaatattctttggaaaaaaatcaatttttctttgaattctggtccgatgttcgaaattaggcaaatccgagttcagattcgtgaccagcaccctcgaaaacccccaaatattcattttgagcacaaataaaaagtaataattttaaatagaacccccattctttaggattgccaaaaggggtaaaaatgcgtgggcaggaagacacaccatcccagaaatgagctccaataccaaaaaagattaaaatacttgtctcagtggtctgtgagaaggtcaccaaaggggtgggtcccaggttcgattcccagtgcatgctattgatgtatttctatgattttaatgaataaataaaaggaaaagtgaccaaaatgattttaaaattgtttacaaatttttaaacatttttatttgtcatgtgtaatgaaaaataaccatcaatcctcgatcagtcaacgatatcgacgtcggcatcttgatcactttcttcattcgttttgtcttcctccgcttgctcccgttgttcctcctcccgcttaattagttggattaaaattttaaatccccttccatcaactcaccagcttcaattcgtcgagtctgccggtgtccagcagccaattcgagacgaaatgatgctccagctgttgtcgcatttgttcagagtccggcatcgtcttccaaagttgctcaagtcgccgccacacggaatgcagtgcctcatctcctgaaaaatcacaacttttaaaattgaacccccaaaaatgatatggtcccaccctgctcatccaaaaggcccaaaaatccgtgttggcgcgcaaacggaacaaagtggtgaagcagcaaatgggcctttgtcttttttgaaagaagcgttcgcaccattggttgttcgtcgagaaatgccttgaactggtaaactgccgtctccagtccatccaagccacctggagacaatggctgggccttaaattaaaaaaaattatttccacaaaaatgaaaaccaattactttggtgaaaatttggattttccccaaatgtgccattgtttggaaaattgttttcgcccattccgtctcgaaaagggcctccatttgatcggcatggacgaggattttgcggatgctgttccccgttaagtcgcgctttctgaacgctttcctctttgcccctattcgtctgaagaattgctgagcaatttcggcattttatcccgcttccaactccttgatcagagcatttccgaggccttggaagacgtggaatggggccaacagcatctgctcaaaactgatcgacggcagcagagatgcacaaacaatgcctttcgtcagagcccgagtctctgccgttgctttgtcgccgccatgggtcagttgctggaactgatcggcttgcctctccaattcttgcacagttcgaagttggcattttgctgaactgatcagatggtctcttcggcagtcacacacaggggatgggaatgctgtcattgccgaaccgcaatggccaaccgcccatagaaaacacagatctccgccaagaaacctggaaaattttccgaaaatcaaaaagcgcccgtcaatttcattgaggtgctcaatttgttcccacaacgatccgcagaaattcttcaaattctttcgtgaatcttttgcgggaaaaacagcagcaacaaaattgttggaaggggaatttgggcgcaatgcatgggccaacgaaatggtgatttttgtgaatccccgcccgtgatcgccactgacctgaatgacattgtatttcaaagcagcgcaaattattcgctttacttttgttgtgactgagtcgaagatctgcgtcttcttgcgcttccgcgttgaacggcgaggttcagcgttggcctgctgttgtggctgctccggttgcggctgttcttccggcggtggcagctgctgctcgtcgtccatcgcttcgatcggcacttcgtcttccgagtccgaattgtctgcactttctgaactcggattgtccgaaggctcttcggtccaattctctttcaactgatcaaagtgtctcttccaaattcctctcgccgttcgaacgaggaacattgccgtgccaatttgtcgggtgatttgtccttggatccattttgatccgtcgcgataatttctcgcgtaaactctttggttcaccttgaaattttttcgcgcatttgtctcacggtcgaaattccttttcattcgttccgtgtaggaacttttttgcattttggccgcttcaaaatcattcgccgctgtttgttttactaaatccaacaaagttcgaagcctgcggccgaagaggatttccgaaggcgctaattccgttgctgcgtgcggcgtgacacggtatttcaggagaaattgagacaatgcaatttcttgcctcatcccctcttttttgagcttgttcatgccttgcttgaaggtttgaacaaatctttcagcagctccatttgacttggggttgtatggcgcaatcgttgtatggataattccgagtgattgacaataatcaccgaattcttttgagctaaattgcggtccgttatcggatacaatttgctcgggaagtccatgcgctgtgaagacaattcttagcgcttcgatcgttgccaatgccgttgtcgttcgcattctgaccacttcaggccatttgcttttggcatccatgatgatcagccacattgatccccaaaaaggtccgcagaaatcgatgtgtattcgttgccacggtctttccggtgattcctacgggtgcaatagcactttccgctcatccggcgcctcttcttggcaaatttcgcatctttttcggatcatttcaatttctttgtcgatgcctggccaccacatcttctggcgtgccagggccttcattcggaccatccccgggtgggtcgcgtgcaaaatttccaacatttttgtgcgaaattttgacggaataattgtccgatttccaaacatgatgcacccttccattaaagcgagctcatttcgaatgacataaaaactttttagtccttcttcgactttttgtggccatcctttttcgatgaattctcgcaatttttgaagaattccatcctttttcacttcttttgcgatgacattcacagtgaccggcaaacacgaaatgttttcgttttgaatttgctgaacttccagtccaacatggtcgatggttgtctcttccggacaaggcagtcgcgacaaaccgtctgcgttgccaaattcctttgtcgagcagtacaccacttcaaagtcgaagctcatcaatgtcagcgaccatcggtgaagtcgtttggccgccacgatcggaaactctcctttgggcccaaagatcttttttagggctcatggtcggtttggagcacaaactttcgaccgtacaggtactgtttgaatttgtcgaccccgaaaatgattgccctcgcttctttttcgatctgcgagtaattgcgctccgacgaatttagcgttcgagaggcatacgcaatcacaccaactttccctttttcatctttatgaaaaatgactgctccaacaccatagtcggacgcgtcagcggcaagaaaaagtggtttttgcgggtcgtaatggaccaaaacttcggtcgatgtcagaaccttt

SEQ ID NO: 15333 - DNA, 1965 bp, Heterodera glycines
cttggcttaaatttatttttttatgatactagatgaaaaataatagacataacattgatttttcgaagacttaattcagattcttaatcagcgatgtttttttaccccaaattcttgtaaggaaaattcttttaataataaaaaaatttggaaaaaccaaagtattgtgaaaaaatcatagacaaaatcaatgttttttaaaatctgagttcatattcgtggtcagcacgttttttaaccccggaaaaaaggctttttaaaattttactattttttgcccatcgggaccacaattctacctatacatattttgggtgcaccccaaaatctcgccgccgaaatctcgccaccaaatttttttaaattttttttaaatttcaaaattattcaagaaaaaataaaattaacaaattcgcttcccagctcaagtgcctaaatttaatcaacaaccatttgttcgcttcctagtcgcttttcgactaggattagcctctctatctaagtaaaaaaaaagatagtagagtttccagcacgtggccacgaggaggcctgcgattggaaatggttaaaccttaacgtgccatttttttttttttggttttgaaatataaaagtgaaaagtcaaagaaagattcaaaaagttaaaattgattccaaacgataaaaggccaatatcaaagaagtgaaaagcgcaagcatgcatcaactgggcacaataaacctccgggacgactctcaaatgtcgaaaaaagaatggaaagggcaaaatagaatgggaattttattgttattgcgagatgcattaaatttgttgacccgttaattattgtgcaatgttagaaaaattgttaatcaaatttggaatttatttttattttttcttggataattttgaaatttgaaaaaaaaaaaaaaaaatttggtggagagatttcgaccggcgagattccggcggcgagatttcgtcccgtcccctatattttattccacagaaaaatataacatataaaaccatcctcactgtaaagaacacacatttattataagaaagtaaaagataaataatcgtaatcaaaaataataatataaagtgaaaagggagagtttgacaaaggacgacggcgataaattcgggcctttaatagaagaattaggagttccctgaaaatcgaaggaatgtaaattaatggcgcaatttgtggtcgtttgtgcctccggtgaaaaacgaccggagaacaatttgctataaaccttgaaacagaacgaacactctcctcccttctccacaactttcatcaattgagcagctattaaagagatttttttcagttccctaatttatttcggatgggccgataaattacttaaatataatttttactttttagtttcagctttgaaaattattcctttcggcccattccgattttgcacaagtgtaaaaacctcagtgggcgggatttctgtaatgttggccctttcatttttagatgatcaaaaacgatttttgtgctgatggcagtgtacggtagcgtgccgcccaagagggtacggtactccctcaaaaaacacactgacacccggtaggtgtactgtacctgaacttcacaacacagtgcctctctcattgcgacactgttgtgggaatacctatcgacgatgatgatggtgattgacgaagtcaccgtggccattgttttgatggtggtggtttttttgtttggtggggggcggcgatcgcgaagccgagttgcggacacgacgacggcggtggtcgtcagacgcatcgccgtgggcggagtgtttttcgttgttattggcatcgtcgcggtggcgcgagtgggacctcgaggaaagtgcaagtctttgacactcattaattaatattcaataaattgggagaaaaggaatctaatctttcccattcgcccgtaaagggggccaaaaagggatccgtcttagcat

SEQ ID NO: 15334 - DNA, 2418 bp, Heterodera glycines
aaattcgctcatttcgcgctccaatcgctgcgccttctcctccaactgttttttcgttatctcatccatgttctgacaatgaatggaatatccaaatgggaagtggcttttcaaattttttggtgacaagggaatttaagactcaaaaaatcagctgattcccatctttcccttatttacaacctgtgccccctgggtgagtgccaaacgctctttgtgccgctcaattcgtctcatcatatcgtcatgaatgcgccgcaaaaagtaataaaactggcgttcatatcccagcttttcgaaatgttcgctctttcgataggcaatacgcaaattctcgtcatgaacatagcgacaggcgcctgaaaattgtctttaaaaactcttttatgcgacaaaacagttaaaaacctaaatccgctttggtattgacaaattcatcatgagggcagaaaccagcaagaaagaatttacagacatcgttgtcctaaatgtcgaagtttaggcaaaaatgacaaaaaagacaaaacccgaaaattcaggtccaaattcttgtcttcatttcggcctggccccatcaattcatttagcattgccgcgatttggtctttcgccgtcatttggacaaattattcgtattacgacaaaataaaatcacagcagaacttaattagtctaattaccttttttcaatgtgtgatcggagaaaaatatttttttttctaacaaattgtaaaaacactatgggtcaactccactgtgcaaagaaaagcctagtactatctcgtcgtttctctttttctttgtaatttatctgtaatttatctcactttcgcatactatctcttcattttttaattgaaaaggtgctatgtcattacttaaaaaccatcataatgggcgttacttaaaaaaccatcattatgaaaatttttgcttataactttgctctaaaaagaccaaatttttaatccttgctatcattcgatagatctaaatgttctttatgagcatgtaaaatgggaaccgccaacttcgccgcggccatctcgccgcgagaaactcgccgccgggccaactcgccgcgcgctttctcgccgcggggccaactcgccgcgcgctttctcgccgcggggccaactcgccgcggccaactcgccgcgccttgttttttggctatctcgccgccagatttttcgttgaaaaaatgcattaaaagcaaaaattctttacagttaattgtattcaatgtgttatatttcagcaaagtttctctccaataattggaatttttcgattttgatttttaatctaaaatggtttaaacgattttattggaccactgatgagtatcagggatgactttcagttcgtttccgtgtgtgtaaagaaaggttgaacaaaatgtgaaatttaaaagaacttgaattttcaacttttttatcagtattttgggttcggggttcggaatttctggtttcaaattgtgttatggaccagtgtttgttattttaatgattcttttgaaataaattaatgcattttttaattttatatcaaaataatgaggtaacctttcaatgaaaaaaatctggcggcgagatagccaaaaaacaagacgcggcgagttgggcggcggcgagatggccgcggcgagttggccgcggcgagttggccgcggcgagttggccgcggcgaagtgaccccgacccgtctatataatcacaagaaaataaattacattaacggaaaccgaaaatgcttggtaatctgactcataaaagtcgtttgtggcgtataatttaaaataatttggaagttatttagtctgaatggcctgtaatcgggtctgccgtaaatggctctttctattttcaattttcaaataaaaatggggccgtttatgaaattcatttgatttatagcattgtttccggtttcaattaaaagagggattaaaaaagaccttttgttcatgagcatgggccccagtttataaaaatattttggagtttttaaaaaattcgcttttaaaaaaaaagttttggcactcaaattcttggcaaaatgacaaaaattttctttttttgcatttatttactcttttcatgacttttttcgctttctagacgaaatttgaactttgcgaaaaaaattccgaaaaataagtcaatcttaaaaagtgagtagatttacgtccaaaacaatgaaataattgtgatttgcaattgtgcaagtaaaatagataaagaatgagaattttgagaaaaacacgtatttttggccttttttgggtttttagtagatgttttgggggtttttaggctaattatttagggagtgatcatcatgtattgcggtccgttttatgaccgaaacaaagggttggacattggcaacaaccatattggctaaaatgca

SEQ ID NO: 15335 - DNA, 912 bp, Heterodera glycines
tgcaggtcgtaaaagaatttaatgaaaagaacggcgaaagtcgaataaaggaaaatggccaagtacaaattgcccatgctttgttggcacctaaagcaaagaaatgagcacagatctcagcaaaagcttcttggaaaagtgccggccttgccccgtcgaacactttcagcttaaaaacagtcgcagtgattgccaccccaaaaagcatttgcgtcgtctgaacggtggtcacaatcatagcgaaccaacggggcaatttgaagcccaaagaattgagggcgtaatacgaatacatcagagagtgagcaaagaagttcatgggcagaaagagcgaagaggcggcggtgtgttcggcaccttcggaggggagagggaattggcacaattgcaaaaaggagggggggaaggggaattggcacaatggcaggaggggggggggaaggggaattggcacaatggcaggaggggggggggaaggggaattggcacaatggcaggagggaaggaaggggaattggcacaatggcaggagggggggggggaaggggaattggcataatggcaggagggagggaaggggaattggcacaatggcaggagggagggaaggggaattggcacaatggcaggagggagggaaggggaattggcacaatggcaggagggggggggaaggggaattggcataatggcaggagggagggaaggggaattggcacaatggcaggagggagggaaggggaattggcacaatggcaggagggagggaaggggaattgtcacaatggcaggaggggggggggaaggggaattggcacaatggcaggagggagggaaggggaattggcacaatggcaggaaggagggaaggggaattggcaccatggcaggagggagggaaggggaattggc

SEQ ID NO: 15336 - DNA, 1576 bp, Heterodera glycines
  misc_feature (1108)..(1108): n is a, c, g, or t
tttcatgattcatttcaaatgagtgaaaaagttgatcagcgaaggacattgttcacaaaatatttaaaaaacaaataaaaaaacaaaatataattatcgcactttcaaattaattgtattttttttattgaaaattttaattgataattatcctaatctttatggaagcttgtttgaaaaatgtctccaatttaagtatttattaaaaagaaatgagaatttaaatttatagtcaattaaaaaatgttcgccaattaacaacttttaaatgatccgacggcgacaaatttaaacaaataaatgctgcgcaataattactccttatcaatgggtttatcagcggagagaattcaaattgacgaagaatgttcccaaaaaacatgaattattgcggagactgcaaaaagtcaccgcattaattgttaaacatttcggggggggggggaacattttgccaaacaaaaaaatgaaaaaattaaactgaaatggcgaaaaatcgaatgtaaatttttggccattccccccccccccgtgggctttcgttttataaattcgtttttcgcgcaaaatgtcggcccaccaaatgggccattagtgaatgagctgagatggcaaacgaacttttgctaattgtatgtttaatttacttaattttgtttgtttcttctgtttctatgtgcacgacaaacggcggttgcgcaaagagaaaaaggacaaagtgtaaattcataaattaaccccttgggggggggcaaagcgccggaagtgcaaatggcgtaattgcaaaacaatttgtacaatattatgaaaacaaaaatgaaaaatcaaatgggcaccacggggtttgaacgaaacattgtaattgaaaatgattttaataggcaaaagaaaaataaatttaaatttaaaaaacgaaagacaaaaagaagaaaatagcaaaatggtgaagaagacggtgaaaactcttttattgtataatttccattttgagaccagtggaaaaagttcggagatggcaatccaatttaattgcttcgatcatcggatggcatttacccgaaatcgaaaattaaacctcaaaattccgaattttaaaatgaatttcgcnccctctctgtcccctttatccccttcccccccccccccctttccctaatggactctttcgagcaaaagacaaaatcctcgctaagggaggaaaattgcaaaagtgcaattagattgaagcttgaatttagatgaagtccatatattctctcaattataatactttcctatttatttttttctgaaaatatttgccttttttttgctgtttttaatgcctttttcactaataccaattaataaactcaaaatctggtaaggccaaagtcaaaaattgttcaaaaattgttcatctgaatcaatttaaaaggaactaaaagcgaagaaaatgcaaattaagggtgcgcttggcatttttcatgaaaaatcagtactgaagtatctttattttaaccgggactcaggtacccatcgccaaaaaatggagcaaaaaaacttaggaaagcccctaatttgcattttttttttt

SEQ ID NO: 15337 - DNA, 3098 bp, Heterodera glycines
attgcatttttattctttaatacttttatttttttttttgatttagaattttttaaactattttttaataattaaatcattttttttagttttttttaaatttattttttcattttttagccttgaatgatttttaaaaaaattagctaatattaatattattaataattttgatttacttcctaccagggatgtgccgaatcggaatcgtaatcgtaatcggaatcgcaattaatcggattttgggccataatcggaatcggataatcgtaatcggattttgccttgaaatccgattattacacccctaagaattgaccttttgaaggaatttttttagcgagaataccaatgaattttgaaaaaaaatgttttctgaaacgaatgttttaatcttattttaacataatgactgaaattaaatttttctcacaaagcagtgccggattaattctccccgatataatcaagttttttgttatttagcaaaaatgtcaaatatctgggaatattctccaccgctgggttgattgtgacagatctgaaaacgtttattgcctgagaatgtggacaaacttttatttttgcatcacaatctttaaatttatgattttgattatgaataaaatttttgggaaaaaattatttttaaaaaatcggaatcgtaatcggaatcgcaattaatcggattttgggccataatcgtaatcggttttaaaaccgtatcggatttttggccataatcggaatcggcgatttaatcggaatcggattttgtctggctcggcacatccctgcttcctacccatcgtcacagtgtccggctatttcgggaaggcgaaattcgattccgaatgccttttcatccgtcccatttgactcgcgttgttcaggcgcgcggtatgagacaaatgttagtccattttgtccattcgtcagatgaacactataaaaaacaaaaacaaattagaaaattaaattccaaattttacggttttgtcgaaagttggccggaggcaaaaggcaaattcagggggcaaataatgaacaaaataataataatcatttttgcttaattacaaaaatttattattttttaactaataaaaatttttcctttttttcattggaataatacgataaaatcatttgatggacatatttatgatttgctgaataaatgattgaaaatgagaatgggatgggatgcatttttgtgatgattcaatgcgaaaacggattaattaatgcataaatattccaataaatagaaaataatatgttaatttaacaactaaataaatgaacaattttattataaatttatatgattttaaatatttttaaatcagttttaaaaaatggaagtcccggtcccgatcaaaaccgggacttaggtactcagttgtcccatttttttcagtaccaggtcccagtcccgttctactcttaaaactttgttcataaacaaccaaattttaattttttgcttctcaatttggctttaaaaatctaaattttatagcggttaaattgtcggaatttgcttaaattaaattgttttttagttgtatttggatttaaataatatccgtcctagctggtcactaattggatgcgcattttcttatggaatcatcgctacacagctgtaaatcaactcgtactacagcacatcaaaatcaaccgcctggaatacgctgatcaccacatgaaagctaagtgattgttaaatgtttaaaaaccgaatcattgtaaatatttgtatgaatttattgatttaattatgaagataatattttgtttgaaaaattactatattttttaatcaaattttagcatggcattggctgtgcggtgccaatccctcaccctcttttggcactcaaaaatgacactcaaatcggaaaaagagctccactcattgagaaaacttttgaaattaaccaaccaaaaattagtttcagtttttcacacaaattactatatttttggaagcaataaaaatgcttcgttttagcattttttgtcaaaaacttcattcaagaacaagatggaattagaattgttcgatttacttgactttcggaattccgattttttggttttattgcatttttattgagaaatttcaaaaaatctcaaaagagtgaaagaatagtgacaaaacgccaaaatagtgaattttcactatttttgtgacgaagctccaaaatagtatttctagtaacatcagaatcgaaaattttcaacgcagaaatgcgttttttgagctcctttcttcaaaacattgagcaaaaaaaaaaatatagttaaatcaccaaaattagcggccctaataattatccacgaaatatttttagccgttttttctttttaccgtcaatgtccgggtaaattcgtgaaaacatgtgttttaacgtgcggcgtttatctccaaaaaaagggttttggagaacgggtgggggtggggtaggtccgggcggtgccgataggcgccggccgggggggaagatttaaatttgagtgaaattgttaacagattttgtcgaaaaatttgtctaaattttacgattctgagacgtttttttaagaaaataaatgaattttgctagtttttcaacaagcgtttgtccaaaaaatggacaaattttgcgtcaaactttagattttcttgaataaaataaagaaatagtatgtagggccgcgatttttaatgaaaaactttttttttttgtttttgcttaattgatttgaagaaaggacctcaaaaaataaaatcaaaaatacaccccctaagaataggcctaaattttttttggaaaattttctcaaaaatttatcttaatatttttaaaaaatattatggcattaaaatttggctctacagcagtttacgcctccaattgacttttacgcgtccaatcaacgcccgtccccgagtttctacttgcttaaagcttacattcttggtaccaatcgaaagcttgaagtctaaagaagtttttgtatagcaaaattttcgggataaaggcaacgagacaaaaaaatttttcgtgaatatacgcgaaatgatgaatttcgtgttttctcattgc

SEQ ID NO: 15338 - DNA, 3647 bp, Heterodera glycines
cctatccattagagccaaggcagggccaaaatagaaggcgcatggaaaggcaaggccatgacagcgagaatcattaacacaaccaaccactctcagtaaccccaataattagctcaaaattgcgaatctaattcagagctttcagttttgatctgggactggataattgtaaaaataactgattgattttgcaaaatgttctcatttttgaccctaaagtcttattttttgccttgctgttctgattttgaaaaattttcgatggaagccctgcaaaaactcccatgggaaaccaataaaatcggtttcaatttacgcctcagggcattaattcaggggtttattagaggcgatgagtttgccgccggataaccctcttcggctggaacattttcgcctcttcgcgcgcatttacggccgatttgacgcgaagagaaagccaaacaaagcactgacacggcacgaacgaattgtgaacgaagcggcggcacagctcagtttattgagaccggaattgctgtcacggagagacgagcttttcccattggccagaaaggtaaaggtgacttaatccattatgaataacgacatggcacaatttatgaaatttgtcatttttggaaatttaaatggaaattaatttgaatagagttaacaagccagtaactaagtaagtgtttgtggacttaaaaaataaaataaaatgctaaacccagcacagaaggagttgagccgtttcgccatttttacgtacgtaacattggcatatgtttgagggcattcacctctttttcccgtaactttggcattctttttgagctcgcccgtctattcgaactcccgttgaacctgagaacatcgtcagcagtggaagcgaaagggagtgcctccccgccggggtcgtcgatgataccaaattccgttcggaacagctcaccgacatccaacgaagaatgttgtgatgggacatcaccatcaacatttgtgccgacaaagcacgaaaagggggacgaattttaccaagggggagacgaggaagaggacgaggagagccaagaatcggaagaacgatgagggggggggggcgaatgggatttgccatttttggacacattttggcccatttattcaatccaaaaacaaaaaatgccattttcatatttcattcatttgtaaataaatatatgtattaccaacaaattgtattctcagaaataatttatgaataaattatatttgtgtcatttgcgcaattcaaagtcggcccctctttttcagctgttgctggtcatttcttggctgataacatgacgagattaaaatgtcaatttcggcacaagttgcagtcggcaaatacattttggcaaatgcacaattattatgcacgaaggagggcacgtctttgacgccgtaaagactcgaataatggtcaacctggtgaaagtgtgccaaattatgaaattcgaatgtaatgacaataaaattaaccattttgcaatgttccggcgacaaaagtaacggcctcccttaattaattgtgttataatggacattccttccggcatttctctccactcattgcccaccttgcgcgtcgcgttgcacattttgtatcggtggcatcatccgctgctccccgccttccgcccactgtccctccccttccgttttggtaccgtgccattgcttcgtcttcatctcttccgtttccccctttgtctgctgctgatcagtcgctccctttcgtaatggcgttattctgatcagttgttgctgctgctgttgttgtccttgcgtttcttccaccgttctgtcctttggcttttcgtccttttcaatttctccaaatatttctttggcttctgtttgattggcatcaatggttaattttttgttataatttttgttactttctgctttatttgagagaggcggtgccattggtacgttaaacggcctcattgatgctttgattttaacagccggcataaattgccctactattttgttttctgccttttcgtcgataattttattggtaccaccgtcaaaaaccgcgacgccaggaatgccttttgaaatgaatttcaattaagcattgtttgagggcttcacgttacttcgtgcccttggcattttgacttgggccctttttgttgcttctgttgttggcattgtttgttgttgctgaacgggcggtttccgtgctgttgttgcgatatataagtcatcttaagaattattatgaatatttaaaagcagtttcgccaaattacctccaatcccttcgatatattcttcctcttgctgcttttcatcagatgtttttgaactctttgaatttaatttacaattttcacttattttatatttaatacccaatccgaatactttaaatgcttatataatttttattttttcatttaaccaccacaggtgttgtagcagtaattgctgtttgcatgttcaacttctgctgcttcggtggtgccatcgccctcatcgtcgtccgttgaggtgccaatgctccgattgaaaattcggccgtgccctcaaaaggtgcggtggtgccaacttcggcctccttgagattgtcctcgtcaatgtacttgaaagaagcaatttatgacaaaaatatttacgtgtatttattaatccattaaaaaatgtacttttatcattaaaatagcaattataacttaattgttgtaattagtccacaaacttacctcaattattggttcgggtgttgtgcctttggttgaaaaatacaaatatcgtgccccagcagctccagcagatcgacgggggctttcttcccaacctgaaaatggcatgattattacgcggaattaatcatttttaaattggaataattttcattaattagtcgaaacaaacccaaaatgtcagtgggaagcctttgacgttcttggaatttggcaaaataacttttttgttgagtcaaattctaaacacagtaacgaatatttaaatcggcatttaaagttaaaattttctttttttaatgaataattaattgtttgtcattacctcctccgagtcgttgtcatcgaccaaaaaacatttgtaccgttttgccttcccattatttgttttggcatttgttcttttttcgtccctttttcggtgcgtaattacttcatggttttgccgtaattgcagcacacgagccaaatgagccgaattgtctctaaattgttagcagttttaattaatataattatttattttttcttccttttcaaaaggaaaataaattaaaaatttaatgatcaaaataacctgcttaatggagcggaattttctgtttgcttattcgtttccgtatcagataaaacgccgacacaaaaaagaattaaaatgataaatggacgaagaaaagttaattgaccaaaagcaaattcactcattttctgaacaaatttagaaaatcattaaatacaaatttacaaaaaatttttcaattataattcaaataaatatattaattacttttgttaaataatcaaacgacaaataaaaaggcatgaaaaaactgcaaaaagagaggagaaatcaaaacaaaaatcatttgcaaaatcataaactgaaaagagcaaaagctgctaatagcgaaatatgaa

SEQ ID NO: 15339 - DNA, 2358 bp, Heterodera glycines
gaaaggatgctttgatgggaagtgaaatcaaatggttggaataaacatttacatttagtagttgaaaagttttttcctttgatcggtgtaacgtctccagccccccccccccccccgttggcctcccatcactctgtccgcctcatatccgcagggcatttaatttatcctttttcatttatataaatatttacctgtcttgttattattttttgcttttcaaattaattttaattaactttttatttttagcatattcaattcattcctgcattaatacaaaatcttcgacaactaatggcggcagcgcttaaaaaacaacaaaattcaaatttaattttttaggctgcccaatgtaacaaaacggcttcgcatgtccggcgcctgatttgggcacttggtgggcgagggacaataccctttggaaacgcatcggctgaacttatgctgaatgctgccatcgacttccactacggtgggtaaattttaaaatccaataattatcaaaataaattttaatgttgatttgtttgaaaaaggatataggaattgaatttgcgttttatgtattttttggattaaattaaaattatttagcggatttggagttggtattccgattacaaatcctaaaaatgtccatttaaaatatttcggtgattatgataattacagaaaaaacggatctttaatgataatatttatcataattttaaataatcaaataaatggcttttcagaagtgcgcctccaaatttcggcacacaacaatcattttgcgcagaatcttgccccgccgattcaaaatgatgtatgttgaatttttgttaaaactcccatctattacgtgtaattttttggagtattaggcaatgaaaattttacgtatggccgtaactgaagctgagttattttgtgcgctgccgacgactactccggagcaattacacgcgtttggcaattgtaagtttagaagaatgctgtacgactcttaatagacattttctgagtaaaattttagaatatcatttaagactgatcaaaaaaatactctttactttttcattgatttaaaaaaaatctatcttattattttttagttttgagacagtttagccaacatctgcacgatgagcacggcttcactgactagggcaattggtataatcaaaattttttatgggattatttccattgtattaaaccgatttgtttatttttgaaacaatttttttatgatacatttttgtaggagtgaaaagtgctttttggagaattcaactgatttttgtggggaataagagaaaaggggagggggggggcagattatgaaaatctaagacagagtcatttccagattccatttgatccccttcacaaaatgtatttgccgattgtctaatggactgtgcacgagtgtaagttttggttttgaaattgttttatcggaaacaaatttggtgcacagtctttgacagttttgccattccgtttcgtctcccattttttcattactatcataacaattacttaattatttgtgccttatgcttctctcccactctaatgtgccatcacagaaattttccttccgttcataattatctcatcacaaaatatttttatcgcgcatccctctttcatccctcggcggtgccattgcccagcgctttgtgccgtcgtacgtcgcctgtcagtctctcttttcttccgttcttctctttttgcaaaaacaatcccgactctttgcaatacataaagtttatcaaatgtcaatacgtccaatgataaaacatataaagctagaaatgcgtcattttttaaaattaaatttaattttttattcctttgtccttttgcgcatttgaatttttgatcaaaatatgcaacggttttgaaaaagataatcaatacttttaatgatgagtgcttcagggaatttatttcaagaattttagcaattaaataaccaaatattttaagaattttagcaattaaataaccaaatatttttgctttcctttatgtttttctgggtgtattttttaattgtaaattgatgacagaacttatttaatctatttgttaattgattgactctttggttcgacctttcgaccttctgcatcattaaatgttgctaaaatggttaatgaacactattgttgtaaaccaaattacaaatttatctttaactactttgggatgcggagtgtttttggagggcactggcgccaaaaatccgcccacgattcgataagaatgtgaattgccgataattaaggttagataagaaagtgggtgtgccatccatcgccattataaagttggttgcccgacctcaaaattacaatccaa

SEQ ID NO: 15340 - DNA, 1491 bp, Heterodera glycines
  misc_feature (53)..(53): n is a, c, g, or t
  misc_feature (109)..(109): n is a, c, g, or t
  misc_feature (111)..(111): n is a, c, g, or t
atcatttttcaaaattaatttcctttaatgcttctttagtctgaccagtgttngagtgaggtgcaaacgctgtgccaattgttgctgtgcgtgccgggcatttttcgcntnaaggaatttcaatggtacggtcaaagaccgatgcgcacatggctggtggattaaaattcaattatttaatttgttaacaattttaaataattttaggcttactttccctttttgaagggtgtaatattccggttctaaattggtacgatcctcccacgcttaactttccgcgtgacatcagagcgcgagttggccttccgttgtcaaaagatgcgccaaattatgtaggcccttttttcaccgatggaaattgggaaaaaaattaggaaattaaaaattttttagtcaagaaaaaggaaatggctttcaattttgaccttttttattcccttaaatttatttaatccaaaaagtggataatgcacgatttataggtgaacgaaatgcatgccaaattcgtgcaaattgttgccattgcgtgccaatggccagaagcgacgttgaccgatttgaacattctcaaactcagtgaggagaaatgaaaattaaaaaaagaaaattatttttttcttttttagcctttaatttataaaattatttattcatttttattttagttttgaagagcatatgtagccaggttcgttttgtaacccaatggatgattgagaaaaaagttgatttttatccgtgctgaatcgtttagtaatagacatttatgaatattaattatcatcttaacttttttcaggggtaatgaaattttttttaatttgtgcgttaattgagaaacataagagctattaaatggcccaaattgtatttaaataaattgcttatgagaaagttttgaagctttaaatttacattttatgataaagtatattttaaaaccttgtgctaacaacaatatttaatttttttttgctttggtggaactgtttttccaaaagtattaaatgcgtaaaattatttaaatttaaatattctttattttaattaaattggatgaaatttattttatgtattatcccttggtggaatttatgaaacaacttagcacattttgcttttgtctcatctaccaaaaaaattctcgaagaaatataaaaaaaatgaaaaaaaattccctaaccaaaaattagatttttgtggctaaagcagaaaatccaatttttaatatccatttttattcgttaaaatacagtactttttataggcaccgaaataaaagtcgacgtatctcagcgggcctaaatcgtagacccactattccaaaggcaattcggtagcaaattttgtgctctataaaatgggcctactcaaaatttccagaaaatttttcctaaccccctagaattttttttgaaatttacccctcgttcccagccaaaatgggctgatcagatcaccatgaaggagtgatctgatcaatttggg

SEQ ID NO: 15341 - DNA, 1347 bp, Heterodera glycines
cgccttttcgccgttctcaactttcctaattttgtgaattccccaaaatctttggaatttttcaattttttcacctttcaatgtttccgtttctcctaaatttgccttttttccttttatttatttttctttcagtaaatatttcatattaactcttttaaataataatttatattttttgcactttcgatttctcctcattttctctcattttgtctccccccccccctttttccctttttctcgaggggcaattgcctttaccccgaaaaaattcgattaaccaacggagaaaattgccctgccaaaatactgcatgcagtgaaaagctgaaaagtgaacggcgaaattggggagaggaaaaacaaactcacgtggtgaggacgcaatgaaaagagaaaaggggggggggggagacggaactttggcaaaatgacgagacgaacgacgcgatgagacggcataatgccgactcttgttttgagaaggaatggggtcaagcagcagcagtgtgttcggtcgcattattccctcccattagccctttggcattgatcagcaattactctgatcactgattgtttaatgtctccccttattttccccctctgattttcagctgttgcttcggttctttctgtgccaatgccatctttttcttttgtcccttctccctcttcttcctcctcacgttccgtttccttttcctcttttccaccctctctctcttcgctgtcctcttttactgcctctcgcactcctttcgctgcttcttcttcttccccttccttttcctcttctctcttttcttcctcttcttccactcctttttcttctttctcttcgtcgccttctcttttgcccttttttcctctgcttttcctccccattgtcctcctccttcttctcacgccgttttgcgttgcgcaacatcgaagaattccaattccgttggaaatggaccgaatgttaggggcgggtagggaagtgtacgacaaacagatcgacaccgactcagtacgaacagcggccgacaagcgtaaagttggccatgtacatcgaggggatcggctcctttcgtacccacacaatggacaatcattcgttttttggcttttttgccaattttccctttttaggacttccaattggacgtttatttgcaacagttttggagggacccgcggctggcgcacaacgaaagcaggcgagcaaaaacagcgcacaaagccacaaacattctcaaaacgttcgctttactataattctgatccgtgacaaatccatcctggaacgaatttggcatccggatgtttactttgccaagttggcactgtgccaaggatt

SEQ ID NO: 15342 - DNA, 1570 bp, Heterodera glycines
cattttctccttttcccttcttttcccccccctccccctctctttccttttccctctttacccccctctctctccttttccccttttccttttcacccattcgcttcttttctccccccgtcggtcatttaaatgttctccccttttcgcaacttctccccctcctttttttgcttttgatttccaaattttgcccctttagcgacaatggccgccgcaggtttactgctggacgaaaagggcgggggaaaggaattcgcaatttggaaatggttgaggaaaacgatggaagggaaatggaaaaggacgaaggagcaaaaggagaagcacaaaatggtcatagtcagtggaaaagcacaaaaaagggggaaacattggccaatcatttgaagagggaggacaaaactcagcaaaatcactgcaaaaacagtggcagcaaaagcaaaagaaggccttctcggctgagaaaggcgtcgccgagtgatctcgaggggggacaacggacgaaggacgaacggagggccaaagtcagaagcaccggtgccaattgatcacccaatgccccgctttgaattgcagaatatttgtgcgcttcaaagtcaacatcagttgcgacatttgccgaagagtgaagcgaacgacggaggaaaggaagcggcggaagtgccaatcattgtctacgaagagagtgacaacgagacggagcagcacacgcaccaccaccagcagcagcagcagaagacggtgggccaaccgccgcggacggccgtcgaccgacgcgaggcggcgcgcattgcgtgttgggcgagtccggagctgagttgtgaaggactgtcgctgaaagtgcgcgagacgcagccgcgggggacgacggagggtggggaagcgaggccggaggtcaaagagcggacggagcaatccgagggaaaagcaaaagcccaatttgaggtgtgtgccgcggtgcagacggactgctgctcgtcccccacctcctccacgctttcctcctccgccgttctgctcgtccccgactgtcccgtgccatcgcttccgttgggccccgccctttgcgacggcaccgcccctccggcgctcccttcgcttttcgctccctcccaaaagcctttccttcgccgcgcttccgcgttggcctcactgctcgacccgataaatattggcagcggagaaaagacggaggagcagccgaaacagcggacggagaaggacaatttggggggagagaaagggacgacgcggcgacaacagccgatgatgtcatcgcaagcgaaatggagacacgcggtgcgcaaattgcaaatgaacaagtgagcggaggatggaaaacggacggagagagcaattagggactaattaactaatctagacgcgaagccgggcgaattcaggcaaagaaaatcgacgcgtggagtcgctgggcatttccgctgtcctatctgagtttccacggcgcctattggtattattatttgagagtggccgcctgagggcactgaaacggacagaaaatggaaaaatccaagcaaaaaagaaatttgaatttcattttaat

SEQ ID NO: 15343 - DNA, 1166 bp, Heterodera glycines
actagcgagcggtgtccgtagaaaaaaagccaaagcgtggctgtgtcccgtccaacaatttcctagtgcttagtgatggactagcgagtggtgtccgtaggaataaaagccaaagcgtggctgcgtcccgtccaacaatttcctaatgcttagtgatggactagcgagtgatgtccgtaggaataaaagccaaggcgtgtccgtagtgatgagcgagtagtcgataagcccaaagcgtggctgcgtcccgtccaacaatttcctaatgcttagtgatggactagcgagtggtgtccgtaggaataaaagccaaggcgtggctgcgtcccatccaacaatttcctagtgcttagtggtggactagcgagtggtgtccgtaggaataaaagccaaggcgtggctgcgtcccgtccaacaatttcctaatgcttagtgatggactagcgagtgatgtccgtaggaataaaagccaaggcgtggctgcgtcccgtccaacaatttcctaatgcttagtgatggactagcgagtgatgtccgtaggaataaaagccaaggcgtggctgcgtcccatccaacaatttcctagtgcttagtgatggactagcgagtggtgtccgtaggaataaaagccaaggcgtggctgcgtcccgtccaacaatttcctaatgcttagtgatggactagcgagtggtgtccgtaggaataaaagccaaggcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctagtgcttagtgatggactagcgagtggtgtccgtaggaataaaagccaaggcgtggctgcgtcccatccaacaatttcctaatgcttagtgatggactagcgagtggtgtccttaggaataaaagccaaagcgtggctgcgtcccgtccaacaattccctaatgcttagtgatggactagcgagtgatgtccgtagtaataaaagccaaagcgcggctgcgtcccgtccacaatttcctaatgcttagtgatggactagcga

SEQ ID NO: 15344 - DNA, 928 bp, Heterodera glycines
gcttagtgatggactagcgagtggtgtccgtaggaataaaagccaaagcgtggctgcgtcccgtccaacaatttcctagtgcttagtgatggactagcgagaggtgtccgtaggaataaaagccaaggcgtggctgcgtcccgtccaacaattccctagtgcttagttgtggactagcgagtggtgtccgtaggaataaaagccaaggcgtggctgcgtcccatccaacaatttcctagtgcttagtggtggactagcgagtggtgtccgtaggaataaaagccaaagcgtggctgcgtcccgtccaacaatttcctagtgcttagtgatggactagcgagtggtgtccgtaggaataaaagccaaggcgtggctgcgtcccgtccaacaatttcctagtgcttagtggtggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctagtgcttagtgatggactagcgagtggtgtccgtaggaataaaagccaaggcgtggctgcgtcccgtccaacaatttcctagtgcttagtggtggactagcgagtggtgtccgtaggaataaaagccaaggcgtggctgcgtcccatccaacaatttcctagtgcttagtggtggactagcgagtggtgtccgtaggaataaaagccaaagcgtggctgcgtcccgtccaacaatttcctagtgcttagtgatggactagcgagtggtgtccgtaggaataaaagccaaggcgtggctgcgtcccgtccaacaatttcctagtgcttagtgatggactagcgagtgatgtccgtaggaataaaagccaagg

SEQ ID NO: 15345 - DNA, 1708 bp, Heterodera glycines
aaaacatgaaccctgagcttttcgggggtgctgatcacgaatatgatatccatttcgactaatttcgaaccccggacccgaactcgaacaaaatcgaaactcatttttaaccaaaattcacctttatttgtccaaaatcgatttatatacacgtaatggccttgaaaccctattttctattcattccatgcatttgatcggtttagacaaaagttggattttttgtgaaaagtgagttttcgattttgttcgggtccggggttcgaaataggtctaaatggatatcatattcatgatcagcgccccctaaaaaccctataaaaagttgttttacacaacttttaaaaactttttttaattaattttgaaaaatatgggacccccattttcatgattgccccttttttaatttcattttgttttcctgtggtattttttcttccgcattaggtgcaaaaggcattggacgcgttggtcgaggggaaactgatcagcgaaattgaacgcgtgggaggcgcgggctttaaagtgttgcgctgtttggagggggccactgcttacgtttttgcctcgaggggctgcaaaaaatgggacaccgccgcacccgaggctttgttactcgctgctggtacatttagaaattatttttcacaacaatctgcacttttcggtggaactttatcggatatgtccggccgactgattaattacggcccctccgtacagttgataaacagcgggggagtgctcgcgaccgccccgggcgtcgaccaccaagtaagtgaaaaggaaacattggggttattagttgttgattttccattcattttcatttctaagagtttcgttgccgccatcccccaacttgtgaaggaatcgctgccagaaacagaaattgttggtctgtgaataccaatttgacagtgttgtgacatctccacctccgtccgggttcccttcccattttgataattgtgacgaattcccttatgtaacattccgtttttgaggatttatcgaacaaaaacaaaacaatgtgacatttttattattttcccgctttccaatcgcatttcattccaacccttcgctgacaatggctttcgccctctccgacgtaaatggttctgttgcggcacttttcgtgtttttccgcctgtttttgtcctttcttctctgtgattcacgtatgattctgtgctcccgcgtggcactgtgaatttggcataacaattgaattttttttaaatcgaaaaaaacaacctgtaaatagctttcggcacatgccgatgtttgacgatacgccgcacttccggatggccttggaaagtgtcgcgcaatttctggctgtattcgatcgccgctttctcgcgtggacagagctaaaaaaaatgctctttttattatctattctggttgaagccatcaaaatgactaaccgggccaagtttttcggctgcgtttgccttccacaggcgaatgttcatgtcatcactgccggacaacacaaatttgttgtcggaagaccacaagacggacagcacatattgcatccgcggggtgtggtacacttcccttacaaattaggagggaaatttataaacaggaaataggggagatgcatccacaaacatcgacgcaaaaataaaatattaaaaagttttaaggggctagacaatgtaaactttggtgtccagacatttgcggc

SEQ ID NO: 15346 - DNA, 3002 bp, Heterodera glycines
  misc_feature (42)..(42): n is a, c, g, or t
  misc_feature (74)..(74): n is a, c, g, or t
  misc_feature (116)..(116): n is a, c, g, or t
  misc_feature (2787)..(2787): n is a, c, g, or t
  misc_feature (2792)..(2792): n is a, c, g, or t
  misc_feature (2853)..(2853): n is a, c, g, or t
  misc_feature (2913)..(2913): n is a, c, g, or t
caatttgacagtgtgtgacatctcttcctccgtccgggttcnccttcccattttgataattgtgacgaattccnttatgtacatttccgtttttgaggatttatcgaacaaaacanaaacaatgtgacatttttattattttcccgctttccaatcgcatttcattccaacccttcgctgacaatggctttcgccctctccgacgtaaatggttctgttgcggcacttttcgtgtttttccgcctgtttttgtcctttcttctctgtgattcacgtatgattctgtgctcccgcgtggcactgtgaatttggcataacaattaggaatttttttttaaatcgaaaaaaacaacctgtaaatagctttcggcacatgccgatgtttgacgatacgccgcacttccggatggccttggaaagtttcgcgcaatttctggctgtattcgatcgccgctttctcgcgtggacagagctaaaaaaatgctctttttattatctattcgggttgaagccatcaaaatgactaaccgggccaagtttttcggctgcgtttgccttccacaggcgaatgttcatgtcatcactgccggacaacacaaatttgttgtcggaagaccacaagacggacagcacatattgcatccgcggggtgtggtacacttcccttacaaattaggagggaaatttataaacaggaaataggggagatgcatccacaaacatcgacgcaaaaataaaatattaaaaagttttaaggggctagacaatgtaaactttggtgtccagacatttgcggcttcgcccaattttatcatcgataaataaaaaggacccacatataataatttttgcctatttacaaaaacaaaaaatttttttttagtgccaattaataggctcaaagcctaacgagttgtattttttttttacattttctcattgttgcttgcactttttaaatttttgcaaaaaatatttttgcgccccgccgcaaaaagaggtgtgaaagcagaaagtctcatcgcccatgaatggtgcccccccccttaactgataatcctgggacgtccatgggggaaatgtttctcaccgacttcgccattgttcaacagggaaaatgcgcaaggatctgtcaaaactcccactgacaaattcgtgaccagatggcgcaaagtcgacgtccatcacagcggaggtgtgcccttggtggacgtggcgagcggagtccaacctgcgcatgtcgaaggtgtacaaactgacaaaaagcggggaaagtcaaaaatatacccaataaacaacggaatgataggttcgtcagactgacttgtagtcttcatttgcagcaacaaaagtgaacggctcaagcggatgccaggcaatgcttaaaatcatttggtttattaaacggcatttttgcacctgttcgtcctcagtttgagcactacgcggctcagcggcactttctggcgtgtgtcgaacagaaaaatggagcgatctgcggcacatccggccataatgccttcctctatggggttgcagttaatatgctgcacagtgttgggcccaacagcgtaatggcgaatgggcgaagatctgaaaaggatgacaccgattgggaggacaccacgtctggacaccgcacctgtgcaaccgccacaccgaaatgccctcaccacaggtgacgaaatcgctggacatcgccacgtgggaacagccgtgagggaccccgtcaagggacaactgcgaatggccaaggaaagggacagaacgttacacaaaagaaaaggccaattcattggccaccgaccgaatggacgggctgcgttggctgagcatttccatcaaattcaattggcaacggccacactttgagctgcgcgtcttggccaaccgtgacaaagtgcaaaccgtcagatgcatcaacagagagaccgttgatggggccggaatgtgcctggaggacgtgcaaacagcggcgagtggccaaatgccacactcggacttggccatcacgcgcaccggacagaacggtggacagacgggtgggatgtttgaccaacaaattgacctgcgaacgtatggattaaacaatttgaaaatatacgaagaaatgtaggtaaatggggataccgaaatgccaataaaaaatgaaatgccaacaccaactgaccgcctcattgtgcccatcaaaggcagccagaaatggcttcgcgaacatgcgctccaactttgccgcgttcagtgctcgcgtgtactccacctgctgctgaaatgggtcgggcggggcggcgtaattccgaggcactaattttggatgcgaaaaatcaccaaaaatatcttcataaagctgctaacccttgaatatgtcatgttttgtctcgcgttggtattcatccggatgtctggagatcactttgactttcatctgaaagaaaacgcacaaattaatataacagtgaatttatttgccaaaataaattaaattttgcatttacagtaaataacgcatcataaaatagtcagtattattatcatgatttatttgtttgaataactatttaaaatggcaatgaaaaacggaaaagggatgcaccaatttttctcattaaaaaccaattttcggcacatctctgacgatactgcagacaatgctggaacattgaaacatcacaatttatacaaaaaaggggcagagattgacaatgaattgtggagtcaaaaaataatcattcttaattcttatcctttttgcgaccgaaagggggggggggggtcctctctcgcctntaagntacgttttgtcattccatgaaccagcaaatgcttttaatacaaaaaaatatatacacaaantttggaatatattttcaaaaaaaatgtttgactattcagtaaaatgggatttggctgaanggtgcattttgagacatgacagaacgtaataataaaggagtcgcccaaaaaagggctcagggttcgccagcatttccccgtccccattc

SEQ ID NO: 15347 - DNA, 594 bp, Heterodera glycines
aatgatatctctaaaatgcccgaagtgacttaacatggggactcaagaaatcttgccccgacaagaaatgaaaccattaatttttaaagtttgcaaaactgaagatcccaatggtctcaccagcaagtgaaaacgagaacggcgcgagaagcagcgaacggcagcgtaaatagggggggggggggaatggaggaagaaataaatattctcctaatttagatttcgtctttttttttttctttatatttcctacgcattggcctaacccaagcaatttagcttgggacgaagcggctacatttccttatatatattccaatttttactataatatgagtttattttttactttcatgtccatttgagattagcttaaaatatttaaataattcaatgtaatctggctaatgattttatttacgtattaaaaattttcgttattctttgattcgatatccaacttaattttgagaagaatgtgtattttaatcattactttaattaaactcattcatatttttgatttatgcactttctcgtgaagagacccaatctcgcgtctctcgcctcccgtcacccaccgtttccgatgag

SEQ ID NO: 15348 - DNA, 2404 bp, Heterodera glycines
  misc_feature (10)..(10): n is a, c, g, or t
  misc_feature (2380)..(2380): n is a, c, g, or t
tatcagaacncgccggaccctaaaaatcctttttcttttttttcaatttaactcaaagttgcaaaatttggccattttgtggacaaatctgttaacaaatcacattaaaaattacaaaaatttttccggcggcatctatcggcaccgccggcccctcaattccccaagttttttggaaaaagcgccgcaaaaaaatcaacttcgatttttcatgctcagaatctcacaaaatgcttatttcgaacaaaaaaaattactcaaatcgatcatggacaatcaaaaatataacatttgaacattttatacgtgttttgaataaattttgtaaaaatgaggctttttgacccaaaatgaggcttttttgcctgccaaatgaggctttttaaaattttcatctggcaaccctgtataaaatagttaatttgcatttaaaaaagcgatttttatacggtatccaaatatccaaatcgtactgtccagcaacaaaaaaaaatcctttagaatcttggatttgtgcttattttggcatatgtagcagcttattctgtgcttccagtatattctttatgtggaccaacactctgaatgaagttatggaccacgagaattggacaatgaattggtgattagcattttggccaaaattggaatctttccggttcttggtactgagtcctcactttattattcaactaattcccaaggaaaaaatctattagttttgaatattatgattagggatggattcttaggtttttacttattttttctgcggctttaactcgacgagaaacatacgaaaaacacaatttttgttccaaaaactttcgttttaacgcccctatccgaccctaggaatccctattttggatgttcgcccctaaaaatccctattttgagtgtcgcccctaaaataagttttatcccttttttggcgtttcgcccctatttcgcgatttttgggaaaattattaacaagaatgcaataaaaatgaaaaatacacccctaagaatcgacctaaaaattttcaaaaaatgcaccccactcttaaatcccgaaaagttcgaaatgtacttcatttctaactacaatccgtgaataaaattatttgccttaattttaactaatttacatagagaaaatatcaattttaataaatttcaccccgtacatttgaaactttttcgcccctatttttgcccctattttgcgaattttttgcccttatttaggtccctaaattggaatttttccccactaaaaatcccatccctaattatgattgtaaaaaatttcagaaaaatttgactaatgaactgtgaaaataacaaaataccttatacggcccacaaatgacaaaatcggcctaaagtcgcaggctaataaatttggtttaattctggctcgaatccgcaaaacaaaagtggttgaaggaggcgggcggaaagtttcaaaccgaatttctaaaaagctatcttcgatttggtgcgcaagtaaattgctattccagtgctcgtctgttagtttgggagtttccattgccacaaatatgcaagaaaacgcttcgtcgcttggcgtttcattctgcggtcattcctggtggaatgactaaatcaggtcgaccctcagaaaatgctggcgggataatatgccataaatgggtccgtatcgttttggcggcgacgttttggcgccgacgttttggcgccagggtcgttttggcgccgacgttttggcgccgacgttttggcgccaagctataataaaaaaaagaaaacacccaaatttaaaaattttgtaaaacaacaaaaaaaacgtatttttcgcgaaggtaatactgccgatggttggttgccccccttttttgaagaaaatttttttgttttcaaaagtcatgaaaacatgcttccaatggttttcagggtcgctgctcacgaaccaggcatccatttcgaccaattcagaacccggagccgaaattcgaacaaaaaatcgaaaataaaaaatttcaaaattctctttttgtttctaaaatagattaaaacaaccaaaacgttttggcgccgacgatttggcgccatgtagggaggaggtagaaatgatgaaatcgttataatttttctgacgaagtctatcaaagagccggatttaattcttcatttactctttcgctttggcttatgttctcttaattttgtatttaaatgaatcgtcaaattgatacgaaaaaacaaaagcctaaaataacgcatgaaggccagcttcggccggtggtctgatcgaatgaaagaatgtttcggagactcattggcacctccaatgttctaccaaataaattgtttccatttcttcattttgttaattattatatttaacganaaaatttcattttttatttttttt

SEQ ID NO: 15349 - DNA, 3885 bp, Heterodera glycines
  misc_feature (3768)..(3768): n is a, c, g, or t
  misc_feature (3843)..(3843): n is a, c, g, or t
tgatttcaatatatcgagcttcgaaatttcgggtttcgatacttgcgtatcagtttcgagtgctaagccgagcttcgcccgtccctgtctcagaccagcaggaggccccatttcttatgctggactagaactgattttttgaaaaactcccaggaaccagaccgctaacattcgatagcccaaagtgttttctattagcctgcaaaatttaaaatttttgatgaaagttgtgacggaaaatgttaagaaaacatttgagtacctcaggtcacaaatagatttttcaacagaatgaaaattgtttttcggcgcaatcgtttcggcccaacaagtttttggctataactttttctttgtcaactaaattcaacattgttggtatcattctaaagcttaacatgtttataatgtattttaagttattgcttcgcgattagacaattgctaaaaaagttatacatgaaaatttcgaatttttaaagttttatcttaataagttttttacaggcttgcaaatcttttcgcctttcgcagggctaatagagcatttgaagggcttaagaatgataccaagattattagaattggttaacaaagaaaaaagttgtaatcaaaaatttgggctggcaccgaaacgccaaaacggccaatccctttttttagatttaaatgtttggccttctatttcctaataataatttcttattttttacttttattgtaatcgttttcaagaaattgcttgaatttagataatttgattcacatgaaaaatttagattattcttttatttatttaagttgaaaaaaatgataaaagagcttcgagatgaagtgttcggaaagatcgacgagcttcgagatgaaatgaaccaaaaatttggccaaatcaacacgagattggaccgaacagaccaacgactcgaccaaatggacaaacgactcgaccgaatggaccaacgactcgaccaatttgaggtaattttgacagatctaagcttagttgtcggtagttctgcttttgggcttacatttattgttgctgggtttgtttatggacccattgtactttatttctcaatgtttggacagaccatacatttaatctcattgaaacccaattcggggcaggcgcttttggttagcggcgttcgttccccaaaaaatgaccaggattcagtatcgcgtttgaataatttccctcccctccactgatcagcagtatggccctgtgccgccaccgatgccgcttcagtccggccactacagtggtattgaggtatattcccaaattttaattttcgggaggaaacgacgcagaccgcaggttgggaaaacgaactgctccgcttgttttttggcgttttgtcggggccaaaatttgaaaatgcaattccttgaattacaaatacacaattcacagtctacctccgagttttccgagttgcgccagattgggacttctgccgcatttgacacccgccaaaacaccggcagcgaattgcaacgccgccctccatttcttcaccacgtgtccgagaccggcaaccctgtgccaatattggtgcggagcttaactaaaaacctttcctattgataaatttttcaaaaattttcagactaggctgattaactataaatttttgtgatatcagactttcagagttcgatcgggctcaacgctctgttcactcctctttcccatttttattttggcaactgtgttccgtcaatgacgtcgccgatctgcccaaaggacaaagtatatatttggtcgctggtttaattcactacggcttaggcttaattgggccgccccccactctccgtaccccatattcagtttttcaaaaaaaaaaaaaatcaaaatggcgtctattttacaaaatttgtagccgataaattactgtttttgccatttggtcactatttttcaaaaatgataaaatgtgggtatcgcagctttacgttgtacaggtcaggcagtgccgtcaggcaccgtcgggaaaattaaataaagcaatttgttaagaagaattgcttaaatttaaaataaaatttttagtttttttgatgggggggggggggctttagcccctcaatccctcctgtgaatcttttcaaggattaggcagccatttgcttttggtcatccccagtagttttttgcataagatattttttcacgttttctctttgaaatatttttagttttcgggaggaaataaaacggcggtgaatatcatgggccggttttttgacattttctgtaccaaaatttgaaactgcacttccttgaatacaaatgtacaattcacagcccaacgtcgagttcgacgtggacctcggccacgacttgagcacccaaaatgtgggcgatcttttgaaagggcaacgcagcgttttggccgatccgccgatgcaattgtttcctcgccatttgttcgaggtttgcaacagagcgccaaaattggtgtggagcttaactatagtaagaacccatcccagggataattttttttcaaaaacttgaaattaaaaaaaaagtttttgaaaaagatgaaatgttactgacacaaactttgtgaatttcggaaaaaacttacgcctgccaatttttaatgtaaaattgttgaagagtggcgaagcttccgagacggcgtccgaccgcaaagaaagcatgggaaaaggacggaaaaaaccgagcaaagaagtcgctgatgctgggctcacggtgataatattttggctgattacgttagtcaatacctagactagaatttcaactatttttttttgaaaatgtaattattcatattaaaatacaaaaaaaatttagaaaaaaattccattttccttgaaaatttctttaaatattttttctaaaatctcaaagtttgacaaaaaaaagaagttatttttgatatggaggagggaaacggagagggggggggggaaacgttgagcacccataaatacaacaaatgcacaaatcacagccctccgacgagctgaacaaaaccgcctcaattgtgccaacgtcggtgcaaacttttcgtcgccacttgtccgagaccggcaacagaatgcgaaatttggtgcggagcttaacaaagaatccagcccagggaatttgaaaatcataaattttaaggacagcaaaaattattgggattcaaaattggaaacacaatttgcaaaaataatgactaaaaaatgttaaattttgacggtttttaaagggaaaaaaactaaaatccggaaatttttcaagattattccctgatgagaaattccatgggatgtgccaagttcaaattcagagcaagtggcgaatttggggcggagtttttaagatttttggactttctttccattttccatgatatgtttttcagttccgtacgaatacacgcagctattcctttaagaagtgatggaattccattttattttgtcatggttgttgcgagttcttcactattttttctcaggaatttaattttaatttttttacattaatttttggcttaatttctcttaatttttgttttctttttttgttgctttatcacttttttcgatcttttggttttttacaggtctgtttcacttctgaataaacgtgtacttttttacttttggtccaccacttttaagctttgaacgcgatttcaacaaaattttaaaatgctaaactgataatccaaataactgtcctcatctgactgtaggatttggaaaacgaagaaaacccaattaaatttncaaaataattaagcgtagaaagagattgtatccgatcatctgatttcggctaacagggcttgaaggaattaactntgaatcggattttgggcaaatgtcgggtgcttcggtgtatta

SEQ ID NO: 15350 - DNA, 1127 bp, Heterodera glycines
  misc_feature (14)..(14): n is a, c, g, or t
agcgagtgatgtcngtagaataaaagccaaggcgtggctgcgtcccatccacaatttcctagtgcttagtggtggactagcgagtgatgtccgtaggaataaaagccaaggcgtaggatggctgcgtcccatccacaatttcctagtgcttagtgatggactagcgagtggtgtccgtaggaataaaagccaaagcgtggctgcgtcccgtccaacaatttcctaatgcttagtgatggactagcgagaggtgtccgtagtaataaaagccaaggcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtccccgtcaacaatttcctaatgcttagtgatggactagcga

SEQ ID NO: 15351 - DNA, 943 bp, Heterodera glycines
atttttaacactacaattaaaaattccagatttatttttactttcatccattccttttgcattaaatactttttatttacgggcttcttccctctgctgatgttgtacaacatcactgtaatcttttcttacttttatatttgttgcatttgatagtaaatacgcttttcagtttctcaatagactcagtcgatccctttgcgaggcggtgaatgaccaggaaaggcgcgaggccgaggagactctgtcaaaactgattgattcgcaagactgtcttggcaattgtttactgctcttgcaagatggagaggttagagaagattgttggttgccatgagcgtaatcggagaaggaactgagctccaaaaaaattttgcaaaacaaaagggtcccccctattgtttttgataaaattaaaaatttgtcactttataacaagcgccaaatttgcttaataggcccaaataattgtgtatccatgatcagcggcctctaaaacctccgggtacttggtttcagtcaaattcgaaatttacaaagcatgtttaaatactcaaaacgagctaaaaaagatatcaacaagtgatggtttctccttgttttttttggtacataaactcggaattcaaaaacggctatttttcacacacttttctctgttaagcagccatttgcgcaagttgtggccagcggagcactcaagcgaatgttgaacaggaaaatcagcctgagtatccaagatcgactccaattaagtgagggaatttgaaagcggaaacccaaaagaaaagtgttaaatgatttaggaaactacattcttgaatatctgattgcacggccaactttgcctcctttcattttgaattcgttatgcaaacttttcgcgctcctaacaaaagtcggatggttggagaaggagccgcaaacggacgcccctcctttc

SEQ ID NO: 15352 - DNA, 2405 bp, Heterodera glycines
tttttcgggctgatatttatttctgtgtatgattccttcaaattttaggtccaactctcttctgtccgacgaatgctttttgacagcaatgaccgacaaaagtatttggagcaaattgtgaatggcctaaagcgcgttttggaatcaccagagaatctgaacactgctgtaaaatgggcttttgtggttttattcctgttcaattttaggacaatttccaccaattttgccgcgttattagccgaatgaaggccaattaccaagtgtccgaattggtcaaatgcgatagtttttccgagttgttaaacagtctcaccaagttcaccctggaatgtctgtccatgtcccatttcttcacaaccaacagcatttactacttgatctctttctggagcaaactcgccggttccctcggttacgcccgtgtcgacgtcgaattggtcatcagttttcttttattttgttcaatttccgttttttcagatttccctttgcattcccaaagtttgcactgctttcattcagtcgagaatcgcattgtgtgaaagtgttgttaggtcagtgaccgttttctcatcccatgcatttatttgcctttcctttttcagacagggcgtcgaagacccattggacgacatgggctcagtgaagcaactcatggaattgtttaccattctgtcgcggaaggactacaagcaaacggtgaaggaattgctggtcaggttcgatgagagtcttggcattcttttcacgcagggcatttctgaagaggttcaaaatgtagaacgaattttggaaatggtttgaagttaaactttttaaggagcaaattatcgcccggaaaaggctgatttggctgattacaatgatggccgctggaataaacgggaaggcgtcttccaacagcagcgaattggacgacgacctttacgacggggaagttgccgcgcgcgtttggaaggtttgtgccggcgtacctaaccattgcaaaagtcaattgacattttgcagacaatgcaattgacaaacggacgattggaacggcaacatccaagcgttatggacatccaattggagttcgcttacatttatctgatggacgaatttcgcaaggcttacatttccgaccaagtgatgcgtgatagtcaagtgtacgaaaagttggcggaactcggcataacggacgactccgaagtgttacgactttatgcccagaaaatgttgggggatttgttgtgcataatgagtgattaacatgcacttttgccttcttagaatcgtcaatttgacttactggggaaaggacgagaagatcctttcgtccactctctctcttctgaatgatctcaccgtcggatacgcaaatgtgcgcagacttttgaagacgaaggaaatccaagaactgctccgaaaccatgctgtgacttgttcctgattctttttcttttatcgaaatcttttcattgccaggcctttgactttgtcatttccattgaggacatttccattatgaagtcgcggacaaatttctacgcttcacttatgcgcctgttgaacattgaattggaagatgaccccgtacttttcagccagttcatgggtcccataagcggtattataatgaatcaataaacattttttttaatttactggtccttagaaaagttcaaagggattctcgcgatgttccaaagcaattccgccgcgactttttccagcgaggaccaactaaaaatggctgtgattggatttgttcgtgaccttcgaggtatcgcactcgcctgcaccaaaaaagccaattaccagctttttctcaattgggcgtaagttttttttcattcattatcctctaaaatggcactttggctaattgagaatgccaaatgtgttcgccgtgatgattgagtcggtgaagcgatggactgacaatgccgacatttgcacgccaattcttaaattggtggccgaaatgactatgaacaggtcggactcgactttccatcgctgcttttattttatgaaccgctttagacagtcgcggctcacttacgacatgcacagttgcatcaccgtcgtgctttttcgccatgtttcctccgtcctttctgagtacggtaatcgctttttgcaacttccgtcggtgcccaaaggccagcactacaaacaacgggtcaaaaacatcggagtgatttgtcaaattctgcgacacgttctctccggcaattacgtgtgttctttttttatttgtaattttggactctttatttattatttagcttccgcatggcgttttttggctttacggttagtgaatttgaataaataggcatggaaagaattggcaaatgaaattgacaaatttttaggtgacagttgccttaacgatgcgctcgacatcactttta

SEQ ID NO: 15353 - DNA, 2902 bp, Heterodera glycines
atcatttatataactaaaaattgtacaattcagatcacaaaaaacaattatttcttgctaattattcgtcatgaagcgaaccaacgcatcaaacatcactccgcctcgcgcaaaacgttcaatggcacctgcactggacctggacccaaacactgttgcactcgcagagcaagaacgacaacgcactttggtgttcattggcctcccggaaagcaatgctattcgcccatcggaacgtgttcaggaagacagggaagccgccacaaaaatcctggaccatcttgaagttgaggcccaaccaaccgccgtctttcgactcggacgttacgacccgcagcgaacaacacgcccgctcaaggtggtcatgccaacaaccacacaccaacacatggcactcggaggatggaagcgcgagcgtgctcgactccgttctctacaaaacctgaaccgcctgttcgtccgcccagcgctgaccaaagaacaactcaaggaagaatatgaagcgcgcttccgaaaacgtcaacaaaaccctgctcccgtggcaacagcaatgcaacctcgccagacaaatgttccgactcccgtcaaagaaaatggaccaaatcagaaggaggccagcgacgacatttccaaaccgccggaagtttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaaaaaaaatacatttattccagtacttcacatttctcaccaaaatttttcctcaaaaaaaaaaaaaaaatttttttttttctcctacaaccctaaaaaaaaaacaaccacttttccctttgttggaggtctgacttttctaatttctgcttctccattcaaaatttcaattcttttatcactgctttccatttcacctcatttccgccaaaagtgtaagtggcacatgtccttcttttggttatttttatttttgaataaataaataaataaaaattgaaaaacttgagttttcgatttttgttcgaattcggatcaggggttcggaattggctgaaatggatgccatattcgtgctcagcgaccccaaaaaccttataataaatatttgtataaggtgtgataccatcggtactattaccgaatcgagctaaaatttctcaaaatatactcctatgaaatgaaaaaaattttctcaaaaatttactttcttggcaaaaatttttaattttaaaaattttttaggtaactattttgggttttttggtcttaaaaatcccagtcctactcatttgcaactgcaatcagtgaataaaaattatttttgctcaatttttggctgaaaattatgtcactattcgtcactatttcggactttttgtcactatttcttcactattttggcatttttactcactattttagttaactattttgggatttttcgtcaccaaaagtcgcatccctagtgatcactgatcagaaacggcaaaagcagaaatgaattttgattgattatttgatacgattatgagacggaatgtttggacctttgccatttaagtgagccgtatatgatttgattttttgctcacgaatttgatcataaaaacattgaatttttattgtatgaactgctacatattgcccatcaataagacaaggaaacgcataaatggctcatgaattctatttttgccgttaggcgccgccgggtgaaattttgaaaatttgagtgcaatttgttaacagattttcaacaaaaaaggctgatttttaggactactaggcccaatttgtacgggttttctttaaaatatgtggaatttaaaaaaatatgaggaatcatattttgtcaataggaaacatatgagtagggcccggaatttagtgataaaaaatccccaaataattaactaaatagtgacaaaaaaatgccaaaatagtggcaaaaatagtggcgaaaaagttccaaatttagggggtgtaattttttaaatagctgttttttaatttgaaaataatttaaaattgaggtaaacaattttattcactgattgcagttacaaaatattttcttagcaaatattgaacaagaaaaaaaaaatttgggggaagaatttttgtgaaaattttccaattcttaggggtgtattttttgaattttttaggtcgattcttggggtgtatttttcgtttttattgcattttttgggaaattttccaaaaaatgccaaaatagtggcaaaaataatgacgaaacgccaaaatagtggcaaaaaattattttagtggccaacttccaaaatagttttttttagtggcgaagctccaaaatagtgattcctagtgatgaatagtggcgttaaaacgaagaatttccgaactaaaaatgtgtttttcgtgcatttctcatcaaaataaagccgcagaaaaaatagttaaaaaactaagaatccgggccctacatatgagtatacgaaaagaaaattaaatataattcgatttctgtagagggattgaacctggggaaagaagtagaaaatcaagaagattagccactaagccatttgcacaatttttagtgttacttttagactatatcaatttttttttaattttgcctttaactccaattttcagcattaaattttcactcagacccccttcttaccagtgcttgtttttcccggttgccctaccgggaccgggaaataaatttttaaaattcgggacctcggaggaccgggaattcccggcccgctctattctagtctattggatcatctagaagaacatttgatttttgtaatcaaacaaatgaaaccaacat

SEQ ID NO: 15354 - DNA, 3275 bp, Heterodera glycines
atttctgttttttcttccaaatttgatctctttcccttttgttcttttgactttttccaatatttacggtaaattcttcttttgtctttttcagttcgattgtttgcgaatcaattttatgacaaatttgctctaattgattcaaatcatttttttgttttgttgctttttcatcattagcaaatgcaattaacttggctaataagtcaccgttttctggtaaaaaagcgttaatttgtttcaaatcctcatcagtaatataagaattcgtattttctttgtcaattttaaaaagtttttcccatttttgtagcacttcttcaattttttcattcattccttaaattttttgattgtcttttttccgttttatttatttatttttattgcaaattgctgttaaagttttgtaaaatcaaattaatgaacatttttggtactaaatttagtcacattattcgggatggatttaatatattctattctaaatttattctaattttcactggcctataataattattaaagtaattatgccattatcaacttgccaatttccaaattttttgtttctgctttttctctgctctgcctttttgattttgactttccaactccctaaaaaatgcattgataagtcattctctcagctgatttggaatttttggcccaatttattcttaaaattttgcaaattttttttatatttttagtctattttttctcaaaaataacgacattgagtctcggtggtgagggaaaaaggatccatccaaaaaaggaatttaaattgaaaaatatataaaaaggattatttctatggattatttaaagcaacctgcacaattaaagtgaaagaatacaaatataagagaatggcaagtgttagatgaccaataataagcattttaagcaaaaaattaatacggaattctcaaaaatatttataacgacgatttttggagatgaaaattcgtaaaatgggatgaatttagttaaaacaaatggagcaaattttcttcaaatttttcagattgatataaaataggatcgatttacacattgaaaatgtaaaaaaaatttatagaatacaagtgcattcattcttcatataattgatattttttagtaattttttttttgctgaacaaaaaaaagaaatttacaaaataataaaatgcaaattaaaagttaaaaataatgcatcattaaaaaatcaaagtgaaaattattattaatttagccaaacgaatggcatttttcaacaatggcactttgttgtgctactcactaagagactataacaacaattcagttggtaaaatcgttttggttttttaatggctaaagagcttttaaaatctattaaattagagagttgaatttttaaaaatgccggcagctgatgggcgttgaaaattgattgaccggtggtaggtagagccggccctttttcaaaaacccaagtttttgggtgcccccagtccacgttatttcaacaagaaatcacggggcggattgcgatacgcttttgccactttaagtgtaaattaattgaaatttcatttttaaatatttatgttcaaatataaaaatttacaaaaattgcttattaattttcaagtaaataattttttttatgattatcaaataattttgcctttcatttcaccatacaatttattaaactgttaattaaatttaatgtcaaatgctggcaatgaaaacatcgaatagtgcggttagtttttttaaaatttgattttcgatagttttaataacttatcaatagaaagagaagctaattagctaattacttattattaattttgttatttaaaaatatttatagtttttctttatgtgttaagtagaattgggattttaattaagggaaaaattgatttaattggcaagaggtttcgtcagcataataaaatttaatgaaaatatttatttttctttgggaatttgtaggaactttttttttgtaaaatcaatagagtcactataatttttacaataaaataaatatacaaatttttgtttaagaaaacatttaattattttaatgaattgtttaaaaatgaaattattgcaataattctttttaattatatttttggtcgcccaaattactcaaatcgaaacagaaatgaaaaagttggaacaaaagtcatttgaagaaatatttggagaaaaatgggaagaaaaaggagaagaaagattggaagaaaaaagagaaataattaaaaaatattatcaaataaatgataaaattaacccaaatagaaagaaaatacccagaaaataatgcaataaaattgaaagaaaaatagcgaaaaaattgggaacaaatcgaacttatattcaacaatggattaaagaatttggtcttcagaaacaaatactaaaagctacaaatcaaaacatgatgaacaaaagttagaaattgttcaaaagtttattgcaatgaaaaatgaatataagcaaaaaagaaaatattcaagaaaagaatggaaccaaaattatgcagaaatttgtaagaaaattggagttggctatgaaacaattaaaaaatggaagaaacaatttgggatttgccgaaaaataaacacggagaaacaaaatggataaaatgaaattttattggagaataaaaggagaaaatacaaaaatgagtaacacggaaattgcacaaaagctgaaaattgatagaaagaccattttgaactggaataaacaatttggtgatgaaatgcaggaggattgaaatcatcatttgatattattttctcatttttgtaatcatgagaacgggggagatttattttcgaatcgtagaaaagtaaattgttgtaaattaaaaattattgaaaattcccaaattaaattaaataaataccgtattatctctgattatccacccggggggattatactgaaaaatttttaaaatttttttgaacatgtcgccaaaaatgtcatcgcggcaataaataataatgttattgcatttttgttacagaatatctgaattttacatgaaaaatttggaaaaattccatatatttaccaatggaatctttttgctgcgtttgtaaagcaatttatggggaaagagagaataattcaccaaaagaatgggaaaaaatttattcaaaaatatcaaaaattttgcacgaaaaattggagtttcgcaaattccactattaaccaaatggaaagaaacaatttggaatttctggaaaaagaaaaaacagaacaaagaaaaa

SEQ ID NO: 15355 - DNA, 3010 bp, Heterodera glycines
  misc_feature (2929)..(2929): n is a, c, g, or t
  misc_feature (2975)..(2975): n is a, c, g, or t
  misc_feature (2982)..(2982): n is a, c, g, or t
acgggggaaatgtgtgtgaattttctggccgcccattttgccacgtcatagccatggttgttccactgaaaaacagcggattccaattttattgtgtagagaattgtcgattttttttttgtgaatttttggcttttttgactcatgcgtcaaaaattatcaggaaaatcggtaatagtgccgatggtagccccccccccccccctccttctcaaaaaagtcattttatgagatttcaggacggagaattttattctgatagccatttcgacacaattcgaattccgaatccgaacaaaaatatgaaatttaaaatttttctagtttcgcatttttggttcaaaaccggtttaaatgtaaggaaataaactaaaaaaggaaaaattgacgaatacggtaccaacgaaaagtcgcataaacacttttataggttttcttaggcgctgagaacgatagaacagctcaaaattgggcgcggaaaagcatttaaaccggtttaaaactcgaaaaattgagaagcttcaataaatatcttttaaaccgattttagaccaaaaacgcgaaaagaggaaaattaagtttgattttttgttcgaaattatccaaggttcggaattaggccggacacaatcggattttgagctaagtttaaagcaccataacttttttctttgttgaccaacaaacttggtatcattcgaaagctcgcaacaagctttattggcttttcaaaaatcatagatataatcataaataaaaatatgcaaaaattctgattttttgcggttttcgtgttacatctttttataagttttaatcgcttagtaaattcttttcactacactcaccggtgtcacatatcccagcgtagcaccgctcgtaaatttcctcttcccattgtccaatttgttaaaatcagacaaaatttttgccttcaacagatcgagctgcaataattaacattcattgagtaaggcgtggattttaagttacgaaaaatcccttgttaactaaatagtgacgaaaaatggcaaaaaagtgataaaatagtgaccaaaatttttttaaataaatttaaataacattttttgttcaaggatttttccataagattttggtgtaaaatttgctttcccattttcgtgccctttttgataattaattgtcttaaaatgcacacatttttaatattgtataatttttcatcccttacattgtcctccttctcctcctcctcatcctcctgtttaatttcatccattttgttttggtgatgtccattattgtccgtgccaatttttcgctcggattttggcattttcccatcggtctcttcgaagaaaaataaaacaacacaaaaaataataggaaaaaaatgtcggaccatttaagctaactgtatgaaaaatgcttttggcttaaaacggcccgaaaatggaatttattggtcgtcgaaaagagtaaataaataataaatacgctaaataatgcaaaatggaagaacaatcgatgacggacgacaacgacacgacaaggggcacatttgccttttcatttgcgatgaaatctttcagttttttctcagttttttaaagtaatttaaaccataaaatatttaaaaacattgaaaaatgttagtaaaaaaacaccgaaaaatttactcatttattctcttttcttttcgttttctttttcgcagagaagcaaaaatcaatttcccttttctcttttcatcgcttgtcctttcctttctcatttttttatcctttgcaaatgaattaaaggacaaattaatttctcatttctgtccttaaaatcagaggcgtcctttcgcgaaagaatttaagccaattttcaattaatgataaatttttgcatttttttgataattaaactaataattaaatttgcaatttaaattgtaattttatttctttctaattgttatatttactattttcacaaatattcaatcaaatggcttgttctgttcgtcttgatccccacattttgctcccttctcatttctttccgaaatttcctccccatggtccgccgccgcccattccgccgccgtacggcgaaccgtacattccgcctaaacagacaaaagaattatttacataaatattctgaaatgttggcacttttaaattgaatttcatttcaattttcaaaaagccttttttcgaatgatttaaattaaaatgtttgtccatttaaatttggcatgtaattaattaataattgcttaataaaaactcacgtctggcgcgcagagcagcaggttcattgtcaactctctcttcttgcgcggttatcagtgcggaaaaagcgcacaaaacgaccaaaagaaaggcaatgataaaacggagaggcgacatcttgagagtaattagtgcgagggtattaaaaggtaattaagtcaattatgtctgtgtgagttttggggaccctcttttatagtgtggccttcttctgctaatgtgctactgatcttcggtttgtgccagtttttcttccttttttttctttcctctttagtaaattttttttcagtttgacaaacaaattaattagggagactaatcagcgctaattggcaaatcggcgcacaaaaatcagtggtgaaacatatttgtttattaaatttaattttgtcgtacaattaatcgaaggtgttcttcaaacttgctgctggtgaaagtgaatcacttgcgcaagtttagtgacttcacaataaaataattattctttcccttttgggcaacaaaatcaaaaatttaattgcccatcatttgtaaaaataattaatgcaataaaagaaaataaaattaatttctccatgtttcctccagctaatttttaatattagtggatagagctgagaaatggcaaatataaagggaaattatagaattttcacttnatgtaaaattatttccaaccatagttttaaaaaataagttaatttncttaagntatttttaaattaaatttatcttttacc

SEQ ID NO: 15356 - DNA, 1259 bp, Heterodera glycines
attttacttgtcccaattatgacaatccgcgcggggaccgaatccatcgcattattcatttttgcaaaaattgcgagatctaataaaaaaatgatgtcagattcgatattagctgattagcaaggccagccaaaaacccctcggtaaacatttaaaaaatttttgcaagcaagaaaaggttccccaccactatggttttaataaaatacaaaagggtatttgcaagggagtgccatggttttcacaaattaattttgccggaattgcttattcttaagcagaagcggcaaatgtttgaaaattcataaatagtgccaagaaaatttaaaatgaaaatgcatatataaatttaaaatgttacctatttgtttcagtttttaattagttttcatttttcaaaatcataaacctctcaatctttaggtacaaaatgctgaagcggaagcgttatttgccaattgatagttatttggaagcgcttacaattccgttagaacggaaacaaaagcgagaccaattctaccaaaatattcgctcgttctacaaaaggaaatggtgactatttgtgcaaaatagcattgttaattttctgtatttcatctcaggggcttcgatttcaaggcgccttcagcgaacggacaggagctcgacctttttgagatgtacgaagcggtcacttttctcggcggctggcaaaaagtgacagcactgaacagatggagcgaaggtggccactttacacaaatctttctgctgattttgacatttttggtcgatgttcggccaactaataataatttattttactacaaaagcattttttgccccgagtaaattcagccgttagcatttgccaattttagtgctgcaactgctaaagattgatgaaaatattcaaatggctgagcacgccgttcaattcctttacatgcgctttctcagcaaatttgaacagagcgaagcgggcaacgacatcagcgaagagcacgaagcggaactgatcagcggacgcaccaatcgtttcaaaacgtttgcctccctctcacaagcgaactgtgcagagccacccttttctgcaccaaaaggtcggaaaatgaataaacttcacgggagtcgctgatcacgaatcatcttaagaaaaaatgcaaaaaaaagggcggtgtatgcggcataatggaaaagtagccattcatttgcaaaacaaaaatccttggttttttattttttcaaaaccgtcacacttttccgtagcacaaaaa

SEQ ID NO: 15357 - DNA, 2016 bp, Heterodera glycines
  misc_feature (24)..(25): n is a, c, g, or t
  misc_feature (61)..(61): n is a, c, g, or t
  misc_feature (1874)..(1874): n is a, c, g, or t
ttataatccggacgggatgaaatnnacgcgacgggagtgaattgaaaggacacagcgccancttatggcgggcgaccgacttcgacctcgacagaccgaccaattgggagggtcttcaacattttggccgtcttccacaatctttcgtttgaggaggcgaacacggcccttatgggcgaaagtcacgcgcttgtcaggtcgaaattggatcatgaatttcagtttgttttttaaattatttttcaggtttttgctgctttgctccaattgtcggtggcatttgctgcgtaaaattgcctatgatacactgagtaacatcgcaagaaatgtttgtttgtttgttccccgctaataaaaatgcatttctatcagataaaattggtcgacaaattgtccaccgttttgctgaacaccgtccaaaagggtctccactcggacgacaaatgcaaagtgatgcgatccatggaaattgtggctggtttatgcgcaacgccaaccaacgagtcaattgtttgtgaattcttcgaagaatcggttccacgcttttaactgtgtttttagagtaattattaatttatagcaaatcataccgcggattttcgctcttttgtcactgaaggatattttgatgtgtatgtgtgccatggagtccgtgttggccatttccgagttgggacgggtcgcgtgcgaagccgtcgcccgctgtgaccgcgtcgttgaaagtcagtggcaaattaatgctttttcattttataataattagtttttaatcatttctgctgtcttttagtgctcgtcggctttttgaccaccgatgccctttcttttggcaccgtcggtttggcggggatgcacgtggttgaggtgcacggacaccaaaccaggccttatgttgcggttagtttccgtcttgaaaatcacaattaaatgatttaaaacttcgcaaaatgaatcaatttttagccaaacaaaaagaatcctcccccgccgcttaaacttcaacccgtacaaccgcccgttcaatatgcgcaacaacggcaccaaacgccggcgagcagtacaacaacaacggcaccaccatttggtgaagcgatggaatttgcaataaatgctcgcacagatactcttgaaacatgcccaggtaattgatattaattaattatccctccgaatgctttcgtctccttcagatgcctttcatcgtcgtgcaaccgatggcaatgactctgctcaatttgcctctcatcagcgtcatccaccgactcgcaaaaaagtttatctgaaatcttcgcgcctgccttttctcaaccaccgacaacaattggccaccgatgctccgcctttacaaaatggcctttcgtcaattgctgccgcggttccgtcgtccattgaatctgtggcgaatgaacgcgactttatgtgcgaatggctgatgcagtcggagggggacgacgattggtcggacgaggagggcacagcagcggggccaattgagccgtgcgcgaggtgtgccgggaattgcatttgtagttcttatacaaaaattccagactttcccggcggccgaaccccattgatttttgaaaattttatctcaaaacagcaaaaaattgaattgttcaatttttatgcgcaaaaccgctgaattactacttttttggcctgaagagcaaaaaaaaaaaactctccggtgccctccccaaaatggttttatgtggatactggcctagtctacggtctcactggccatttctcagggcattggttttgttttttccttttttgttccccacttaattctttcgtctggaatttcacaggttttttgcttccgcctcacaaatgcttttccacgtgtacaacgaacattgggntgccgcttgtccaacagcacagcgacgggaaccggcgaggatcgctctgtcgttggcccatttgcgacaacactcgcgcactctgtggtcatcacaactcatttgcagtaaacaatggatgagtagtgcattatgaaaatgg

SEQ ID NO: 15358 - DNA, 3018 bp, Heterodera glycines
ccaaaaaactggcggacggggggcattttcggaattccgacgcagccaaacttgccttttgggtcggctcccttttcgttttgaatggcattatgcgcccggcatcagtttttcggtaaagctacacgaattttattgtttctacaatttatccattttcagcgtgttttttgccatcgctttctgtggccaatccgtcggtcaaattaggcattattttgggctttgtctttcttccctttccctttgcttattttaccgttttcagctcatccccgatgttgtgaaggcgcgtttggccgggtctctgctcttccatctgatcgaatatccctctctgatcgattccctttctgaccgtgggaatgatcaggcaaaacggaattggccattccaattggacttaaatattcagaaattcgctggctagccgtaacatccgcaaatttggaatttccgagctctagtttgcaatgcgataaattttggcaaaaatttcaaaaaatcgtaaatttaaattattaaacaatcgttgggatttggatgccaaaggcgtccttgaaaaccgatttcatccattctgtgagggttaacaaggttgttaaaaacaaaattttcgtcggactttgatccaaaaagttaatttttttttttggcactttacctatataaaaaaagcgtcgccttaggtgaggaattttcatattattctttaaaagaattttggcaggtattaacaggaaaatggaaatctccaaaacattgttttaaaagtaaaaatttttaaaattttaaattttttttcctggaaaaagccccaaaataacaataaaaaatttggtaatcatgggtaaataattgtcataaatttaagtgccctcagtttttggcacagacgaaatgtcaatggcaaaagtaaaattttgacagcagcgctcaattggtaacggaccttgcttccgctccaataggcctacaacaatttccccacttttccgcgtctccgaattgtgccattgtttaacaatcgcctaattaccgtgtcgttagtaattagtcagtctattataataaagtgcccgcggcaaaaccaaaaacaggaaatttttcgaaagaaaataaattcagcaaaaaaatgaattaaatttcagcgaaagtactgcaaaaaaatgactctaattaacggaaaatggcctaattacatttaaactgccgttggaccaaaaaatataattaactttccaaagacaaaatttatcgattataaatgtttaaagtgaaaagcctttattattaaattaacaataccaaaagccttacacataattaatcagattgcctcaggcgcccacaaatgaataaaatttaattgccatggccacaattcacaattattcaattaaatggctgcttggccgaaggaaaagcgcgaaaatgaatgaatgattgaattgaattgcattgggccaaaaaagaaaaatatttgaaccgtcccggacaaatttaggagcaataacaaatgtcgtaaatgaatgatttgattgaattgcctcgggcaagaaattttttttttaattatttgaactgtatgcgggacggacaaatgtgctgttgacaaatcattccgccccccccccccccgcttgggtaatgtcttgggcccagaaaaaaatgatatttgcctaatgagattggtttagttttggcaaaagttaattgatttgtggctcgttggcattagcttgtcaggcacctttcaatggttccccagctttattaaatagcggttggcaacaaatataagtccagggcctttattggtcagtgccatttgtctcaaaatgccaaatttggcgaaaatggctaaaaatttcacatttttcccacgaagccaaaatttaggataattcagcaaattttaaggaccagccaaacaagaccacaaaaaagtcattttgctcatcttgacaataattagcattgcccatttgtctggaaacaaattggcattaattagtttgttctgaacgaagtaatttgtcggcatattttgcactcggcacggacggcacagcacacacagttcttttttttgtagcgtctgtgtgaagtgccgccgccgtcgccaagtgattttgtacaatatttgcacacattagggaggcaaaatttgttggcactgtgttggttgtgagtttttgaaatgccaatggttgagtgataagaaattggagggaaattggcattttggtattaaaaaaattttccaaaaaaaaaaaactaaatgcttttatgttaaatcaattaaatttttaagagaataaatgaaatttatgataaaattaaaattcatctgccgcttagctttaattaacattttttaaccaaatcttcgattataacaaaaaatagtaattctaaaaaaccctgaaatcattttcaaattagcataaaaattgcaaaaagaattaaaatttcaaatttcaaaaattcaataaattaattagggaatttactgttaattgaatgaaaatgcttgatggaaacagcatttttgggtcctggcctttgtataaataaaatttgtggaatgagaaagggcaacatttttattgcgctcacgaaaatggcacggtttttttgttccaaaatttgttagccgtgccaaaatcattggtccaacatttgttgctcgcgtgccgaacgcatataaaaacagaaaagttttttccgggcattacctggggtggtgtaaatttttgccgccccgggggctgtcacgcaattttttttcactattggtggcacaaatggtgcatttcggcacaacacatcatcgctcatcaaccaccacattctatgcgcgcgatgtgccaatgctccaatattttaataattcataaccattgcgccaatttcttgccgagaatttctcgacccatttcccctcgggggcgctaaacttacttcttttcttttttttcttttccatttaaatttttcttttcacctccgccg

SEQ ID NO: 15359 - DNA, 2641 bp, Heterodera glycines
caaattatttggaggcaaaaaatttacccattcaatacattgcacttttattattcattgtatttttatatattttataatttaagcatattacactattatactcggatcagttaaatttgaatttaaaaaatttctttgagataaatataaagagtgaagtgataaaaatatggagttagtcgtttttgtgggaaagttgacatagctgcaaatgtcgggacacaatgaatgatccagacctttttctccaacaattcataaatatcaaaattcgtgctgtttgagacccaaaaaaccaaagtttttatcgagtcgtcaggctcgagaccgactctcgggcataattaattaaaataatacaattgttgcaattgaatgggattgaatgtacgaccgactgaaatcgatcattaattaaggatcaaattacatgtaagaaaaatcggaaaatatctgtaaaaacccatattgagagaaatgttcaattttaaattttatcattgaaattaaaatatgctctgccacaaaatttaagcacctgaataccaccataatctaaacatcctccaaggtggtcggggagtgggtgacaaaaatttggcatcccccaggtattggatccgctttagcaattgtccatcatagtaataaaagcaaaaccgcagtcagcaaaaaaaattccaatttaaatggtttcagtattgaaaaaatatgcttcttacaaaattataagtcagcttagtttttggtgaatttgatcactttaccaagcatatctttcccctaattcttaagaagcatacaaaaattggaaaattaaaaaaaaaattatgaattctttttcgaaaattggccaaaattttctgcttcacctccggcgggtgaatgaagcaatgagaaaatcagagaaatctgtgaaaaagttttgaaatttttgacattttaaaatttaaaagcctattagcataaaatagacaattaactaaattataacgttaagatttgtttattcatttgtcaacccaaacgaagtccatttttggtgaaaatgatctgtcgagtggctgaattgacaccaattcctacggtatcgccaacaccgtatgaatattcgacatttattccctttccggttaatccaaatcgcgccatcagtataatatgcataagtgccctagcgacttagaattgctacatccaattttgtgcgcagtttaacggaaaatccaagtctaatccatttgaaaaattaataataaagggatacccaattaataataattcaattttaattaatataaaacttttctgaatcactagttttgttatcattggtggggcctcggtttggagaagattagccaatatttttttggaaattcaccaatgccactgccattttagcatttaaaaatgaagccaagccaaataatgtcaataaataaaatcaattttgggtaaaagatcttttttggctgatcgttgatcagtaagtaatcaccagaaattaatgtttgcctgaaaaagttgcataaaagttttatgaaaataatataaaaaattcttcaaaaatataataaatagggaaatcgttaaatttatagattgatcccattaacaatttgtcggctaatctatctccaaccctctgaccattaaaaatcttgatcaacccattaaccccttttcacgtataccgccagcctctaaaaaatttcttttttaaaatggccaggtatatttagttttttggagattttcaaaatttaattctaaatttttttaaaatttccaaaatcccgtaatcccgcgtgggattgcgggattttggaaaattcgaaaaaatttcaattaaattcaaaaaatttccaaaaatcaaaaaatgctgaaaaataaatttttaggggctggcgggatgcattaaaaggggctgatgggtcgactaagatttttcgattggatccgacggtaaaaagttgatcggaaatcaaattattaacggttcataaatttaactatttttttcttttcaaacccacttttttgcggtgcaatttttcaaaaaactaggaacagggggtccggcggtccttatcagggatggcattccgaggccccaaaaattttgggaagtcggaattccgaccccaaaaatgtcggaaatcggaagtctttccgtgccatacctgatgcctatcgacatctgcgagaaatttttgaaatttaatgcgatttgttaacagattttgtctaaaattgaccaaatgacgcagtttttaactcaatttctacaggatttattaagtaaaagccaatccgggggtgccgataggcgccgccgggaaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaatcaatattttgcggatcccgctgcgggattggacctcaaaattctttgcgggacgggattccgcgggattaatcccgaaatcggagtgcggactgggatcccgcaaaattccgcgcgggatcccgtcccgcgccggtctctaat

SEQ ID NO: 15360 - DNA, 924 bp, Heterodera glycines
  misc_feature (880)..(880): n is a, c, g, or t
tgagttagagcctttttcttgtctaaattttcctcattttatttctatgcgaatattcatttttataccgttcgtcaatgtttcctattctgttgatcatttgtctgtcagagtgaaacacccaataatttatatccccaacagttttgtattcaacgcttttcatcaaaaacatttattctgttgattaaatagacaaatcattcattcatcaccagaccacaaattgcttaagaagctgaaacagaaagaagcacagtattttaacattagaccaaaatgagtaagggtcaaaatgtcaaataaaaagaaatcgcagagagaggggagttctcagatattcgtagtcggacttacaattaggaatttaatattgtgcaatgagagcacataaaaacggaataattaaaaatagccagaaatcgcggcctaagaattgcatttttcttcaacaccacaattttcaagccaaataaaatgtttctcacacgtggggaatcctgacaacttcctaaacggaatggaacattagcttggattggtgtccactcataacctgcgcctgaatctttgctgtgattgcagcggctgccatcgcagcagcggccggcaaagcgctggcgtttgggttcggcgtggtgctcaaatagttcaaagcgtcgggaggacttatacaacgtccgatgaccaaacactgaccaccgaaattgaaactaaacgaaccaagcaaatgatgtgaggattagcaaaagtcgtcaaataacgaacccattcattccttcgactgattccttcgccgcttgggccgttttgaattcgatgtagccgaaactcctaaacaataaaattgttaagtgccaaccagtggaagtttgtttgngaaaccaacgaacgaaagcgacggatgaaagatatcatttttta

SEQ ID NO: 15361 - DNA, 2172 bp, Heterodera glycines
aaatgcactagcacctgtctccggcaattccactcttcattaatcacttttttccatttctttaatccctgtccaattttctgcgtttcttaacactatttctttccacattgatcagaagttaatcttctgtcagataatctgttgagatgatgttatgacattactcaaaaaaccatcaaaattaatcgtgccttcgtatttcttttcatatattcggcggtctcataaaattgggagtccctctgttaaaccccaagttcatttccgttttgcactctttgaatgattgactcaccggtgacacttttatcgtccgaccgcccatcattttgccgttcatgtgttcctgtgcgagttgagccgcttcaggcacctcatactcgacaaatgcaaagcccttgtgattctgaaaaaacgaaacaaacaatccaagtgttcctccccgagggtcggcccgtcaccccggtggacggatcccggcacatgttgatcagtttgatgggcccgtacggtgcaaacacttggcgcaggtgctcttcgcctatgtcgaagttgattgacccgatgtacaccctggacatgatggacagcgcctgtgtgtagagggagacttttgttgctgaaattgggggacagcattaataacgcacaatcgtcggacaaagagcacaaaatttctgctgattttctgtgtttgtttgtttgtgtgaattgtcccatcacactcccttttagtaatttccttcttaatgggagaaaaggtgaaaaatgaatggttaagcaaatgaaagaatggttcgtctgcagcgggtcagtcttaccatttgcggagtccattctgaagggaggggcaacaaataatgactttgggaaacaaagcattcatttcccatttggacaacggtcggagggataatgccaggtcacaacggtcgaccgactcaattcccaaaacacaatgccaacgaatgcccattcattgtcagttttggtcgggctcatcgtccgatcacacatcacctgctgttggtgtgcctcgcgctgtttcagcatcacatatttcacggattggtccatcgcgtaacgcttcgcccgttccaagtcctccttttcataagtgcgcaatttcctaagcccaagtccgatcagttgtgcttctttctgctgcccaggcccaacaaaaaccttaaattatttgtatgcaaaagaaaattatttatgccactgactcgggcggtttgttgaagcaaaggcatagcgacaaatttggtggttggggctgcggacggagaatcgacggatggcggagtgctcgtcgcataatgggctaaaaatatgtgacaattattggctatttattttaatttgctggtaccattttgttgcggttgctgcttcatcccattctgttgagtcacataactcgcgtaaacatccattttaacaaaatgccgacagacacttattaaaacaaaagttgcttgctgaaattgttgcaaatagcattgcgataatctgtgtcctgcttgtatcccatccgtttttagtaatacatttgggacatgtacatttttttgtcttcaatactttctatgcctcagaaaaaaggaatcgattttcctctccaactgcacaccatttatatgcatgtctatgtttatttgggactggtcaactgagtcacaagatattgaacagagtagggttagacgggaacgggtatttgggcaaaaatcgggtccgggtattgaaaagccgggttcggtacaacattctacaccgggtacccggtaaaaccgggtatagaaaattttcttaatttttcaaaaaaaataaaatttcacgaaaaatttgtactttgtaaatacaagtatttaaataaaagtatacataattttaattcgacagcaaatcaaataatattttttaaacttcatttgacaaagaaatttcagtaattaatagagaccggaaatttcaaatttgcggatcccgctgcgggattggtactgaaaatttttgcgggacgggatcccgcaggtataaattccgcatttaaaatttgcgggatcccgcgcgggattgcgggattttagaaatttcgaaaaaatttagaattaaattttgaaaatctaaaaaactaaatatacctggtcatttaaaaaagaa

SEQ ID NO: 15362 - DNA, 3898 bp, Heterodera glycines
  misc_feature (80)..(80): n is a, c, g, or t
  misc_feature (2691)..(2691): n is a, c, g, or t
cccaaaagttttttgaaaaagcgctccgaaaaaaggtgatgtgaaaatcaaatctgaatttctattaatattcgatgatntagtccaaaaatgattaattgtttgaaataattgaagaaaatttgtttgaaaattttcattaatttaatttattaaataaaaaaccaaataattttgtattattttacttgatataaattaaaatttgaatttttttttaatttttaaaatttttttgaatttttaaaatttcccggttggtcccggttcccggtttttcttgcggtcccggtcccggtcccgaaaaaaaatcgaggtcccggtcccggtcccgaaaaaaaatcgaggtcccggtcccggtcccggcttctcaggtcccggcaagtcccggtcccggttttggcaaaaattcccggtcccgtggcactctaatattaatcaatcataaataataatattcacatgaaattgtattcccggacttcctttgccatgtcatcataattacatagtccaaatgattggagccggaaattatggcaaaacattaagtctacaatttggcatataaaagtgccaaaaaatcagggaaaaaacacaaattattaatttaattaatttaaatattcatattttatattttgaagtatataaaaaatgaacttctacaattggtacatcaccgtttttctggtgatatttgctttgactggcatttgcaaatttggtaattattaaatataaattttaaatccacgaaaaataaaaaataattttattcacaggcactatcgcttcacctgttcacaatgaagaagatgaaataaaaaatgctcagccacgctttgaaattggtttgagaacaaaaaagaaattaataaaaataacaaaaaaaaaaatccaattttttatttatttaaatttaaaaaaattaagaaaattctcttttctgaaaatttaaattaattttccatttttaattaagtaataaattgcataatcaaaaaaaaaaaatattaggtgaatcatcaagcaaaatgagtggtgaatcgaaagaaaaacaaccggcacagaaaaacccaaaagctgagactggtaaaaaattcactaaaaaaattcattaaatttaaataaattttagaaaacattacactccataaaaataataaaaacttttcaaaacttttctgaaaatacaaagcaaattttttctttttgaacattagattcataaaaataacaaaatttactaaaatttcggatctatgagccctgccgttctgtctgttatcaaacagcagcactcaaattacccttactcgtccggcggagtcgaacccacggcactttcaattccttggtgggctctaaccgactgagctacgggcccaaggagattattattccattcctatatcttggatgctctcattttcaatcattttttggcaatggcaaatacattttgccaaccaaaaaaataacgacacatttttcataaaataaattgaaaattttcagcatcgaccaaattgccactggattatgacttgcatcgtgtggctgcaaaagcggctggcaatgtgtacgcgtggcttccggccgacaaacagcccaaaaagcttgcggacatcaaaccggcggcaccggcggcaccattgccgccagccgattatgacgtggagcgggtggcagcaaaagcggcggaaagcgtttacagttggttgccaaaggagctacagcccgaaatgatgactggtaatgcagcaaatttagaatgcatttctccaattttttggtattaatcgatttccagggggccaaacaattttaatgtccaaattaggagacaaatcctccaatatatttccagaattaaatttttgatcaaattaagagtgaaatgaaccaatcgatttctaggccaaacaatttttgtgccaaattaggagacaaacctctaaaataatttttggggccattcaattttcgtgccaaattatgagacaaatcctccaatctctttataggctaatcagttttttcatcaaactacgagactaatcctccaatctatttcgagacgcatcagttttcctaggcactaagccatttttgcgctcaaaaccaatttttgggcgctagctaacccacttgcctgaaataatttggaaaattccatctaaacaaacggaaatattctaatttaaataaaattttaaaacaatttattatttcagaggatgaacgtgttgaatttacagctgaagttttccaggacatttgaatgtcatcgaatcattttttggtcttcaaatgattcagtttagcgaaggatgacattttattttttattcatttttgtaattgttcaacaattttataagatataaaaaaaggtattttgtttgatattcttttgtgggtcaaattgtacaaaatattttttttgtgctagaaactctctctgattgataagaaaataagtaaaaatgttatttttggacttttgaatgcgagaatatagtcgcaaaaaaagtaaagacctaaaaatccgttccatgaaatatggactaaaaagctcaaaaatagccaaatatggaccaaaataatgactaaaaaataaattttatacctcaaaaacccataaatattcaatatttgcttaagcaaacttagaaaatacactanattaccaaaaattgatttaaatctgaaaattccaaattttttttttatcaaattctagcttcacaatttctaaccaaatacatctcaaaatttttgtaataatctcattctattgtcagcgacaattttaggtaccgataaaatacctaaaaaatctgccaaaattttgaaaaaattctcttttttggggggtgtattttttaaacatttctaaaaagtcgatctttagtcgtgtatttttcgtttttttttttgtatttttcttgtaaaaatttccaaaaaagtgaccaaaatatggattaaaagagcaaaaatggctaaatatggatttattcgcaaaaacccttaaactcaaggctaccctttgtccttatttgtaagatttgtccttattttgagggtccaaatcttacaaattttaaatgtccttatttgtaagatttgtccttatttaagctctttgtccttattttagtcttattttttggattcagagagaaatttagattttaaatgataatttttgaaagaaatgttttttgaaccgaaataatatgcaaaatcttaacaagattcagttaaatattcaaatttttctcttggcgatacacttccatctagagctcggccaggtccaggccatttttcggcaacctggattttcgccgcctcctaaaaattcttattctcttaaaaaattggctcaaaatcataaaattttgtcattttttgaacaaaatcgttaagaaatcgcattaaaaattacaaaaatttttccggcggcgcctattagaggtgcgccgttgaactatattaacctaattgtgataatctttctgattttataacatccataaatatgtaattaattgcatttcttaagttattagcatgaatttttaggtatttcgctgacaaaatttcagccccattctgaaaaattaaaaagtcatttaaaaaataattttaaaaaattgatttactataattcttacactattaatatttgaaaataaacatttaaaatcaactaaatttcagtggtaaaatttgccttaaaatcaagtaaatattattaaaaataaaattcagaataagtggtctcaaatttcaggaccatctttaatcatttaaaatttggcgaattattacaaaaatattatataagtaaagttaattgttaagtgtgtgttttttaatttgtagg

SEQ ID NO: 15363 - DNA, 1431 bp, Heterodera glycines
tttccccatattttaggcatttgccaatgcttcttcccctgctaatttcattgttgtcttttggtttgcttcgtcttctgcttcctccgttgtgccatttgatctgaccaatgaatttactcgggaacaattggcattgaaaaggactgactacagcagccgatgttttctgtttgtccgttgtccaattgcgcgagacaaaagcaaatggacaaaatgggaagaagaagcgattggctggcaattttatgagcaatggaacagaatcgacattgaaattaataagaatgacatcggagatggataaggcgaatgctttttcaaaaatccgattttatttggttttatttttaggcttcttggcgcaatgcccggcccaactgatcagccgcagaagtgaatgaatgatttgctgagaagtgatcggtcaatttgatatggaattggaagttgacaaatgctcatagaaattgttttgttttttgttttgtttgaatgatcagacttggatttgtgactgttgtatatttaggaataaatttttgtgatttcctgaaaccgaaatccatcggtaaaaatcaaagcaaaattgaaaaatggcaggcagattcgtgatcagcaataatagcacaatttaattttaaatattattttgtggtgatcattttcactatttccagatcattgaaaaaatttatttatgaaatcgttgccgaaattgaaaaaaaatattttaaattaaaagcactggataatttgttatttttgacaaaaaaaaatgaaaatttttgttggaattttaaaacttggggttgaaaattcagaattgctacgtacagttaaaatttcagatcgatcggtccatggtaagtggtcaaacttccaaaaaatagggtgtccctattctaatggaacggcgcgcggtcaaaatcccgctgcgtcgaaatcccgccgcgtcgaaatcccgccgcgtcataatcccgccgcgtcgaaatcccgccgcgtcataatcccgccgcgtcgaaatcccgccaaagccaaaatgagtcggaatcccgccaaataaaaattagcgaaaaagtcttaaaattacattcctaaggctccaaaataaattcattaatactttaccagaatcgcataaataaataacaattttcacgaaaaataatgatatttttaaatattgaatgaatcgaaaaaagagaattgtatgatcgaatcttcaaaattttcatagtgcacgaaattccgagctcaattcgctgcgtccacttgtcggtcgatgtttctgctgacttcaaaaattaagtcggaaaagggtcgggcgatcagaaacttataaaattgttaagtttttgagggtttacaagtaaaaaatacaaaaaagatgggttaccttccgagaccaatgttggttggttgaggggg

SEQ ID NO: 15364 - DNA, 1692 bp, Heterodera glycines
aaaaatttaaattaaaaggatcaaccaagaatttttaagggggtccgagggtcggagaaattgtgatcaaaattgtaaatggtatgaatccattgacgatttattgggtgctatgtcgaagcgacaaaaatatgggtgtttgtaataattaaatttaattattattttaattttattttctaagtaattaatcataacttagcttaagcttagtcaaattaataaaattaagtatttagcgacagctcgaagcatcctctactacttatgaaattttcaaaaaattagtaaaaatttacaaaaagttgtgaccaaaaaagtacgaaaaattttgactcaacaattttgaccctagctttcttgaaattcaataaaattttttgaaatttagcagaacagtagagtaatctttaggctatctaattatataaacaaaattaaaattgattgttttagaaaaaagttatgaaagaattaatagggtcatatttttatggtcatccaaaaaatgtaaggacatttaaatgcataaaaattgttcaaacttaaattaattcactccgtgcttgatacgaaaagatagcccaaagattactctattgttctgctaaagaaaattccttaataaaaatgcaataaacccaaaaaatacacccctaagaatcgacctaaaaaaatttcaaaaaatatacccctaataatcgatctaaaaaattttttgaaaaattttctcaaaaattcatccccaaaaattttttttcttgacaaaatttttgatttaaaaagttaaatatttgctaagaaaatattctcatttgcaactgcattcagtaaatatcaaaatttttttcctcaatttttggctgaaaattatatcactatgcccgaaccccgaccccgaacgattttgtcaaccccgaccccgaacttgctgaccacgacaaccccgaaccccgacttttccaaccccgacggtcgggggcccaaccctacttttacataatattttttctgcgcatataggaaaaatgggctcaagaacagcatttcttctacgttaaatgcacatatataaccagggttcgcagatctgaggctttagcctcattttgtggttttttgataggtcaatgaggctaaattttcaaaatgaggctttgaggctttttgtggttttttgagaaattttgagtctttttgaggcttttggggaaaatcctcagaatcttttaaattttgataaattggcataatgtttggcaatttaaagaattttttaaatgaaaatatgctaaaaatatggtcaaaattcttaatttttcccccggcggcgcctatcggcaccgccggaccgtaaaaatccttaatttacaagcaaaaatttgctcaaaatcgcaaaatttggtcatttttcggacaaaatctgttaacaaatcgcattgaaaattacaaaatttttcccggcggcgcctatcggcaccgccggccccccgtgcgctccaaaagttttttgggaaaagcgccgcaaaaaaatcaacttcggtttttcatgcttagaatttcaaaaaatgtttatttcgaaccaaaaattgctcaaattgatcatggacaatcaaaaatataacatttgaacattttaaacgtggttttgaataaatttgtgaaaaagaaggtttttgacccaaaatgagg

SEQ ID NO: 15365 - DNA, 1577 bp, Heterodera glycines
atccatcccattccaactttattcattcgttcatccttccggcccatcacagccaaacgatggcaatgatcaaaattaaattcagcggatgaactccaaacgaagcgaaatcaaaccaagcaaaagcaaaactcactttgcttcaggagaaaatggatgtgctgatatggatgaaagtgatggtggagggagcataaaatgaggagacggagaagagaacgggcgaatggattttggaaggatcggtggcggataattgggtggacgacggacggagaaaggggggggggtgacgaaaggttgtggtgttctttctatctttgtccgtccgtcgccacacttttccctaatggacgacggcgaattttattgggtggaaatcgatggatgggcgataaaaaaagaaaaacggagcaaattatgcaaaaattgtcacattaaaagcatcggttggtccgtttccatcaaaaattgtcgtaattcgcgcaaaataataaaaataatcgacaatgaaacaaatgtttcttttttgttatgccaaaatgaaactgaccatttgatcactctctctcttctcaaagctttccctttcgcttttttccccattttttgcactttcgaatgtctcccatttgctaccgaattgcccattcactccgtcctcttcccctggggctattcccaagggattctatcgctttacgaagccttcggcaccgtaaattttttttttgtctgagtgccctttcgtcaaattttgtgcggtataatgtctaattgcttcgcaaaggaaagagaattgaaaataaaaggaaaggaaagaatttttcaatccccggggcattttttgtttgtccaattggaggagagaaagaaaagagaaactccgaaaaagtgacggccctttctttgcttgctaaatgtcaaataattggttaaaattcaatgctaagccaattttgaaagggaaattggcattaattccgctccaaaattcttccccatttcccatttttgccatttctttcggcattttttgtggaaataggcaattaatctctgcaataattctcagacagcaaagctttacacttccaaagccattgatgagaaaaagaaaagaaaaaaagaacgcaaagggcgaagaaagggtcaaaaaggggtgggggggggagcggaggaaaagcggccttggggaaatgaaaggaaagggaagggaaagggcggaggcgttttttgggagttgtgcaaatgggtaaaatatggcgaggctttggtgggaaattggggaagttaagcattcatcgaatcacacattcttttgagtaattagcagctaaagtgaaaaaatggttgagagaaaatggcacggccaaaaacaacgcaaaaaaaaaaatcacgaaaatgcaaaaataaaaaataaacatttctgcgcatcggcattttgttttgtctaccgttttgacgaaaaaggcaaatagcgtaacaaagacaaagaggttgggaggagagggaaaatcaatttgtgcccggaagggaaaaggagagaatttgtgacggcggcggcggaaggattt

SEQ ID NO: 15366 - DNA, 1883 bp, Heterodera glycines
atttcattggatattctccacttctctcaatttgtcgatgaatttgattaggtaaatgaaagaaactccaaagcaaaaagtgtgtttcgatcaaaacagtgataattaacaacaaataagcaacgattgaatcgattgccatttaaagcggagaaactccaaagctattggagaaaagacgagcaaatcattaattacgtacaaaaaaaaatccatgaaaatatgaaaccggcggaaattttataaaagaaaaaatacgatcctcagccaattttttatgattttctgatgaattaattccctgctaattgatgcaccgcaagctattgttttttaaaatacctattttattaataaatttatttgatatgtattgtaagttgaacgattccttaaaatcacttcaaataaatgtttaattttttgttaggatacaaaaaccgaaaaaaaagattgaattatttataatttaaaatcaaagtataccatggtcaatgataaagtactgtgtaattagcttaattaagaaaacttttataagaacagaaaaaacatgtcccgacatttgcgcctatgccctccctaatcggtttcaaaatttaagttttacaattttaaagtttgaaaaaaacttcaaaataaaaggcaacggtaacacaaattcaagcacaaaggaagtgagggaatgttataaaagtgaacgcctcgcctcggccatttccatccgtcggttttctttgggactttgctggacaaacgcttcacatcagtggacggacggacgacaagcggggggagggggactaatatttgttgtgttgacgagtccatcaaaaagaggaggggagagggaaccacccacccaccttttccgtccgattggctgactcggacggatttgtcgtttcgggggactcaacggaaaggtttaaaaattgagccatcggcggcggatgactgcttctggacaagacaaatgaaaaagaatggacaaatgaatgggagccaaagaaattcaataaaatggcgggacaaagcgcggaaggaaaggcaaacgatcaattttttggcaaatgaaatacagaaaaattagaaatcattgtttgttgggtaagtgattgttaagtgccaatgacgagggccagggatggcattccgaagcccaaaaatttttcggaattccgtgccatccctggcgtgggcaattgctggcaaagcaatgtctctgctgctcaattttctcgcagatccaatctccgcagaacaaccaaagcacaacaaattcagaacgaagtacccatttggaagaccgagcggaaaaagttcccagaggacaaatggagcataaacggacgaatcgaggggggaagggaaaggatgaccttttaatagacgaatgaatggacaaacgaaagactgagtagaggggggggggggggggaaggtccaagagatacaacccaagtgcacaagcagacaaaggagtagagagcatggatattctaaacggaaacaacagctaacaaataagtcgaaccgattgatgaaggcgtaaacactctgtacccagtcaatcaaatccggttctcgacgagtcgagatattttaagggaggaaaaagaaagagcatcaatgacaaaccattgaaaaacgggggaaaagcatttaaaaccacttagagagagagagtggcgtatgtttaaaattgtattttgaacaatacgataaataaataaacgccattatttggcaaataacttcacaaaaaatcatccaatgtggcaaaagtcgatctcaaaatcagttctccttagcacaaagcgcaatcgcactgcacgaaatttccccgcaagtgatccatcagttcctggcaaattttccag

SEQ ID NO: 15367 - DNA, 998 bp, Heterodera glycines
aaggagaagactcaaccccaaacacctcgtttgacaggtgctaggtctggatcaatcaatagaagtttctactcaggctcaaaaaacgaccggtcgagtggcagaaggacgcacgaacacaaaaataattacagaagtggttacggtagtcggagtcgaacgaatgagggatactacgaatcgcctttgaagggaccgagaaacgaggcaaagaagcagaaaatagaagaaaaaccagacaatgttatgtattttcgtcgttagttaatttatatggaaaattttacattttttatatttaaagaaaagtcttgaaacagccgattctttttcatttattggattagatacgatttttgaatttaacagtaatttaaatgggtaataagcggaaccatttaatgaaatgactttcaatcaaacaaaaaaatttcccgacgggtgcagacgaatgtctttccttatttaaaatttgaataaaaatttagtttcattgcatatgtatgacaaactttttaagtttccttgaatttatggcattttaccatttagtcctcgtaaaaagcgagttttttcaatgggagacaaatgagggtaataatccttcggaattggtgcccgacggaaaaaagagataaaaaactgataaaataagctaaataacaaaaagcaaataattgttcatatttttgtttgttttgcagacaaaaatctgccttttaggcagagttgtattgaattttccaagtttttcagaagaaatcaaggcctatgagacaaatcaactcaaacatgtgacccattgaattaaactggaagcaattaacactaaaataacttatagacatcccttaagcattttctattcactttatgtaaaaaaaaaaaattcattaaacacaaaatttttgtgggcgaaaaaatgtgaaaatctgggtaaattcgtaaaaaaatttctagggggttggtgaaaattttctgtggaggatgaatatgat

SEQ ID NO: 15368 - DNA, 2537 bp, Heterodera glycines
  misc_feature (2518)..(2518): n is a, c, g, or t
tgacagcacatcacaaagtggtgtccagtttgccaaagttgaaatatttggacatttctgacacaaatcttacgacttggccttccgaaaatgatcgtccatttggcgggtaaaatataacaatacgtttaagctgtaacccgaaaagctggaatccatgactttttttactctttcctaaaaaaattcttggtttaattttcaaaattttataagcactgggcgaaaataagttttttttattttgcgctttatttagtgccggaacgattgacagtgacattccgggactgagttatctgaagaaaccgctcaaatatttgggcattttcaactgtgaatcgagctcgcaatacaaaaacatcccggcggaaaaggtgccaatgggaaagggtttttgctatttcctggactttttcaagataagtggcgaccatggggaggaccaagtgctgacagcgatggaaatgtacttggaaagacccaaaacaatgcaagcggtgctcaacgaaagttaccatttgtaccgttttggcaccaatttggtcattatatacctccatctttgacattctttcagttatgtttttacagagtcgacaagttgaagcgcttcatctcgtgctaaagtcgatgtccttgcacctcaacaacagcaacctccaaattgccggcagtgcttcgatgttttacataattcgttcgtttgcttttttcatccttttaaattctgccaacctcttgtttaggctctgtcaaaatgaattggtccacacgacggagagtgatttttgcgctaattgatggtccgatttattcttttgtattccaaaccaattttcagtttttaggcatggagaatcacctggacgagcaggtgatggtgcgaaactgttgcctctgtttgtgtcaggtattttgctgcctcgatttcatttcttatattccttaaaataccctcccgttcagttcgacatccctcaagacattatgttcggttatggacatgtcgccaaccttctcgtcaaagtgctcgaaactcacagttcggatccactcacccaaaggattgtcgtatttttactgaattcaatggcttgtcatgtggaaggcgtgcaaaagatcgaagtgggcgagttcggagcaattgaggtgcgaatcccccccccccccccgcctcctgatttagcgttttgcagataattctacaacaaattgcacgcaaacttcagtccaaccaatgcgacgatgttatggacacggcttggagttttctttggaatattacaggtcaacttttagtgtactatacaaattttggtagcagctcgtttccgcaccgtatcagctcccccccccctggcttaaagctttttcgaaaatttattttctttgaatttccttgtaagaagactttgtaagattttttcttgaaaattttttaagttagtaaaaaaaattctattttctctggggtggggaaacgatgcggggtaggaacctagtgcaccccacaaattttcacaaattttgttaaaagcttcagtttagatgagacccccgcaaattgctcccgatttctgaaagccgaggggctcactctgttctacagatgttatgtcaaatttcccagtcaaatggaattggtacggaatatgatgggacttatcggaaacattgcggaagtgttcgatttgcgtgatcagttgatgattgacgactatttgaatatattttggtaattgactatctgtgcctaatgaaaaactcactgaaccccttttcagcacactgcttgacaatttgagtgacggaatcgaaatttcgtataatagcgccggcgttttggcacatttggttagtgatggcgatgagagatggaagacaacgaaggtgaaaaactcgcgacgccacgtcagcgatttgattgtgcgggtgcgtgttggccggcagcgaaccattcattaatttatagtttagtattttttctttaattcttttgatttaaggctaccgagctgtgggatttgaatgctcgtcgcttcatcaactaccgctcctttaaaccaattctcggtcttttgtcccaatggctcgcgattggctctcaacaatgggccatttgggcattggcaaatttgactaccactgaccgtgccaaatattgccgttttgtggtggaggagggtggcgtagaattggtggaacaattggtcaacagttcgaactctacaaatgcaatccgaaatttggcacagactgtgctcaacaacatcgaagaatggtgagtttggatcattaaacaaatgataactaagaggaaccgagcattttttattatttttacgtcaatggaaatattttttggtcctaattaaggaaaagaagcgacatcgaggacaatttagacaagcaagaaacgacagctgaaaatacgaacgacccttcttgacttagctgctgatttcccttaaccaaacaactaatatatttgtcatattcttttcttaccaccganaatttggtccttcatggat

SEQ ID NO: 15369 - DNA, 4463 bp, Heterodera glycines
  misc_feature (2497)..(2497): n is a, c, g, or t
gggtccactgcgtttgggcgctcacatttgggcgctcacgtttgggcgccagcatgtttttccactataacttttttcattggcatccaaatctaacattgttgatatgttcgaaattttaatttatttagaagctttttctaagatattgcttcgcgattcgacaattgctaaaaaaattatacataaaaattgcgaaaagtcgagctttttgaagttttttcttaataaaattttttcttggcttgaaaatctattcgctttttgtaaggctaatagagcatgtgaagggctaatagagcatgtgaagggctttcgaatgataccaagattgttggatttggattccaaagaaaaaaagctatagtggaaaaacatgctggcgcccaaacgtgagcgcccaaacgagtgggtcccggcggtgccgataagcgtcgccggtgaaagccatacaattggagtgcagttgattaatagattttgtgaaaatggaaacatccatgaaagtggataatggacattgccctttaaaatggttaccaacattgttgtacaatctgtattttactctaatcctgaagatacatgaatattccgattattaatcgcttacttggaaattttgcgaaaaaatctaaatatattactctattaaattctgctggttcacaaaacgacagtagtactgccggtagcgcctattgccgcaaccgtgaactctttgaaaagttgagttcaatttgttaacagattatgctgagaatggtcaatttttatgggtgtttttgtctattaatcagaaaaaataaattcaaaagaaaacgtcaaccggtatcgaacctataacaaaaaatgatgttgtgttgaaacactaaccattaatccacaaatatatttaaaaaataaaacaaatttctttattcataaaaattttcaaagatggttaaaaaatttttccttttatcaacgaatatgccattcttaagggtatatttggggcgggggcgggggtaaggccaaaaaacctgtcccgtccccggggacgggggcggggtccgaaccctattttaaatatttgcaaatgttgttattgcatttttataatttatttacttatttattcaatgaattttgtgaggagaagaggaaatgaatgggtgaatcaattgggcactgttgctgccattctctcttctgcctcttcttcggttgaccacgggcagaaaaaccaaatgaatcaattgggtgggcgtctcatcgggtcggcgtcagtttggcgcggccactggcgccggtttttggtgccgcttttttggagcggccgttttagcgcccgtaatggttttttggcgccagtgtttaaaaatcaccaaaattttaatttgcctttcattttggataattatatgtcattttctttacaataactcaaactcgaatatttagaaattttttttgaaaatttttagggatgggaaaatatttaaaaaaattttttgcttatatatatggttgtgaattatatggactaaaaaacactaaatgtggacataaaatttggactaaaaactcaaaatatggtacaaaacatggacaaaaactgccaaaatatacgttataaaccctcaaaattcacaaaaatgtttaaaattcttgtcaagaaaataaataaataattttggagatgaatttttcatttgttaggaatgtattatgaaaatcttgtgaaaacttcataaaattaaaagtaaaaaattaaaagacattaaatctttttgcataaagacaaatttttataatttttaaaaaaatttcatataatttaaattcttccttttaagttcaatttaataagcaccacttctttcaattcaacatccattacttggagtttttgctccaccttcattccatgactacgcgcgaaaagcatttcgtgaaaaaatattaaaaatttcgaaaccaataaaattcaatggtaaagtaaattttttagaacctaaagaaatgtgtctaaaatgcttcatctattaaattaaattataactcaatttatctttcaaatgaaaaagattacgatgtattttgttaaaaataattaagagttgtaactaagaaaaacctaaaatattttaaaataaatgaagaaataattcgctagatggctaattattatttataattttgtttattaaatttaatttaaaacaattaatgtcattgataatttctagacaatattaattgttttcgtccgaattaataaagattttttgtgttttatcagttggtattattccacggcaagttttaccgtgagctttttggttttgttccgctggtggccaaaatagattaagttttccataaaagaaataaggaaaaaatttggattaataattaatgtagaaataaatagcaaaaaatttaagcgctgatattaaaaaaaaattatagcaaattaaataaaagaaaataaattcaaaaaattaacaanagaaaaaaaagtttaaaaacaaacgaagaattaataaactagagatttggattttgtagctaccgggcttaatttattttaaaagtgaataaaataaactctctggaaaattttaaacaataaattgttgcttgcttattcctttaaaatataacttttgaatcggaagaaaaaacaatctaaaagtcaggagttgtaattattgaatgttattgttattatctttgatttttagtggggaattgaactgtttatgaattttttaaaaatcagttgaacaaataattctatattttcatataccatttggaagagaaattttgattttttaataagccatgtttcagattttttattttgtgcttattaaattgttgctttttaaatgaacttccaaaaatgcaaatttcggaataaattctgaaaacgctattttctcatgaacctttctgggatcaattcaaaaacattgtccaataaaaattgagaggtttgctaaaattaatttaccctaaattattcttttatcttagcagagtggaagattattgtcaaaagcaaatcaaagatattaaattagactatttctaaaagaatagagaaatataaataaaacaaaacactgataagaaaacatatcaaaaattttaatttttctaaacctaaaaatccaaaaattcgatattaaataataaatgaattgtgattatgatttaatagtatattcaaatgaataaataaatgaaaagaataaaatttcctagaaatatttccatttaataagaaataaaataaatcaaataatattgcattttcttctcaaaaaaaaaaacatttagtcgggtcagggtgggaaacagtaaacatcaaattaatgaagattgatacttgaaagattataacaattcgtgtttaaaaaataatttagttactaattaataaacagaaaatgaattttaaatattttaagatatataaaaaggacaaattaaaaatataatacaagaagaacaaacacttaataattgtagtttactgaaatattagagtatgattttttaagggaaatagaaaatcaaatcattgaaaaacggacctgaatccctaacattattttttgacgggattacctaccgattcaagattttttttcaaaaaattaataatttatgtaaatgagaaggtatagattatccaaaaatattttttatgtgaaaaagttatatttatttgtaaaagataataaagaagagtaaaataaaaattaagataaaacgaattcgaaattctaacaaaagcaatattaattcgctgatgtggaaactaaaataaataagaaaggaataatcaattctatgctaatcaagtggaatttaaagaataggtaagcaagataaatactagtgctgtccgggaccaaaaatttcccggccgataggcgccgccggggaaatttttgaaaataattaatgtataatatctaacttttatgacatgaatagagaagctattctattggtatttttggtaaaagctgaattattatatttgtcaaatctaaaaaatattttgaatttaaaaataaatgttagcaaaataaaaattctaagatattctgaattactaattgcacattttcatagatccagtaaaacaaatataattaattgcaaaaataaatgattatttgaaaatgaaattaatgaaaaagtaaagttttacatttttaatttaacataatttggtgttgcttgaagaataacgcacaaacaacgggattgagggcaaataaaaaggttaaaaattaaataattctaaatctcagttgacatagctttaaccttaaatagataggttcatctaagaaatgaaaatgaagaagaataccaacaaaacagactaagatcatttgaaattggacctacgcgcggactttttgactgtccaaaataaaaaaaattggaga

SEQ ID NO: 15370 - DNA, 2733 bp, Heterodera glycines
acttggccaataatagaccaaacaaaaccattttgtgctcattttgaagggaaaattctgaagaatatttcttaattagtcaaaagtttaaaaaattgtttattggcaaaaaaatgaaccatgtgttattttatatgttagagacatggaaatagtgcgtcaaaatgagagaaaaagaaaaaactttgccctgggaaaaaattttttcctgtgggtaacttttcttgaaattttgcctaggcccatattttggccccctctagcgattcaaagtttattttgtgaaagttaagtttttaactcgagatcggctcttctatttttacaagggaaaatccccaataaattttaagttttgcaaagttttggcgttctgattactaaataaataataaacttatttgtacttggagcccaaaattgaatcgccgtgtatagaaaaatgagataatttagcagtatcaatatcaaaaatgcaatttgacaaccattccatctttcaattgtcatttccctggtctcttttccccttcatcagcgtccgtcccccacataattcgggtgcaccaacagaattgggtccgctgctgtcgtcgtactgctcgcccccgtcccttgtccgtcttccccactctgtccctcgtccccttcctccgcttctctgtcgcctcgctcggtcatcggcggccgttcaatgcgcaccaacactttgtcacgaatcaatcgcgggatcagtcgggcgaacattgttttctgtctcgttaggtcctgctccgagttgatctccggctccatcatctccaaataccttttgttggacacaatttaattaggagattgtccgacgatccttcgccttaccattcggccaattgcgactgtcgtgtgcccggccattccggctcgtccccgttgcgctcctcctcctcccgcatatgtaccaccagcatattcgcaatgcgcatgtactggtcatgtgacaattttagtccctcgctgccgccgtcaacggaaagggcacagacagagggagcgccggctgattttgctgtgtcgctcgcagtccgtcgttgtcgtccaagctgttcagtttcagtgtctttttcgcccataaattgggtggtgtctatgtccatttggtgttgttcttcgtcctgctgcgtttggttggtaatgtccgccatcggttggggcgcaacattaaaatcagcctgaattttggggtttatgcgcttgcacaaccaattttaaaatggcacatcgtcctcctcgtccaagctgatctgcggcgcactgatcggcacaatcgttttggagagcaattcgtacgcctttttcacgtgctcttcggtcacctcaaataaatgtttatttttaattgcttaaatgctcttttgccccactctccgcacctccgcttcgcattttagacgagcgtacgcctcggaaagacggaccagcgactcgagttgtcgcactgtcacgcgcgtgccgttgccgtcgtcgttgatgcgcaagcgcaaatacgcacttttcaatgctcgttcagcttcagcggaaagctgaaagacgcgacaaaaataacaaaatcaaagcactgttccggaataagccaaatttatcattgtcctattcccacgtgtggtctgaagcatcttgcgaacattatgtatttgcgaatttcgtccgttgtgtacaccgctttcttcgaccgttcatggtgcagtgcccgacgatggttttccaaaatacgacaagcaatgttataatcgaccacctaaagccatcggccaaaaattacttgaaaatttcaaaatgaccgaccggattatcgttggtgtccagcaggacaaagaacaggtcgaagcgggacatgatcggtgcggacagagcaatgttgttgcgcaacggctgcgaccggtcatatttgccaccgatgggattggccgccgcgaggatggagcaacgcgcattcagagtcgccttaatgcccgccttggtgatggagatggtctgctgctccatcgcctcgtgaatggccacttggtcttttgtctccattttgtcgaattcgtcgatgcaacaaacgccctgacaaattggcaattatgaaattaaataatggcttttctaaacaaatttgtcacattgtccgccagcatcaaagcgccagcctcaataacaaagtcgaaagactcctcgtcttttaccacagccgcggtgagtccggcggcactcgacgcttttccgcttgtgtaaatcacattcggagagaaactctcgattgttctgaaaagtgaaaaatgtaaattacgacgggaacggaaatggaatgccgttagaataaataattggtggaaacccaacttcaaaaattggctctttccgcaggacgggtcgcccaccaagcacacgttaatatccccgcgaagtgtcgtccccgccgtttttttggccacgcctccgaacagcatcagtaaaatgcccaatttcacttgctcactgccgaaaatgttcgggaaaaggccgtccaggatgtgctgctcaatgcgcatatcttcgctcatatccttcaatttctcttggacgtcaggcgacagcgaattccaaaggtcggtggggctgacttcctcgtgggtaaaatcgatgccggtgaacttggcaaagcaaggaaaagcataaaattaaaaatagaatttaattactgccggattcgacggctgaatgctgcag

SEQ ID NO: 15371 - DNA, 1082 bp, Heterodera glycines
agaagggttacgacgggtgcagtaagtaaacggacgacgggggaggggagaatgagaagcgggacaatgttttctatgtatgaattgtgcggaagattggccatcccattcattcattcccaattcgggatttggtgggagcggagtggcaggaaggaaaagaggaaaagggtggaggacggagaggggggggggggggtcccaaaggatggaatggtggaagggaaggcaccgcataataaatcatccccgccccctcccgtggcatggccaatcgaattcacaaaactatgccaaaaaaggagtcatccctttttcagtacaatgcgaacaatagaaaaagcacacttacacagccctatcggtctgcagcatccgacccaacgttcttcaaacatccaacaacaaaaggcgtggagaaataataatgacgtattaataattattatggcaaattggaggggaagggaccaaagggcgcctcagtgccgagccaaaaatggaataaaacaaaacaataccttcaacagtggacaagcagcgaacaataaaataattattatgttaattgagttgtgaaatgaatgaataaatgggcgttaatgatatgtgaaaaggtgcatttgatggacgacatgcgaaatgttcgggatttgaaggagagacaaatggccaatttaaaggagaaagacgaacaaacgaacgagccaacatgctctttaacagatcaatcagcttcagcccaggactctctctttttttttactttcctttgcaaatataaaagtgaaataaaaattaaggcgctaaataattttatttatttttgttgaaaaaacaaaatatttgtcctaaaataatgcaaaaatatatttgttgcttgagttggtttgttttttctttcgcccttcccttttcttctcccgcgtttttctcccagcgtttctaatatccaaacactcatttttctacacatttatttttgacacccaacaaaagtagaaaattggggggggggggaattgacagactgtgcccaaagggatggatggacagaggaatttgagggggggggggggggg

SEQ ID NO: 15372 - DNA, 2827 bp, Heterodera glycines
tctgaaaaaatttgtgcattttttgacggccaaaacaaacgaataaacgacgatttgtcagttacatataattcataattattcactattttaactttttagaaccgaataacttttactcattttcactttcatattccctttttcgttattttccaatggaaaactgctcgaaattgttttccaaaattagccaattccattttccactcacattctcatccgtttgttttgccattgccattagtttctcatgtggcccccctggcagtataatagtcgtaaatcataaatgatgaatgagacataacaaaataagagggtttggagggacaaaagataatataatggaagtaaagttggcaaagcaaagggaaaaggagagataataaataattatgaaaatgggaggaaaagatgaaaagagagagagaaaaggggaaaatatagaggaaaaagggagggacacgagtgaaagaaagggaatgagagagttgaaggagaaaagtgaaaagggaggaaagacgaaggaaaggggaatgggttgaggaaggaaaagtgaaaagcaacgactaacctccttcaccaccaccacctcgccccctccccaactcccaattcattttttagtgatattgatccgtaaacaaatgcacccaccgccaggtgtgaggacggaatccgtagcaattgcagatggccatccgtgaacaaggctggcccacctgaacggaacattcattccactcattgtgctgctgggtttgtcactccttttgtggtgtttccttccccttttcttcttccacctcaatgtcaatgacatgtgccatttgtctgccacgtgcaatgtcaccggcgcttgacaacaaggaacgttccgcgatgccagccccggtgctgctgtttgaacgccagcgattcttttccgtagaattgccaccaaaaacgatctgaaaaggaaagggaaatgaattgggggacatgggaaaaaaggaagaaaagcgaatggaaacccaacaaacattcattaagattagttgaatctctgtaaaacctgttgaaatctgcgacgccaaatcataaaatttgttagtgaaggtcagaaaaattcattcaaatccaaaatcgcatttaaaactaagggccattttagtcaatttatgtattaatgttgggcccgaaaatgaatttttttttatgtgtgaatggccattgaagccgcaattttcgctaaattagtctcctctgttgcgccaaattggcagtcaacagcacattttatgcttattggaattttaaattggatggaaaagagcggaattttctacttaaaatagacactttcaattttggaaaattaatatttgagagtccatttgaactatgagaaaaaatgaagaactattatattatgaattgagattaaaggaagaaatgtggacttatggagtgaaaaaggaagaacagcggcagaagagagagagagaaagggagggggagaaaaagagggagagagagaaagagagaaagagagagagagagagaaagagagagagagagaaagggagggggagaaaaagagggagagagagaaagggagtggggagagagagaaagggagagagagagagagaaagggagtgggggggggagggggaaaagccgagaagcaaaggaaaagccgaaggggcaaagagccaatttcacccccattccaccttctgcatccgctccaaatcccaaacatttcttctaacacacacacattttggcattgccattcatttcggcgaagggaaagctaaggaaacagtgaaaaaaagaacggacaaagagaaacggaatgaatgatgagatgaagaagaagccgatgatggaaaagacagccatgccaatttgggagtttaaaaattggaacactcaccaaacaatgccaagggtgagaagaaacgaggcttaagcccccccccaaacaaaatgacaaaaattgacagaaactaaccaaaagcccattcctcaaaaagcagaggaagaacgaactgacaaagaaatgagtcccaaggactgaataaatgagaggactaacagacggaaggaaccgtcccttcccttcccccgccgtcccctggcaattccatgcttcgcaccgccactgccctcccttcctcaacggcctctgccccaaattcaattcgctcatttcttatgtccatatgacttttccattgaattggctctgttccaccaatgaatggctttgatgtttggaaaagcgtaaggcttaaaatgcgcttcaaaattatcggcaaaagtcagtcgattcgacccgacaaaataaaataaacatcgattgaaagtgtgtggtaatggcaaatgaatggtccccccactcgtcggttggcttttgcccaccttcgctggctgttgcccttcttcaattgccgtgttccttcgagcgttctgttgtcgtttttgcttctcatcgataaaccatccgtttcgaagttcgccctcaaatgtttttcttccaaattggtcgttgtttctgctgctgtttgttttctctttcgaattcggcttttctgtaattataaaaatagtttcatttctaaacgctttttaaccgttttgaaacaaattttgtgttcctttgaccgcggaagaaggacgccgaacaaccaatggcggttgtttgagcacggctgacggtcgaacaacttttgatcggcaatactcaacgagggcaccctcctcaaattcggcatcgtcttcgtccgcattgtaatgacatgggagaaagtgacggatcaggaacatcatcaca

SEQ ID NO: 15373 - DNA, 2260 bp, Heterodera glycines
  misc_feature (1024)..(1024): n is a, c, g, or t
  misc_feature (1083)..(1083): n is a, c, g, or t
aattttgcagactaatagagggcacttaaggctatcgaaagataccaagattgttgaattttgttgataatgaaaaaaattatagttcaaaaactcggcccacgcgaaaatgaccccaaattgagcacacagaataataactatattaatatttaaaagaataatgggtaatgaacattttccattagtgaatgattggaattaggccctaataaggcaaaaattaaaaagttcatttagtgtacttttgtgaaactgccagttgtacaaccataacataccgtctttacgttcatttggtcagcaaaatcgtatttagctgcacaaatgttgcttgctccttggcgcttcttttcatgctgcgtgccattgacagcgcggcaaaattagttgaattttttaaaactttaatttaaaaaataggtctgtattttttttttttagaaaaatcgtgtcatcattttcactgtaattgtcgaactgatttttggagtgtttccatgcttcgtttcaattttgtacaatcaggtaaatcacattttttattaaaagttaaatcaaaatggacaattaacagaaaaattcttaaaaattttattttaataaatattaattttttaaatgtttttttacaaattattcaaagtgaacgtcgtcagttgctttaggtattaaatttgccaattggagccccaaactctggtctgaaaggtgaaattgcgatcacctgttgtgcattcgatggcgcaatgtgtggcatactgtatatgtccgttttactcaagcgtagccatggttcatctaccgttgctaatgccgttactactgtaccaggagcatccaaaaacttgcagaaagcccatgagaatttgccaaaaatctcatgaaaaatttcatatgccagccacacgaacaaatgaaatactctttggttttgttttttttaatatttttataaaatctgacacagctggcaaaaaaatttacgaaaaaccccaaaaaactcaactattaagcatcttantatcttgttcttattctcgcaaacaactatatttcgtgaggcctaataattcaaatttntaaagacattttcccataaaaacgatgaaaaagtaatacccaggaaatcagggttttgatgccttgacctggaaactaggatttcctggacaaaaacccacgaaaatccaggtcccggaaaaactgaactctacccgtgacaaaagaggcggctttcgttcaactttgcagtagtgacggcatgagaaaattatccaaattttaatttcctaattttgcaaaagtcaaatttggacaatcatctttattgaaataagcaactcaaaatgaagatctttggcttttttaaaatattgtgctgtttttgcatggcatttttattccaataacaaaacaaaatgccaaaacccaatgaaaaatacatatttcaaaataataaattctcatcactctacaaaaatcataaaaaaattttcatcaatgagacaatgaagaactctgctgatcgggactgatcattcgatgtccgtgcttctgctgctttgagctccgcccccttctcgtcccgccccctcctctgttggcattggcattattcgttgttggtcatcgtcgtcgttgttgtccatcccaccattttggctactttcttcgtcattagttttgctatgcccaccgtccctctccggtatggctgtacggtaccgcgccagcacattcatatggtacttttcaggtggctcctcagcgcgttggtcggtttccctggcgcatcggcccatcgccggtaggcacagtgccgacattcgatcacatccgggccgaactgataaaactgcttgtagtcaattctctaaacggacaaatatttaagtcgaacggtttttaaaaaaatcaaaattataaagaccttaacggtgcaaaaacaaatatcacttttcaataatttcagccactaattaagccgtatttggttcgaaataaataaattctttctttttaaagataacgcaatttttccccgttcttcgtacgcgtacgatctcattcagagtggtcatttctttcgttcatttttcgttcctgaatttggcattcttggcagcccagacaaaaaatgtgataaacgcttttcgaccggtaacgtttttgcatactggtagagaaaacaaaaaaaaagcatttttctattttttgaattataaattgcaacaataatttttctaaatttttgcat

SEQ ID NO: 15374 - DNA, 1517 bp, Heterodera glycines
tcgtcgtcacccattccccccattttggtcactttctttgtcctccgttttgctgtgcccaccgtctctctccaggatggctatacggtatcgcttcagcaccttcatatggtactggtacttcttcaaatgacttcctcagcgcgttggtcggtttccccggcgaattggtccatcgccggtaggcacaatgccgacattcgatcacatccgggccgagccgataaaactgcgcgtagtcaattctctgaacatcccaaactttattacggtattggaaataagtgccaattttgctaaaaatagccacaattattttaaatacagtattttgacattataatttaattttttttttctttcgattttggccctctctgcataaattttgccaaaaaacaaaataaatacccgtgttttgtgcgcatatgacttcaccagagtggccatccgtcgttcgttttttgtccctgttttgcattcttggcagcccgacagaaaagtgataatgctttcgaccgtaatgttggcgtactgtaaggaaaaaaaaattttttttgaatttatttaagaaatcatttccctattttgcatttatttatttgtttgttcatttttcacttcttttttcactgcattgaacattgagatgcttcgtctgtggcctgtgagcaaatggtatttgtgcaggacattgaacaaatgagcgacgctgagaatgagtcgtccggtgccattttcggcaagataattcccggccatttcttaaaaaatgctcgggttaggctcaaatcgttcttaatttgtggtttttagtaaattccgccaattggacattttcaaatcaaaaattcgttatcactttttttcctaaaaatagtaaaatttaaatattcttggaggatttatgatggatacatcggcaccgtctaaatttatcggggaccaggggatggaactacgtctggacaatccgtcatggaaagacaatcagtcagtgaatttgtgggttttttcaacactttttctgaccattgtccgtaaaaataaaataatttataaaaggcacaaaactaatataattcaaaatcgatgaaaataaaatttaaaaaagcgtaaaaattgttaataaattatgaatgtttagttggccgaagatactcacagaatgaatggccaagagccgaagcatttaaacagtgtattgaaaaagtaccgtatttcccgagtgaatggacccagcggaggtgagtatttagatggcaaactttatcaaattataaaaaatgttttgggactttaccaatggtataggtagttgactttgttcaaaaaagtttcaggaataggggagggggccggcggtgccgatagacgccgccggggaaatttttcaattttgctctgtttcttagcaaattttgcccaaaaaatgaccaaatttctctatgaaaacaatatttatttcataaatattcaattttacccagtgaaaagagtcacggaaaaaccgtgaa

SEQ ID NO: 15375 - DNA, 3858 bp, Heterodera glycines
ttaaatttaattaatgggaataaatatttaaaaattaattcttaaattatttttttgtgtttcatagaaaattttttaattattatataatttaacaattttgaatataatattgcttactggatctgcaataaaaaataatgcaacaaattgcaatgtgccaaagatggtggccaacaaaaggaacatttttggcactctctccagcaattctggttgtgtaaaataactgcaaaaataaatttatttaaaatttcattttaatttaaataaccctgtagaatcaatgtttaggttgtcagggttaatgtatttggtctgaattggtgacattatgaaggcaccactgccaaaaccagcagtaataaggccgctgacgaggccaacacgatgaggtagccacttaaaaaacaaaatgaataaatcaaattaatgttttataaaattatttttttcattaattttttattaaataaattgcacaaaatttaaattaaattaaattatgtacggtcttattactcaaaaaattaataactattcatctaattatgcagccaatattaaaaaagatatttcaataatattccattttttcaaatttttacattttgaataaataaaaaattttgatattattaaataacaccttaattatacatttaaaaattagaattaagtgcctcaatttattacaaaaaattgttatgtaaccaaaacattattacaaaaataatgacttaatttaagttgaacgtataaaaatgaaaaaataaattcaaaatgaaatccactttctggcattgtgtcaacacacaattgtatgcaacgccatggccaaaagcagcaaaaaatcccagtgtaatgaactgaatgaatgataaagcattagctattagaaatataaattaggaattaattaccaatgaaaaatatgatttttgtatggccaagtaagaaagtgccactcccaaagtgtacagaaatgagccaaatgctgctccccatcgtgcgccaatcactttctcaagataaccaccgacaagaaaagcgaaaggaaatccagctaaatatttaacatttatttaattttaagtttataaaagttttttaataaaatttgtcataaatattaaagaaaattttatgaaattttctagcggcgcttataattttatttccgattgcatttggatttctcaaattttgtacattcttagaaattaatgcctgtcaattcaaaccatattaagaccaaaaaacttgaaggcaaaattaccggtaagtaaaatttttaaataaaattattttccgatataatatttaaatcaaattttttgtaaaattttaccgagcaaactttgaaaccatattaatgtgccatcatttaactcaggatcgactttccagcgtaaatatgatgccaaatatgggagcaaattccctataaatcaatttaaaaatttatttaatttcaaattatataatttaaatgaattaccgaatgtgtacacgagtccgtaagtgaattgcagaataattcctgcaattataacaacatatgcacgtgaatttggtgaaatatgtttcagaataggatcatcggtgtccatttcaattatttaaaaacataaaaaattatattatttaaatttgggataaaagggtgctaggtcgatccacaaaaaagctcagtgtgggcgttccacaaaaagctcagtgtgggcgttccacaaaaaaagctcagtgtgggcgttccacaaaaagctcagtgtgggcgttccacaaaaaatgctcagtgtgggcgttccacaaaaagctcagtgattgataaaataaaataataaatttaaaataataaatttaattattgtattggtaacatccacgttgaaatcaataaccatcaatacatataattttgggctaccactgaaaatgtaaaattaatacaataaatttttatatgtttaataaaattataatttagaaaatgaataagacttttatttttatttttttgttatttcgatttgagtattcgacctctaccaattccggttttgaagaatttataaaaaatcacaaagctatagaacttgtcaaaagctatcgaaattaaaacattaaaaaaactccatgaacaaatgcaactaaaaggtattgacttaagtttttgtaccttaagacgctacgtgtcaagactaactattgtttctgcgcatacaaataaaaatgatgcttcaaactcgaatgcttcaagccatgaaatgccaaaacatgaacttagatttgaaaagtgcttttcaaaaactttaagaaaaaatgtttttataattggaaatgaatctgcttggagaaaatatgttcaaacaaatgagaataatgaagacatatatatttcttgttcaaaatgtcgttattttcgcgaacaagaaaaaaatgttaatgtcaaatcgatcgtcgcatcagctgttctgcgacagggaacacaacttgttatgttgcagtcaaaccataatgctaactgtaagcccgaaaaattagagaaactggaagcagaacaggttgatagagaacaaagaagagaaaattataaatgtgagtcagaaggcaagattatttggcgcaaaggtttgggaaaagcacgagaatccgacttaaaaacagatattgatccgttagatgaaaattcgatttcgagtaattatccctcttgggtatcagttcgacgtgcttacaatcgtaggagacaacaattacaaggcacagattcgaataatccgtttgatgttcctgaacggttacaattaacaaaattaggatcactcaaacttctgatgggaaaaacaattactgaaacagaatggatgatctatagaaatcgagaaattggaactttgctttttgcatctaaaattcaactagaggctgctagatattgtaaaataatggtagcagacgctacatttgagttagcacctagaggatttagacaaatatggcttaaacatctcaatttgggctgagcgggcgtggcgttgtcggtttccttcatggtctaaaaattttatttagataaatagtcattttttctaaccggtaaaacaaatctcctctaaatttggagtgcgccaaatttgttcgattttggaaaataaaaactcattattaaaagtctcaacatccatcgtgattgtgtgttcgtcaattctcattttaaggggaaaaaaaactttcagtcgttggacatctgtttaacaggggaatttaaattcttatgatataagccttttgagtaggtaggtaaactgactaacattttccattaacgccatgtatgctataggatatcaaatatccaaccaccgccgatccgaccacaattggtaccaaaacaagagcgacaatacctccaattgctaagacagagaggatagcacgacggtgtaccggtttttgttcgattttcacactttggtaaagtataagatacaaaaatataaattttttgattggatgcattgcagcgattgggagagtgaatatttgtttaaatttgtgatttatagattaataaaaattagcttaaatactcaaaattttactatccattcttatgttatcaattaattcactgtttcgggaatgaaattataaaatctttacatgaaatgcaaagaaaattagcaccttatcaattgtcttcaattaatttgcgaattttccttttttagctttgtataaatattataaatcttttttatacacatctaatagaatttaatcagaattacacttgccgttccataattaatattttaaaatttattttattttatcatcactgagcttttt

SEQ ID NO: 15376 - DNA, 2547 bp, Heterodera glycines
atgaattattaaaatagtttcacattttatatcaaatatcaatttcgacttcaagtacgaaacttgaatgaaatttattctacatatttgcagttgctaaaatttaaaatattcttgttgcgttaaatttatcgagttttttaaatattaaaaataatttgctttaaatgattttgagaaagtaggcaaataaattttgaattattgtaaatatttattttactttttttctaaattttaatttaattaattttctaaatatgtgattattttagttttccttcattatggctctgcttaatttatgcattttaagtttatcttgttcatgttcggtgtgtattaattgtttatccaatttatccaatagtaacacttcactgctatatctaatataataataattttattttttacatgcgtaccagatccttttcgaaatggtttatcatgacaaaaggctgctcaagtttatgcttttctattcggcataaaaaattaaaatctttaaattccctcatttttatcgaaatatagcaaatttaattaaaatgaattattaaaatagtttcacattttatatcaaatatcaatttcgacttcaagtacgaaacttgaatgaaattatatatatgttatattgacaaggcaactcatccttaaaaccaatttctcgggaacggctgggcaaaccgggctgaaattttgcaccgaggggtagctcgagacggggcatccgggaaaaatacgaattttccgatccggtggccaactgagtaccggggaccgatttcctgttttttcgtgcagttcggggcccataacttttcttccgaaacataaatcaaaaagtttccgctggtaggaacctaagttgaagtgttgtctaattttcaaaaaaaattccaggcctctacctataataggaagggctgcagaaattggcaacttttcagtaccaactttgtccacttcagtaccgggcgaataactcattagcgtttgaactgagcggggggtggccagcggacttattgtagagttttgtaagcccgattttttcaaatttaaaaaattcgaaaattttcaaaatttctcgagctaggccccctaagaggtttttgggtttttgaattttatgattttttgccgatttttccggggaaaacggagaccactttcaagcaaccgtttttcgagctctatcgattggtaagtttttgaaaaaaattcggtttttttccggaaatagaaaaaatttttggcctgagcgggacatttgagtcccgggcctataactcgtcagggatcggttttagccaaaaattgccttagaacatttttgtagagcattttaaatgctatcgaatggtgtactataagtctggaaaatttcaaaatttttcgagctaggccccctagaaattttcaaatttttttttgtgggccaaaatgggggtgaaaattttttttctggggtattttgaggtgctgaatacgaatataatgtttattttaagttttggaaattttagaattttttaaaaattcgaaaatatttttcaattttttgacccttgggattttgggctaatatttgaaaattcataacaatgtgttgtattggccaattttaatgaaataaagctttaaaaataaagaaaaataaggagaattttatgagatttatttggttttataatgttcaaaagaaaaaaagttattccagaatttctggaaaaattcggattttcagataaaattttataactcggttcagaaaagtcattctgtaaaagtaaaatactacaaaaatccgcaattttttgctctattatataaattttatttggtatttttatctcttctttaaaaaaagatataaaaataaaagtgattttgtgcttcgggtccaaaggggggtgaccaggatttttgagtggaaaattttttttcacaaaaatcttccaaaaacatgtcattaggggttatttgggccgctgatcatgaatatgtgatcagattttactttatacatcgttaagacctcagaatccctgtgtgattggggattctgaggcatcatttttggggggggggcaaagttcgagtccggacggtgtaacataatttttctgtgcatttttacgttattttcaatgattttaattaatttaaaatattttgttgagttaataaataaaaaattatatttaaattaattttttttttgatgaatacattttataagtttaaattaattatttttttaattgatagaatttcatgtattttttttaattaaatttgttaaaaaatattttcattttaatttaatgaatttactaattaatcactgttgtaccccttctaatcaaatttgtactacttctaatcactgttgtacctcttctaattactgttgtacctcttctatttactgttgtgcctctctaataactgctgtacctcttctaatctctgaagtgcctcttctcatccctgttgtaccccttctaatcaaaatggtactacttctaatcactg

SEQ ID NO: 15377 - DNA, 1108 bp, Heterodera glycines
  misc_feature (14)..(14): n is a, c, g, or t
  misc_feature (1009)..(1009): n is a, c, g, or t
  misc_feature (1018)..(1019): n is a, c, g, or t
acaaaaatccgccnaattttttcctctataatataaattttattttaccatttttatcacttttttaagaattttttataaaaataaaagtgattttgggattcgggaccaaagggggtggacaggattttgagtgaaaaatttttttcaacaaaaatcttccaaaaacatgtctttaggggttatttgggccgctgatcacgaatacgtgatcagattttacttttgacatagtcaagacctcagaatccccgtgtgattggggattctgagtcatcatttttggggggggggggtgcaaagttcgaatccggacggtgtaacattatttttctgtgcatttttgggttattttgactgtttttaattaatttgaagatttttttttaaattatttaaatttattttttttaacttaaagaatttcattatttttttttgaatttgtaaaaaaaaaaatttaatttcaaattaaataaatattcaattaataatttccaacgttgtttttaattaataactaccatttttttcgtgttttcattgttttattcatttaaaatattttttattttattaataataaattacatttttttatttgaattaaatttttataaaattcgagaaattagttcctttcaatttcaataaatattctatattataaatttctaactttatttttaataagtaaaaggatttttttaatttgataagtttataatacatccaataatacaattttcttatttatttcattttaatccatgattgtacctcttctaatcacttttgttcaaattttaatcactgttgtacctcttctaatcactgttgtacttcttttaatcactttttacctcttttaatcgctgttgtacctcttctaatctctgttgtaccttttttaattcacttttgtacctctttaatcaccgttgtacctctcaaaatcactgttgtatctcttctaatcactgttgtacgtcttttaatccctgttgtncttcttttnntctctttttaactcttttaatcgctgttgtacctcttctaatccccagggagatcttttaatcaccgttgtacctcacctaatcactgt

SEQ ID NO: 15378 - DNA, 924 bp, Heterodera glycines
tgctattgacccgcgttttttggtattggatgaaaatgcattcgcttcctgaaagatggttgaaatagaaaacaatgcttattgtcttttcttccaagccaatacccagtaatcatcgcccgaatcccaatcctcttcaaagtcatcttcactttccgaaaccttctttttgcctttcttagccgctatctggaaattattaataaaaacttagattttcatgtttcacctttgacgttgttttattggttttggtttttggaggagctctcactttcttaataaatttgtttaaaagttaaaataaaaataactaatgcctttggtttaggttcatcctccttctctacaggatcatcatcagaaccctctaggtcatcttcgtcatcgtcttcactttccaaaaccttctttttgcctttcttggccgctatctggaaattaattaataaaatttagagttttcatgtttcacctttgaagttgttttattggttttggtttttggaggagctctcgctttcttaataaattggtataaaagttaaagtgcaagcaactaatacatttggttttggttcatcctctttctctgcaggatcatcatcagaaccctctaggtcatcttcgtcataatctagccctaaaccttcgtcttctccatcctttccctcttccatctccaattctctaattattgcatccatatctatgcctaaatcatcgtcatcgttatcatccatattgccgtcattatcatctatgttgtcgtcgtcatcgcccatagaatcgtcatcttttacaaattgtcgtcatcttcctcaatttccaattgtaatttctgttcttcgctatacttaattgtatggtcaccgcccttttttatcttctctccaatttttttcatttttggacgaattgatg

SEQ ID NO: 15379 - DNA, 1241 bp, Heterodera glycines
  misc_feature (34)..(35): n is a, c, g, or t
  misc_feature (51)..(51): n is a, c, g, or t
catcgttctcacagcaaaaacaaatgccgagacnnggaaggaaaagagaangaggtagcataatgggaataatagttcctaaaaaaatttaaatgataattttgttgtaaatctttccttttatgttgcattgctttttcctcttcaattgcgacgcaaaacgcagaaaaaattatgtcagagggttggatttattgcgtggctattgacttttacaattggtagggcatatagaatatgcgaatacgtaagaattggcagagagtgggatttatttcgtggctattgacttttattattgccatggcatatagaatatgcgaatacgtaagaattggcagagagtgggatttatttcgtggctattgacttttattaatggttattgccaaggcaaaaaaatattttacaaacgtaaaattgagtcaaattggattatataatataatgtttgaaaatataaatcatagtcctcaaagtcaaaaccgctcaaaaaggttggaatcggttttagaagggcccaaaacattgagaaaaacgcaaatttggagcgcttgccatttttcaggaaaaaatcgggtgctgaattgtccactaggtggggcgtgcgttaaggtacttgcggcccggacatttgcgcctcagacatttgcggcacgacaaatgcggtcgggcatttgcgcatcagacaaatgcggcccatttcttaagggccattttcgggcacggaacgccaaattatcagcagttgactaattaattcatttaaccaataaattcttgaacaattcaataataatcgaattttaataatttcaacaaatttttcaattcttctttttaatttcgccaaaattttattgttttagttcaataatgtcgcaataatatttctccatttcttttaggttaggttattaactggtactcccggtgttcagttaggcatgttttcggcctcggttttcggttttggccaaaaaagtctgtttttgatttcggttaaacgacagtgcactacttactatcttaatctttttcttcaagattatcatatcgttgaatcaagcctgttacagctctgtcattctcaacatattcttcaatcggtcttgactcaattctcttgtaagataaattcatagacgtgatcagaagcgccgcgctatgacagaaattgaaagaattttttaatttgcttaacaaacaaaagttatgctgcttcttgcaaagaagactta

SEQ ID NO: 15380 - DNA, 3173 bp, Heterodera glycines
  misc_feature (3145)..(3145): n is a, c, g, or t
cgtcggttttcctcacactttctctggcccattcttgctctcttctcatcatgcttttacatctcatccccaaaccggaatgacccctggttgcttttcttcgatttcccatgccatccatctgagatgaaggtggaccgctgttcattattgtaatgcgcagcttggccgtggaagttcggattggagagacgaagggcgaagccgagagtttggtccattcattcactttcacttcattttttatttaaggatcggggacgatcctaaggaaaggggggagttgtaaggattattagacgcatttccctcatttaattatttcccattggccattatcaattcaattacatttatccttttctcacgtttttccttttctcattgtaatgtttctccgcccattctcttcgcattttctccttccccagtgatcagtcagtcagtagtggtgatggaacagacttcaattatttattccgatttctcgcttcgtataaatccaacaacgaatgaataaagacatctttaacagtcaatgagtcgtttgggggttcggggcttggtcaaagggcccttggcttttccccattccctcccaaactccatccgggataaacggtgcatagttggtctgggggcacagtgcgcatccctcactttatgacgtgccaaagtttttagttttttataattaaagaaaaggaacaactatttcctttcttcaaagaaattgttagtgtagaggtaattcgttagtcaaaattttttttgggtcaaaagttcgaatcccctatgtgtaaattcattttgtaatttttatttttgctttttgtgagcaattcaattatcaaattttatttctttatcaaaatatttattttaattttattccattaaaaatcaaaaattgcattaaacattccaatgcgaaattatacacattaaattactttttaaaaaaccaattcaaattataaatatatatcgtccaccgaattgtaccgttcagaatactaaaaagctattcaaatttatttcggatcaaagcgattccgaaaatatcatatactgtggggattttaacatcccaaacattttatgggatgaaaataaggtaaaacatataaatgatcctatgtcaaatatgctgattgagtttatgaaccaaaaacaattgaaacagcatgttaaagaaccgaccagagaaaatacgattttagacttagtaatgactagcgaatcagaattaattaatgaattaattgtattggaacatttttcaacttccgatcataaaatggtcggatttcaaaaaagaaaaattccggcgtaataatcccagtgtttatagaagagattttaaaaatattaatttttcgaaattaagtcgggcgattcttgaaaatcgtattgatttatcaataaactcagtgtacaccgttgatcaaaaatataaagaattcttaaataaagtactgaaattatatgatacttttataccaaatagacctcatcgataataaaacaatcgtatcctcaaaaaataagagatttattttcagagaaattactgttacataagcttgtaagaaaatttcctgaaaaaagtgaaatcattttaaattacaaaattatttctagggaaatgaaaaaacaattgcacaaattaagaaatgaacaagagtcaaaaattatttcccaggggcaaaattcagttaacaaatgtattagaaataaattatcaaaagttaatgaaattcctacgttaattgatagtgctggaaatatgttttccagtaatgagcaaaaatgcgaaatattagcagaaatatttcaaaaatcttttttagaaaattcagttgttaatggttcactgactcaatcaacacagaataagattaaactttctgacattgaattgaatgctggcataatttggaatatattaagaaagctccccaggcgaaattccacttcaccggataacattccttacattttattaaaaaattgtgctgagccaattacaaaaatattagctgacatatttcgacttgctttggattccggtcaaattccggaaatatggcgaacatcattagtggtaccaattttcaaaaaaggcgaaaaaactgatccattaaattacaggccggtgtcattaaccagcactgtctgtagagtttttgaacgaattttaagtagcaaaattttagaatttctgaacggtataagattttttgataaagaacaatttgggtttttaaaaaataggtcgactacaacccaaatattaaaaacaatggacgatatatataattctctacaaaaggatcaacaaattgacattatctatattgattttgtcaaggcgtttgattctgttctaattgatttattacttcaaaaaatcaaaaagattggaattgaaggaaaatttcataattttttaactatctttttaaaaaatcggagttttaaggttaaattggcgaagaattgtcagacagtttcagaatattttcaggagtgccccagggaagtgtcttagggccattactctttttaatttttataaatgatctggcgtcctttattactagggctgggatttttatgttttaacatattttttttgcggcttagttatggcgagagaagcccaaaaataacattttctccgaacaattttcgaattagagcgacttataaaaacataaaaacacatattttggcgttttcgcacataaaaacatatcgcacatatttcggggtttggcacatattttgcacatattttggcatttttgaaaaaaatatctaagaaaaacacaaaaaattcaaaaatgcacccctaaaaatcaactttcttgccatttttataggctctttcaaaaattttctttatttatttcgtgtaccgaaaatcggattctccattaattcgttactggatatcgaagtttcttgctggcacttactcaactgatggaaaaataatctttaaaacaatttatcaaaaaaggactaattttacccccaaacacctccaaatgttttttatttgcatttgtgcgggcaaaaatgaaaagaatgagtttttttggaatttttatgcaaaaaatacccattggtttttccnaatttttagcacatatttttgcattttt

SEQ ID NO: 15381 - DNA, 3368 bp, Heterodera glycines
ttttagcttttgtcgtattttcgctttaatctcttcgattgttttccttcaaattgcctaattatccgccattaattaatgacttctccccccctcgccaaatgcgctcctcattttggaggcccaagctgattttgcgttgaatttgttgtgtggcgtgtctagcgtcgaccgttcgtgcattgtttcgccgttttctgtcgccgtcactttgtccatggtttacgcgggcgccaaggaaaagacgggcgaagaaatcggtcaactgcttggaaatggtgagaattctcgaacattcacaaacggaaagattttttaaaccatttttagaggaaaaattcttaagatttgaaatgctcgaggccgggttcgacattcatatttggcggaaaaatgccaaattcgttatcagcaacccagacaaccacagaaacatttttctactgctttgaaacaaaaagttctgttcttttcaaggccactgaaaaatgcctccaaataattgccttctcccaccccagttcttagtcccccaccctattaattacccctttaattaattgttctctttccgctttctttttaattgccccccttttctgttaattaaggtgcgcccgagtcggaagtgcacaaatatttcggcactttgctcaaatcgatcgcaagtggacagaacagcaacactttggagatggccaacaaagtgtacgtgaagaaaggcatcagagtgaagaacgcgttcaaaaagaaaattgaggaaaactacggtggacggatggaaacggtggactttgaggacatcgaagggacggcggaggtgggaaattgttttattggcatagtgccaaatcagtcccgaaaaatttttcatatgaaaatttcgagctaaaaaattttactttcataattttacgtgaatcatgtaaagcgctacttaaaatcgttcattttttgaaatttattataaacacagggcgggctttttgtttgtaaaaaacaattttgatagtgtcaagtcgggaaaagcgttcccgggcgttttctgggtctctctctgatcacgaatctgacaccattcatttcgatcaattcaaatctctggccgaattcgaatagaaaagcaaaatttttatcgcttttttgcctcagaaaatcaacaatttcgtggaggaagcgacccatgagaaaatcagcgatttgatcgcgcccgacgctcttgacaaggagagttggtaaaagttttaatttttgtttctttaactctatgacttttcaaaagtgttaatctaatacatagaaatacttttggttggcacacgcaaaaaagtcgccggacaaaacatcgtcgcaaaataactatcaaaaaaacaaaacaaaaccgtggtttactgagaaataaaatttcccttaaatttttttgtttccttgaaattctaaaaaaaaagaatttgtttacttacaattatgcttatcctggtaactcttcggcggcaattttcaaaaattacgaacatttttttattctttgccggcgattttgatggaagaagtaaaaaacaaattgtaattgtctgaaaatgctttctttctttcagcttggtgctgatcaacgcgctctacttcaaaggcgcatgggcgaacaaattcaacaaaaaattcaccaaaaaggcgacattttatgtggacgcgaacaccaaaaaagaggtggcggaaacaaacacattttaataattaggaaaaattaaaatgccaattatcagttttcaagggccaatgcccacgaattcggcaccaatttcgacaattttcgaaccgatgaccaaatttctaacaaaattcgattttttgaacaaattaaaagcattaaatttgcgatgaatgagaaggataacagctgattgattatgtgactcgttcactatcagtcgaaatggttttcgggatttcgtggtcagtggccatgagaaaagattattggcattttaattttgaaatgaattaaaatatgggcaaaaatttgtgggggctaaacccacaaaagagtcattttgtccataaacgaccaaatctgattttttagctggaaacaatgcatttgacgtccaatttcatttatgccgagaatgctcaggtcattcacttcacacattttcatgcttttttcttatgaatttgacaattttctgattgcttgtacagctccaactcctcggcatgccctacaaaggcgaaaaggagttcatgttcgttttgttgcccaagaaacgctttggactgatcgaattgttggctcaattggacggcaaaaggctggtgaaactgatcaaaaagcgggacaaatgcaaagtgaaggtagataaaccccaggaggaggacaatttctccgaaaaaatcacaaaaaaaacagagctgggctgaaaaggcagaattttgtagcgatttgtgccaaaaggcactaatttttccatttttgggccaatttttcaaaatataatgcttcaatggagtccagcggtgccgatggcgccgctggggaaattttttttaaaagatttaatggagcatgataagaatttttcaaaaaatttgccaaaattttaaaaaattgcccatttttgcttgaagaatttttctttttcatttcggggggatccccccccccccctggatacgggcctggcctaaatgaactgtcctaaaacacaatgccatcccattcttttcacaggtgcagttgcccaagttcacgttgaaagccacgcatgaactgaacgaaccgttgaccaacatgggcatggccaccgcgttcaccgacagcgccaattttgagggcatttccaacaataaacagttgctgatcagcaaagtggtgcagaaggcgatcattgaggtgcggttattgcccatgatacacacacaggacaggcttttcagaagggtataccaaattttttacaaatttcacagtggcgtctatcggcaaagtcaggccccctattttaccatttttaaaaatttgactctctaaatggcaaacccatggccattttggcgaacaacggctgtaaatgcctgcttttttccacggcaaagaaattttgataaatttcggcaaaaaaatgattaaaaaatgtttttttttgaaacggggatttaacatcttcggtttttgtgccactaaattcgacgattaaggtcaatgaggagggcactgccgccgcggcagtcactaaatgccatattaggtattcagaaggcatcgaatatcgttttgtcgctgaccatccgttctgtgcctttctgattcgcgatgacactgtgcttttcagtgagattttccgcaaatgattccattccatttatat

SEQ ID NO: 15382 - DNA, 3241 bp, Heterodera glycines
ctcacatcaacggacattcccaccaaaaaataaaataatgcaagaattgaattaatacaacacaacgtaagaaaaaggaaaagcaattgggaaaataaatataattttgggtgcttttggtaagtgatttgattggacggttttgctgtgttcggattattcgtttgttatccattcattcgcttctcatgcgctcgcaccgccgtccgatcgcttaagcattctttcgcggtacacgtccacaagtttaagcttaacaaaaacggacacaatgaaaaataaaattaaaatagaaaattcatttaaccccaaccccaaaaacgaaccgtcgctgcgtttaggtgtggctttaacacattcaacccaatcgaatgactgatggaaaccaaacaaatgatggccgaacgtcggaccatcgactgggaattgtcgtagcactgagagagcatttggaggaaaatcaacgaattattcacataaaaatcaaatgggaagtgtaaatgagttttccgtttccaaaataaattaaaatgaagaaaaaattgtagaaaatgggaaaaacatttgccactggttggttatatgctcttctggcaattccacccattcggcctcccccctttttttgctggtacttttttgtcagagccggtcgtttccacccctcccgatccaaaaaacttaaaaatatacacttaaaaatttttcaaaaaaagaaaaaattaaggaaaattccgtgactgaaaatttcataactttttagaatctttttgaaaataaaaataaaaatttcgtggggtaaatgaagtgcttgctccttttgtgtccaatttgcttcttttttacctgagtcatccgaggcacaacggtggggagcagtccctccacctgaaatatgtgttaaaatgaaacgaataaacaattctttgtttccctctctcacttcttccggcggcagtttggagagcatacttccaagcattttgatcgctcccgacagttggtggtatttgctgtgtttgtcgtcgatgacggtcagcaaaaggtgcatgcacgtgttggtcggcaaatggttggcaaccgcagcaccacaatcctcggctcgaagaacggagatggggaacaaatgtaatcaacgcatgcaatcataatacgaaattgaccaatctacgaatgggtgcattacgtttcggtacttttacgttttggtggcacaccccgttttttatcaaacgtttgacgcattcatatttatgcaaaatttctctggcgagagaattataagcgacacaaagtcaatcaatgcatttgaggataatgggggtacggcatcaaaacggaaaagcaaatacgtttcgcctaatttatttgattttttaattttcggggggggggggaacggagttcggatatggccgagccgttgtaccaaaaaagtggacaaatcactgtgagaattacccgctctgaccacggtggcatcctcacattcgtgcgcattcagaatgatcatcaccaaaagttcagttttggcaaccaaacgtttcggctggaccaagctgaaaaaaaggattgaaaaggaaatgccgcctgccgcctctcttaatttaattgagtgcctaatgaaatgattcataattggtttgccaaatggtccctaattaatcaccccccccccctccctcaacaaatgccaactcaccacaactctttgagtgttttaagtgccgagattttgatgatgttaaagtgacgctccaaatcttgagaaatgatctgttggatggcgaagaaaattgtgttaaaataatcgttccacagcgtaatccctccttcgcggatcttaaaaaacagagaggtgattgtgaatgcttacaaatgttgcttttccttaccattcgcgacaacacttgaagcgcctcctcaatttccttttcattgctaaattttgacaaattaaaaaaacgaaacaaaatgtgaatattacgtcactgcattggccccaattgtgtcacatatttcctggatgaatgcaatttgctgctcgtggtcattggctaactgttcggagctcaggaaggaccaaatcaaaaaagtcaaagtaaataggctaagaaatgaaaaacagaataaaatggacttgtgttcaacagctgggaatcggagggggtacgcccaagagaagggggggccctcaaattcagcagaacactcaaaacaaataagcgcaaaaaaggtttccgtttcccgaggcagtgagtgctaaccaggggaaagggataggaaaagggcgaccgaagggaaaagccaagcggtcggccgacgtaaaggcgagaaaaagcaggcaaatgccgagggcgaaagtgccaaagggttggacgaagcaaaggcgagaaagcaaagggatgcccaaatgggctgaacgccaaaattggtcaacgcaaagggaaaagcgaagaatggccaaatggcaaatgccaaaattggtcaaagcaaggcgagaaaggagaaaagcaagggggccaaatggcggagcgccaaaattggtcaaattgtaagcaagggaaaacaagggaaaatgtgaacaaatgagagaaaagtttttttttgtttttgttttattttaaatgaattcggcaaaatttgggtgagaaaattcgtcgttggtgatcagcggaaaatactcccgcttacgcgtacagcagtggttcttccgcttctgaatcggacgacgtccattcgcaacacttctgccaccgagcttcccctcgctgttccacaaatactccgcgcgcgaactttgggccaaatttccatgttggttgtttattatttgtcttatttcttcgttttgttacaagttttggtaatactatcgatggtgcccctcccctttttggaagttaattttgtggtacttaaattttttgtttctaatgataaaaacgtgtttctaggggttttcggggctgctgatcacgaatatgaactctattggacgaatttccgaacccctaacccgaaattcgaactttttttcgaaaaaatttttttttttaatccgtttaaaatgtgtcaaaatgcgtgctccatgattctccggtgagctgctcgttcaacacatactcaaaaaataaataaaatttaacaaatttctaaaattcaacaaaatgccaaaatatgaagtgtaaaattggcgcgacaatcagttttcgcatggatacaaagctgccacttggga

SEQ ID NO: 15383 - DNA, 1123 bp, Heterodera glycines
caaagatgggtaacaatgccagtggatatatggatatatcatttatgtttgcgcgtgtggagcactgaaaatccgttctgtcatttgttgtacgcgcacggagagcattgaaattaatcttttgttggaaccaaagatgggtaacaatgccagtggataaatggatatgccatttatgtttgcgcgtgtggagcactgaaaatccgttctggcatttgttgtacgcgcacggagaacattgaaattaatcttttgttggaaccaaagatgggtaacaatgccagtggataaatggatatgccatttatgtttgcgcgtgtggagcactgaaaatccgttctggcatttgttgtacgcgcacggagaacattgaaattaatcttttgttggaaccaaagatgggtaacaatgccagtggataaatggatatgccatttatgtttgcgcgtgtggagcactgaaaatccgttatggcatttgttgtacgcgcacggagaacattgaaattaatcttttgttggaaccaaagatgggtaacaatgccagtggataaatggatatgccatttatgtttgcgcgtgtggagcactgaaaatccgttctggcatttgttgtacgcgcacggagaacattgaaattaatcttttgttggaaccaaagatgggtaacaatgccagtggataaatggatatgccatttatgtttgcgcgtgtggagcactgaaaatccgttctggcatttgttgtacgcgcacggagaacattgaaattaatcttttgttggaaccaaagatgggtaacaatgccagtggataaatggatatgccatttatgtttgcgcgtgtggagcactgaaaatccgttctggcatttgttgtacgcgcacggagaacattgaaattaatcttttgttggaaccaaagatgggtaacaatgccagtggataaatggatatgccatttatgtttgcgcgtgtggagcactgaaaatccgttctggcatttgttgtacgcgcacggagaacattgaaattaatcttttgttggaaccaaaagatggggtaacaatgccagtggataaatggatatgccatttatgtttgcgcgtgtggagcactgaaaatc

SEQ ID NO: 15384 - DNA, 1759 bp, Heterodera glycines
ttttcagtacagtttcctccattcgtggcgatttcccccaccccgcggtgatcgattcgaggccgaagcctgaccagcccccttcgggcagttcacttaagtgaacgccaagctgacggacgtccccggtgaccatcattttcttgagattcggtgccccacatgccaaatacactacggcggtaaaacttgtctgcgttgcttcatccaaaagaagatgggttgctcgacttatcgttccttggacgcgaccagccatgtgagtcgtgaggaaaataactttccttttgtcgtatttcagataactttcagccacttttgcttctcggacccgcagaggtgtgttaaaatctaaactaaacaaattaatgttccgcatggctacggccgcttaaattacgacacaacggctacggccacctaaaaatctcaaaattgtggaaggcgtggcgatttctgatgaatttaagttcagatctaaaacaaataaaattctgatggactccgtcgccgtgccttttcttttggacaacgtcccgtctttcaagtttttctccaggagatttgtcctttccaatcacttcgtccacactttcaacatgaattttgatgaacacgggcaaatcaacgtaatgagcagcgagcacgcctactttatgctgaaggcggcgcatttcggcgacatggcctcgttccatcacatccgccatgcgccaacgccggcggcggcaaaacggcttggccgtcacatcatgccgtttgtcgagcaacaatggcacgtcgtccgcttcgaattgatgtgccgtgcgctgcgtgccaagttcgccgttgagcacttgcgcagtgcccttcgaacgacgggctacggccaattggtggaggcgtccagagatgagtattgggccgctggacgcgagatgcacgacgtcggtttaacggctacggccaattggctcgggcagaacgctcttggtggagccctcatgataatccgggaggaagtgcgcacacacccaccgacaccgaacaacctggtgcggcattatgtcgtcgcgcaagcttcggctgaggactacgtcattgtggcggcagcctttgatcatgagcccttctttgttcgcgttggaaacgacatgctgcagggcctgggtttgcagcgcaatctcgccgttggagacacgctagttctggttggctactactggagagcagctttcgaacaagtagcgcagattggtcatccaacgttgccgggctggctccatcagggccaaattgtgcgtcaagcggaggcgcagtcggtacagaatgtcgtcttggtgccatctttcgtcatgccaggagtgatcagggccatcaacaacggcagacatcagggccatcgcattgtttgctcggtgaatgtcctggtacacggtcgcatccatactctaacgaagcgaaacatgaacgaaggcgtaattgagcttttggaagagggccaaaatgtgcaactgcatgtgatggaggtgccggcaggctggtggtgtgctcgaaattacatcctccctccaaatgcgcttcttggcactgggatggaatggcagtcgaacggaggggaagtctttcccctgtggttggagctttgaggagggaaaaaagggggcggtggtgatggaaagagggcgaatggggaaaagaagaggaagatgaggagaggaagagaagggaattgacggagaagaggcgagagtgaatggagactgaagggcagtagcaa

SEQ ID NO: 15385 - DNA, 2173 bp, Heterodera glycines
aaaataaaattcataaatattataactccttttctctattgcctttatcgaccaaaaattattaaattaataatagctaaaaatattatttctattacatgttttcgttgtctgcacaattaatggaatggtccgtaacaagaaattaattagaaatttacaaatatccgacacaaattaatttttaattatttttttatttattagaacaattggcaaagaaatcgacggcagctggtggaaaaagaattttcagatcaatcgctatttcaaggtcaccaaacggaattgaatcagtctgttccgttcatttttaggtgaaaatttaaaaattaataaattatttattttattttttgttttttaagggctcgtctttacccatatggtacaaaaaatggagatgccaatatggttggcgccatttctgagttcaaattatcaaaccctttaatttttctcgatcaaacatttgacacaatttgggtaattgaaaattaatattaaaaaacaattttttactgatgagaatcaattgaaattataaattttttattgataacaatcagtgattgttaagcatatttgcaaaagaaggttatctttttaatccctcaattaatattttgttttttaaattttctaattagataaaattaaaaagagaaatttgaaaattattaaaatttcccgaaaatgtcaaatctatggacctttcattacccgtagaaaaaatttgattgcttagattcaccggaatggcattgtgtcaatggcacccgattttgacccgtccacaatacccaaatcattgccaattaccaataatgggccacctttaattgctgtattatggaccaatgattgggatgctcaacgccgtcgggttctcattagggaaacaaatggtatactatacaaaatttattttaaaaaatggaataatttaaattttgcactttacagaggagacaattttggcaatggcacaaaatgaagtgaatattcaatttcgatatggcaaagagtttgagccaaagtcaatggtgattattacatggatggattcttctgttactgatgaagacgatgaaaatgaggtgatcaatttaaactagagctcggcataaaatcgtggatctcgacctggatttaatggttaagctctagacgtggatttcctggccaaaaaccgaagaaaaccaagatccaggaaaatccagacttgtcatggcctggatccaggtcgattcaatgttttttgacaacatgaaataaaaaaaagtaacacaaaataataaattcgaaaataatacctggaatttttagtttttcatgatttcggcagttttaggaaacgatccatcaccggtttttttcatatttgagttggacctagacccaggaaaatccaggcatggatccaccaggttcaggccgagctctaatttaaatacaattgattaagtcatggagaaaatacaatttattaaagtgttaaaatattttcaaaaaaatttctatttattaaaaataaaaaaaatttgtaagcgttttttatcgcttggaatctggtgacaacggccgtaaattcccccttattttgtttcaaaattttttgaaaaacaccatatttccgatgtttacagctttccgatgcagatgtgttattccaacttgccttaattgttgggaacaatgcatgttttgcgcacaatattttcagcaaattgccgaagagcgtaatggcaatggtaattaattgatgtgatgtaataaaaatccaaattcgaaacccaaaacaacccaaaataacagaatttatttctatgaaaaaagaattcaaaaaattttaattttttataaaattacgaataaacatccaattactacatatcaagagtggcttcaatgggccggcatttgcttcatcaagtgctgaaactgtagcagaaatgccaaaatttttgatgctgcccgggtcaggcacatctgattcatcacagctgactgaaaaaagcaatatgggcattccaggtggaaaatatccaaattaaaatttagtttttttccttttccattaaggtcctaaaaaattggaatttcaattttttcttaattaaaaaaatttaaaaattctaaattttttgttgcgtatttcctgtaaaaaaat

SEQ ID NO: 15386 - DNA, 1132 bp, Heterodera glycines
aattttggggtagcgacgaaaattattttgatttcttaaatatacttataattttgaaattttatggcataatgtcactagtttatcaagaaattttaaggtctgacacaaaatttttttgatctttgatcccgaatgtactgaaatttacaattttgcattttcccgaaattgttaaaattgataatgggagactaaaaatataaaatttgatacatttttgatcgaataaattgtaaaaataacttgatttgaaaaaatgttcttatttttgaccctaaaatcttatttttcggccttggtgttcatattttgaaaaattttcgatggaagccctggtttaaaaatgcatggaaactgggagggagtttaaccgaaatttttgcgaacgcgtctcaatatcgaatttgaccaccattttttgcggcgctctttttcaaaaaaagtttgggcaacagcagaagggggatgggcggcgatgctattaggagccgcgaggaaaattttttttgaaaatttgcaatttgttaacagatttttcctaaaaatacctattttagcaattttgggacaattttttgcaaaaaaaattggagttttggtgggccatttcttggcctattggaaaattacaaacatataaaaatggccaaagtcaaaaaatttttgccgtctcaataatgatttttttttcatattaattaagacaaaatttcgcttttctgcattagttaatattcttctttttttgtgaatattttgtagtttttaatttgtcggggaatttcctctccgatcacgaaatttcgctcatctgtaagaagttaggtcagatgtttggcaagtaaaaatttcatgattttaccagaattttcactacctaaaaaacaaaaatggaaaattaactattgcttagttaacaattaaattaaaacatttataaattttatattattttttaaggatggaaaggtgcaccaatctgtgacgaggacatcgatgaatgccaagatgaatcagtgtcatgcccaaatgaacagcccgattgtatggtaaaactcgaagatttttttcatcacacattttccaatttttaaagattttttgcatttgataatttcaaaaaaattta

SEQ ID NO: 15387 - DNA, 4318 bp, Heterodera glycines
tcaggtcgtctgcatgcccaacaattcgcgaatttcctccgccgttttcgtctgcaacaaatcggccaccgattgggccgcgtaaagacgctgagaaaatggtggaggacaaaattgatgtctttagcaggaaattgtgaacctccgtcactcctctcattacgaaaatttgaaaaaactcaaaatttttttattcatttcaaaaaaaaaacagaaaatatttaaaaatgaaaatcattctgtttcttaagtgaaatgaaaattttttagcttgatctgttcaaaacatttttttaaattataattttcccagatttggtctcaaaatgcccaaaagttcccgatttttctatggccccgaaatttaagtcaattacactagcaaaaaaaaaaaaaaacaatttttgacccgaacagaaaaaaactcttcagttgccctcccgaattgttttttctggttagggcctgcagagcggagcaggagtttacccccgccccccgaaaaaatttttacaaaaaatttatttctgaaaaattttccgggcgtctttttaaaaagagtacccttttgaaattttttttcacttttttttggtcaatttttttttttgtttattttttatgcagaatttgtttttttaacatggaacgtattgcatactatttaataaactgaaaaaaacattttaaaagaaaatttagcgctagttaaaaattgacaaaaaaatcgtgaatatattttttattcgccataattatgctgttaatacttaatattagcattatgtgtcaaaaaaacaaaaaaaaaaaaattgaccaaaaaaaagtgaaaaaaaatttcaaaagggtactctttttaaatagcgccaaattttcttacgaaaaaatttccaaaatttttttttcttttgtaaaatttgtttgagggacacgacgagtggggatttattatttaccagggaattgaggtccaggaaatgactcgcattcaaaagcattttcaactcagcgaactcaatctgaatttggaaattagggcgaaaagtggcattttttaatgcaaaatcgacgaccttgaaaaaggatttgtcaaactcgtcgaacacttgccatttttgggtgccggtgagagggtcctgcaaaaaataaacggggaaataaatactttttaatttaattcgaatttaaacaaaatttcatggtaataccagtctattgtggactcttttcaggacaaatttttttaaagacatgaaaagtaaagctccccggggtgttttggtgataatgagtcaatttcggctaattcagtacccataagaccgaattcgaacgaaaaatttaaaagttgatttttcgaaattcacattttcgaattgagatttgcttagtgcttattcattgctatagagaattttcagtaataatttccatgttttaattaaatttgagatttctgctggaattcgaattcgaggttcggaattgttacgattttcttaagttatttttggctaaaaattcgaaaagcaaaaacaaaagtttttttttcttaaattttcaaatgtatttttgcatattccacaaaccctttcaacgattggctctggctttcctgaaaaaaacaaaatgttaaaaaaataagaatggtggtaaaaatggcatgaaaaattaacgttaatgcaaaaaagttcgttttttcggttgccaccctttgacacaaattttccttcaagtcgtcccgtgggctacccattctttttttgtataaatttaaaaaaatgcccattttctttaaaaaatttcgggaattttaatcttattttcccctccaggggtgggtacccaccatcgcgatgctccatccattggaccatcttttcaaaggtgtgcaccgaaatgcttctcactgggaacacaaattcgtccggcaatgcctcgggcaaaaggcccaaaatctgaagaaaacaaagcaattgtaattcgaaaaggaaacaaacggaagaatttgttgcattataaagaattgggccctaaatccaggtcatttttatttgcccccctccgaaaatttaaaaaaacgaattttttttttgaaaaacatgatttagattttcatataaattgtaaaaaaaatagaataggtttttagactggattttcttttcctggatttttgtgcataaaatcaaggtcaaacgccggaacccaagtccaagtgggaaaatagtcaaatattttgcatttgttgacacaatttggtagtccaaaaggttgtctattagtcaaaaattaaagaaaaaaacattgccaagtattagaaaagctgagacttaaagtaatttgaaaacccaggcttttttagtccttgatgcaaccgcaataaataaggcaatcgatgatttttggttataaaaaaaaattaaaatgttcgaattcgggtccggtgttataaataggtctaaatggaggcaggattcgtgctcagcgcctcaaaacacccctagataagtgttataagaattttcagaaaaaaatttaaagaaaaaatttcaggaccaatgatctaggcgattgtcataaatagagcaactttttcatttttaccccatttataaactgctaaaaaaagaaattcttaatccaatccaaccaaactttttgctaattagttgttcattcattggcactaactttcactgtctttcggaaagcattgcattggagcagtaattggacacgaacagtgacgcattggccaccttcgcactcgcatttgacctgagaaaagttgcaaaaattgcaatttcaggaaaaaaaattggagaaaaaatggaaaaaaaacattaataaatgcacggacaaagacgcgttttcagcattaaatgtggccaacagatttcgaaatctttcccggcaaggattttttggcgccattggcattaaattttcaaaattttacgccaaaaaggcatattttcggcaaatttctggccaaagatagatgtgtagttgaatggacaggaaaaacatcctttggataattttttgtcagagtttgaaaagttttcaaccggtttcggaggggtacagaaaacgcaaaaaaatttcttccccctcccctccatttaattatttttggcacctctttcccaagcaattcgttgttggcattcttctgctgggaactgttttcttgttcgttgttattaggcggaaagtctgacaatgatgaagaggacgatgaagaagaggaggacaacattttaggaggcagcaaatttttaaaataaacaggagaataataatgaaaaatggtagaggtaaataaacggaagggacttgtacaaaagtgaaattttataagattttgatgaaccaacagcactatgggtacgccccactgtgcagagaaaagcctagtactatctcgtcgtttctctttttctttgtaatttctctcactttggcgtactatctcttctttttaattatgtaaaaaacaacatttacttctctccatataactttttttctatgcatacaagttgcaccaaattttgcataccgatagagaaaaaaattttgcatcgaatgttctataaggttttaataattttctatcttgtttttttgtaatacatatttaaagatttcgttgacttttttaattgtttaatggctaaaagaaatttgccacacaagctcaattgcaaaagagcaaggcaaaaaagggagaacaagcgagaggagcgacgaactaaaatggccaaggcgaaacacgcccgatgggccaagaaaagtgagtttttccattggtttatcgtaaaatctctaattttccaatttttagccgctccccagcccgacaccgatgccgaaatgccacaaagggccgtcgacatcagaggcaacggcgcaggacaacgacggacaaccatcatcaactccaacaccggtgacaccgctggaaatggacgtgccgtcggtggagatgatgggaatcggtgtgtcattcccttcaacgcctgccgacgaagaccaacaaattcaaccaatgccgtcaacatccacggcacgctgtgacctggtggcgacaccatctacttcaaagggcgccggtgcctttggtctcgacgatggtgagtgagaaatttcaccaaaaatttagttttttaagtcgtttcattttcattatttttaagtccatatgttcgacgagctgcggcggcgccacgtttggactgaggaggaactgcagcgacagcgccggtcaaacgccttcctccgaaacagctcaggcacagcgcgatcgttc

SEQ ID NO: 15388 - DNA, 2478 bp, Heterodera glycines
  misc_feature (51)..(51): n is a, c, g, or t
  misc_feature (157)..(157): n is a, c, g, or t
  misc_feature (169)..(169): n is a, c, g, or t
  misc_feature (175)..(177): n is a, c, g, or t
  misc_feature (179)..(179): n is a, c, g, or t
  misc_feature (187)..(187): n is a, c, g, or t
  misc_feature (192)..(192): n is a, c, g, or t
  misc_feature (194)..(195): n is a, c, g, or t
  misc_feature (200)..(202): n is a, c, g, or t
  misc_feature (206)..(206): n is a, c, g, or t
  misc_feature (209)..(209): n is a, c, g, or t
  misc_feature (228)..(228): n is a, c, g, or t
  misc_feature (234)..(234): n is a, c, g, or t
  misc_feature (238)..(239): n is a, c, g, or t
  misc_feature (242)..(244): n is a, c, g, or t
  misc_feature (253)..(253): n is a, c, g, or t
  misc_feature (2469)..(2470): n is a, c, g, or t
atacccactattttttaagcaattatacgcgaataatttcactttttaatnaatttttattaattcacaccggataatttgttttttaatggaatgcaatttgtataaatttattttttcttgtttgaaacagttacatctaagaatttaaattatnatttaaaatttnggaaannnanattaattnatttntnnaaatnnnaatnagnaaattggaaaatttttgtntatttnagannttnnnaataatttnttggtagattttcatcatcgccttcaaaatttcttggttcatcagtgtgatgtttttaacggtggcatcgtcggcattctctcgcttcttacggcccataaactcaactaaataattatctgatacaaaaattaatgcttaatcaataggagctttatgtaattacgataaatttccatctgagaaaatgcgtaattggaatccttaattgctttctaaaaaacggaaattaccgtaattagatttataggcttaattaattttggagtgtttaactctcttcttcgtcctcctcctcatcctcctcctcatcgtcttgcccaagctcttcaagctgatcttccagcgaagagccctttttcatcactttcggcagttcatccccaatggtgtcagactcgcgtttttcggcactgtgctgtccaagtccagccgctcgtgcaaattcagtctcgttgacgccactaattgaggagccaatctctgcaagttaaaaaatttcttaatttaaattttcataatttaaattaaatttaattaaagatgacaaattttaaagagctttttaaccaaattgaaaatgacgttttttataaattaaattatcaatttcgaaatttatttttatttcacataccggcaataaactgctcaatcattgttttttgcacaggagcggtgtcggcaatcacaatgaatgcatgagtcaaaaggctaattaatgaaatgcgtattttaatttttattttaaaataaaatatcactcttaaaatttcaaaataaattataatttataaaaaacgtaattaattttccattatttttagaattataaataaatttacttacacggatgccatcatgttgcgcattgtctgtcacttgttgtattaaattttggtctaaaatcgaatagtttttgaaacaaaaaataaattaaataaaaataggagtgattgaggaattcctagagttttaggatcacagagtgattatattaattgaaaattaattaacggagaggagcatcttacaggagaagcagatccatttttctcatttttcaaatactaattttagtggaatgtactcaaaattctgtccagaaaagtttgtacgttaatcctttaaaatagccatcagaaatttaattttacagtttgtctctaatcccaatcaactctaaaaatcgaaaaaatttcaattttataatgactgtcatgttcagaaaatagtttttattttattttttctattgccccattgaatagagtgtttggtggtgtgtttacaatttaatgcctattagctcattatcataatcatcatcatcatcattagcagcaccatcagcagtttgcctgctgctgttcagtggtcacagaagtgggtaaattttttcactgctctgctgcttattcatcattatttttaaattttcgatcggacggaccgttgtgaaaagagaaaaaaatgaataaattaccattttttacattagccatccattaataaaattagaaaaaaataaaaaaaaatgaaaattaatttgtaataaacaaaaattcttaaaaatattaagaaataggtgaatgaaattttttttttaataaattgatgcattgaacggtttaaattggcatcagagaatcggtttttcgatattctgtaaaaaaattttgagaaaatctggatttgtataaaatgtatttatgaaaatttggtcgtattctttcgtatggctatattttgataagcctttattagcatacgctaatttactaaactactcgagatttatttggtgaaattattaaattatttattataatataaattaaaggtaaaattaaatttacaattttttagccatgcattgttttgaaggcaaaaagtaaatcttttttataaattaccatacattccagtggattattccgcctggacatctttcctattcattttcgggttttaataaataaaatattatgaattgtagcaaatttaaatgaaattccacaactctttcaaattaaataaattttgaaaataaattgaaaaatcttttaagtgaaaaaatagataagcaaattatttatcaaagcagtgtcaagctgagatttttttatgtccatctctaactattaaaaaaaatcaccgaaattctccaaaataaaagtaaaaagagggtaaaaagtttttgcgaccaacaaaannagtaagca

SEQ ID NO: 15389 - DNA, 1033 bp, Heterodera glycines
  misc_feature (90)..(90): n is a, c, g, or t
aataaaaaaaatgaactcttttaattattgtttgatgaattttttttgtctataataattttaaatttatttaataaaaaatattatgcnaatatccttacaaattagcgtcacaaattgatatgttgtttaattacttatgtttgttgtttgagttgctattagatacacataatttaaattttaagttagaaattataaaaaacttttatgaaaataaatgagaatttcataacataatgaaatttcattttgtatagttttagaatttcttaatccaagtagcattaatccgatataaatctgtattgtatgcttgaaattaacattttaagttttaaatgatattttaaaataagatcgttcgatcatttataaattacatttttccaattaaatagggaaaaaaaaacaattattttcgttatgcatcatgatttcaatttttaataattcgtcttttttaatattaataaattttattatttattatgtatcaatgcctgccatcataaatattctttgatgtggaaaaaaaatatataattcaagatagatagttacatttggaaaaaagtttttgctcttttcataattgcatgactaattccttactaatcatttttcattaagcaattttatatttaattcattattgatcaattataaagattcaattttgattcttggctacctgtgtacaaagtggaacaaatttctatgcagcattaattttttacgtacgtatatacagggtataacaaactttcgtgcatataaaatttgaattcctttattgggtgtttttatttttggtataatgatttttttgttcaattttctaatttgaaatttcaaaggaaacgaatgccaattttttcggaatgacatataataaattttgattcaataattagtataatttgcttataaaaattaaatattaaattttgcgacgtaaaatatttaacaaataattgagcatttctaaacaaggaataatagttaatttaatagaattaaatcaattaag

SEQ ID NO: 15390 - DNA, 2504 bp, Heterodera glycines
ggggatctctagagctgtcatcggcccactccgttctgcgattggtttgccctcctaagttgccgtcgtttctttgtcccctccttcgatggctatgttttctccgtgtgaaaccgaatctagcagctgtcccataaaatcactggaaaagctaacatttttacgtacaattaaccattttatctgtaattttccccaattattccccgtttacgttgttctcgcgtccacttgctgctctctccggcatttttccgctttccacaaatcgtagcgctccgatttcttccaactgtagtaaaatgtgaccaattcgcccactgtccgacacggcagctaaaaaagaaccgattaaaatgtaaaaaacactcattgccgttttcaaaaatggacaatttgagtaaaattaaattaatataaatagtaaactaaatgctaatttatgcctaatttaaaaaagcaccaaagtaattagggttggagcaaaatcaaatagagcccgccctatgcttgaaattttcttagatttaaaacaaaatttgtagaattatttctcccaagcccaccatctttttatttttcatgttcgactgtttaaaatcaaaaccatacaaaatcacgttggattttccaaaagcacttgtagtgtttgttcatccccctctcgaactgctcgcactcctcgtccgtccacaccaatggccgcgtcggctgcgttcgtttcggcgcattggcactctcgaaagcctgtgaagttttgtcggaacacataaaactgtcttttgctgcctttggatcataattgtgcttaaatataaaaaataggttttcttacaattagccatttttgtctgactttcattaatgccaaaagtgcgtcttcgtcatccggcacatttgctggccgaacatcagcgagcggagtcgtcggtggcgcagaaggattccggcacggcttcttcacggcctttatttgcgcgaagttagtcagataagcgtctataaatgcatttggacaacgatcagtcgacgggcaccaaagtttctcggacaactcgtccaatggttgggtttccatcgattgattcggaagttcagtgacctataaaagaaaatggaagaaaaaaaagaaatcatataattccagatttagggggtaacttatttgttagctgtacaactttattccacagcaacaaaacattaacttttaaaaaagataggactaaaactaataaaaaaaccttgtttctcgaacatttttggacataactttattgaaagtaaacaaattttctttggaattttgcaggctagtagagaaatatcaagggttaaaaaaagtctggttgctttagagcaaagttataagaattttttagctcaaacaataagccttctctattagcctataaaattcaaagaatttcgttatatttcaaaaaagttatgaccagtaaacttcaaaaaacttttttttttcttaacatttttgaccatctttttggcaaagaacgaaaattatcagattagtagatgacttgaggctatagaatggtaccaaaaatgttaaatttggatgcttctaaaaaatggtgcgcattaaagttgccaaatcatttatggttatgtgaatgcaatagagccgatttctgtccaaataataccccctcctctccaccacaccaccaacttggaattggggtccgacgcggaccggctgcttcagcagaaccggcggttcgtagtcctccgtgtcatcgtcctcctccaaatcgtcctcttggaaataagctcctattgtttgcgaccactgtccataagtttcggaaatggcggaaaaaactctgtcgcgcaacgaagcgactgtttgagcagccgacgacaacccatcgacggcatcggaggaggacggaaagacctcgtcggagtcggcattttctaaaacggagcattgaaaacccccatacgaagtggcaaaactgaagaccatcttcccgctcctctcctcccccgtaatatttccgttgcaattcttccagcgaaagttccccgtcctcctgcaattggcggagttcgttgtcgcagtcgtctcccgagctgaggttcgcttcctcctcgtccaaagttgctaaagaaagcgttgagatataaattggttgaatcaaaaatttttgtgcccaattaagctctgaaaatattatgatttgggagggagggaattctcggtacttatgcagtttacgccacataaaaaaattgttttttttaattattaaaacgtgtttccaggggtattcgggccgctgatcacgaaaatgacattcatttcgactagtttcgaactccggacccaaattcgaaccaaagccgaaaattaatttttcactaaaatccacctttattgtccaaaaacgattcaagtagacttaaatgaatagaaattagggggttcatccaggaaagacgcgatgcatttgaatcgtttttggacaataaaggtg

SEQ ID NO: 15391 - DNA, 1398 bp, Heterodera glycines
  misc_feature (1089)..(1089): n is a, c, g, or t
  misc_feature (1097)..(1097): n is a, c, g, or t
  misc_feature (1101)..(1101): n is a, c, g, or t
  misc_feature (1115)..(1115): n is a, c, g, or t
  misc_feature (1119)..(1120): n is a, c, g, or t
  misc_feature (1127)..(1127): n is a, c, g, or t
  misc_feature (1135)..(1135): n is a, c, g, or t
  misc_feature (1138)..(1138): n is a, c, g, or t
  misc_feature (1144)..(1144): n is a, c, g, or t
  misc_feature (1148)..(1148): n is a, c, g, or t
  misc_feature (1170)..(1170): n is a, c, g, or t
  misc_feature (1174)..(1174): n is a, c, g, or t
  misc_feature (1178)..(1178): n is a, c, g, or t
  misc_feature (1182)..(1182): n is a, c, g, or t
  misc_feature (1185)..(1185): n is a, c, g, or t
  misc_feature (1188)..(1188): n is a, c, g, or t
  misc_feature (1202)..(1202): n is a, c, g, or t
  misc_feature (1205)..(1205): n is a, c, g, or t
  misc_feature (1209)..(1209): n is a, c, g, or t
  misc_feature (1224)..(1224): n is a, c, g, or t
  misc_feature (1226)..(1226): n is a, c, g, or t
  misc_feature (1231)..(1231): n is a, c, g, or t
  misc_feature (1235)..(1235): n is a, c, g, or t
  misc_feature (1257)..(1257): n is a, c, g, or t
  misc_feature (1259)..(1259): n is a, c, g, or t
  misc_feature (1281)..(1281): n is a, c, g, or t
  misc_feature (1284)..(1284): n is a, c, g, or t
  misc_feature (1306)..(1306): n is a, c, g, or t
  misc_feature (1312)..(1312): n is a, c, g, or t
  misc_feature (1322)..(1322): n is a, c, g, or t
  misc_feature (1353)..(1353): n is a, c, g, or t
  misc_feature (1357)..(1358): n is a, c, g, or t
  misc_feature (1370)..(1370): n is a, c, g, or t
  misc_feature (1374)..(1374): n is a, c, g, or t
  misc_feature (1378)..(1379): n is a, c, g, or t
  misc_feature (1394)..(1394): n is a, c, g, or t
taagtaccgaattcttcttttcctaccaaccacttttttagggctttttaaaagtgatttttgtaccttcgtcgtcatcttcttcttcctcctcatagtcactttgagcatcggcatcagccattcttaaaaaatgacaatttttgggtaaagtgttaaaaaaaattgtagagacaaaatttccaatacttccccgggcaagatcaaatcttggtaatcgtacgcttttactagtcccacaaaaaagaatttcgatggaccgggactaataacgggaactaaatttgtaaaactacccaaatttgaaaaaaaaaattattttggcgaaatgcctttatttcaaagtttgaagatacactggtggaaaaaagtctttactcaagccgatcaaattagaaaaaattaagatttcgactagaaaatttaattgattattttttgtgtttttatttacccctatttatgtgctttttatgcaccacattattttgatccactcattcattctgagcatgagtcgtttgatcactctttactcaaaaaaagggcggaaaaaagtctttactcagaacatgaaaaaccaccttaaaattaatctaaaaacctgaaataattcatgcttgcttatcttttgatactgatcaaaaaagtctcttacatcaacttgatcagatcactctttcatggtgaccaggaatgtcaaaaatggcttgaaattggggaaattttagaaaaaaattcctagggggttaggaaaatttttttggaaattttgaataggctcattggatagagcacaaaattcactacagaattgccttttggatggttaggctacgatttatactcgctgagataggttggggtcaaaattggacacctcaaaaatgattgatttctaccgtatttcaagggaaaatgattaaaaacagatattttttaagatgatcaagcgaagagtacttgcaagtataagtgtgctaggtcagctgcgtttaatcgttcatgccgaagcactcgcataggtaaaagatcgttttggcgtggattcaataaaatgatcgacaatttattggtgaaaaccatcanattcatancccncaacttcatctttnaaannattatanaaataaanaanaaaaanccanccacaaaaaacttttacacttntccntatncacntanctnattttctttctcantcnaaanctttcctaacctttntnacacnattnttaaattttaccccctaattanantcattccattcatctcaccatnctntatatattttttatcacttttnttattntcattttatnatactcttttagaatataattattttcatanatannttcaaaaataanattncctnnctattttcataattntttt

SEQ ID NO: 15392 - DNA, 1104 bp, Heterodera glycines
aacgcccattgtgtgcggtttttttgactaacgcccattgtgtggcggttttttgactaacgcccattgtgtggcggtttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggttttttgactaacgcccattgtgtggcggctttttgactaacgcccattgtgtggcggttttttgactaacgcccattgtgtggcggatttttgactaacgcccattgtgtggcggttttttgacta

SEQ ID NO: 15393 - DNA, 2318 bp, Heterodera glycines
cggagcggcggcggaacgatgagagaaaaaagggcgctcacccggacacatttgcagtgactaattaattaatcattacttatgaagggataaataaccgagaaataaaatataatcaataaatctgagtatttcttcacaaaatggactattgaaaaagaaactctaaattaatcacattctgagaaacgagtgtcggacacaccttctaaaattggccataaaatattatgccatttatatcagaccccgtagctcatcagatcaagtttaggttcaattgagaaatttcaatttttaatttggtaaaataagaatttagtaaaactaatcaaaacactaaaatcgtcaaaaaaaatttaaaaataaaccaatgaatgggacaattcagctgatgagaaatctgagaaaacaaataatattttatatcaaaaatttaggttttaaaaagggcaactaaaggtaggcaaagagaatggttcatgacagctcattaattaatttcaaatatatccaattattttttgattaattaattattttttaaataatctctttttgtgatggctttcgctcattttctgcccgccaaagaagcatttatttaataaatatttttaaaacatccgaaatgccttttccatttgttaattgattcatcatttacgagtatcgcattgcgttcgtatcatttgccacataaattcgcgacttttccgtgcaaaattcgctgtccccggtggaattgttggaagaatatgcataaggataatttctgcgccttttgaccattaacagaagcaactgacaaatgaagaagaaaataaattaacaaaaaaaaaacaaagaaaaataaaaactgaaaaagttacgccatttttagcaattttcaattaattaaaagaaataagtgttaattgatgagtcattaccgcaactgcaagcagaacaatggcggacaatgcgagccaaaaggcggtccaaactctgcgcaattcgccaccaccagatagcaatttgccattgtcacttgtgcccttttcctcatccgctccttccgtgccatcgtcgtccattggcatgccgaccatttggtcgggcaacggtttcgccatgaatgtgccatgggccatcagggcggacatggcaagtcgagagtggttcatgctctcgttccaccgctccgttcttttcccgtcctcctgccatcttctcggcacaaacacactttgccaagtctgctcctcctcctccttttcctcctccgtctctcgcgttgcgttctgttccacaaggggcagttcgtgaagccaaaagtcaagcccagccacgtcctgaagcacagagttattaagcatttactgaaaatgggacgtcaaagtcgggtcaattcccttttcatccgatggatccgcgggacgaaaagggaacggtcaattggcacctccgacggaatgaaatattaagttttgaaaattcgttggtgccaatttcatattgcgttttcgtgctccttaattgcctggtatccgtccactccgtgtggccaatccgtcagagtgccgttgtcgctgacattgaaagtgatgcgaaagtaattgcgtccgttccaattttggggtttccaccctattaaaatgaaattttatcctcttttttttctctttacttgccaatgtcgggcgcttttcctttcacgaagtttttgatcatttgcgggtaataccaatccatcaatcgcaggtcgagtcggtccatcggaatttggtgcaacccaatgaaaaaatacctaaaaagcgttccgtcgccctttccccctgttttctgctcacatatcattggcatgattggagtaattggcaacttcgaactctcccacataacttcgtccggtctgccgcgtgtttaccaatgccgtcaaaaatgcctcggcatgcatcgattcgtaactcacacgcatactttctgtaacaacgaaaaacagttcaatttggcattaatgcctacttttttgcataaatgtgtccttcttatatctatctctctatgaatgcactgaatgccaccgtttctaagagtccaaatgctaagaatggccaccagacactttacgaaaggtcattaaaatgggcaagggacagagctggaaaagtttgccgaaatacgaaaaggccaattctaatctatttgttttttccaatgtggtgacatcaaaaaattcccattttactagcattcagtgcataggtagataaatgctaaaatggcattacgagtagaatcaataataattatgcctaattgattaattaagccac

SEQ ID NO: 15394 - DNA, 1934 bp, Heterodera glycines
aaaaagcgaaaaattttaaatttttgtaagaacttttgtaaaaaaattatttatattaaaatgtaattttgttttagcatataataaaaatttataaatttggaaattcaatatttttacatttgtctaaaaaatgctccttagcttgttatggtgctttaaaagtcaattcttaatttatacacaatttttggcattttttgaaggttaaaagccatttttggcagttttttaaggcatattttagtgcatatttgggcatttttcgggtttttagggcatatttggggaattttcagtgcatattttatgcgcattttggcattttttagtgcatacaacgtataaccctaatttattacataatataattattttgcttttcattttttaagtatttgtttgcttttagtttgatcatttgcacttttcgtacttcgtcaatagcaccgttttgagtcacgtgcaagacactgttttgttgttattcttttaattggttgttaattcatttaatgccttgtaaatttcaattgccacgcacaaaacaaaaaacatttggccacaaaatgacaaattaattaaatgcgcacaggcaaaagtacaaaccataatactaccgtatttattgtaatagagcccccgggggctctattttcaacccccctcaaattgtgtgcgagtaagagtaacggcaagacaaagcgcttatattcaacaaatgcgcaaccatcatttacgaaatgccaaacccaaactaatttgcaacgaaataatgttttagacgcattggcacttttttattttcctttttcttgatatggcacaatccgcccccctcagtgacagcattttcttatctttttgtgcattttactgtcggattgtccaccactgtcggattgtccgggagcctttcagaggagggctctaattcagggtgggtaatttaataaatacggtaattaactcttgaattgttaagcagcatacattgagcaaaaaacaactttgctcgtaaatttacagtaaaaagttatttaaaaatttgcctttatttctttatttttctttgatttacacaaatttttacaaataattttacttcaattacgtatatatattatcattttttgcttcatcaatggtcatttcgctgctttgtctgtgcttttcgtccctttgtgcttttctgtcggcttttcgtcctccaccggtcgccattctccgtcacattccctcttcgcacttggcaccggcaatttagcaagacattcggcaaaacttctaaagaaatattttaaattttgggtaattgacttttatctaagcaaataaaagcgctgaaaatccaacaattaatgtaatttgagtaacgcatcaaaaacatcgcttttctcggccaaataattcttaatctcgtgcattattaatgtcattttaaaaatgtttatttatttactcattttcctgtaatgttttttgaaagaaatttttaatcaatgggttaatttcattttttgtcggtcgattaaaaccccaataaatgctcgtaattgtgacccgtggtgagccgaatgacaaaaatatcaatgttcgtaatagttaaattaattattattttaattttatttgctaaataataagtcatatcttaattatgcttagtctaatttatgaagcttggaattgtgaccctaacttttttgagactcaatagaattttttgaaattttaactgaataatagagaaatctttgggtatgacactattaattccttcataactttttcagaaacaagcaattttaattttgtttatataattagatagcccacagatttctattattcagcccaattttcagaaattttttattgaatttcaataaaatagggacaaaattgttgagtctaaaatttttgggaaggtt

SEQ ID NO: 15395 - DNA, 1295 bp, Heterodera glycines
tcatcctcatcaattttgccaatgttcctttattcccggaattaacttactaagtgaccggaatttataccccaattggcaaatgtcggcaacagaattcgagaatcatctgacaccaaatctgagcggtctttatgccaaaattgacgctttatctgcccaagttcaacgactgggtctggcaatggctacgcttccgaatggaaggtctgtcatcacttttggtcgactgtctgtggaggccgtgcccgggcattttagagcttactatgtttaaattcgaatagcaattccattgaaaacgccaattaatcgaaaatcattttctgtctgtaaataaaattaaaatcataattaaatttaaatattacgaacattgatacttttgtcacttcgtcctagcatcattgtgaccacctgtcacagctgcacaattgcatcgcgcaaatgtcaaattcttcatcccaaacacattgcggcacgcctttgacagtttcctccgattggtccttcttctttctgtgcttttccgaggaatgcttcttcaaagttactaaacatttaaaaaccaattagtccgttaattgataggcaattataatcattattaaacagaataatgactttggtgtcgggatttgtcgaggcatttgaatttgtaagttggcccaaaatatttttggaaccatgaacatgtcgaactcgcccagcatttgtcgtgcgtttcacagcatctgatttgggagtggaaatggacgtcaattggacgatacagagttatttttttcaaaaaaaaatattttgaaaaatttaaactgatttaaaaattccaaaacttgtcaatttcgtcaacggtttcacccgacccgccgacaccgcacctaaaaaacattagaaagatgatgatgatattataattaatagttgaaattaaaataattttaactttttttaaggtttaagaaggtcacaattattaattgatattacaattaaggctctattgcactctttatgagtccaaccaattaaccaaacctggtttttaatcattcgaaagcacaaagtctaaagaactaaaatatataaaatctctgcgtttaggcaattaccaaaatttgattaattaattaattaattgttgattattttcgtctgtaactttctttaaatgttagcattcccttactttctctcgtattattaccttatttcagactttgtgctttctaatgattccaaaaacatagggtttttgttcgaatatgaacaaaattattgtataaaaacccagt

SEQ ID NO: 15396 - DNA, 1252 bp, Heterodera glycines
tgagtcaaagactcgagactctcgacaagcgctaatgtgatttttaattaagaaaagcaaccacgtcattgtgacaatatgttctgcaatatgtcttgaccttttccccgcattgatcagcttcgctttctacattgtaagccaattatttacaatatatccaaataccaaaattggaatttaaaatattttaaaatattatattaaattatgaagatgcaaaaattatgtttaagctgggcttcggcttaatctcaaatttggcatccacctgcacagtgttggactcgctttgctgtgccatttatttcacgctggcgtttgtgccgcccggctggcttaaaaggaatgcaaatgccactgccattggtggcaccacaaatgctcaacttagagaaccaaatcaacagcagcagaatcggactcatcgaatcccttctttcaacaacacagtagggccgggaacaaatcagccgaaccgatactgtaacggaatggtaccagttgttacggtaggagcaagaatttgaagaagagagtctcagcagatgagtaattgatcattcttcgaaaaaaattaattattttcttttgcaatttttcggaaaaagaacaaaaacttaccttttcaaaaaaattaaacaattcatttatgtttattaattaaaaattctattgttttccttttagaatcattttacactataaaaactattaattaaaattttattagttaaatccaaatgaacacttaaattatttcaacttgttgggtaagcaatttttaaaacataccgaataatttcattgtaacacgccaatggggtaaaaaaataaataaaattaaaaaaaaaagattgcttaacgaaaacaatttaattatgtatctatttatatcctttagtcactactattcgcttaatgagttttttcgttatgaaaattgaaaatggaattgtccaattgaatattccgaattgccattttgccgtatttagtgtattcaaaaaaagagaacgaattaattgaggaaaaagcgttaaaaatgataaatattttttgaaatttggtcaataataattattattttttggtataaaaacttttttgatacattcatacgatggatttttaacattttaacgccaagaaatttttagaatttaaaattttgaagaaaaaaaaaattattatttaatgaaattcaaaattttatttttcttcgggatacaattccaaaagatccttttgg

SEQ ID NO: 15397 - DNA, 1179 bp, Heterodera glycines
tggggatcaggaaataactagaaaaactgtgctgggtgtcgggagtctcaaaaggcagttgagatgaatggcgccgcaataagaccggaagtttttggagggggccaatgccctcatgtagatacatggcttcgatgacctaaataaattattatttcactgaagtgaaataatgaaaaattatcagatttaaggcctaagcctaaatattaacaccagacggggatatgcaatgtggataattaattttaaatgttataagtagagaagggaaaaaagggcagcaaaaacaggaaaaaaggcactataataggcaccaaaaattgcaaaaaaatgcgtgaaaataggcattcaaaaatgtttattaatgacctttagggagcaaaacaagtaaaactcaataaaaaaaaacttattttggtcatttgaatgattattaaataaaaattttataatttattcgaataaggaaatttttaaaaatagaatttttatcgagaaaaagaataaaaaaggtattaaaggcacgaaaacccaataagccaaaataaggcataaaaaactaaaccaagaaacttcaaacaaagtggaaatgtattatttatgctaaatatgtcgaaaccaatgcgaaaatcagaatcaaataacataattagcagaaaatacatcttattaaatagaaaatcaatttaaaaaatcaaataatataaaaataaactactgaatttaaataaataatttatcatttaccaaaactgagtacggctttcgtcaatattctaaattcttcctgccgacaattaaacggtaaaaaattacacttgtcctcaacaagcgccttacgccccaaatgtatcaaataaggaaaatttttaaactataaatttttatcgagaaaaggaattaaaaaggcatcaaaaccgaaaaatggcagaaaaagcacgaaaacctaaaaaggcaaaataaagcataataaaactcaacctagaagcttcaaaaaagtggaaaatgtgttatttatgctaaatatatcggaactagtgcccaaaaaaacagaatcaaatagcataattaggataaaaatcgtcttattaaagataaaaactatttttttttaaatcaaataatataaaaataaaatctgaatttaatcgacaatttatcatttaccaaaactga

SEQ ID NO: 15398 - DNA, 2538 bp, Heterodera glycines
  misc_feature (1475)..(1475): n is a, c, g, or t
  misc_feature (1487)..(1487): n is a, c, g, or t
agagttaatgtgaagaggacaggataaagagagagacagagagaaagaggaggaaagcggatggccaacccgctcgttcatatctatcggttataatagatttaaatgggccgccaaaacacagccgtcgaaacacagatgaccgaagcacagccggcagaaacacagccgctatatatttataccgaataaaaatagttccctaatacagtacacattgagatacagtaagccacttttaatataaaattattgtatctgtctgagctcttcattttcgtttgaatttgtttttattgttctttatctaattgattccacagtttagttgcccttcccgcaaagggaatatatttttgcctaatttatattttgtgttacctctttatgaggtggagttaaagcgattagaaggcttaaaactttaaataaatcgaagtctgttgtcgaagattttgagtaaatttttttcaaaattgcacaaactaacgaatggatgcaaagaatcatcagcaaaacgtggagcaacaaaaagtcattaaatgaatctatgtggaaataaaagggattttcgaaaattgaaacataaaaatcccttaaataaaataggcaattaataaattacattttaaaattcatttaattgtttatttgtttatttaccaacccaaacgaagttcattttttgtgaaatgatctgcgagtggcgaattgacgccaattcctacggtatcaccaacaccgttagaatgttcggcatttattccctttctttgtttattaatccaaatttcgccatcattttcatatgcataagtgccaatattttcaattatccaatccaattttatatgctgtttgaaggcgaatccgaagaagacccaactgaaaaattaataataaaggattaagtattaataattataataataatttaattttctgataatttggtctcaaaaataaagtttcttacccttttttattttttaccgaaatttcatagtaaaaaatgttggacgaattattatccagcaaaatcggatgttttgcaaagacggaagaccaatcttttgaggaaaaaaaatgattaataacaaatttcgaaaataccataatcctttcccttgtgatggacagtccaacttttgtcgtcaatgatttcgagattcttatgacaaacattggcatcccaataattttgtcggaaaaaaaatcctttaatcattttgcacttttcagaattgttccgaagttgctgaaattaatttttaaaattaaaaatggaaaatttaattaaattaaaatattcttaactcatgtaattaatttcttctacaaaaataatttaaaagaaataatttattcttcgcttaaaacttcctcgcctttgggcatgttttcgtgttgcttctccaattcagtgattttttccataatttttgaaaattgatccgcagaagcttaaaaattanatcaattattanatttacaaattttatttttgttttaatttctcgccgccttttgactgttcttctcgctgcttctccaattctctggtttttccaaaatttttgacaattgatccgcagtggcttaaaaattaaatcaataaattaacatattttattttcgtttaaatttctcctcgcctttgatcgtattttcgtgctgctgcttttccaattcactgattttttccaaaattttcttctgatcattgtgcaattgtgagaaacattcagctgaaaatatacccaattatttatttgcttaatattgacaacaaaaaaatgccgtaaatgctccgttgtattttaaatagagatcgatattttgaaaaaggaatggacatggattctgtgttagaactgggcctggattttcttaattaaagacccaggaaaatccaggtccatgaaaaatccaggccctatatccaggtccatgccgttctctaatctattgttcagcccccctcaaaaaggggccttgattttaggagggctctaactcagagggtgaataaaatgtaaagtttgaaaatgtgtaaaaatatgaaataagaaattattttaaaaaaattcaaaatccgtaaaggcatatttcttcgaccaaaaagtcctcgcaaaaacgcgatgacatggcgaacaaatccaatgcggcgagttagacctaaaaacgaaaacaatatgggataaaaatttgaaacactataaacccgaatcaacggatgggaccgcttcttcagtgtcttcgtcgccgtcgtcggacgctgcgtcgtcaaaatttaatcaaaaaataatcatcttcaaaacgtcactcaattcacaaacacacattgcgatgcttaattgtcatttaataaaatgctgttaaactgaccctcaatgttcagtgtcggctccaattcgcctctccaccgtcatttttgatgttgcacgtgtacgccccgctgtccttagcctaaattttaaagtcattttatgtcaaaaatggcgtttttgaaccgctttagtcgacattggcggctta

SEQ ID NO: 15399 - DNA, 1758 bp, Heterodera glycines
  misc_feature (18)..(18): n is a, c, g, or t
  misc_feature (21)..(21): n is a, c, g, or t
aaaatgcccgaaatatgnatntaaagttccaaaatggccaaatatgggctaaaaatgctcgaaatatggattaaaagttcaaatatggcctaagattgcccgaaatatggattaaaagttcaaaaaatatggatttttagggactaaaaatcttcagcaaattaaaaatttgtaaagtagatatgctatttttaagaactgttttactgttccttaaagtagtttaaactaactttttcgaatttaaatggacatttaatgaattaaattattttcaactcataaataatttctttaataattaatttattattcgcttaaaacttcctcgcccttggtcgtagtttcgtgttgctgtttctccaattcagttttttcctcaaattccttctgctcgcccatcagttcctgctgctgttttaacttttgttctttttccaaattttatggcaaaactcctcacattttcgagttccaatttggccattttcaattccatttccattttggcaatcttttcacgaaattcctgaatttaaattacaacaaaagtacttttgttccattaaattcaaatatttctccaaattgtttcaacttttccttcccctcaccttaagctgttgtcgatcagtgatcaatttgctgtttttcccatcgaattgaccatcgttgtccaaactaattgcatcgccattcacttctgaaaatataaaccgaatttactgaattagagcccccccccccctgaattatagccaccctctgagttagtgtcctcctaaaatcaaggcccctttttgaggggggctgaacaatagcgcccctgggggctctaattcaataaatacagtaattaaatgttgaattttatttatttaatttcacattctaaatttcaatttttctacaattttcccttttctaaacatttaccctcattttctgctggcgtcaaatcatctccatcatttattgaattgttcgaaattgacattttggagttttagtaactcttaaataaacttaatcgggaaaatttttctggggttattttcggatgctgagcacgaatccggccttattttggacctactttttccaaaaaataaaattttttattgttctaataataagcgtgaattaatgtgatttgctacaagcaatcattttatcacgcattcacggggtaattaaatatagctaataaataaataaacataaataattcaaaaagtaaataatattttattcattattattttttttgcaattggataaataagtaatttttttttgtgaaaagcactttttgtgatgcatttgttgatggatcagagacatcaatttaacaaatgacttggaactatttccatttaatccattcgtttgtctttgattattcattttgctcactaataaatttattttcagaaaattcgtacattttttgccatcctattttataataaaagaaatttccgaaaaatttaaaaagttgtgaccaaaggtgttgaaaaaaattaccactctttttgaacaataaaattatctgaaaattttcattttaataaaatatacaaaaattaccgtgtgataccaagcttatttattttattgcgtttttgaacagtccaggaagagttttttatgaaaaaactgtaaaattggcagtttggcgaacgcccagcaccaatttgaaacatttaaaatttcccagtgacgtctattgcagggctgcacgcaattacggattac

SEQ ID NO: 15400 - DNA, 1641 bp, Heterodera glycines
gacgaatggactttctgcaggtcgccctgcgtcactccccaagccgccctctctgtaaacgaacacttccgatttaacctacgacacttcaaattccctccgccaccttcaccggcatttatccaccagcagcaacaaaagaaagagccaaaaacgccaaagggacaaatgcttttcggagagactcatttgtatataaagctgtacggaaagccaaattatagcgaggtgaaattgaacacatttcggggtatgcaaatgacaatttgatgtcaggattctttttgcggttttgtgcatattccacttgaaacagagacaatgaagccgagagagacgccccacggacccaattggtctgttgtatcgtttgttcaaatattaataaaacataaaacaaaataaggttctttcacaatgagaaataattggaggaagggaaaagggacaacagcagagggaagaaaggggagaagaggaggaaactctttccacccatttccgccggaaatttgccttcagcggggattggaaggaaaaaaggaggaggagaaaaggggcggaggagagttagagggggaggggcagcagcagaagggggaagtgggaggggggggggaaggagggaagggaaaaggtagggaatgcgatggtaaaggaggcctagagggccatgaagatgaatttctgggaaaatttttaatttcttaggagtgtattttttttaatttttgggacgatttttaggagggtaatttttctgaaattttttaagtagattcttaggggtgtattttttggttttattgcatttttgttgagaaattttccaaaaaatgtcgaaatagtgaaaaaaatagtgacaaaacgcacgccaaaataatgaattttcactattttagtgacgaagctccaatggtgacatgaagtttgggcaccagagtaagggatttcaaaaaaataatacaaaataaatatgtaaaatgctaaataaatcgttaaaatctagtaaattttaagaacccttgtgcttaaaaatttatattttcttgctcactgtcatccctacgcatagagtgctcatttaaagcctaataaatttgtaaaaatttcccatttagcaaaatcactttttataattgcaccgcccgtcacaaaaaagaaaaagttttcctccgacaatcgccgactcatttcttctaccgcttggacatcatcatgaacaacaattgatgggttcacttatgacatcgtttggaaaacgtggaagtgttcgcttggccacgaaaatgaataaacgaattgaggccgaattttgtgttaaaaattttaagacaaacgctaatttttcccccggattttagctgggtctgctttgatgtttggatggacattttgccctgttttgatcgtcctcaactcgtccttaaattggcactgatttcgccgcgtttcaatgcgttggtggacaaacatttcgatggcaaaaacaaattgacactttggagttgtgtctgtattcgcaagggcgttggactaaaaccaaatgtatttgtggctattgatggcaaatgtgtgccgtttccattggccgaccatccgctgcgcaagaacattcgctttaaacgctttattatttct

SEQ ID NO: 15401 - DNA, 1699 bp, Heterodera glycines
  misc_feature (1667)..(1667): n is a, c, g, or t
atattctgatgagtggtttttgatgtcaaatcgaaacgctggtgaattacgtcgaattagggaatgctaattgggtaattagttaatagcgcacatttccatggtcaaaccagcgcatttacaatcatgtgaatgagtttaaatatgaagacattcacaatgagaaatgcactagtccaaacaaaggagaagcagaagctaattaaattttaattatattttagaataaaaaagggtaaataattaaaataaataggggagcaaaatagaatttagtgctaataaatgtgattttcgtgtttctttcatcaagtactatccgtaaaaaataggaaaaatcaaaaaaaatcagggctctctctattcatatacaaaaaatattcaccaattcccttttcatgactataaaaatcttttgttttccgctttgactctcattaaaaaaataaagtttccaacgaattattattctgctcttttgtgtgacatcattcgaaactcggccaaattgtgctaattgctgccaaaaatgaaccgacggtaagcgggtattttttacaattgttttagaattttctaccagaatgagtggtagaaggatattttttacctttttttttgcaaaaacatttactttttttgttcattgtttaatttatttctaagcaaaagttttttatttattgaaataatgatcttaattaaaaaataattggaaaaaaatattaataataatatgaattatatacataatattattataatatataaattttttaataaataaaaatgttcataaaaaatgtaatataactcttatactttttatttacaaattatattttaaaaataattaactactcatattctggcgacttaatttagttaaaaaaaaatttttaaattaaaaattttttaattcataaacactacaaagacttttagataaacaaaaaaataataataataatttcgaatagtaataaaattaagattatatatttatttattttttctcaaatcattaatgttcaggacagttacagtaattataaatggtgatccataaagattaatattttttgttgataaactttgttccactttaataaattggttaaagactgcttctgcaatatttgaattaattggtcttattggtacaatgatatcaccttgctctaacatttctgatgaaattataactccagctttgtctgctccacccaatttccttttagcgtcagcaatggcttcatcaattgatgtctttatacaattttctaattctattgttgggtttgggcatttctctatattttccactacaaactttgattttgaccgcaataatcgaaacttcttactattagttgtatattcttcgatttttttaatgcatggtttaattccttcatggtgatcaaagtttttagaaattcggggttttttcgtttttgtatttgacgaatttctttttgagcgcttcattttaaattagttcagttttttgaccagaaaaaagcttctttaaatactttttttctgctcccaatttaaaaccaacaatttatcagtcatatttacaatttataaattcatttagaaataaaaaataaggacatttcaaaataattgaaaatataatgaatgctcatgggggacgngtaaccatattcacgaacatgataagaactat

SEQ ID NO: 15402 - DNA, 974 bp, Heterodera glycines
  misc_feature (855)..(855): n is a, c, g, or t
aattttcacttatttattttgtacaacttttcttctctttcttcccaatttcctctcccatcctaaccaaactttactgtaaacccaagccaagccaatttgtgtccatcccagctcactctcgactccaccccttttctcttttgctatttaaactgaattcattccttgcattattaccctttttttctactcactttgactcattcccattttacttacctttctcacttttgctaaataaactttcattaacaaacttaaagtcttgcttttgattgggaaataagtcgggaacacaacatcttttggtgccacgacccgggaccaaaaaaaagttcccttttcccaaatttctgagcaaggccgagtgccgaattgctgtcgagggttggtcgaagctgtgtgctcccaaccgaagagactaattgcggagggctagtcgaagctgtgtgctcctagctgatcaaacggataattatttgagttagtcgatctgtgtgatcctaaccgggctgtgtgccaatttcaaaaaaaaaagtggaaaaacagtaaaatgtcaggcgagggatctgacttcaacccagcttttttcacggtggaggaaaatgctcaataccaaaccattctcgagcgtttgcgttcttttgaagctgcagtttgcagccaatttcgaaagcttgaaagttctctgaatggaagtgaacgagccacaaaggaccaattgagccgtctcgagtcatcgctacaaaatttggacgagaatgaagagatggatgaattcgagactaaggagaaaattttcaaattggaagagaaactggaggagacacataacaaattcgaagttcttanagctaatgtgtctgaaaacttaaaggaatgttttgagaaattgatactcaggtaaaggaattgaaatgttttagtgacttgataaatgagaaaattgagtcggtggagaaggaaatgaa

SEQ ID NO: 15403 - DNA, 2629 bp, Heterodera glycines
tggcgacgcccgtgcagacttttgactgtgggcttattgatctgattgtggaggaagaggtttgacagcaaccgagttttgctgtgtcatcgctgaagactgcctgcatttgctattatctaggcgataataacaactttttgttggacctgctaacagtttaacactgttagtagtgagaaattttgcgccgctgatattgtgttttggcaacataatttcagttcgtccacgcgcacccactctgataatatcttggcgctattatcaatagagtggtgaacgacaaaaataaaaatggcaaatccgacggttcagcaattgatggacatggttaagcaactgcttgaagcacaacaaaatgcgccgcaagcaggccagcaaccctccaatgtgccgtctctaccgaatgtggaaaacttcgaattcggagagcaaagcaccgacatcgaggactggctgcagcaattcgactttgctcttgactgtgccgcaccaaatttgcaggatgtgctgaaggtgaagcttctcatgacgaagctcagcaaggaagcgtttgccgaatacaaaaagtcctgcatgccgaaaaatgtgacagacttcgacttcgcgaagactgtggagcagctgaagagtttgtttgccaggcctcagtccatttggattgacagatatgactgcctgcgtgcatccaaactggaagacaaggaattcagagcatttgtgaaccgacacaaaaggctgttaagggatttcaactcaagaagctgaaagaggagcagtttaactgcctgatgcttttgattgcaatgaaatcgccgaaggacgcggatcttcgaaagcgaattttagcaaagttggcagcagatggtgacctcgttcggtacgacaacatggtggaagacctgcaagtgtacctgtcgaccattgccgaggctaaagcgcttgagcagccgatgtcttcgaaaaatgtttttgctttgaaaaagaagcataaaacgcgaaagaattccgaatcgtcgaaagggagcagcgaatcgtcagcaagccagaagagccaccgatcgcaaccgaagtgttggcgttgcggaaaatggcactctcccaagcgttgttcgcatggcaagtccacctgcagaaagtgcaatgtgtcgggaccaaacagaggcaaattcggcccggcaaaaattttggcaaaatagaaattgggacaaacagtagacaagcaggggaatgatgttttattccgactgaaccgatttcaataacaattccacgacttaaatagggtgtcattcgctgattaatacatttttgtgtgagaaatgaataagaattgaatgtaaacaaacaaatattttttgaatagaacgacgaagagggggaacatttctaattaaattaaggtttttcccatttttaatgaaattgcatcatgcttataaaatttatcatttccattttatttctcgtgacgtgagtcgcgacactccccacagcaaagttgtcggggggttcagttgctgcaagtctgcctgtatgttgttgttttatttattatgcctcattccgggttgtctgtgctgagaaaggcgggcggttgattttggttaatcgtaaaatctgtgaggtgatcagttgaccaggctgatcccttgttgcttgtgaagatccgctccgcggcggtggacagcgatcagttgaccagactgacttctccgtcctgtcgcccttgtaccagcgtctgccacccgctgatcacaagcattcatcagtgcagaggttcccggccgttgcaccacttgtcgggaccaaacagaggcaaattcggcccggcaaaaaattttggcaaaatagaaattgggacaaacagtagacaagcaggggaatgatgttttattccgactgaaccgatttcaataacaattccacgacttaaatagcgaagagggggaacatttccaattaaattaaggttttcccatttttaatgaaattgcatcatgctttaaaatttatcttttccattttatttctcgtgacgtgagtcgcgacaaccatctccttctttctctttaacccactaccccccccctctctcaatctcctgttctctctctcctcaaacattctctctctcttctctcacctcctctctttctctccttttctctttattcctctctctctctccctactcatctcttctctctctcactatctctctcctcactcccttctctctcactttttattcctttctttctaacttctccgctatctcttcctctctctctctctctccttctcactttcctctctctcactcctcactctctctctctcctcagttccgtctatctctctctctcctctctcctctctaccctctcccatttttctatctttctctctctctctcttcctcccgatatctatttctctctcttctctctctctttgttccttttcctctctctctctctccccctctctctttcttcacatctctctctctcttctcaaattcgctctttcttcctttctctttctctttctctctttctctcctccccctctctttctctcctctctcccttctctctctctctctctctttctctctccc

SEQ ID NO: 15404 - DNA, 4314 bp, Heterodera glycines
  misc_feature (4275)..(4275): n is a, c, g, or t
aacaaaaaatggcagaaaggttaaaaatttatatcatcctttataatttttaaattttctataaaaaaatattttgttcatttggttagatgaaaaaaaaaatttttttttgtccaaatttttttttcgcacttcttatttaactaactaattctgattttcataaattctcgaaaaatgttaatgaaatttctcgttaatattagtaaattaaattttcatgtgtttaatttggggtaaaatatgctaaataatggtaaattcgttttttcttttcatatttttctctaaaattaataatttcatattttattataaattttttttcccgccttcccacccccctcttgcaaaaaatgaaaatttctgggtttttaattaggtgtccataatttaagccgttttaacattgttcacaggaaaaccgggctctgccaccattgaagcaatgctaattgacttcaaattgacggaaacgagtttgaccacgccgctgcccggtgttcagctgcattggatccatttcaaccatgccgtgatgctgggcaaatacaatttggccatgtccttcgtcacttgcattattatgctgttcaccattgtcagcttcctttattggtggtacgcactgatgttgtccgtccgcatggccagcaattacggcgaattcctcggatgggccacagtttcaatggcactcgttttttacatccttttctttatggcattcgtattattgtagggcctcgcgctttcgggacgagaaaatgtcggagccatgcttttttcggggtcagctattatcagggttgggctagattaaaccagcaagggtgggggttcgagtttggcctaggagggccgggggggggggttactcagggctggttttttttttgatttcacaccgctttttgggatgagccttaaatattttatatgaaattttctaaaagatttcgcactaaaaatgatcaattttagaatttttggctaagataatggaaatccagcacttgaacaacattttttctcttttcctcataaaaatgcacattctttggcgtgtatgtcggtgtcgggagccctaccctaattgatcgtgtattaaattagactaagcactttgatggactaattggcaatgctgtccttgttaccacacctttttgaatgttttttaatttttcagtcaaaaataagagtttttctagagttgagcacgaatctagcacctcattttggccttccggattttggcccctgattcgaaccaaaagccgaaaacccaatttttactaattcgtttttatggaacctgaaccggttaaactgagtgaaataaacaaaaagtcatccaatctgcaaaaagtgcgaaattctaaattttttatttagttttttggttaggttccaattctgggttcggaatcaggtggaataagtgtcaattcatgctaaataaccatgaaaaccctaaacacattttttatattaagaaattaaatcgaaaaaaatcaacaggcttatctatattaattcagcttttttccctgtgattaggtatttgggagcgaattctgaggcataaaatttctttttggaaaggttaaactaaagttttcagaattcgatctatatttaagatcatttgttaccaatttgttctttttcctaaacttttttttcccatttataaacattttttaatcattttattttggcatttctttttccttttttaattactgttttctcattcgataaatgagcttttatggaagaaaatgttttgtctaccaacatttggggttaggtccctaaaaatagcaaaatatttaaatgcgtgtttcgtcttgattgatttaatcagtggtcacacttggcgaagataaaaaattcgattcaaattttacaaattattaggagaaccgaggccgaacgggaattcttttcaagaaaaatcaaaaaatatgtgcatttttcgagtgaaatattcaatttttacaaattattaggagaactgaggccgaacgggaattcttttcaagaaaaatcaaaaaatatgtgcatttttcgagtgaaatattcaattaatcttttgtcattaaataaatcgtttactccggtgttgacatttaagcatgaaaaattaaaaaatatttattaactcctatgcaaccaactgtaagaactccagcaggttatgtgtaaatgtcagaccctgaagattaattgataatcaccatgcaatttgcatttggcgaaattttttttttataaaatcagctgtttttatgttatttgcaaatcttgcttgtcactttttatgtattgaataagcttacctactatttttctacgaattaactaaagaatgcttaaaagacaatattcaaaaattagctgacaaattttcgggttgaaatttacttttcttttaattttgtatttgaaattttacaaccatgatcgattttatttttgaaatgttgatgagaaaaggtgaaaatgatgagaattggatatgtaacaaatcccaaaatcggaatagttttttatgaataagaaacggtccaatcgaatcatttcaatgccattgttcgccatggcattcagcgaatgaaacagtaccaaatggcatggatgacggcagggatccacaacaaaatgctgaattaaataaaaacaaattaaaaaataataatatattttaaaaaattttttatttgtgtaccaaagaacgaccgaaatcagcacttgttggttgcactcgcccgacttcagcagaatggcaatgggctgaattaatggattaatatgctagtaaatggaaagcaacaaggcacttttacagacaaaaatatgttattgtgggcagaggcccgtacaaaactttcgggaaagggcacccgaagacccaaaaatattttccagcgtactttttcctatattttgctgcgtgggaaaaacatgggaaatttttttagccattttcgtcaaattttggccacttcgagacaaaattttggaaaaaaaaaaaggaagaaaattgatacccgtggaaaatttataaaatttggtcacatttgttaagaaaattagacaaattttaaaaaatttacctattttttctttaaaaattttaattttcatttcgtggcgggggcaactgccgcccccctccgattactggcctgattgtggctaatttgctaattaatttttcggaaaaaatatttggcataactttgctcaaagcaaccgttttaattgttgatacaatttaaaaaaacgaagaccgttacaaaaaaaaaacaaatagcaagggcaaaatattgaaaacacaaagctaccaaaagataaagcgtaatttttcaaatattttacagatgctaatggaattgaatccggacccctaaaaaaatatctcagatttaaccaacggagacgcaatttattcacgcggtttaatgttaatatttcgtcccttaatcgtaaaattgccaaataattatatagttcaattggaataccggcacgaagaagcaacagatcaactccaaaattgccaaaaccatatcaccaagctccatcgtttatgtgtgtatattgaacaaattaatttgtaataaaaatgttaatttaaaatttataataatttaaaatgaaaataaaataaacatggaaaaatgagaaagaaaagcgcgaagagaatcgatgaaaagaaattaagtgaatgcctaatacatagcagaaaatgtggaaattgtgcagggcaaaacaggcggttgggggagattaaacatataattatcgatcattatttgcgtatgtttacgcttttcccaattttacgaccaccactcaccaaatggacgagagagagaaatgaaatgcaattggggggggacgaattttgtggaacaaacaaacaaacaatggaagaaaacggagcaaacgcacacagaagggaaccgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaacctcaaaaattaactttttcttggctttttcggcgccgcgtggcataacttttttatttttgaatcattcatttctatttttacatgtaaatatagagcacacatagagctttcaatgatgccagattggctanagctaactgacaaaataaaaaagtatagcatttcaaaat

SEQ ID NO: 15405 - DNA, 1795 bp, Heterodera glycines
tttgatagaaaaagcatcagagtgcctaaactaacatgttaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtgggggccttcgccgccggagagagagaaaagagagatataagagagagaaagaaaaaagagagagagtgagagagagagagataagagagagagtgagagagagaaagaaaaagagagagagagaaagaaaaaagaaagagagtgagagagagagagagataagagagagagtgatagagagaaagaaaagaaagatagtgagagagacagaagagatagagagagaatgaatgttagcttttttattcaattattttttaaattataaaaaaatttttttaatttatttattttaatttataatttattttattttaatttaatttattttttattaatcaataaaaactcttcaataggtttaggttcactcccggacccatccaataggttttggtttaaaccaataggttttagttttgggattgtttatttattttgatttttattatttatttatttttaatttaatttaattatttaaatttattattaatcaataaaaacccttcaataggtttaggttcactcccgcacccatccaataggctttggtttaaaccaataggctttggtttggaacggtggttttccaaccccgaaaaagggggctagttactactggagaagaaaggcattgccatggacaagcaaaagttgaaacacggggaaatagaactgataaacgaattgacaatgtccgattacgaaatcagaaaattttcaatattgagtctgattataatttggtaattcttctctctcgacaattgtaatttgtcttttttgaaaaatttatgattttccatgtttggtatttgtctaaaaaacgaatttttttgactcttgaggctaaaataatagatagaggtcaatagggcttatatttatagttgctaaaaatgccaaaatgtttatgttctaaaaatcccaaaaattgctaaaaatgggaaaataattactaaaagtttcaaatttagtggtaataaatgacaaaatttattcaaaaaattaaaaaattttggccaaatcagtattgagctaaaaaaattttcaagccaaaaattcttgaattttccaaaaataaatcccgaaaatcataaattacaagtttggtggctcctaggttggccttgagactttgacttatttcgggctagataaggcggaattttcaattttaaaataaggaaattaagcttattgttgattttggaaattctttcacgcttttttaaatgtttttgcaagaaattcttaaaattaatcctttttctttttaattccaaaaagtctcttgaaatttttcatctgttcgcctttatttttttctttttaaattttgtttgtttttctttctgctgttggccccaatcacagataaattatcgcattttcccaacaaaatttttatagaa

SEQ ID NO: 15406 - DNA, 1530 bp, Heterodera glycines
  misc_feature (538)..(538): n is a, c, g, or t
cccctcccccctttaaagctgaatttgtataccaacctagtttttggtatcctttatttgatgatgaaaaccaattcttcattccatcagcttcatctaaaagaatgacggccaataaaaaaaaaaaacatggaaagaaagcgacgagaatttgcgcatttgctttgatgtttggatgggaatgaagcctaaatacaaaatttttaacaatagttaaaaacaattatttttttaagaatccgacaaggccggaaagatttttaaaattaaatcagggggctcgctccgccattggacaagctcgatttcaaaggaaataaggtgaaaataatattttgcggtgcgctttttacaaaaaaaaaaacatgggaaaaaaaagaggtccggcagtgcagataggctccgccttgaaaattttttgaatttttatagggatttgttaatatatttttttcaaatttccaagagcagatgaccagcaggtccatggacttcctttgaacccaagacaagcagttggtaaccctggatgaaaggnttctcgtggttttcaagctagcttattatgaaaattcataactgcatcaaatccttttacatgtagggctatcgactgatataatgaaaattttgttgctttggagcttcaatgtttggaaaacaatttctcggcctttagacgctagagaagcgccatttaaaaaagtgaaagtgttttcaaagaggattttttcaaaaattttaaaattttaatgcgttttcccaaaaaattttgagaagtccccaaatttatgcatttgattttgtaaaaatgtacggatgggaatgaaagaatgaaacctaaattcaaaatttttttattttatttctaacctaaaaattttaaagttatggtcaaaaatgtttgaggtttcttgagtacatttgaccataattctgttcaaacttaacgaaattttttgaaattttgcagacttgaagaaaacacatagggccatcgaatgccttcaagaattaaaaatgtagttgcttttgggcaaagttatgggtaattttgttggaaattttaatttgatgcttttttataactttctttttgctggcttttttaaaacgacatagcaccctttttacgctagagaagcgccattttaattatggagtttagccctatggctacgaaaaatgtttcctaaaatttaatttaaattcaatacagttaaatatggaataaggaatattttttgtgaggaatgcattatttcaaacttttcagtgcgcttttatgccgtgatttttaattgcacatgcagacaggcatttgccatgtaccctttattgaattattgtacacattattttaaatagtgaagccattcagcctagagaaaaaaaggaaaaacgtaaatttgaatacaatgcttaggcaagaaggtggcacctacccactcagcatttgcgctgtctcatgacttacaccaaattattaaaagatgtccaccccattaaaaaggtcatttatattaatgt

SEQ ID NO: 15407 - DNA, 4467 bp, Heterodera glycines
  misc_feature (826)..(826): n is a, c, g, or t
ttattgctccaccgagggcaccgattgtcgcgctcgttaaaatatgcgcactctttagagtttttagtgttttggcggcttggtaaagggtagcaattgggtggcaattgctcacaacaaataaattggtcagaaaaaggatttttgacaataatttcatttttaattaattaattaatttggttacacagtgtttttatactgaaaatcagtactaattgcgttgttaaattgcccaaggctctttaaaaaggaaaaatatttttgtagactagcgggaaaccacatcgataattggggccaataaaaaataacacaaaaaaaacggtcagaatcgatgtaaaaatgttagaaatgtttcggaaaaatagaattgggggcgcgcttgccctttttcaggttgaaaagtgccggaattgaagtgccaaactcatctgggactcaattaaccgcactataaaacattcaaaatacattttgaataaattttctagggaattttgtggcgctgatcacgaataagaaatgtatttttcaaaatttcgaatcccgaacccggttctcttgactaaaaatttgacgcaactacaaatttaaaaaacattcgtcagactttttcctctgccctccgtctcgctattaacaatgataatgtataacttagcaaaaagcttccgttagattaaaaaattgtgacaaaaattaaaatattttttaaaatttgaaagtgtataaaaactatatatgaaattgaaagtttttagcatgaaattatatgaaattaacatatttgaacaaagaaataaaaactaattttacaaaatanagaaaatattattgaaaccaaaaaaaattttttaaaaagcttaaactttaagcaaatatcattgaccatattaaagtttatatttattaattaatgaattcagtgttttccaagtagcgcgcgcattagctaaaataacaaaattaactataaataagtaaaataaggtttttaaaaatcaaaaaatagacaaaatacatcgagagcttaaattaatcagcatttaaatttaaaatattatccataagagaatttataaataaaaatgaattaatgaaatgctttatagttttataatttttactgctaataattcatttttacaacgaacattcattaatgaaaaacctataaatttctataaataaataaataaatttgcaaaaataaatgtattaaattagaatatcgtttatttattacttaatattctaataaaaaattttatagcacagatttggatgtatcagagtggttaagagtataaagtaatatacaaataaactttggaaataacaaattagaattatattaattattagtttaaaatggagcaaatgaataattttgaaaatttataacatgtttaataaaaaaaaaataataattagatataaaattggataaatcatcccggaacatgatgaacgaacttaaactacaaccggcttcaacgtttgcacgcataattgtcaagtgaaagtatttatattaaatggtgatatgttaaaaaattaaacttgctcatataaataaaaatcaaacattttgattttacaccaagaatgcagtaattatagtaacatagaaataatgatatttgaaccataactatctttaacaatttactcaatttaaaattaatttattttatttgaatcaaaggctgcactttatcttaaaaatatattttattaaaaattttaaaattagtaaaacatattcaaaaaataattgtaaaagaattaaattatttcattataatttcaaaatatttattttactaaaaaagcagttaaagtgataaagaagctactagttataacatatttaacataacaaatttttaaaaatcgactattgcaataacaaaaatttaatttgaatatgcaaataaaagatgcaattgtataaatttgaagtttataacaataatataatatatatttaaaaaatattatttatcgcgaaaagaacattgttttgaaaaaatgagaaagggctcaaaaaccaatagagctctaaatttaaacccaattgttgtagaacaaaaatgcatctgcattaaataaacatctaaacgcataacaaaatcatgtaattgaattaaattcaaagcagtaagaaataaaatttttagtatttattaacaattatcatatatccgtggcccattatttatctaattatgaaaatttagggaatgtgaattaaagaaaggtaaggaaaaatgggaaagttgagtcgatgaaacaatacacgttaattatccctatttttgtggggaaaaaacaacaacacgtaatttaataattatgttttgttatggaggaggaccgagccaagaacacggacatcaagtttgagcggctcgtcgaagaatgccgctccattttgtcgctcaggagtgccgccgctgcactcgaacatcctggtcacgggtggcaggctaattcaattttagttaagccgcagcgtgagaaggagcgacaaggacgacagcgacagttcagtaattctcgcactcagggcatttcaatgaaggacggacgcacagtcaatcagcaaacggccgccagtcatcaaagccgcgtctgccttttccatgcaaaacgtgtggaggaaatcattggaacaacgagtgcaaaagcaagcgtgaaagtcatcggaacaacgaaagtgacaacaaactatggcaaaagtgctacaactgtgatcgagtcggacattttgcacgatagtgccgaagcaaaaagcagaccaacaacaacgactcgatgttcgtcatgaatgtgtccgacgacactgacggatggatcacagtggattgcctgatcaacggcaggcaggtttcattggtggcagacacagccgcctgaaaaaccatcattcaaacgcccatttgggagaaattgggaaaacccaaatttaaaagggcaaaactttaggaaaatatattcagggcataatttcgagttaattggtttatttgattgtacagttgagttcgcaggcattaaattggagttggaatgttttgtggcaccaacgggagcactcaatctctttggtctcccatggattcgtgcatttgaattggcactgcaacgtccaatcgccacaacacttcaaattgtccaaccagaaccagcattcatggccatggcttcatccgcagacctggacatcgtcacggaattggaccgtttgttggcaattgaggccattaaacagattgattacagccgttgggcagctccgattgtggcagtcaaaaagaagtcaggtgacgtccgagtctgcatcgacttctcaacagggctcaacgacgcgcttgaactcaaccgacacccgttgccacggcagtagtaagtactgccacaccttagcagtctgacgctaattagatgtgacagctggcggggaagggtgtcaattagtcactaattgggggggatactaattggtcagcggtcaagagggcactaattggtcagccgtagcgtgtggggtggggtgtaaattaattagggaaacccaaacctattgaacggtttcaaattgtcacgtaactttttttgatgagcgaaaaaatttgattgatttaaaaagtgacagccgagggggagggggaatttgattggtcagcgaagtgacagatgagggaaaaattcaaatttctgatgggcggggggacgtgaattttgattgatcaacatatgacagtttttgatattattaaattattcaaatgaagtgaaataatttgttttgcactcggtctttatcaaacttgttatgaaggtgcaaatttgcaatttgttgacgatttcgcgcaatgtttcgaccgaaattaaattgtttgtcacttataaaataggtcaatttgtgaatatttaaggtttccaaaatggaattcattgtaattgctacatttgttccatacttttcttccaaaaattttccatcccattctattgttgatagaaaatggcaccacgtgatgactccagtaacaataacaataatggtcagccgtcaatccaatttgatcaacaagttcgccaggaccctggtctaaatgctgtttttgactttgttcgggaacagggcgcgcgggtaatttgtcacagcaaattaattttttcattttttgattaattttgtttagcatggcattttcaacacacccgccgaaatcgtcaatgttcttcagcaaatggcacagcatcgactgaatgagcgcagagcggggaataattgagagaatgaagttgagagaaaatgaagagcgaaagttgagaacaaattgatgaaacaatacaaagatgatgggaattctgaattattattatttttttttcttacatgatttaatttattgacaatgctaaaacaataaataaaaatgggaaataaat

SEQ ID NO: 15408 - DNA, 1081 bp, Heterodera glycines
ccccataaatgtttgagtcccccaaacggactctccaaaaaatatttttggttttcggggcagtccccctgaaccgatgcgcccagatttatggggagaccgaatctctccggaatatattctctatagcctgtgctctaattgtgcgttggatttttgctctccatatttgtgtgagtaccccaaacggacactcgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttgtgttttcggagcagtccccccgaaccgatgcgcccagatatatgggg

SEQ ID NO: 15409 - DNA, 1921 bp, Heterodera glycines
tttgggttgaaaatgtgggtcaaatatttttctggggtattttgatgtgctgagcacgaatctgatgttcattttcagtttaggaaattttggaattttttaaaaattcgaaaatatttttcaattttttaacccttgggattttgggttaatatttgaaaattcataactaacctcagggtaagtcaattttaatacaacaaagctttaaaaatagcaaaaaatcaggagaattttatggcttttatttagattctctatcatgaatataaaaaaagttattccagaagttctagaaaatttcgaattttcagaaaaaaattctgaacacggttctgaaaagttattttggaaaagtaaaataatacaaaaatccgcaattttttgctctattttataaattttattttagctttttatcacttttttgaaaaaagttatagaaataaaagtgattttgggaatcgggaccaaaggggtgagtataggatttttgagttgaaaaattttttcaccaaaaatcttcaaaaaacatgtcattagggctattttatgacgctgatcacgaatacgtgatcagattttacttttgacatcgttaagacctcagaatccctgtgtgattggggattctgaggcatcattttgaagggggagggggcaggttcgaagccgggcggtgtacattatttttctaccatttttttcgtgtttttcaattttattcatttaaaatattttttgagttaataaataaaaaattatattttatttaatttttttttgataaataaattttataagttttaattaattatttttttaattgatagaatttcatgtatctgttgtacctttttaatcacttttgtacctcttttatcaaatttgtacctcttctaatcactgttctatttcttctaatcactgttgtgcctcttctaatcactgttgtacctcttctaatctctgttgtacctcttcatatcactgttgtacctcttctaatcactgttgtacctcttctaatcactgttataactcttttaatcactgttgtgcctcttctaatcactgttgtacctcttctaatctctgttgtacctcttcatatcactgttgtacctcttctaatcactgttgtacctcttctaatcactgttgtaactcttttaatcactgttgtactaatcactgttatcttctaatcgcttttgtacatcttctaatcactgttgtagctcttttaatcacttttacacctcttctaatcatttttgtaactcttctaatctctgttgtttttttggcccttgggaatttgggcgaatatttgaaaaatctcaaggggtattttaaattatttaatttttttatttaaattgttttattaatttattttaaattattttctgatgaataactgttttatttacttcttttaatcactgttgtgcctcttttaatcccttttatatctcttaatccctgtgtgattgctcgtctgagttcaactaaattttaaaaacgggcgcgaagcgcccgcccaagcccaataaaatttgaaaaacgggcgcgaagcgcccgtccttgcccaacaaaattttaaaaacgggcgcgaagcgcccgtccaagaccaacaaaattttaaaaacgggcgcgaagcgcccgcccaagcccaataaaatttgaaaaacgggcgcgaagcgcccgtccaagcccaacaaaattttaaaaacgggcgcgaagcgcccgtccaagaccaacaaaattttaaaaacgggcgcaaagcgcccgtccaaggccaaaaaattgaaaaacgggtgcgaagcgcccgtatgagcttaatggatataaaaaacgggcgcgaagcgcccgtataagcccaacaaaatttaaaaaacgtgcgcgaagcgtccgt

SEQ ID NO: 15410 - DNA, 3050 bp, Heterodera glycines
  misc_feature (623)..(623): n is a, c, g, or t
tcaatcaaattctttggggcgagaaaattttccttaaaggcggagatgcaaaaagaaaagcgtcacacaaaccgtagattttatacacgggaactgacatcagagaaatgaagggaaggccgaagcgacttcatttgaattccatttcgcttaaggcggggggggtcggggccattcttgcccctcggggcgcttgcccccaaatattcaaatttttcaatcgatcatctggatctgtcaccgcggcacgccagcacggcatggcagtgggaggagtcagcagcggcaccatccccaagttctcttctcatcatttgccactttcgcccactttttcaatttgtcagcagcggagacgcatcccaaattcgcttttcactagttgccattttcatccactttcatcatgccctttattgcccccggcactttcgcttttctttcaaaagagtatggggaattttcgactgggcattttgacccaaacagagcatacgacccaaattcacttgcagaactttcgtaatacatttattttgcttccattatctttgatttttttctttgtagtcaatggagaaaagagtttctggacggccgataccgatccaaaacaaccaacnccctccttcccccctgcgtgccccatcgcccagctttccaatcccggtcatcgttggtaatttaaatttcagttttttttggattttgcaaatattccgtttacaggaaatcgtccacaggatgaaaattgtttggttttccacaaatatcttgtctgattttttccattttagggcggcagatgttccccgatgacgatgggtacgaatcggaagatgatgaaattctcttgccacctccgccgatccccccgcaacttggccaccctccaccaaatgtgccggtaatttcggtctcgcttttcgttgcttttctcaaatttccgagtggttttttcaggcagttcgtgtccagccaatgcatgttgggcagcagcggctgccgctgagagacttgccacaattcgaggaccatctgcaaaatgtgccggtaattttgggtcgattttcgctgcgttttctcaaatttctgcgtgtttttttcaggctgttcgggtccaaccgatgcaacaaccattgccgctgagagacctgccgcaaattttccaccctccaccaaatgtgccggtaattttgggtctttctttcgattgctttttctcaattcccgagtgcatttttcaggcaattcgtgttcaaccaatgcagcaacccgtaccaatgagagccgtgccacaattcctccaccctccgccaaatgcgccggtaatcttgagtctcgttttcggttgctttttcaaaatcccgagtgcattgtttttcaggaaattggtgtgggaccaattcatgatgggcaacaaccactaccactaagagcgttgccacaattcgcccaacctccaccaaatgtgccggtaattttggctcgtttttttgttgtttttttaattcccgaatgcttttttcaggccgttcgtgtccaaccagttcaacaaccgataccactgagagacgtgccgctatttggcaacccaccaccaaatgtgccggtaattttggctcgcttttgttactttttttcaagatcccgaatgcaggtaattcgtgcccaaccgatgcctcaaccgttgccgctgagagacatgccgcaaattcaccatccaccgcgaaatgtgacttcaatttggatcaaattgtggttgctttttcccagtctctgggtgtttcttcagggaattcatgttcgacaaattcaacgggaatacgccgtaccgcaatttgcccatccgccgccaaacttgccgtatcatccaccagaaaacgttccggtagttgggtcttgtttttcgtgcgtttctcatattttcggatgcttattcaggcaatccaaccacggcaacgaccgcgccagctgagagacgtgccactattcgaccacccgctgccaaacggacaggtaatttcagaccctgtcttctacctaacaccgaaacatcttttctaagcaaatgcatcccaaccccccgagagtgctggaagtgatccgacggctgggcgagtggagaggaagaccaagggacccaagacgtccgcttcaatgaatgaatggaatttggataaaatttgttgtttttaaattttttgtaatgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatggatttttttcatgtgcattattttggtgctagtaagatattgccgaatgaattaattggttttttctcttcattttaaaacatttcacgtccccatgccctgcccacttcccgcggaattgatcaaggaaataattgacgctctcccccctccaaaaacacatcggcttttgcgcgtaaattttgttttggcatactttgttaaatgtcggttttattccatgatgagaagattgtttcgcccagagcatatatcaataccaatggcccgaagaactggaatttatttctttttcgatgttcatactccccctatttattttccactataccaataataacatttaaataaaattataattttttatttcttatctgattaatttcgatcaatattttttgataattaaacaaaattgtatttttcccaaaagatttttctcgcagtagcaactcatcggcttttttttactcccttcataaaatgtctcgcttttgccctatcgcccaaatcaaggaatcgggtcggcttaacacaccaaaggggaaatttagtgagttccaaacctatcaaattaaaaaagaattttgatattcgttttaggtcttttttatgctttggaaattgctcgaagctaccagcttatagggaaaagtataacggaaaacaaattccgttatctgatgaaga

SEQ ID NO: 15411 - DNA, 1510 bp, Heterodera glycines
  misc_feature (15)..(15): n is a, c, g, or t
ttttccactcaaaanccatgtactccccctttgtcgcaattgcgaaatcacttttaattttatacttttttcgaaaaagtgataaaaatatgaaataaaatttataaaatagagaaaaaaatcgcggattttttcattattttaatttgtaaaatacgttttcagaaccgagttctgaatttttttctgaaaattcgaaaatttccagaatttctggaataactttttttcttttgaagctagaaatcccaaataaatcccataaaattctcctgatttttctctatttttatggctttattctatgaaaattggacaagcctaagtttagttatgaattttcaaaaattacctcaaattctcgaggcccaaaaaaatgaaaaattttcaaaattttttaaaaaattccaaaaattgcgaaacaaaaaacaaaggtcatattcgtgctcagcacctcaaaataccccagaaaaatatttttaactccattcttcaacccaaaaaaaattttcaaaaatttctagggggcctagctcgaaaatttttgaaaatttttcgacatatagtacacctttcgatagcattttgaaagctctacaattttgctctaaggcaatttttcgctaaaaccaacccccgacgagttattggcccgggactcaaatgtcccgctcaggccaaaaattttttctatttccggaaaaaaatcgaaaattttctaaaaatgtcaccaatcgatagagctcgaaaaacggttgcttgaaagtggtctccgtttttctgggaaaattcgttaaaaaatcataaaattcaaaaaccaaaaaatcgttttttaggcctagctcgaaaatttttgaaaattttcgaaatttttaaacatggttcgatagccctttgaaagctctacaaaaagtccgctggcgactacccgctccgagcaaaccctggcgcggcattcagctggtactgaagtgtccaaaaaaagtagttcttacgttgcctaacctacaggtcaggggtttgatctgatcaaaaaaagtttgctggcaaagttgtagcccatagtttgggcattgatcttttggggttcactaagccttaaaggcaaatgcaaaaaatttcgtaacagtgagactgtcagcaaagtcagtttttgcgcccctggtactcagttggacgtcgagaatttttctctatagttttcccagatgcgccgtctcgagctaccccttggtgcaaaatttcagcccggtgtgcccagccgttcccgagaaatcggttttagagatgagttgccttgtcaatataacatatatataactagcgggtgcgtgaaccgtcggctatttagctggaaaaaagcgcttcgcgcttcttgagcttcgctacctaggctgtgaagcgattcaaattgatcgaattggttggagattttttttgaatttttaaaaattattagcgatttttaggccgcttcgcgccgttttttaaattgtgctgagtcggacgg

SEQ ID NO: 15412 - DNA, 1002 bp, Heterodera glycines
taagacgggctgcttggcgcccgttttttaaatttgttaagctcagacgggcgcttcgcgcccgtttttaaatttagttgggccttttcggccgcttcgcggcctcagacgggcgcctcgcgcccgttacaacggtgttagaagaggttcaatagtgatcagaagaggtacaacagtgatcagaagattacaactttgataaaaagggtacaccagtgattagaagaggtacaagtgattataagaggtacaaattagaagaggtacaacagagattagaagaggtacaaatttgatgaagaggtacaaaagtgattagaagaggtacaaaagtgatagaagaggtgaaacagtgattagaagaggtgcaacaatgattagaagaggtacaacagagattagaagaggtacaacagagattagaagaggtacaacagagattagaagaggtacaacagagattagaagaggtacaaatttgatgaagaggtgcaacaatgattagaagaggtacaacagagattagaagaggtgaaacagtgattagaagaggtgcaacaatgattagaagaggtacaacagagattagaagaggtacaacagagattagaagaggtacaacagagattagaagaggtacaacagagattagaagaggtacaacagagattagaagaggtgaaacagtgattagaagaggtgcaacaatgattagaagaggtacaacagagattagaagaggtacaacagagattagaagaggtacaacagagattagaagaggtacaacagagattagaagaggtacaaatttgatgaagaggtacaaaagtgattagaagaggtgcaacagtgattagaagaggtacaaaagtgattagaagaggtacagcagtgattagaagaggtacaacagagattagaagaggtacaaagattgtaggaatggtacaataatagtttaaaagggtaaaatcatggtttaaaaattaaataaataag

SEQ ID NO: 15413 - DNA, 5002 bp, Heterodera glycines
gcgagcggagccggggaattttgcagttgtctttgccctccattgaatgaaacctcttctgatacaagattgaacaaggagaggcccatttcgggaaaaaataaatgaatttggggaaaaagtgattcagaaaggggcacagattcggtggaggagcgggcaggggctgatattcaaaaggggaactgtgatgatgaatcagaattgagacatttcttcgctgccttttttgctatttcaacaattagggttatgaatattaaaaaaataacacagaaagtattggctaaaaaattaaaaataatttttgaaattccggaggcaaaaagtcgtgccagccttaagcgagaccagcaccaccgtgcagcacacacctcgtgctccaacgcgttgtcgcgcaacgacagagagccaacgcacgcgcagtcgccgatgtgctgctccaacacggacacgcaggcggcagagccgacgatggccgagtcgaggcacaggtgaagcgagccgggggcaaggtgcgggttggcagagagacctgtggtacacagacagtcagtcagaacggcatttttaaaggaatgccgacattagcactgccactctttttctgcacgtcctttgttgttaaaaaaaaaaatcaatctaggccccaaaaccgaaaagtacccatcactttgccattgttggccttcaccccgcccgtttgcacctcttgcaaaatgttggtgccgttgttcgcccgtgccttcgccgctttttagacgtagtaattacagaaagacttaatttttgaaaggaaccttcatagccacagattttgcaatttaatggagtgttgtttgatatatctggtctttttcaaaccttaaagatgttttggaacatgatgatgatcaggttaattggatacagatttgtgaagttttacatcctgaagctgatcaaagtcccctggggatgctgaaattgatcactcccctgatcagcctcatgaatcaatctgatcacgggaaccatttacttgtctgagcagctttgaaagttgtgcttacctgattttttagatttttatcaaatgtgaaaaaaactcatctcatctaacttttggtgcataaaaattcaagtgagcaccttccttctccttattcgatataaaaattattatttttttttaaattttaagcaattttcatatttcttttttaaattgttcctgaacagtcttaggcacttactgcgaaaagccaatttttttttaaattttcattatttgtgtaaatcattttgatgtccatttatcacattaaaattcatatattttttataattgtttcaaaaatcgactcatcgataaattactgcccaatgattcatctttctgatcattttcttatgcttcaccataattgtccgtcgctcttatcagttgccgaagctgcccgttggtgataaagatcagccgctggatggtattgaagcgccggccgttgatcaatgcttgttgctctgcttgatgacggatgatcagcttccttttccttcttttgacctctatggatgctaccagtgctgtttcttcttgcatgcccagcttcctgcttcaatttttgatcatttaccagtaccaatttgctgggtgaatgctcctgatcagttaatttgctgggagaatgcttctgatcagctttttggctcattttctgatcactgatcaccatcgtgtctcctttctgatcaccgatcacaatcttgtcattccactgtgggcttggcaaggcgtgaaattccaaactgtacatctgatcagagttctctgattccgatcgcagcctcagttcactgctgctttcgatgatcggtgtcaatggtgatctgctgaacatatcttccaatgttggccgtctttgaagcagactaaatccctgaaactgatcagtgccgtcatcccatggctgttccgcctctatcagtgtttgagccatctgaatataaatgtgaatttaaatgtatattgtaatccacaagcccgttccaatttactcaaaccccgggactcaattcggcgaaccacattttccctttcccaccttgtctcccgctcaatctccctcctatccgatccctcttttcatattccactcccttccgccacttacggatatttttcacgtacaaaaggcactccgaattcccttcccaccgttttattttccccgggacccgacaaaagtggcattttttccccaggcattctttaagcgctttgggcgatcgatctaattaatttctcatctcacaaattttatatttccattttacccatatgtacagcaataaatttatttaaaggaaaagaataggaaataaaaagaggaagggcatggaagcacgagaggggagggcgcttaaagagaatttggaataattaaaacaaatttcgggaaatcacaggaccaaaattcggacaatttccctcatttctcgggcccggcacacacttcccacatttctatgtatatgttttttagtgcaaattcaaaaatataaaaaaaacagttttgcttttctctcaaattaatttgccattttcagtttttttcacttggtataacgcaacgccaatgaataagtttggaattttaatgaatttgttgaaaatttgcaaaaattttccagaattttccctttcatcagcccctcgcgcacctcatccaaactgccgggtagagcaacaatggcaccttttttctcgcccattgccgacgactcgccctgctccaaccgtaaaaactcgtgtagtgtcggcatgttcagcaccgtccgctgatcagtcggatattctatgatgtgctgatcggcgatcagactcttcactttcttctcaacttgtgcgtccaacttctggccaaccagttcaatgttcttctgtccggtcagcgattcttcataggccatggtttcgttcaaactttgtcgttcctcctccgtcatgcgattgaaaatgtcggtgtacaggcaaacggcacgtgccacataggccaccagttcgttgggcttctgcttttggaggtcgtgctggtaaaaaacacagctatttgttgtcatttcgccaagagatgattctttgaaaatcaaatctcgaatggatattcattctatggtttactgttggtggccaaacatttaggcactaatgatctgagccccaatgcttgcgcatttatcataaagtgacagaaattgttttgtcagagggcagtccattcccgatcactatttaagctgttccctcacaattgttcaccccccccccccggttcattttattccaccagtctccaattgtacaaagacaatccggagatatacacacaattgactgtacgttcttcccttttcacttccgaataaagcataaatattcgaattaccgttacacagtgtttttgttaaatatgttaacaccaaagtgtcccaattatattttttaattttatattcaatctcttccaaccaaccccaacgtgttgttgctgttgttgttgtggttgctgcttgccaccgctgccggtgccgggagacaacaactgtggcgtgacagaaataatttttttattgatcagatgaaaaatatttaggtttggcattggatttcagaaattttagggtccttgaaatctcacccgagacaacgataagcgtgttttaattggagatgaaatggaaaacccggcttttgtgacacctgacctgaattttttttcgggccaacagatatttcgaaatgagataagatacggaaaataaaatttaaaggccactatgaaagaaatttagccctagaaaaaaagaaattaaaaaattacacattatttgagtcgtggccaacccagtcccacccattcaaccaaccccgccgccgctcaatgtcagttgctgtctgttcgcggtgccgggcgataataactatgacatgaatattttattgaacggattaaaaatattttatttgccctttggatttcaaaattaagatctggaaataaagtttaatggccactaggaaatcaaacctagccatagaaaaagaagaaaaaaatcccgcgtcaggaccaatcagatggggggggacccatcagtcgaggacaactcagctttcgacaatttaataaaaaataaataaatttttaaactaaacatattttttaatctttaaaaggcaactcatacaatgacttaggctaggaggctaggatgaagcttttttaggctaggcctaggcttgcttggacctaggtttaggctttatttggtaatccatcagccgaattcagttgagttgtccccagctgattgtccagaagtcgaaaaatatatacatatttttctaaaaaatggctaaggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtggcctggacattttgtgggtcagcgatggctaaaaatggcttcgtctttgagtcctggccaactcagtcccacccattcataacccaccccgccgtcgcttattgtcaattgttgtctgctcgcgctacccggcgacaacagctgtgactggtcgtcatttctgctggaacttctcccgacactattcagccgtttcagtcctgccttgaatctctgtctgtagcttggcgttgtgcttccgtccgtcatgcatcgccgttgggcgtcagcttcaatttcttcaagttccaggccgaaatgtttggtgctcaagtagagaattttgtcccgaatgtccaccaacgggcggaaagtgaccgcgtccacttcatgcttat

SEQ ID NO: 15414 - DNA, 3429 bp, Heterodera glycines
ataaatgatgccgagtttaaataaattaacattttatgaatctgaaatggtactcgtcaatgtgttttgtgctcaactattagactgtcccgtcaagtcactgcgcgaccgaattaaccaccccgaagatcgtgtaaatgcaatgaacggattgatggggaagaaagttcgaacaacctacaaagatcgcaatgggatgcacaagaccttttttgtcggcggtatcacggagcgcggtgcagctttcgttccggcttatggcaatctacgggcaccatacaacgtaaatgtggcagcttatttttatgcacggcatcgcataaagctccatttcccttacgtgccttgcgtaattgaacgcttttccgggagaggtgaggaccgtttctacacaatggagttgctgggaattgtggatgacgaaaacaaagggagattgtttggacgaatgtttatggaaattggtgaagaagcagatgatgatgataatgacgaggatgtttcaacatcctttgactcaacactacgatttgatatgggacgcgatgagtgttcccaattatggcgatgatcaatatttgcaatattcatcttctattactaaactatgcacttttctacctaaaaattacattttaacactcttaattatttaatcaatatatatttttcactctattaattcggcatttttctacccaaaacagacaacttctttttttcatttattcaaattcacaaaataaataagaaaatgtttacaaggtgtgaccaaagtttaaaacattaaaatctgacttaacaattccctttccaacgtagggcctataacatttctgcattgggccactggtcacttttcctccttctctgatgctaggccgcaggaagtttgggtaggtgactatgatcggctcatagtcaccagtagcggcgaagtccaacacttgttgcttgaaagtttcataccgtaggtgttgattattgatgacatcgtagttgagtgtcatcccgcgcaccttcagcacatactctaacaccgcagcagcaggtgcatttaagcgcctcaacttcaatccgtactaaataaaaatatattagcatattgattagcattttaaaaattaattacttgttttgcaccaccgctgcagtactccacaatttcgtgttgcggatactcatcggtaaactgacccaaatgtgggccagttttgagtggacaggcgttctttgggtgcacaaagatcaatgaatccgtgtctaaattgttgatcaatatgttatttttacctagaaatgataataaatttaccagtgtataaaagcacgcaaccaggtgttcgtgccaccttttgcatcgcctttaggaggaggagccgcgcagccgaggtcgtccaaagagaaatcactgcaattttcatattttttatatttcattggaatctttttcccatacctatgttggagcagtcgtgctcctctacccactccttcttattttcatagctatgtaagatatggtccaaaacaagttcgtcgattgccgtcacatcgaccgatcggttgtccaagtgttctctgaacgcaactgggtcatctgtgatcaacgtctgcgaaagtccaaagttgcgcaaagagaagcgacccccttaatatttatttcattattattgacgtttgattagaaaaacccacataaattatttagacatagctttgcaatagaccgctttcccttattgacagccatttttgacggatcaatgcttatcccaaactgctcataacattctctgacgaattgttgctccttttcggcgtcccctttgatgctgctgtcaaacccgctggcctggattttctgcgccataaactcagcgatgtatggacgaaatagcttgtcatcactctgctcgtactccaacacccggaacactttcgtgacgcggtagccctcttcaagcgctgcgttgagctcaattgaagtgctggtgctgacccatccgcgttgttggtcattatgtctgcagtgatattcgtcgtcaactcctccagtagggtagtctttcgcgcacttcatgcacaatggaaagcataaacgttcaccaactttcacaggcagaaccggaatggtgcactttcgtggcggaatcacccagcatttaatcagtgccaaagggaaggtgttgtgtgctgggctcgtccaattaacatcctcgttcaacacgtgaaccttcgggtggcccactggataacgggttgtgaaactggaaattaaaaattgtaacacaattatgtaaaaatgacaaactttatgtatgggtagagtgaagtaaagtcgaagtaggaaattttttggtctgcgcctgccttgtggaagagctttagtggtcccgtccgcccgccggtgaacgcgtcacggatcaccaacggtccaccatccacatattctgcaaattttttccgcatttccctgcttctgtccaacattcgttgaatctcgcactcccagaagacatcaactcgtgtcacttgagtcctcaagaactgtaaccgcttggcatcgcgctccctttgttctccagcagttttcccgttgggcaacatcatgttgtcagagggaaagcattttctacagccgtgccaaacacaacctgcaaacaacttttttttaaattgcttaaaaatatagaaaaattaccattcacttcaattacacacccttctgcctcaatccaaccgtccacagtgtagtttgcaatctttttttctccatcaggtgagtaggctgtctgcacttgtacgttgttttcctcagcataccagaaaagaaagcggagagccagcttgctctggttctgggtgttgtcatagcccttttcagggacaatggcaaggtgctccgccggcagatggttcaacctgaagtgcttcatgcacgcaccggcaacagtcatgcattcccgtagaacatcaatcccatcgtggttttcccggtcgtcgattccgtcgacatattcgttccgcttcgacacatcaaaaaactcgcggcggaatgcgacgagagctgccattagaatttcaacgtcattcgtacaataactgaaaaagtccaaaataaatattttaatttaaaaatgttttacctcgctagtgcttcatcgagttgaaaaggctcttcgcggtgctgctcgaaccaatgatcgaattgtcgtcgcttctctggcatcattccgttggccaaatagtcgtcaggggttgggtagatgtgttgaccgtagttctccggacggttggccaaatgcgggaaaaagggtttgtcttcgacgtccaatccgtaggatggcaccagctgagccaatgcgcagggcatcaagttgaatgagaagagaacacaatgtttgggttcccggttcttttgcttct

SEQ ID NO: 15415 - DNA, 1336 bp, Heterodera glycines
tttcatgttgcaacaaccggaatatttcacatatcatgttaacacagccggaagactttcatttgatgttgccatgattttccgtttaatgttgccaacaaccgggagatttcccatttcatgttgcaacaaccggaatatttcacgtttcatgttgccacaaccggaagactttcatttgatgttgccatgattttccgtttaatgttgccaacaaccgggagatttcccatttcatgttgcaacaaccggaatatttcacgtttcatgttgccaactactgaaaaaaacaaccagagaagattaaagtttcatgttgccaagaaccggaagatttcacgtttcatgttgccaacaaccggcagatttcccatttcatgttgcaacaaccggaatatttcacgtttcattttgccacaaccgggagattttcatttgatgttgccatgattttccgtttaatgttgccaactaccgaaaaaacaacctgaagatttcacgtttcatgttgccaacaaccgggagatttcccatttcatgttgcaacaaccggaatatttcacgtttcatgttgccacaaccggaagactttcatttgatgttgccatgattttccgtttaatgttgccaacaaccgggagatttcccatttcatgttgcaacaaccggaatatttcacgtttcatgttgccacaaccggaagactttcatttgatgttgccatgattttccgtttaatgttgccaacaaccggaaaaataaccggaatatttcacgtttcatgttgccaactactgaaaaaaacaaccagagaagattaaagtttcatgttgccaagaaccggaagatttcacgtttcatgttgccaacaaccggcagatttcccatttcatgttgcaacaaccggattatttcacgtttcatgttgccacaaccgggagattttcatttgatgttgccatgattttccgtttaatgttgccaactaccgaaaaaacaacctgaagatttcacgtttcatgttgccaacaaccgggagatttcccatttcatgttgcaacaaccgggagatttcccatttcatgttgcaacaaccggaatatttcacgtttcatgttgccaactactgaaaaaaacaaccagagaagattaaagtttcatgttgccaagaaccggaagatttcacgtttcatgtttcatgttgcaacaaccggaatatttcatgttgccacaaccgggagattttcatttgatgttgccatgattttccgtttaatgttgccaactaccgaaaaaacaacaagaagatttcacgtttcatgttgccaacaaccgg

SEQ ID NO: 15416 - DNA, 1887 bp, Heterodera glycines
  misc_feature (56)..(56): n is a, c, g, or t
  misc_feature (124)..(124): n is a, c, g, or t
  misc_feature (184)..(184): n is a, c, g, or t
  misc_feature (228)..(228): n is a, c, g, or t
aaaaatacaggggagatttaattttatttatttatttttaatgtaaaatatttttntaataataaatattttataaaaatataaataataaggtcatcgttctgtgttcgctaaacacccaatnttgttcaccgaatctggcattttctattttgaaatcaaaattaaaagctgtaaaaggtanaattacaaaaaaaaattaagttcgatttgatttatattttaatntagtctttgctcaattggatttgccaccaaagcgatgccattgggcgaaaatgttggccaaaattcggacagttgtgcataccaaagcgatggccaattttggaccaatgggtcaaagaattttggaatgccgaacttttctcgtggcgatttcgtcggttgtggcattaatttggccactcggcggattatcttcacaaagaatggccaacctttgggtcttttattttattttaaaattgtttatgtttgattttttcagatacctccgatttgttcctttcgcctccttttggttttccattgtttccgttcatttctttgaatgattctggcgattttattgagacaaattttgggccacaattcaaattcgaccccgcaaaagtaaagagaacaaaattatttaatcaaataatttgaattaatcttaaggtgattctcaattttccacgacaaaattattgggatgccaatgtttgtgatgagaatctccaaatcattggcaacaaaagtttgactgtccatcacaagggaactacttctggtatttgtttttaaatttataaatcccatttttttcttcataagattattatcattccgtcttcgctaaatatccgattgcgctgaacaagtctttgtctgactttttttactatgaaatttcaattatgaaaaaaggaaaaagcgagtaagcgaatttgatattttgaaacatttataattataaaaagaataagagaaatattttattatttatttcttctttattcagttgggtcatgttcggatttgcagtcaaacagcagcagacaaaattggatgaattaattcatcttgaaaagggcacttatgcattttacaattatggctatttatgtattaacggaggaataaagggaagaaatgccaaatattcctacggtgttggcgataccgttggaattggcgtcaatttggccactcgaaagatcattttcaccaaaaatgggcttcgtttgggttagcaaataataaataatataattttacgatttttaaattacaatttggttaattgtctattttatctaatttattttatgtttaaaataatcaaaaatcccttaactttttcacagatacctctgattttttggttgatccatcttttgctgatggttctctttatccatccgtttctttgcacgtatttggcaaccaaattgaggcgaattttgggcccaatttcaaatttgatttggcaactctctgaggaagaagaaatattcactaaaactgatcaatttgttctttttaatcctttttatttccgtcttcgcaaaacacaaaatctaaattaatctgtttgtctgaattttgaaaataaaaagacttgagaatgttaattttatctaaattcataaaatttctacaaatggaaacctcactattaaaaacgcgggggaaagtttgggcaccaaatatggattttaaaaactaaaatgtttttaattgtgtaaaaattgcaaccatttcatttatgattagaggtcattagagatcaaattgttctttttaatcgtttttatgttttattcatggtgatttaacgagctgatgcttttagtcggcaatccaaattttctgaatttcgcaattgaaatttgaaaattc

SEQ ID NO: 15417 - DNA, 1210 bp, Heterodera glycines
ggggttttatgaaagtcgtcaattgcacttcaaataagatggaaatgtgtccttaaatgagtttttaagacttttttgtttaggaactttttctttgatcttttttccgagtttttatgggaatttcgccccgacaaatgttcctgcccccgacatttttaaatttctccagccatccccgacaaatttagtcggggaattttcaccccgaaccccgacttttccaaccccgacgtcggggtcgcaaccctagttttgagcataggctcagataaatcttttccctatttttaatatcgtattttaatgaaatataaatttgtcctaattttgataaattatatccatatttttgcaattttttgtcaaactttgagaatattagtaaaggcacgctgcgccgaaaaagccaagaaaaagtcaatttttgaggttttttggccataacttttttgtaaactgacgaaattttttgaaattttgtaggttactagagaatcacaagagctatcatgatatcaaaaatatttaatttggttgataatgaaaaaagttgtttgcaacggcgccaaaaaggccggcgccgaagtgggcggttcccattttttggggtccccgaccacgaatctttcaattattttgaccaattccgatttcctaatctaaatttgaacaaaaaatagtaattcgaaaaattcagaatttaaatttatttgagttcaggttattgattagaaattagtcaaaatacatatcagattcgcgatcagcgacttctaaaaccccggatcacttttcatatagcgccaaaaacagcgaatgtctgaacaatcttttggggcatgcccggcttaaaaagagaattccgtctaaaaagtctcaaattactttcagttaatgaatgagaaaatggacaaattccaattggaaatcggcaaattgaaccaaaatgttagttttaattttttttttttttttaatattttaacaaaagatttattaagtatattaaaattttaagtttcagattatcgaaaataaatttaaagtgaatgagaatcgccgggaaattcaggtacagtatatgttttggtacatatatataattttgatcagaaaaatttggccaaatttgcaaaaaacacaatgtttcttttgaaagaaaaaattttttaagcaaaattataagaatttgacgttctttcaaatt

SEQ ID NO: 15418 - DNA, 2979 bp, Heterodera glycines
tttaattttttaaatttcactttaccatcgttttgcaagtgttcacgtcatttgttccaatggcacaatgaatttcaaatgcgacaattccaagcgctgcgccgtcgaaatcattcaaaaaaacaccgaacggaagagcattttggaactcggccaatttagcggaagaggaactcattaacgctaatgactcgatcaattaaatttaatttgttgtagaactgtaccctttgtgatgttaatgtccaaaaagtcggagccgtgcacaaaaaattttgggcctatttccacggataaatcctttctaaaattaaatttgctttttaattttaaattaaatcactcacccaaaagaggactcaaggatcagcccatttttcttctgttcgatcattagcgcgtgccatcccttcgtgccgtctgtgccaacacatctttcagccaattgcttattcccgttgcgccttttgaacacttttcccactttccatccaaaattatcggccattttgctcttgtagcaaatcagcagactaattaatgcgggaaaattaattaattatcaccaaaattatttgcaaattactttttggctttctttcccattctgatcattccgtttccattcaattcgcactttttccatttgtcctcggcaagtctaaagaacagaaagcatttgaaaattgattttaattcatttaattacccttcaccgatggcatttgtcgccagaacaacaaaaaagaacgaaaagcaaattaaattcattttgattttgggaaaggaataaatttgctgaaaatgggaaaaatgattaataaattagtgggtttattggctttgcaatcgcttaaaaagccaaaaaagccaatagaaacggtgactcatcgtttattggctttatctttctgctgatcggaattttgtccattccatattcacaaatcagtgcagtgtttgggagagaagcgatgcaaatgcctttttttcattttatgtggacaaaacggacaattttatccactttcacattgaatcatcatcataaaaatatttagaaagatttgtgcataattattgtatacagtaaagtaaagtaaaaatatttttaaaatggacgatttattagtaatttcaaaaattattttaagtccaattaaatttaaattggtttcaattgatggcaaaaatatacggacagatttgaattcattctttatcctttttctcgtggattcctggctccgaaaaagatttagctgaaaatgtgttggtgctgctcaaattggccgacttcttccaggtggaatggctgatgacgcgctgcgatttgcatctgatcagttgcgtggaaattccgttgatcgaccgtttccctccccaatttgaaattgttttttctgattttacattcattttttcacatttttttccatttcagatttctttttccatttgaattgcgcatctttttgaatgagaacagtgacaaattgggctcattaattgacagtcaattgccggcaaattgttttttgagttgtgccttcggcttgttactgcatgaaaagaaatgccaaacttgggagaagtggagaagtgccggaattttgttgcaaatccttttcatatttgtagttttttctttttttaattctttttcggcttttgaatttgggctacatattttcttcaacactttcttttgaccattttacttttttaaaaactacctttacataaacttttatttaaaatgacatcattattttcattaataaggctgctgggatttgctctcacttgcagcttacacggtcgtgaaattatatgacaaaatttaacgcttcatgactttttcgagatgcacccaaatttaaaattttttattcataaaaaaaaggtacgaaaagatataaacctaaaatggaagaaaaaaaacttacaaaatttacgtttataatcaaaaaccatttttttttgttctaagcttgatggaaaatgcaataattcaaaaaatcttgaaaatgtcaaaattttaataattcaaaattttgccaaaaaaaaattaaaacgtagaggaaaattttataaaaattttccatttttggattttgtaggcggaatttagcataaattatgaattttaatttgccaaaataaccaagcgcatttaacccttgctaaaacatcgacgaataaaaaatgcgacctttgtatataattatggcgcatattatttaatttttatttaataaaaacatttattttattttgaatttttaaatttgttttttcaaattaaaatttttgattgaaaaatgaatcgattaaaaagagtgcttaatgttaaacaaacagataacgaaagtatgtcagtcatttcactgaatatttttgcttgcgtccaattgctaaagcatttcgcttagaaaataataatttcatacttcattcgttttcgaatgatagaaaatttgttatttatttgggcaaaaaccttaaacaaaatattaactagttctttggcacaactgtgagacaagaaaactctccaaaattggctaaaatttgaccacagattggaattttttcaaaatttgatgaaatttcaaatcttttaaaatctaataaaaagaaattaaattccaaaaacgagaaaaagaaataggaaaaattcaagaataggtgtagttcaccaaattgtacaaattttatatcaatcgattcctctaggtctgtaatggaagaatccgaaagaatttttttgcggaaaccaatctctgaagagttactgacccgggactgaaatggccaaatggctttgggactgaactgtccaaagccataaacgcacggaattgctaccaaatagatacaaatcgatccctcacggtctgctaatcatgaatccaaggaatttttggataaaaaagaaattgacaaaagttatgtgtccttaaaaatctcacaaaa

SEQ ID NO: 15419 - DNA, 3649 bp, Heterodera glycines
  misc_feature (770)..(770): n is a, c, g, or t
  misc_feature (793)..(793): n is a, c, g, or t
  misc_feature (841)..(841): n is a, c, g, or t
  misc_feature (3265)..(3265): n is a, c, g, or t
  misc_feature (3514)..(3514): n is a, c, g, or t
  misc_feature (3578)..(3578): n is a, c, g, or t
  misc_feature (3601)..(3602): n is a, c, g, or t
  misc_feature (3612)..(3612): n is a, c, g, or t
tggacacgccgtaaggcacggtcctgcactctgatcatccgtttttcgcttccggccagttgggagcgtgccaaaatcacacccttttccacgaaaagctccacatgactctgatcagaattagttttaaattttttgaacaacaaattatattcattagaaaataattttgtaaaatgagtaaaaaattaattcaattaaaaaattaaatattattttaatttcaattgcaattaaatttaaatttaatttcaaagataaatattctaaaattaaatgaaaccaaattaaaataaaagctattagtaatgggtaataaatttaaaattataataaatgttttttgattaaatctattctaaattttaaaaagagaaaaaatatatttaaaaaaaacatattaattaaaaacaaaatttttattcgaataaaaaaaaattctcacccgtccatcgcctgccaacaacaacagagcattagaataatttgttcgaaatgtgatgttaaacatctggcgtaaactccacaccgcttgtggttcatcctcctcatccccatccaaagaaactattttaaaaataataaaaaaaattttaaaaataaataatttaaattttcatttttctaccggtagcaatttcgtctaccgtagacggttctttgcgcagatcgtaacccaaccattcgttgccgaaaaaagaaacctccgtgctgggcttttctagaagaaacgcaaaattaggaataaataatatttaaaatttaatttntaattttttaaaattattattantataaatattatttttattttgattttataattttatatattattttnaaacaattaagcaaaacaacaaaaaactgaactggtttcacaccgtctcccttcataatcactatccgtacagtcacatcgggccccattgtttgcactgtaacatcggccatcattctgacaataaactcctggggcagtgtcggtggtggtggcactttgtgccaatttggccattcggctggccgcaacaacagcagccaaaccagatgatgccaatgaggtgaatgtcggctggcaataatccttatcagtttttcgtgtgcccattgaatccatcaattgaggatttgaaacacctataattaattaagggcaatttattctatgcaatattatcaattaatttaatcgtgattggacagggaatcaatggtcttaccagaattttcctatgtttgagtttgatcagaagtcttgatcatggtaattaggagtaggattaagcaccgatccgatacgaggaattatgaatctcatctgctgtttcatgtcaaaccgaatgaaaatgtttttgaatgagttactaagaattttttactttttaaaaatttctgtaatatttttatgaacatttgctccccgatatttttgtaatttctccacccatccccgacaaattttgtcgggcaatttcatccccgaactaagacttttcgactccacgagggtcggggcttaaccataaataggagtgctgccgtatttgggaaattcttcaatcctgaatatctctaacttcattattccgtaaagaagtttatttggaaataatccctactcataattctcgtttttaaaaataaacctattatccaacaataattagtgattaattattgtttttttcggaatattaatttcttctgaccctgtgggaacagtcgataaacaagacttcgtattgcacccgcaaaatgctgagaatgccgtcgaagtggtgagctgagcttttcaatttcctgaaattgtttgtttttgcatttaataaatatacctaagtgccattttgaaaaaattcttttaaaataataagcgttgaatatattttcagattatgggatgatttagtttaaaataggttaattctcttcctttcagtatccctgcaaagtttggtgcgcttctgatcatcgaaaaattatgtgtggcaaaattttttcaaaaattggaaaaatatagcaaattggaaaatccaaaaattttttaacaaaaccctatgggatggaaaattaatgtttaaaaatgttttatttcgtcatctcatcaagaaaatttaaaaattttgcattgacgaattttttaatgcattttttaacaaaaaaaaattttttttaaaggtgcaccagcgaaatatgtgctaaaaccctgaaatgtgtggcgggcgatatgttttaagtgctcgggtcttgtcgcgccaattagtaaaaatcccagttccattaattagcgaatgacattttataataaaatttttataaaaatttattttaaaaggcaataataaatttttaacgagctcatccaaccttcggaattccaccaacgaaaacatccgaatttgttctaatgtttcccagcgcaaaagtgcgttggctcagcacacggaacgccttttcctcgtcaagttgaaccctcacattttcccaggcctaaattttgagaaaaagttaaaattaaacgatttttcatttatttgattcaaaaaaaacacctggaaaaagctgaaccgatgccactttccgtcgtccacccgtgcggcattgacaaatccgatttggataaccggacgtcgttccggcatttcgaattgttgctcgcccagacgaaattcgacttggatatgcccgtcaagcaacgaaattgtgaaaaaattttgttgaacagtgcctgagatagaagaaatttaaaaattaatttttatttttgaaatattttttttgtgtcaccccattagaggggcttgtgaaaatagtggaaaaaaatcagttgggaaaaattgtatccttgccaaattttcagtttttcaccccaattttttgaaaaatgaaaatttaaaaaattccaacttaaaaatgtgcaaaaaaaaatatcagaacattttttaataacaaaatatcattaaaactttttgaaaaatattccaattttcaaaaaaatcttagaacatttaaataagaaaatttcattttcactacaaaattttccaatttttttcttatatattttttaactttataaggctttttgaaaattaaacgaactttgcaaataaagtttatttattaaaaattgataaaaatatttatcaaaaattattgtaataatttctgtttgttttatcatttaaacttgccatcatctgtatacagcagtaatgcattgggcatgcgcgttttgaattcaaaactaagttcattttcngaaggtttgtgcccattttgggtacctaaaatgcatattttaaaaattggaacgggtttttttttaaatttgtaaatattcattataacctggcaaatgaatcaggggaccccgaaaggataagagctcggcacatttgagtaataattacaataataataataataattggggaattaacggatttcagacaaggataaataagcaagggcatgtcatgtgctataatttaaaatggaatattttttncatttaagaatttttatttatttaaaaaattttactattaattatattgataaaaatttaattnttaccagaataaaattttattannaatataatanatttacttatagattatcctttattttttaaggatca

SEQ ID NO: 15420 - DNA, 2866 bp, Heterodera glycines
caaaaaataaagaatttttaaaaaattccaaaaatcatgaaacgaaaaacaaaggtcaaattcgagctcagcaccttaatttaccccaggaaaaattttttcacccccattttcaacacaaaaaaaattttcgaaaatttctagggggcctagctcgaaaatttttgaaattttccaaacatttagtacaccattcgatagagcttaaaattctctacaaaaatgttctaagacgatttttggctaaaaccaactcctgacgagttatgggcccgggactcaaatgtcccgctgaggctaaaatttttttctatttccgggaaaaaatcgaaaattttccgaaaaaaataccagtcgatagagctcgaaaaactatgttttggaagtggtcttcgttttgccaggaaaattcattaaaaattcttaaaattcaaaaacccaaaaaccgttttttaggcctagctcgaaaaattttgaaaattttcgaaatttttaaatttcagaaaatcgagcttccaaaattctacaataagtctgctgggcacctttccctcagataaaaccccgacgcggtattcgcctggtactgaagtgtactttttgagcacgcttcagttgccattttctgcaggccagggagtggctctattaaaaaaataaaaaataccagcatgtagaggacactttggcggggtgccctcgcagcgggcattttttgattcgagttttagaaaaaaagttacgggccttgaaataaaaacaaaagtgagaaattagccgccgggactcagttggccaccggagagaaaaacccgtatttttcccagatgcgcctcaaaaagttgtaagacccttccactactttcagggcgctcccggccttcggccgggagattttgttttttaagacgagtccccctttttctctatatatatataaactagggtgaccagttggctatggtgtgcatgcgtggcttggtaatatatggccctcatttgttattttaaaacatacaaaacattatcaattgagttctgttgctgtggggaaagcgcttcgcgctaagggacgcggcttcgccgcgtcgctagaaattgatgtaatttagcaattcatcgcagcctcaggacgggcgcttcgcgcccgtttttaattttttgggggatattcggccgcttcgcggcctcaggacgggcgcttcgcgcccgtttttaattttttgggggatattcggccgcttcgcggcctcaggacgggcgcttcgcgcccgttttttaattttttgcctgcgcgattggttcttgcgggatgcaagactccgacaccaaaccaagcatgtcagcttggttttcaccggccacttgggcttgggtgagaatggcatcaactgcctgtccacttgtctgtggttcgatgatcattatatcatcatgttcatcaacttccattagctcagcggccttggatgtcgactgcgcttcatccgtatgccgatagacaattgggcaaggagttggcaccccttcccttggatgatatggcacattatcagagccatatagctcgttaatgtgccataaaatgcgctttttttcataattgatgttcaaatccggcagaacaaatgtacggttgttcatcagccaggattcagcatacaggcacacgaagtacccgcagctgttaccatcattttgctttgtcaattgctgcacgtattcaacagcgaatgacgcattcccgggcactatctcagcaattattgactggatgagtgccattctctcatcactcaagctgctcatatgcagcgagtcaaggaagtatgcaccatgtgcaacatcgtagacgatgagagtccaatgatttgggaagtgaagcggcataagcacaacttcaggaacagcattcggatcatagccgaaagtgtaattcttcacgttggaaaatcgagaaatatcagttctcgatgccaaagaatccacaactactgtttttcgttgtgaaatacttgcaatgtaagctaaataggcaacaataaagctgtcatttagccattcatttggcctgttccaacaggtctcaatgaatcttgggccagagcgtgggccaagtgctgtttcgccatcacgctcgtaaaggccaattgctgcccatctccaaattttacaggcaaaatttcgcgatgtggcgaaattaattggcacagtgctgaagtcaatttttttagacacaatgtgcgagggtgccggacttagagcgttttccacactttggtccatttcagagcttttggtcatagactcgttggttttgcctcttcctttaccggcatgccctcccagttgcttaactggtcgccctccacgactttgagtcgaaacaggcgttgaagcaatagcttcatttgcaaacgtgggtttgtcacactcggtgacctttcccctttttttgcacggcgaaccttggtcactttgggtgacagcagttcgaggtgtgtcaattgaggacacagtttcttgcgttgccaaaattggcttcgctcctgctttcaagggtcttcccctttttttacttccaatggaagaagcaggtgtgcttatttgcaaagcacttaaacttggggtggtggtgccccggagagatgccgatgcctctccattcccatctgcacttccgtctgggacgggtgagcgacctgggctgacagattgctccgtccgccgtcggtatcgctcctgatcattctttcttttagcttcttgtttctctgccatctgaaaataaaaatgaagaaaatgatatgtacatgtggcaaaatatttaggaattacaaccgataaaccacactcaaatcaaata

SEQ ID NO: 15421 - DNA, 1089 bp, Heterodera glycines
tccctctctcacctctatttccgccctctgttccttccttcacgccctctgtttcttgtttcctttctctccccctcctccgtccccccccgcccactcaaatccctctataaaattttgccggttcaatttctgcgcgacttaatcttcccactatgaattattttttagtttctttctttctctcactcccctctctctcctttcccttcactctctctctctctctctcgttctaatctctcaattccattttctgttttatgcgtgccatcgtatgacaaatggtccaaaaaatgaaatgtccccctctttcaattccttcacatccgttggcctttgctgcaaatgtttcgcccctttttgggtgtggcccccgtaataataaataaatgtccgtcccttcctccgtgcgcagtaattcgtttttttaattgccccgagcaaaataataataaatgattaaatgattgactccgtccattgaattttctcagcccataaattgtgaatggaatgcctgcactgaaagtgaaaacaaacaaaaggcggaaatttacgccgaaatgaggacaaattgcaccgaaggaatgaaccgaaagagaaaaacagaagcagaaaaagttgatgattaggcaaccatcgttaattacctagttaattaatggtttcgagataaaaggaaaagccgaaactaaaatttttattcaaacgtttataatttaaaaaataaaaaaaggaataaaatttctcattgtcagctcatctcttccagtaatggaaaacccaaagataatgttgaaaaaaaatattcaacttttaccacatggcagttaataactaaggcttggcacgaaagcgcatggcactcggaaacaaaacccaaaacctccactgtttaatcaatgtcttctgtcattttcaatttaatttcagtgttttcgttgctaagataagactctgtcttctttggtcgactctttttgtttgatcagtcaatttattcttaaattccccccccccccccctcaggtttcatttcctccgatcggtacccaaaatgcgtgggttggcttcccccgcccccgt

SEQ ID NO: 15422 - DNA, 1794 bp, Heterodera glycines
ttgaactgattgagaaggtgcagcgtgaagctagcaaattgttttcaaataagtcaattaactgattgtttgattgattgaagcccatgggaatcatcgccatgttggacgaggaatgcattgtgccgaaggccagcgacaacacactggcagccaaactgttggagcagcacttgggcaagcacccgaacttcgagaaaccgaagccgcccaagggaaagcaggcggaggcacactttgccatgcggcattatgccgggacaggtgattcagtagaaaggatattcaattgaccaatcccgacgaaattctgtggaaatccaaagtgagtacattattaagtgcgctacaatgtgagtaattggctggagaagaacaaggacccgttgaacgacactttggtgggcgtgctgaaggcgtcgacggacaatgctctgctggtgcagctgtggagcgactacaccactcagattcgtgttgttttgcttttgcaaaaaatgccaatgacatttgatgtcatttcacattgggcaatttaggcattgtttaaaagggtgggggcaatttcaaaataaatggtgaagaattaaattataaaaaatcaaattaagcgagaattataaattttgtgaattgaattatcaaaatgctttttcaagaggaagcggccgcgaaacaaaccaaaggcgagaagggcggcaagaagaagggcaagggcggctccttccaaaccatttccatgatctaccgcgactcgctgaacaatctgatgactgtgagttcctttcgcatttgcactgcttgtcttactgtagctttacactacacaaaatgcacttttacggtacgccctaatccaaaaaaaaacacattggaccgtttaacacagaaaaaccataaaatgattgagtcggaggaatctccgaattggaaatattatttaaccgatctttgaaatcattataaataaataagtttaataattgttgctttagatgctcaaccaaacacatccgcacttcattcgctgtatcattccaaatgagaagaaacaagcagggctaattggtgggaaaagccctttaataaaatattattcatttaaaaagcattgctttaatggaaaaagaataattagcaaaaaaatattcttaaaaatatataaaattccctatttttactgatttagcttatataaaaaaaatgttaacgttagatgctgcacttgtgctcaaccaattgacttgcaacggcgtgctcgagggcattcgaatttgccgcaagggctttcccaaccgaacccaacatgtgccaaagacaataatcattaaatgaattgaaaaatgattaatattttccaattttcagcccgattttgtgcagcgttacgcacttttggcagcagcggaggcagccaaagacgggaaaacgaacccaaaaacggcatccaccaatatgctggcacggctggtcaagcagggcgacttgggaccggaccaattcaaaattgggcacacaaaggtgagatggacaacccacactaatgggctcattaacgaaattaattcttttgacccacttgttcaggtgtttttccgtgccggtgttgtggcacacatcgaagacctgcgcgatgctcggctgtcccaattggtcacggctttcaggcggtgtgccgatggcattgtgccaggttttgtcttagtttacagccaaatcactcaaaaatccatgccgttgttttaagtttgacgtggcacgccgacacaaacaaaatctcgcctaccgtctgat

SEQ ID NO: 15423 - DNA, 1893 bp, Heterodera glycines
cctactaaatctaaaaaatattcgaataaattggataatagtttatatttctttacaaaaatcccgtagaacagaagcaatgcccctagaatataattccaattttagaaatcaccaatacataaaaattcaggtcatgaaaaactctagcaattaaactaattttcattttttttcaattttctaaaattttaccaaatcattttgtacccaaaatccctttgtctgcatttaataaccgtgtaatatattttagtaatcccgtaatcaccatcctatatttcaaacaattgcaccacaatttgtacaataatgtccagagcattacattacattggtaaatctagttttgccgccagcgccatcgcggcgctggcgccgtcgcctaccctcgggtgacatcgtccagtccaatcctttcctctctgatccaggggatcaagttttctggattatccatccccccccccccccctctgtcccgtccagcaaataaaattttttgcacaaatcccatcgcctgcggcggctgtgggtggacgaaccaattggacacggcggacacgacgaattgtgttgtgcaatcggcgcggtcggtgggcggtgataatcgggcgtattgagatgatgcggccggcgtaaatttgtgtgtacaaatttattttccccatttttcacgcggcggcggcggcgattgggcattttatttttactaattggcccaattagcgcgctgcgcaatagtgaattctttatatatttttttggttggctaataattggcccaattagcacagcgccacaggcatcaataacaatggtcagcagaaattagtgtggcgctaatgaccgaagtagatcaatttcatagtaatttggcccatttcttctgaattccatcagagaccagcagcattctgccaaaggttttcggaaacataaatcacaggatcaattagtactaatggatcctgtatttgtctgtcattagtcattatacattgatcagtcattttcagttattgtcatagcttttcgttaatcaaacgaagtaaaagtgaaaatggtcgagcaaattattttagattttaaaactggatgaggaaaaaaattggagaatcaggaattctgggcttaaaaaacgacaaccaggctatagaaaaaaaattcaaaaatgaaaaaagtttcaattattgcattgctggaaagtggtgtctccatgaatttattctaaaattgtatggtatttgttggccggttttatcgaaaaatcataatttaacattttgatacagaattcctgaatttatattattaattaaattatgtaatctttttttttcttatttaaacaatctcatctatggcaatgacctttcatttgttggccatcttttttgctaatcgccctaagtcaaaataaaacccataaaaacaagcagattatttcggattgttttatcttaaaccttatactctgttttttcatccacattaattcaacaaagttcgccattttttggtgccatttccatttcaaaatctgaaagatataaattgatgaaagtgggtgcatggcacggcacggccacaggacgatggcaacttaagcgcctgttcaaataccaatcaaacaaatccatgggttcaactctatcacaatcagctggtcccgtttttttctgaccagatacgcacgataagcgcctcggcttacttagtagaagttgaagcccgagatgaagagcctgaagctcaaagcttttcatgaagctaattaggccataaattctcccaaaatttgcaatttttggtttttttcttttaaaatattccttttcctctaatactcaaaagatttctcgacctcataatctcgactcatagactcat

SEQ ID NO: 15424 - DNA, 1254 bp, Heterodera glycines
tttggggggggggggggggggaggggagaaaatatgtggcggaaggaagattgagagaaagtgtttgggatgggatggaccccccaaaaatggggaggagaaatttttggggggtggcgcctggtggcggaagattgcgaatcggcggatgagcaagcgcaggaataggaggagaggaggaagggatggatgaccttcgccgtgacttttgctcttccatcccttccgctactgctctccactcctcacttcatgccctcaagatggtcatgatcatcattgacaatgaatgtccccttaggcatttctattgaaaatggcaattaactaactaattaattttaattaacggtacaagggtaatttgcaataaattacaacgattaatccaatcattttttggcaaaaactggtgataacaaattaatcaaaattttgcaaaatcataaagtgaagaaaaattattgaaattttgaaaaaattgtctattttttggcaaaaaaacgcgatcgaaaagccataaaacttaatttcgaaagcgatgaaaattatggcatgaaatttggtcagtaccattgattatgactatttgtttaagtgtctaaaagttcatccattgtgacgacaataaaagttttttttattgtttctgtctgtctgtcccacaaaaatttcactttttttttttgtttccactttttaccattttgggggtaatgagtgcgcgaaatgtttttcatcgacggacggacggacaattccatcccaaaatgagtcgtccccgattttattattacaccacatacacacacacaaaaacaatacaatacgccccccgaagaaagcaaaaagagggcgcggtgaaaaggcgcgcaaggccgacgaccgaatgaatgttgacgaccgacgacccctggggggacgacaaattggtggggcggggggggggcgggagaaaatcggaaaataatcccgggaaagccaggcttgtacagcagaggtgcctccgaattttttttaaatttgaggcaaaatttataaaaaaaaaattataataatatttcccagcgtatccgtccgtcccccacctcccgcgtttgtcctcgtgccgcgagaggcgcagctcgcgcgcaacaaaaaatgtcgcgttatttgcgagttgctgatccccagccctcttccaaaaaaaaaaaattctgcgatttaaaaaatgctaccggcgctaaagctcctacttaaatttttaatacaaaa

SEQ ID NO: 15425 - DNA, 3045 bp, Heterodera glycines
  misc_feature (2986)..(2986): n is a, c, g, or t
tttagaaatatgaggagaatgacgttaaattaaattctgccattatttaagaccgtcaaatccttgcaaaaaaaaaatcaacaaaatttttctttgctttgatttctttcaatgaaataaattctttattcttatcaattcttcgatcagcaattatttgaattcatattcgagttgtattaatcctgattgttcgcaagtctagtcatgaaatttttttaaccaagtatttttttttagaaagaaaaatagaagataaatttttttttttgcatgaaaaaaggaaaattatatttcagctcgtattcgaccataatttttttaaatcatttttgcattcttttttcaattaagccagtttggttcatcagtttagttctctttttatttgatgaggtttaaataatagaataattaattcattttaattttttgaattaatactactgataattaattttgcctgttagcaggcattgtcatggatgttccggttaatgattaatataccgttaaaaaactaatagaaaataatgcatctttattattttttattttcttcattaagcctaatttatgaggtacaaaatgttgtttttttttacttccttgcatttttccctctagaaaattgagtaatactcacaaaaacctatctattccattggtttagaacagtttcgaataaaattaggttcattcgaaagcttatactttgggtacccaaccacttgccaaatatttttatcttaaccttaacacattttaaatcacaacaatcgaacccaagattttaaggatttttatattttttgaaattattattattagagctcggataaaaagtcactaaaatcggaaaaaaacgtcaaaaaggcaccaaaacggcaaaatgccaaaaaaggcatttaaggcacgaaaatcacgaaaaaggcaaaaaaaggcataataaaagtcaacgtagaagcctcaaaccaagtggaaaatgcgttttttatgcttaatatatcgaaactagtgcgcagaaaaaaatgcatatgcctcaaaatccgagctctaattattatttataaattaacatgataaaataactttgtattttgttctacttttgtatattataaagctttttccattaaaccgtcttataccaacagcaaatactcagaaaacggatgagcaccaaatgccggagattgctttcccaccaatgaactcagattcaaattttgcatactttcaattatgcattaatacttaagcattattgtgtcttaattatgtgagttttatctacctattctcatgggtaacatgacaacataaccttcggtttcatttcaaaataagaaaaggtcatttaaacttaaatgtacaagcaatctgcttcggcagcactgtcaagaaaatcggaatattggtcaatagaaacacgctaaattaatatactatctttttctctagctaattgagaaaaagcattttcgccttatatttgttttcaacttttacataatgaggaatttcctgcggcgaattatttaatttttttttattacaacttttcgctattcaaaaataaaagtttcaaggcccacaatttttttatagtgcattgtggcttatctttttcgcttagaaaagcttctcgtcaaggtcatccaattcggctgcaaaaaaaaaatcaattaataaagcttcaaaaatattttcaaaaataatcattttatttttaaagaaaaataaataaaaacattaatattgtggagtggactcgaccctcctccttctttccgtttacttcttacaaaaaacttttttgccacacacggcacctttttgataaaggagttcattttcgggactctgtgtaaatggtcattcgtcattgtttagaataaataattttttttaatgagttaaactttgacggaagcaaacggacttagaattagaaaattataaactcagtgttttgaaatgtgttgttagaattccaatgtgaaaagagcggtgaagcattgagaaaaaggcaaactcatagcagaaaggactttggtccatcagtcatgcaagttccttttaaaatgaatgccttaaaacctaagaggtttttgtaatttaagtttttattgaacatttgacaagacaattataacgaagccgtaactgattgttgagcgtaatttatccaaaatggatcaaaacttaaatttgaaattatagaccccatttttattagtgatatacaaagtctcacgaaatcattttgcaattattttttcttgtttacaaaaaaataatttgaattatttaaaaaactattgacaaaaaataattaatttttgatttatttactctaatatatacatttttagccagcacttattcagcaattaaacgccttaaaatccgtgcctataaaaccaatttttttttctcaacatttcataatcatgacattattcacctatcggatataaaataaaagttttgttctggtcattccatgtgattaaaaaaattaacccaatcactgtctgtttgacaccgattctaatattttcagtcaaaatctaatcatttatgatcattattcccatgactttggtcaatcagtcacgttttgatgcttattttttaaaaattaattcaactcaaaagtagctcaatcaaagtttgaggacaaacttaaaggaaaggtggacgtgtaaggcgcaatttatcacatccgttcaatctctttctcacaccatttatccccgcttttccccatctttattccgttccataagtccaactatttaatcgggagcattctctcgataaggagtcagttagttgagcgggcagttaatcggcgagcgagagccgagagcagaacgcggcggaattattattaatgtaattggccaatatttatattattattttactccttctcgcccatccccgcacgcgtattagatctaataggcgcccatgngattacaaatttggggaggtcatttatccagggccccggattttggcttattccttttt

SEQ ID NO: 15426 - DNA, 1238 bp, Heterodera glycines
ccctttgggcatgtgtcgcaccaaagaggttcgctgactgtcccttcggggcatgtgtcgcaccaaatcggttcgctgactggcccttcggggcatatgtcgcaccaaagcggttcgctgactggcccttcggggcatgtgtcgcaccaaagcggttcgctgactggccctttgggcatgtgtcgcacaaagcggttcgctgactggccctttgggcatgtgtcgcactaaagcggttcgctgactggccctttgggcatgtgtcgcaccaaagcggttcgctgactggccctttgggcatgtgtcgcaccaaagaggttcgctgactggcccttcggggcatgtgtcgcaccaaatcggttcgctgactggccctttgggcatgtgtcgaaccaaagcggttcgctgactggcccttcggggcatatgtcgcaccaaagcggttcgctgactggcccttcggggcatgtgtcgcaccaaagcggttcgctgactggcccttcggggcatatgtcgcaccaaagcggttcgctgactggccctttgggaatgtgtcgcacaaagcggttcgctgactggccctttgggcatgtgtcgcactaaagcggttcgctgactggcccttcggggcatgtgccgcaccaaagcggttcgctgactggcccttcggggcatgtgtcgcaccaaagcggtttgctgactggccctttgggcatgtgtcgcaccaacttttggatctgcattcttaatgggatgtgtgagccctggctgatggattccagcacaggatgactacactccatggcgaagaatgatgtctttgatctttatttgtgcattttggttaataaatttttaacttgtgtgcatttattggttaattacctcatatttttgccgcatttgctattccttcctgattttttgtttcagatgccttctaagcaaaaaaaattgcggaaaaaagagcaagagcgttatcagcggcggacggagaaatctgtcagtcgggataactcacccgtctcagacgggagtgcagatgggaatggagaggcatcggcgtctctccggggcaccagcaccccaatcttaagtgctttgcaaataagcacgccggcttcttccattggaagtaaaaaaaggggaagacccttgagagccggagcgaaacccattttggtaacgcaagaaactgtgtctgccattgacacacctccgactgctttcactcaaag

SEQ ID NO: 15427 - DNA, 1403 bp, Heterodera glycines
ctctcatcgtctacgatgttgcacatggtgcatacttccttgactcgctgcatatgagcagcttgagtgatgagagaatggcactcatccagtcaataattgctgagatagtgcccgggaatgcgtcattcgctgttgaatacgtgcagaaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggtcataatgccaatggaagtggatgattcaccagtgcttccttcctcggaagatactgctgttcttgcgcaagcaccagtgatcggcgaaaatcaagctgacacccacggtgttgttgcggacacaattgtccagcaagaaccaatcgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgctgggagtcgcaacgccgatcacacggcgttgctctgcatttcacaaggggtggcaatgcgctgcagcagcagccaaacatttcccggaatattgtgactccgggaaactcggtgacaaaaaatgcgccgattgcggtgcgcatctcttctcacatgaagacagtaccatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggcacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaggcatataagcaggcgcgtgagcagctcactgagcttctccaacaacaaactccggaagagcttcgcttatgtcgcatgactttgtgaatcagcgcagggctccagctg

SEQ ID NO: 15428 - DNA, 2897 bp, Heterodera glycines
acattttcatgaaaaaatattagattttcacaagaaatttctataaattcctaaaatttttgaaaaaattgtgtaattttggatattttttgaggcatttaataaaagcaattccttaaaaatctagtattttaaaacttaacttttggtatatgttttttggaaaaaaaaaaacgattttttaggatacattttcatgaaaaaatattagattttcacgagaaatttctataaattccttaaatttttgaaaaaattgtgtaattttggatattttttgaggcatttaataaaagaattccttaaaaatttagtattttaaaaattaacttttggtatcagttttttggaaaaaaaacgattttttaggatacattttcatcaaaaaatattagattttcacgagaaatttctataaattcctaaaatttttgaaaaaattgtgtaattttggatattttttgaggcatttaataaaagaattccttaaaaatttattattttaaaaattaacttttggtatcagttttttggaaaaaaaaacgattttttaggatacattttcatcaaaaaatattagattttcacgagaaatttctataaattccttaaatttttgaaaaaattgtgtaattttggatattttttgaggcatttaataaaagaattccttaaaaatttagtattttaaaaattaacttttggtatcagttttttggaaaaaaacgattttttaggatacattttcatgaaaaaatattagattttcacaagaaatttctataaattcctaaaatttttgaaaaaaattgtgtaattttggattttttttggcatttaataaaaaattctcaaaaatttcaaaatatgtacgaaaaaatgcgaaaaagtccaaaatgtacatatgtaatatgtataaaaatcccaaaatatgtaaataaaagtcccaatttttgttcgcaagcacaaaaaataaagtgtttttccttctaattaggctatggagaatccaggaaaaaacatgtatttacataaaaaagaagccctgttaattagtttttcacaatataattttaattttctccattctccaaataatcatataaattttcgtgtttcgtgccaaaatacgaaatacgaacaccaaacatatgaaaaccacgaaaatatgaaacacgaattaatatcactggtccccatataaagagcccgtaaaggaagactgggcaggcaaaacgtaaaaatgttttgaataatttatttcttgcccaaattacaaataatttataagtgacaatgatttagttgagggcatcctcgacatttgaggaaataacttttgaggacccgacattgaatatacaaaatcaaaaataaattaaaatttattttcaatcattagaaaaaaagaaaatccctttctcaaggaccaacgggagcgaatataagctattggtccagagttttaacaatcattgcgcaagatgcgatattgcaaaggtctgagaagtgtaacaattcatcttcttggttctcaatcgcattaaagcctttatccaaattcaaactctttgtcgctgtatatttttcggtaccataaaaatgatataaaaagtggaaaaattttacggctatcaccaaattcgttaaatgaccgttaactacctcattatggacgtggtaaaaacggagtcattaccgtggttaaatgacaccaatttatagttatttatttaaccatatattttcgtagagatctgcttggggaaaattcaaattttggaaagttgttgccattttctccaatcggcaacaaatttgatgattcgaaacaggccttttaccttatactccaagaataatttgctattttttaataccagccaatttattaggttgaaacgcattatacagtaatggcattcaatctatattatccaaattgtggaccgtttgaatgtccgtcaggctagcaaaatcgttgatatgtcatttgagtttttaaataagaaacacgagaacgagacgtccaaaaaggcgaaaatacgagaaatgaaacatcgaagaatgaggaatatcccagctgatggacaaacctccatatcagggatggcattccttggcctcaaaaattttcggaaatcggaattccgtgcaaaatccactatcagcacaattaaaattgaaaaagttcttttctcaaaaattgtagaagatgatatattcacattttgaccatatgtccgcacccgtcgttctccaatttgtgggcccgtggtgaccgcaattgcgccaaccatttgcgtgccaacatggccactgttgtggcactgactgaactcgccaccggctgtggccccatgcgcaattgggagtttgtaggtgcgcgtaccgtttgagtctttttaacacatttttaactttgggtttaattaacccatgtttaatttgtaccagggggagacgaacatttcaattaaatattgttatgacctgacggcataatcaacgtccgatcattctgattggttttcgcttggcacccgcgtgctttacctttgtgagtgatcaaactgggaagtcgccgaaaaatggcttttggtgtgttttaaaaactctaagtatttgcttctcgcattttatgtccggattattttgcggttttaaggttaaattttttgtaaatattaaaattagggttgagcggtaccggtaccggtaccgaccggtaattaccggtttttttggtaccggtaccggtaccggttttttcaaaaatcaaagtatcggtaccggtttgtctagtaccggtaccgccggtaaaaatttgcactggtaagaatgggggtctgggtgagagaagagtagggaatggtgaagaaggagaaattttgaga

SEQ ID NO: 15429 - DNA, 1309 bp, Heterodera glycines
  misc_feature (49)..(49): n is a, c, g, or t
aatgatagcgccacccttaatttttcggaatttctttctgggcgagttngattgtgaaaatttggaaaaaacgcctatctctttttctgctcaacactctagacaatcccaaccccatttacggaatgatagcgccaaccctaatttttccggaatttctttctgggcgagtttgattgtgaaaattttggaaaaacgcctatctctttttctgctcaacactctagacaattccaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagaccaatccaaccccatttacgggatgatagcgccaaccctaatttttccggaatttctttctgg

SEQ ID NO: 15430 - DNA, 2033 bp, Heterodera glycines
acgcactcaaaggggccaaccgcagatggcacaatttgcaattgatgcgcaatcggaataaaaaaaatgcggcacagaaaaacactcactcatcaccagcagcgaattaagtgaatgccattgacaattcctgctaatgctgaagtgcaaacggagaaagtacgaccggcactaatcagcagaacgaaatgctaaacgatgaataattagcggacaaattgtgaaatcgatcagcggcacatcaaaagaaaccatccgactctattaaagcgaagcagattggggggaccaaatttcaatagtcaatttataataaaacagacatatttaaataaacgattggcaagaatcagcccctaatgggcctcggtccctcggccccgccgtttctcccaaaccaatgctctcccgactgagctaccgtgtcgcattggccttcattcactaatggtttttcaacgctcgtctttcgccgttttctccgtctgtcggcttcctttgatcatttaaaattcgttcttcgctgtccgtccgtttgatctctcaaacttcgaattccctcccaattttcaattgcttcacaggttattggcatttctctttttctgccgttttggtgataaaaattggccaggacagcacacgcaccgcctccaccgcccaccggtggcatcgccaattcccccgagggcaatttcattgcttttgggccatccccgcagggcaaatggaaaatgtttttttttggcgttttcctgctgaagttcatccatttttatttgagtgatgagacatcgaaattcccacttctccatttttgtattcatttttaaaataaatcatattttagctcagaaattgaaataaattttaaattttcattaattaaccaaaaacttcgatcgaatgatggaacaaatttcatcggaggaaaggtgtcagttttaaatgcaaattttgtattcttttttggatttgtttgaaatatttttttatgattttacatattgaaaggaagtgtccaatttcctccattccgccaattcaaattggcctttttgattttgataattaattcttaatgtgtgtcttttttttaatttggtgtctccattagcacaaattaaccgtgaataataaacaaaaagctttgattaggcggtcttttttttgtttgttttgatatcaatgaatatgatgtgacagacattaattggttatgcagtttcggagagtgcacttcgtccgccgaccctccctttgccgtggctgtcgaagaggcggacgagggcggcatttccattgaagtgccgacgcttcagggcaatgcctcgggcgatgtccacgggacgagcggctgttgccggcacattttcgtcgatgttcgtttaataattccctttttccaatttttctaatcgcttaaattcatttgttcaaaccaaatattttaatcccttcatttccactaattacccttccccttaatcagcttttgatcaatatgcgctgctccgatcgctccatttgggttctgagtgttctgctcggagttctggtgctcggctcacagacggcgcccattttcctactgaattgggttctgatcagagagccgcgtccgttgaatatcactcggcttggcggccccgtggccggcgttgacgaccagggaccactggtaagagagggaaaggaaaagcttaatttaaacaaactcttaacacaattgaaataatgaaattccggatgattttttcctttttttgccttaggaaattccgttcgaatacaatgccggatactttggcatgtgccggcaacgattgccattgaacctgagcagcgccgaagaggcaattgcggcacaagtcgaccaattggtgcccattttggcaccggacatgtgagaaaggcgaagcgggaaatactaattaaaatcacaaattattaaaattatcgaattcatttcaggtgcgtttggaactccatttacaccgggggagaagaaatcggagaatttaggtgagcga

SEQ ID NO: 15431 - DNA, 901 bp, Heterodera glycines
  misc_feature (894)..(894): n is a, c, g, or t
agaggagtgggccctttcccaaatgtctcaaattaatgaggagaaattagtggtttttaccaaacgaccgaacatcaaaaaataaatatttggtatgttttggcgaatgtgccgcttctgattcgtcgttctttcagaggttcctacactgatgtaatcgatcaacagagaggaaacggcaaatcagcgagcaacagcagtcatcgacgaggggaaaaggacaaaaaccgatgtcgggtgattatttgggtgccccatgttgtagtgcactttcatttgtttctcgctttttgtcccccaatgttttccattttgtcaagtcgtcggccgatggtggtggacgcggtcaatttggtgtacgtcaatccggagcagcatcaacttggctatgtccgttccttattcaattccgaggagcgccacgatttttcgcccattttggtggtcgctcattgcaccctgacgtctgaattcattcactgctttaccccccccccccccctccccgactgtccccgtttactcccgccacgctcccgactgatcaatcctttccatgcccctccctaatccatcataattattttgcgattgcggcggcttcgcattatcgtgtaaattaaccgcttgcaaatcgcataaatgttttggccttttgtctttgggggtaattatatgtgtttgaagtggatgattttatgatagtgcggttgtcgtgctaattaaatgagtcaatccaaagatggaattcccaattcagtctaatattattgtcaaattattcgctttccgcagtttgatcagactttttactaataaacttaattcgattaggctaaaaatgcgtcatcagccgattatgtatttcattttcttaaatattattactctcgngttttga

SEQ ID NO: 15432 - DNA, 2067 bp, Heterodera glycines
atatactcaattgtttttggcttttcctaagtgacatccccccccgggattaacaattttagcaacaaaatttgcatacgaactaggcggcaaaacaatcggagaaaagtgttgtcggccaaaatccaaaccgatgggagcagcagcaaagcaatgacgtggaagacctcctgagaagcattggcattccgtcgagggcgacgagcggcaaagagcagcaaaaagacgggagcagagaagaagctgctgcaaaagcggaccatcgcttagggaagggacagacgacggcactttcgacggaaggcgactccgtcgcggcaacggaaggccaaagcaaagcgaaacaaagcggcgccgggaaaaaagtgacgatgaaggccaaacaattgaccaatgaaaagccaatgccttaatttattagttggatttgtttcttaccaaaatgggccgcctccgaagtacaaaatgtccccccgcctcggctccgtcttcttttcattctgctgccatgccgtcttcgtcctcatccgccgttccccacctccacgactgtgccattcccaccgcttatcaactcctttcccctcggcacttcccaaagacttcggcgcctccaactgaccatttgcggatgactcatcctttcgcctcctcttttccttcgttggcttcatctttatttgtatcagcagcctttttgttattttgatttaaaatttgtggtaattcctcagaaatgcgacaattctccgatgggaattcgacagcagcaaattcagaggcatcaacaaaaaagtgaagaagtggacgaagaagtgatcaccgtggacgaagaggacactgtcgatgcggaggagcagcaacagcaggtgtcttaaacgatgactaattgaccaattaaaccgaacattaaagagcactttattaccctagttaggaaggcattatctcaaaagtgataaggtaattccgctcgtttgacaggttcacccatttcggcacaattcggccgcacactccgccgctggtccttcggtggcttccgttgcccaagtgagcgcgtggcttggcctggtggccggggaaatgcgtctgcgactccaatgtgacggcaaaaagtgggtcaaattggccaacaaacagtgaagcgctcgctgttcccctcttcagcggttcgatggtcctttcgcccaatttctcgggaagggccgtccatcggttgcaattcgtcccgggcaacgacagggaattgaccatccgacagttcgctggtgaccagctttaccaggaaaagaggtggcattggcacgggctgtccatcacggaatggacagctaattgccgtccctttcccttccaacgcattcattccgttcagatggacttggcacgatcaccaggaggagcagactttgcacgccatccgcggcatttgcttccatttcttcttctgtcgttaattacaaaattaccaaatgaagcctttttatccaccttttgtttatttgtttgtttgttgtaaattttggtgtttacttttaaatcagccaaattaacacttccttatttttggactcgtctattggcctgccagggacggtcccaagggggggggggggtacgcggggtacgtacccgccagagtttttgggagcggctttgggaggctaccagacgtgtttgataagtcgcgcgagaaacaagtgatgtgcttctgaaagttgtctcagacagagttggtccgcttcgcgaatctggattacatggcgactgcagtactaatgatggtgctttgtccggcaacatttgagatatatgattcaagatttatggaatgttgacagcagccgggaaaaaaaaccaaaattctgtccattttattgaatgattttgccccaatatttttttatgcaaatatccgagcactaccaattggcccatatatgtacgaatacacaatcttcctctaagtaacatccgaaactctggaatgagatgtagggccgatgtatgagcgcacaaaagcgcgaggcctggcactgccgggcacgtgattatttattattg

SEQ ID NO: 15433 - DNA, 999 bp, Heterodera glycines
gcccctccgcacccgaaatttttaaggaaaaatagtctttttgctgaaaattttgggtttttattgctggtacccccgcccagacctaacctcggccaagtttttcaaaaaatttcgcaaatttttcaaaaaagccaattttttgatgaaaatctgctaaaaatggctcaaaatcgcaaaatttgtcattttttggacaaaattcgttaacaaaacgcattataaaatgcaaaaattttcccggcggctcctatcggcaccgccggacccccctattccccaaatatgttttttggaaaaaccgccgcaaaaaaaagtggtgtgaaaagcaaaaaaaaaatgtcgtcgcccgggggaggtaccccttcccaagctgaaatcctgggaccgtccctgtggcctgcctcatttaaaataagcattattctgtctgtggtaattaattaaaaccaggaccaattacaaagaacattggatattcgagagttcgtcaaggctttgtgtttttgttttcatcatgcgaatgcgtcgtctttcagatccaattttttcaagggcgcttatcaacagcacccgtgatccccaaaacactcctttcttaaacaccccttaaactccaaaacccccaagtttctttgattgaagtaaaagttgtttttcttttttcgggatcggatttattagattattgccaaaaaatttataaaatattaaataaaaatttaaaaactgtgagtgattgtgataatgcaaaaaggaaaagcttcataaactaatttgagaaagttagttcggaaatcccacgagagttgggtacttttctttgttagtagggaggggagagacgacggaactttcgatgaaagacgacgccctcaattcatttaataatgtttattaattaattattaattaaatgcaatttaaagcaatgaagggggcttttcattgtccaaaaaggttagccgacatttgcggaccgaccatttgtgagtgact

SEQ ID NO: 15434 - DNA, 1091 bp, Heterodera glycines
taaagagaatacagtaccccgggggaggagacgacctttttgcgggttctgtagtggtggaccaatttggtcacagtgcgcggagtcagccccaatttgagtgccaattgttcaatgcaacgcgaattcggccgttgttcatgagcaaaaatgaacagaagcgcctccttctgcttgtccgtgatgatggtgcgctggaagcgcttaattcggctgattttagccaaagttggcgcttcctttgctattaccgggatttttttgggcggcggaaccaaagggcaaatttgagcggcgggtgtaccgtcgcttttttccagtgaaaccatcgacagcgaaggggcaacggcatcgcccgcggggcaatgcccggccttacgcttcagggcaccggtcgaaaagacattctgaagttgagccatttcaacaatggcatgtgatcagaaacggaccattggtccggcggagtttggcgtcgccggagagtttggcgaattggtctttttcaaaagggcaccgattggcgtgtgggagccgagttcgccagatgccaacccggcgatcagttgcagtgccgaagtggtcgcgttgggttgggagggaaatgccggcggcggagaagcggcggaagagcagggagaggtggagatgggcagcccaacggcgagtgcctccagcgcatttaaatggccgttgctctgttgcgtttggtgtcccccgaggggcaaagggtcggccgagtcgccaatcgctttgagtgcattcagcgcgttgttcaccgcgcaccgctgctgctcgtccgcctttagccgtcccacagagtcgggagcgtcgagaaaggcgatcattttgctgtacgactcgcgtcctgcgaaaagcacggcgcgttaaggaaaagcatagcatggccagaagaacaaacccttgtaggaaagcataacccacggcttcggcttcgtcagcaaatcggacacacaacccgaggtcatcttcagaatgtgttcgccgaaagcctgggaaaggaacaatattcaagagggaagttcaagagagactcaatcgtaataaaagatccgtaaaaatcaaataat

SEQ ID NO: 15435 - DNA, 1457 bp, Heterodera glycines
ccgagactttagggaattgtacttacattagaattcctttgcggataaaaccgggacttaatcttttcgggaatttgctagcaaaaataaaatggaaaactgagaaaatggatttgtgacttttgttccccatttgtccacagtttccgccagttaatcgaccagcgcattgacgagttggccgagttgcgcaagcggttgaagcagctgaaagcggtggacctgcagcacgacaaggaggcacgcgacgcactgcaacagcacaaggaccagcagaaggcggaggaggaggttaatgaccgtttaagggcaattttttataggaaggagagagagggtttttcgacatagactgggtctgatggggtcaaaaattgctgcaaaatgcaataaaaaacaataattgacacgtacaaatctttgtttcccattttcataattcggttctctgttatcggagcagggcaaaacgacatcggacgaattttggaccataactttttttttcgactaaattaaacattttggatatttttcgaaagcgcttgacaaattctattactcgtaaaagttaaaaaatttagttaatttagggccaaaatatcaacaaaaaaaaaaactgatttttgtagagtaaaataacaccaagaatatttacaataatttgtttaacaacgaaaataagaattgtttaaaaaatcgtccggcaactttttggtgctccccgctccatcgtacaattcaaaaccatgcacacttgtcaatttacagcttgtggacaaggacgagcagaaggcgcgcgcggctgtccaacgcgagttggcgctgctgcgccgtgcagtcgcccaactgaacgagggccgtcgcatcaaggacattggcgatctgcgcgagcgcatgctggacgctcagcgtccgttgccgtggcgagcgatggccgacgcgcgcgaagtgcacgagttccgctcggtgcaacaaaacttctactcggacaggaaggaggagctgctgcgcgagatgtaccagctgcagggtgaataattaaattgggagcaggtcgcccccccccccctccccccgatttttttttaatttccaaacagaaattttccaaaaaaaaattcttaaataatttcttactgttactaagaaaagtgcaagaaaaaaaaatttcagcgatttttttgttgagctactaagttttttcaaaaaattccaaaaaatcgctgaaaatttttaccgggggggaggacggcgggggatgaagtacaccttttgcttgaaatagtcaatctcccctattttagctagtaatgctttcgattaaaaatgggaattttcaggcaaaatgggcatgtttctgctgggccgtgaccgtgcgttccgttcctattactacatgaacaccgccttcatcattctgtgcccgcgccgtgatgagctcgccgatggatact

SEQ ID NO: 15436 - DNA, 930 bp, Heterodera glycines
ctgatggcatgcaccggcgatggcatggagcagtgcccggtgcacaacccgcccgcgagatggccacgcctgttggtctacgtggaacgggacggagtgcgcaaggtgggagaagtggaagagggctgtctaactatctgattgaatctttaaatcacaaaaaattagtattttcaaaatttgaaattttaggaaaattttttaactgccccacaattataacgtatagcggaagggggtgacgatcaaagaagttttcagagcttgagatcttgaaaaagcgatgacctagacctgactttgctaaaccctgggctgatttttggtcaaaaaatcacgcttgtcaaggcctggccctgatttttttcattatttcaaataaagaattaaaaaatctgttatttgcttaggaacgtctcaacatcttttgcattttagcttctggacgcattgaacccgcgcggttttcgcgagtcggaattggccgaaagcatttcactgtaccgcgatttttacagggtaattttccgtaaaaataccgttactaaaatttccatttttctcttttgcctcccctttcagcaggaaatggtctcactgtttgactcgacagacacactggaaatgaattggggcgcccatttgttcggttttggccacgggaagcccaaggagttgagggagacggagccaaccgagttggacctattcgtcgaagtgcgtcgccggttgctggacttggagaagctggtaggttttgtccttgtctgtcagtcatctgaggcaataagaccaattgttgtcctggttactccgagtgccaaaattgttgccgtaattatggcaccatgccgcaggaatttgctgtttctgaatcatttcttttaggatcattttttgggtcctttgaaagggctaaaatcccagttt

SEQ ID NO: 15437 - DNA, 716 bp, Heterodera glycines
tgatgatgaaaatgatggggtttcggagcatcagcatttcctatggtgctcagcaattggatatcatcatagttgatgttgtcagttgattgttgttggctctgtaaatataaatcatcataactatctgtcgaccaggacccataaaccagggatttttgtccaaaaaaaatacacaggtccagacacccaggtccaacatgaaatcataggtccaggggcttttttttcttcaaatgggcaaggtttttcaattttcaacatttctaagaaaccacacggtgtcagggcaactcgtacaatttttaatgtgtttagtcataacttttttttaaaatcaaccaaattcttcaaacttgatatctgcttttgtggatttttaatgttcttaaggggtgtctcgagacaaccccccccctcgtcgtaagaggcctcggacaccccccccccccttcgttcgtaaggggggcggctgtaaaagagggagggggtcgtcgtgtagggagggcgtaacgaaggggggtatttaaaacttgcacacaatttccttagcaaaatctatacaaaattttaaaattttcccggcggcgcctatcggcgccgctgaaccccctgtcccccctaaaagatttttaaaaccacgccgcaaaagaatgtacttggaatatgacatatcgacaaaagaaaggtcgtctgcggagaaaagattccgtccg

SEQ ID NO: 15438 - DNA, 1978 bp, Heterodera glycines
  misc_feature (87)..(87): n is a, c, g, or t
  misc_feature (100)..(100): n is a, c, g, or t
atttggatatgctaatagataactcctagggctaccgaatgctgttaaattaattcaattaggacaaatatgagaagagttatgctncaaaaagcgggcnttggcgccccaggtgggggtttggttggcgcccagtcgtaccgatccggatagaccatactatccttctaatccaattcatccatgcataataaatgccattgacggtgcttaactatgggaaaaattttttgctggtttcataaaggttttttttttactttaagtgggtctgtctggcgcagatgggcgccagggatttgtcagaatgccgattcccaatattttagacttagaattccgatttacgactgcctaattttttgtgctgtcgaaattccaaaagccaaaaatttgggctgtcggaatgtcgatttccgaaatgttttagagggcgtcggcacacacccctgggtggggggacctcctaaattctgataggagaatttgtgcaaatcccaatgaatccgaccaccattatgccaagaatacgactatcagtgccgccattttaatgccttactctgttcgtttcggacgtttcgctcattgataatttttcgccaaaagttaagccgatttttttgcacaagcgtgaagacatcgtttcagggaacaggcacaccttaaaaatttattttaacaaaatttccatttattttcccctgttttgttttacctctccttttgtggacgttatggcacgaaaaggcattcggcatctacaaagaaaaaagtaaattaattaccccccccctaattatggcaattaattgcctttgtcgtggactgtgccgtgaaatgctgcgaatgtaaaagtccaaataagtggttttgtattccacaaaatttattcgctgtttgctgcgcttaaatttttcaaatttaaacaaattcgaattaaacattttaaatcgatggtttatacacctaacctaatttttattaaacaattaaaaaactaaatttaagtttttaaattaattaaatggtaaactcattaacccattatttatttttataaattgatcaatatcaatttaaacaaaaatattatcttgaaattatttaataaattatgaaaattttaatttgaatggaaattaaacaaaaacataattcgctaattgaataataattttaaatcttattaaaataactattaaattgcatttaattatttagtaaattatgattaaaaatcaaaataaatggaataattaattaaaaaaggaaaataaataaacaatatcagttaatgacattttaaatcaaattaaattctgattaaaataattaattaattagcagcagcccaatgtttaccggatattccatgttgttaagccctttaagaagcaccaaaatatgctcgtccacttgcgctgtccgataaatgtattttcggatagccctaatttggttgccctaattaagaaaaaaaaaatttaaaaatttaatttttttttttttattatttttacaaggggttcctccttgtcatgacaaatgtcggccaatttaattttcctcaaattgtagtaatccgtgtcaatttcttctgcttgatgttcgcctaaattaagggtggaaaagaaattagaaatttaacccaatttaaaaaaaaatgaaattaattattacaattttgaaaatacccaaaaattttgatggattaactcttcttttcactcggagttttatttgaaaaattgagaaattcttttaaaatatttaacaaatgcaaagtgaaattttttgaaaaaatgatgtttttttcaaaaaaaaaatagaatttttaaatattttttaacggaatattaagaaaaaattgttgaaaaaatcaaaaattaaaaaatctttttttttcgagaattttaagttttaggcggaaggagcaaaagctacacgcaaacagattacgtcttttggcacaaat

SEQ ID NO: 15439 - DNA, 2586 bp, Heterodera glycines
aataaaaaactcagttagtttcggttccaggaaatcactaaattttttatcctaaaaaatacaaaaacaagcaaaactgatcattccaacaaaagcatttttatgagcaagtcaaaaaatcattttacaattcataattatcgatcgatcgatcatttcttaacaattcaatcattcacttctactgctgatcacttgggccgggagttgcgtagagaagcctaaaaatagaaaagcaatcaatttgaatttttgaataattattcgctgtccccaatttgacgctcactattaatttgaatgtcaattctgttccgttggtcataaatttcccatccaatcgcttcctcttcccattttgtccatttgctttcgtctcgcgcaattggacaacggatcagcagcaaacgatggttaatccttttgaatgccaattgttcacgagtgaattcgttggtcagaacgaatggcacaacggagtcaacaaaagggggaagaaacgaaaagacaatgatgaaattggaaggagatgaagccgaggcaaaagcctaaaatacgtgaaaattgtgctctattgcagttcacacaaaacaaaaatttttcgcaactttagtgcaccataacttttttaagaagcatccaaattaaacattcttatcacatccggcatccatttcggccaattccgaaacctgggtccaattcaaacaaaaaatcgaaattccaaatttcgcatttttggttcaaaatcggtttaaacatacgaaaacaaactgaaaacaaccaattctgcaataaaatatctttaatccgttagactaaaaatgcgaaattctaaaatttaaagtttccactttttgttcgaattcgggtccgggtttcggaattcgccgaaatggatgcaggattcgtgatcagttacctcgaaaagccaaggaaacttgttttttttggcaaaaagattgaaaatcttggtatcattcggaagatttgatgtgaagaagctttttctatgcaaaatgctaaccgaattgatgagttataaaaaagatatgggcgttagaaaattttgttttttgaataaattttcaataggttttcttgcttctcacgaaggttgtttaatccagcaaagatttattacaaattgttgagttgaatataaatggactttctattatgcagggttctcattcgtccttgaatggcaaggacgtccttgaaattgggccctctttcttgaaccgggaatttcccaagaaaaatttttttgaaaaaaaacttgaaaatttgagtgcactttgttatgaaaaattgcctattttctaaaatgtacccataaaaatttttaaattttcgtttgggaggagtaaatcgaaaaatttttccattattcgatggaaaacgtttaaaaattttaatttctggggcggggttgatattggaattttctgattcccaaaattctggattttttaataaattaaaatttcttaaattttttgcttttaatcgctgtttttgtggcgctgttttccaaaaaacttttggtaacattggtgagggggcggcagggtccggcggtgccgataggcgccgctggaaaaatttttaaattttgagtgaaatatgttaacagaatttgtcaaaaaatgaccaatatttggttaatttgtgattttttagcctgtttaaaaattaaataaaaataaacttggaatatttttttattaattaaaatttcattacataaaaattataaaggaaataagaaaaatatgctgtcttagtggggaattgaaccaaagcgaaaaatcatgaaaagcagaaggtgtagccactagaccacataacgatgtaaacaaaagcaataaacaaataaataatttaatttttttctcaaaaatttctccttctcaccaattcccttctcttttctcacccagacccccattcttaccagtgcttatttagtcccgccgggaccgggactggcaaaaccgggaccgggatttctgtttttcgaaaaaccgggatcgggacgggacctgaaaaaaccgggaattcccgtcccggtcccgaccaactctacttttttgttaggtattttgatcggcacgtaacttgaagatgaacagttttggcatttgtaagaattggggtttcagggtacaaagatgtcggaacccgtcagttgggccctcacgattgggcccacacgtttgggccccagcatgtttttccacgatagctgttttctttggcatccaaatcgaacattcttggtatcattcgaaagctcttaacatgctctattagccttaccaaaagcgaaaagattttcaagcctggaaaaaattttattaaaaaaacttcaaaaatttcaactttttgcaattttcatgtataacttttttggtaattgtctaatcgcgaagcaataccttagaaaaagcttctaaacatgttaagctttcgaataccaagtttattggatttgggtgacagaaaaaagttatagtggaaaaatatgctggggcccaaaggaggccagggatgttgcaaattgaagaataaaagaatcag

SEQ ID NO: 15440 - DNA, 568 bp, Heterodera glycines
gctggtgggttaagtcccggcgattgaaatgccggagaattgagtcccggcgattgggatgtagaggaattgctgagatagagttccgatgagtgtatgtgtatgccggagatccagtgatgaaatgccgagggttggcacaaccgtactaccgctagttgtttaaagaatggatattttttagatcagggttaccatcgtccatgctccgtttccaaggacgggtatgccgatttgcaagaacatagtggggaaaattcatgaaaaccaaggacatttaaatttttattatatgtatgaaagaaaaatggttaataatttactcaaaggcttgcatttttcaccggaatggatttttttctacatttttttgatttcactgatttttcctcatttcaccgcatatgctgtggcgcgctttgttccaaaaaatttccggggaacagggaggggggggggggggggtcaggcagtgtttgttagcagattttgtctaaaaatgaccaaattttgagattttgggcaattaaatttgcattttatttacataatgcataatttaatccaa

SEQ ID NO: 15441 - DNA, 1429 bp, Heterodera glycines
agatttagtaccaaaagatatttttttaatggtcttctgttttaaaatttgaaacccaaatccagggttaaacggctcacttttttgtgtgcattatttgggtattattttgagtggaaaatttaaaaaaaaggataacaaaaatgatttcctgggactcattttgccgtggcaaacttttccttccctctcccatttccgcgctcatctaatggtcggtgtctcaattaggaattagggggggggggcgggggcggggaatgaatcttcatccatccccccaggggcatggcgcgccactgccggcggatgccgcctttggcagttctgtgtctgtgcctatggcgtgtgccgtgccatatccgtcctccagtcgtcgttgctgctgttggatttatttggcacggaattgtcgctgtgccgggccgatggggtgggagggcatttggcccgaggcacaatgccatgccactgaaattgacacttccgcactacgccgagggggcggcagagggaaatgaatgaatggttaatgagttcaaatcccatcccatcttcatcatttttgcccccgccggcggagggcggctaaaaacaaaaacttttaatggacaaaaaatttgccattggcatgaaaaattaaaagcaaaaaaaaaaattggcattttataatattatgtgttcatcatcatataccatatcaattagggattgaattttagggaaatgcctaaaaacttttgcgtatttaaaactttgagcatttttatgccttttttggtgcctattttacgatttttttttttgcctaaaagtgcaatcccaaatcaacttcatttatctacatattattttggttggaatcttctcttttttgaaattgcacattaattaatatgcgtatcaaattgcatttgtttgccccgggcggacaaaaaaaaaagagtccgccgttctctttccgatgagttcttgtgccgtatgcaaatggcatttgttgggttttgaaaaaaaaaaattaaatgatccttttatgtctaacacaaataattttttaaatttaatatattctctcctttcctctgaaatttacgaaaaaaattacgaaattgcgaaacgcgaaagcgaaattttttctacaacttttttaatagtcaaaatcataaagcaaaaatcatttttttttgtaaaattctattccaaattttaaaaatcaataaaaagcttttttgaggcgcgctttttccaaaaaactttttgggaagagggagcaggcggtgccggtaggcgccgccgggaaaattcttaaaatttgaataaagtttgttgacagattttcactaaaaactgataaaattttgcgatttttgcatcttttctaaggaaaaataggagttttgggggcgcggcggtgccgataggcgccgct

SEQ ID NO: 15442 - DNA, 2266 bp, Heterodera glycines
  misc_feature (14)..(14): n is a, c, g, or t
  misc_feature (27)..(27): n is a, c, g, or t
  misc_feature (62)..(62): n is a, c, g, or t
  misc_feature (64)..(64): n is a, c, g, or t
  misc_feature (70)..(70): n is a, c, g, or t
  misc_feature (75)..(76): n is a, c, g, or t
tttataggtaaaanttttgaaaaattnttagggggaattttcgtttcaatgtcttagggggngnaaaagncgcgnngcgcgcccccttcgaaatgcgaaagcgaaagcccatccctggtgtggggttaccataactttttggtctgcgaggagcttgttcctgtattatttggaacccgcaaattctgggaaataacaccaggaacttttatacaaaaaaacgaacaacaaatattcaggaaaaaaaaaatttgcatttcaagaaaaatctcttcaacacgttgaaaacccacaaaaaatgaattattgtaaaattagttaatgcaaagtctaaattataattgttttggcacaacaaagtgcgttgtggcaaattgctgaatgaaaaactgcaagctttaagtgaatttttgcattttccaaggcaattgagaagggggggggagacgggagctctttttttgccgaaattcccacggattaaacacgccaaaattggtggaaaatgccgagaacggacagatggaaattggcaccatcagttctcccaattcacagtgcaaggatggcaacactttttgtgaagcagcattgatttatttgctgctttccgggcccggggtggacactttgggcgttggaggggaggggggaatttggcatcatcaaaaagagtgccaccccccttggcggggggggggggcttaaaatttcattttttcccatccattcaaaagatgagggggggggggggggggggagatacaaatccctgaaaaaatttttgccaaaaaataattgcatttttattagtgttttttgagagtaatctgttttctctgtttgacaacaggggtccaatttttttgttgagttttcctattttccgggactcctaggggccagaaaaatacgaaaaactttcttttaaataggtcattaagttcttttttgaatttttacggcaaatttttcgaatttatatgggaaacatttttcttaattgtgtgaaaatattgtacatttccctcgtcctcctccttttaaatgatgatgattttttaacgaaatgccaatgtgccaacattttgtgccgacaaaattggcacaatttggagaaaaagtgtgggtgtgcaaatggtggaaaaagcggcgggccggcgcgacggcaaaacggcgcgggacaattgccataatttggggttggcagcgaaatttttgccatcgccatttgaacgaacgaacgatggatgaaagaattaacataattaatctaccaatttgagagattagtttttcaaaaacggattggtaaaaattggaaaaaagtttacacgaaaacgggtgtcggacgcgattatcggcatttcccctttcgcgtaaaaagccaaaaacggcaaaatgtgcaaaaaagaatcgccaattttaattaggattttggaaaaaaggaggtttccctccatgaattaaagttatttgaaaaatggactaatattatacgaacatttaaatttgttttttattatttattttttaatcaaatttcccttaattgggtgggaataaaaataattaacagaaaataattgatgctcaatgatcgatcaaacacttcttgccacactcaatcagtttcagacgtttagtttacgttcggcagcggctaaaaacgaaaaaaattataaaactttgcttaattaaaaatttaaattttcagttttaggcattctttttttccatttattttttgccctattttaaattaaaattttaaataaataatttttatgaattttttcctacatttttttgcctgcccaatctcgcggaatcctctcgcgaacggattgaggtcgattttcttgtcgcagacctgcaagtcaaagtcaaacaattatttttctcaaatccatggagtaattttcctcttaattaaaattgtgatgaattttctcgcgctccctcagagagtcggattttcttcgtcttttaattttaaaattagttgggctgttcgagagtcgaaattctccaagactcgagaaccaagaccaataattgacctcgagacagagaccccaaaaagttcccgaaatttctcgattcgagaaacccgagcagccatataaatcacccctgtctttctcggattggggggggtggtttagaaaaaacccgccacaaagggggtgttagtcaaaaaaccgccaaatgagaccctttattttttctcatgtcttttactgattattttgtataaaattat

SEQ ID NO: 15443 - DNA, 1251 bp, Heterodera glycines
  misc_feature (1240)..(1240): n is a, c, g, or t
acatcaactcaatttgcttgtttaatggcgtcttcttatgtgttctgcgcaatactttggcctcgactcaaatgctttgcgactgtatgattcagggcgtttcgtatgtgggcgaattttcttacttttccgtggacccgatagaaagaccgaaaaaaaaggtgtgtcgaatggtattatgtacggtcgattatagtccgatgttatattgacctctcccatttttgacaaaaatattttttgttcatggtaaataagccctttttccaacaaaataagcttttgaactttttagcgaaaaaattgagctaacatttgtattttgaccgggctaaatcgggcttaaattttgccagtgaaactgtcaaaaattggaaaaatttaaaattattttggcaaaatgtctttttcaaagtgtgaagttagaactgaaggaatttttgaaaatttgtacagtttcaacagattaaaatttttcacggcgatgactaacggtaaaatttgatccaaattagtaattttttgttaaaatctcttaaaatgggtaaaatacagaaaattcaaaattttatcgcccatcactaaaaatcattattcttttaaaaattgaataaattggaaaatttgaaaaaagtcgatttacatcactttacctaattataagctaaaataaaagactaccaatttttatgttattgatcaaaattcaacaaatttttaaaaatgtccgggcccgccagggcgccctacagtacggtctctggtccgagtattgcctgcacgaaaaaaagcttggctaatttttaaccattcgggtcaagccggttattacattttataaaaaataatttaataaattttagccaaacttgtctggtttttacaaagaagaaattaaaacagctgctatgcgagaattatgcaatttgctgcacatttcatcaatggagccaatgatggaaaaactaaaaaaagtgagggcattttaatttggaaatgcttgctcagagatgtgccgtatagtgactaccgttgccattaagtagaattttttttctaaaagagaccccaaaaatctatttaaaaacaacataaacagaaattcaataaacccatttaattttgtaaaatttatttgcagtatttttctgacgtttacattcccatcgactcttaccacttcctatacagctacgcgtgcggcccatttaatattcggaactgtttagtgtgctgctanatattcaaaag

SEQ ID NO: 15444 - DNA, 1392 bp, Heterodera glycines
tgagatattcgcgaacttaggattatgaattatacaaacataaaattctgcaatttaaacaaggaattccaaaattttaaaacacatgtaattaaaaaacagtctttactaaaacggaaaagaatcatttaaaattttacgccaaattgccagctcccacccttcctattaaaaagtgcgattgcgacggctgtacgctgcaactccgtttcccaatgtctctcgatgataaatggaaggatgaagaagaacaaatacattttgataagaatgctctcttcattatcctccgcgagaatgacattgagtaaatgacgtcaaaagaagcgaaatttaattttggattatttagggaaaattgccgaccgccttttgtccaaacaagcgatcaatgaatgaatcaattggtaatgaataggaatcatatttttaggtttttacctaaaacatgtttttcggttattgtaaagctagttttcgagtttttagactattttttaggtttttattttgaaaaaaatttccataatatttttgctttttgaagaaaaatttcaattttacaaccctaaattcggaaatgtttggcgcttattttctcatttttactaccttttttgggggttttagaacctaaaaactaactattttggcagtttttagaaccaaaaaattgcatccccaatagagactagcgcgcgcgggacgggatcccgcgcgggattttgcgggatcccagactgcaatcgcgcatttttataaaaggcgggatttgcagttaatcccgcgggatccatcacccaaaaattttggattgcaatcccgtagcgtgatccgcagatttcgagtaatgaatgaaggcctatgctcataggattttttacttacaaatatttcatgcattcttatacactttccaattagaatttaaagtagtgaattttaggcgaaattccaagcgctgaaaacacaaaaatggcgacggctccaatgacaataaaaactatcataatgatccagtttaaatcgaaagatgcaagtttttttcaagtcaaaaaatataattattaattaaacattttcgagataaactttcgacaagaaattattggcacttaaaattcgaaaacaatttggatgttctatttaagggtcggggtcgttttcgtacgagtagaaaaaagatataacactgttaaatagatttaatgttttgtgtcaattgaatttaattgtatttaaattatgcaacaaaattaatcggcttaagccataaagtccattattttgccaacacttcttcatgtcatggccaaacacaacgccatttctcgttcgatgcactagacccaactgcaaatgagaaaaatatacataatttatatttaaact

SEQ ID NO: 15445 - DNA, 1437 bp, Heterodera glycines
ttggaaaagtatcgttcatcccactaattgagtgtttattattaattgaaattttatgataaaccttattatctcagaaagctatctaatcgattcgaatgttttcatcccggttaactagagcaacgaaaattggtttgaatcgtgaagtttatcatttctaactcacctctcaaactgaggtgcacaacttgcaggatcgcgaagagccagagtcagtgccctcggtgcaggaaaattattaacatttcaaatatttttcaattactagataaatctgccataaaacgtcatcttatctttcatagcgacaatttgacctatcatatttattcgtacatgaccacatctgtgccattcttctcagggatactccgcggtaaagtacatacttccagtgcaatgacgcgccgccccccccaaaaactttttaaaaatttgaaaaatttcaagaaaaatcagaaaatttttttatatatgaaatttcaaagtaaaaaaaaatttttttaatataattttttgggtttaaaatttcctaaaacacgtatcagggtgttttgagacagctggtcacaaatatgtcaactattttgactaattcggaatctcggactctcgaattggtcgaaatggatgcggtattcgtgattagtgacctcgaaaatccacacatacttgttttcaggacttttacaacaaaaataatatatataatttggtcaaaaaatgggaaataaatgaagagagtaccttttttggacaatactgttaacaagtcgcattaaacattacaaaattttcactggcggcgcctagcgccatcgccggtctccccccccccatgttgctcaaatttttttttgaataagtgtgccataagtttttaaaaaacaaaaaaaggttgcattactttgcgcttaatcccaagctaaataggtgactactatataaatttgatgatgacttgcctgggaaagtcgtctcaaaagcgggtcaaagtccgccttgaacaacggagggttttgcacagaaacaccttgggccgacgatcggtgagtggcatatgaagccaattgtaaagccgatgccgatcattaatttcttcgtgagtgttgttgcgctcttctgggaacagccaattgtccacacagatccgatggagattcggaaatcccaatagccccgaaggaagaatgccgcacataagcgagaaatggttcagcgacaaattaattgccttgatgtgcgcccagccaatggcagtcatgatttgaccggcaaaaagccgacgactgttcagtccatctaaggcaacgcctgtcaacgacacaccgccgctaaagaagtcattattttcgcgaaactggagcactgagtcattaacgcatctgaagtttatatttattaaaatatgtaggacattcccatggttgaaca

SEQ ID NO: 15446 - DNA, 1629 bp, Heterodera glycines
tttcagaaggatgtgatgtccagcagaaaacatgatgaatttcagatcttaaacgtgaaaatcattctaaaacgttttttactacttttttctgaaggtatgcaatgaattagatatcgaaatatcggatgttttgcatcggtttcatttagttgtaaaaaattctacaggcttagctttcatttgatcccaaagttatggcctaacaaactgaggatcgtctttggttggacgctcttacgcctgttgggtatttaatttttcggttataaaatggtgtcaaccgccgattaaaaagacggcataatcattcaccagcaggatgaaatctttataagtattagtatcaaagcttagttcaacaaataacaaggtaaattgtgttttaagcaattattttggaggtttttgagaatatgaaaccgccgcaaaatgatggtcgatttcacggagagcacagaatggctgtggctttttgttcattcattcgttccttagaaattagcaccgtcctccctttttgtcagctcagagagtgcacggcacaacgaacacgaggcccgactcgccaccgcaataagtgagtcccacgcatttgcgactgaactcgcaaaatgtgagcgcttcgagacgacgaccggggcaaacttcaggggcacgcctccgacaaattcgctcctaaaaaaagtaaaactcaactgggaattggaacacttgagctgtattgaattttaattatatttgagaatatccgtttatcattcgtagtacattttcctggtccattaatgcgcagtcgcccaggcgaacttctaacctccgataagtacaacactcgtcgtgtgagaagcaaaaattctgtaaaaatatcattttcatttaaacagtttacgataattgtcgtttttttgtttgccttattattgtcttcgctttctgcaattgatttgtcatgcattatcaagtgcaaaagtgtacggccctgcatgagattttcaccatctgtcagttatttattggtcattaaacattttaaagaaacaaaaaagttgaaagcaccacctccctgcccattcggtgccatcctcccgttaagcgaacatgccattcgaccatcggcacccacagagacgcacagcccagacagctgacacacactgacgcatgtgttctggatttgatggctgaaagggaaaaaaggggtaaaagtgggaattagagagccagtttcgaccaatttgagagagttgtggcacaaatttggtccttttcagactcatcgtccggcgaagaagtcacccaaatgtaagaaggcgcctgaaatcggatagaaagggatgaagtgcattgggtaccggtaggaaggacctgctgcgttattccaaaataggaaaaagtggatgattcgaaactgatgaggccgggaaagatcaacggttgcgagcagcactttgcgccgcaggttttgttcaggtcgcactccaaaacaggatgggacgaaccaaactgaaagggaattacactaaaaactgattccgagcattcacttggtcagattcggacggaagaatgaaggcgtaaatacgaaaaagacgacgacggaaggaaatggcaactgaaaaaagaaaa

SEQ ID NO: 15447 - DNA, 1878 bp, Heterodera glycines
  misc_feature (73)..(73): n is a, c, g, or t
gatcatcattagcatgataaataacagaacacataaattaataaacaaaagagcagccagggaaccccgaacncatggcaaagagagacattcggcggaaagaaccactgagacatacggatatggaacagctaatttgacaaacatttaaagtgctgtcatcggacattggaggatggactaaagaaaacattgcatccgactcaaaaacgcatggcaaggaattgttgacatctcggctttgagatttttcaacgagactttcaatttccgatggaacgctaagagaaaaactcaaattaaaatttgaaaaaattagatgtatattatttacctgtaaatgtttatgcctccgctgtgggtaccaaccgctaacaagcccagagattcctttgtaaattcggtaaaactttggcgagatgttgaaggggtttcagagtgatgcaatctttgaatggcacgctaaatttaagtgtaatttgatgaagcttgaaataacattctgtacgggtaatgttcggaaggattcgaattcgtcgtcaaatattggacaccaattcagtgaacaaatgtgctgggcctttgggacacgcaacaaacactcaaaccgtgctatttcactataatgagcagagtgtggcttattggcatattttgtgattacttgggattcttcggattggtcgtccacagttggacaaatgcgtcttgactttcgctttccatttttagcattttttcatcggcgaaagtgccaatggcaatcagttctcgtcctttaataacatttaatgcttttcaaccgaatataaattattataatatccttcaccagggaagaaaagcaaaaaaaatgtccgggttctccccaaagaaatttattttggttacgggcctgacatgacccaaaaacctactttttaaatgacaaaatcttgatcgatccctacccttttattttatgtgttcacctttttttgtcgctcgtgggcaaattgccaatgcagacaaaggaccaccgcagaaaaaggcttgggcaatacgttgatgacattttccctgccggagaaccaaacggtcgggagtgggcactgaacctgacaaaatcaaattcgaaagtgagggaaggcaatcaatttgctgacctgaaatgccattcgcattttctcgcttcattcgtggatccattggtggtggtaaactgttgtagatgtcaacaacctaagagaaagcacaacaaaaaatgcgtaatcagatgtaaaagacatttcattctgacctgagcactttcaaatcgttccgcaacagcaggcgcaacatccacttcataagtgaaagtccgagctgtgaatatgggcagtcgggcactgactgtgaaagggagtgtctgggcaccggcggcggagtgcccttcgttggcattggcctcctcgtcatgtcgccttgtgaatgtgggcggctgggcaccggtggtggagtgcacttcgttagcattggcttcctcgtcgtgccctttcttcgatcgttggtccggtgctttgtctgcttcttttctcctctcattgcgcttcttctcctcccccgtcgacccatttgttacttgcggagtcgtaaattccctctccgtttgattttcactaatttctctactttttgcaatttgaaaattgtccaatgaactaaaaaatgtttggtattaattatcaaatcacgatcatttgttttgcctcttcgatttgttgccgctgaatgttccttccctggcaagtgaggaagaagtgcagggacggtcagaagcccattgaaaggaattacgttgtgaagacggtcgaacgaaatgcgaggaattattgggtgggggaagaacagacacagtgt

SEQ ID NO: 15448 - DNA, 3344 bp, Heterodera glycines
  misc_feature (1578)..(1578): n is a, c, g, or t
  misc_feature (3224)..(3224): n is a, c, g, or t
  misc_feature (3280)..(3281): n is a, c, g, or t
gccaagattaccttccccttatcttgctatattgtttagccaatggaaaacgtttagacttgtatttgtgtaactgattctacacagaataatgcaaatgttgaagccttgcaaactcaaaataaatttaaaaaatgctactaacaaattacgttgattaatcatattcaaatataattagttaaaagattaaattaaaaaccaatataaaatatttagtttgcttaataaaatttattttgctttgcttgattgctgtggctttgtgtgtatacggtttagggccgaaacacaaataataattaatttaaataaattaacccaaagagacaccgtactgatgaggcacggtctctttcggttaaatttgcacgtttcgcgaagtgcccatttttgcactgtcgcgaaacgccccatttttacaccatttttgcactgtcgcgaagtgcccatttttgcactgtcgcgaagtgcccatttttgcactgtcgcgaagtgcaccaattttatacccccccccatttttgcacttgtcgcgaaataacatagcacgggtacggacaattatttatctaactgttatataaaattttcaaatagaacgaagcgtttaaaataaattttacgcttttcatggattaaatttgaaattatggcaccaaaagctttcaatgagacaaacagaaagagcagattggtagcaagcagaaaagaacaaatcggcaaaatgccttctatttttgttttaaaatcgggctctataaactgtaaaagctttttttttttttgattttttaaataaatttctatttattatacatactaatacatattgttgaagaccctgatttttggtgccaaaatctgtttgtttttttacccaaatgccctcctgatttaaacatttcaaatgagaccatggcccaaaaaataaccccttatatgttgtgtatgtgtgctaaaaagaagtttctctattgcgagaattgttcagaaaataagtaatttttatgcgtcttatccaacaataatataagcggaaaaaatgatcgattacattttaatagacgtccaatcaaatatcattagggcatagataattaattatatggaaatgcattgttttttctagaccgtgagaggcctgaaacgcaggaaaaacaatgttttagcttggtttgatgcttcttctagaatggatttctatatcacgatttaccgtatatgctctaattatagcccagtctctattaatcccgcagtctccaattatcccccagtctacgaggtgttttgaaaaataatccttctatcataatcgcccagtctctaattattctccttttctgaggaggttgaaaaataatcccccatgggctataattagagcatatacggtatgtccatatttttctatgtcctaatgaccatattcaatttctcatcaggaataaaattgttaattcccattattaaaaaataaatatagtaattgtgttaattcccatcattaaaaaaatactaattatgtattgttcgtaattgataatgatttgcaaacgaaatgataggtaatcncaaaaaataaaattagtaattgttcgtagtaattggtaatggatatggcaatcaaatgcatctgtcatggcagtgtaacgaaatgataggtaaccccagcttcatcagtgacgaaatttgctggtggttacaatggcctgagaaaattgaaaaatttgaattcaatgaacatatttaattattatggttacagcagattgtatgcactaaaaaatgccaaatatgctcgtaaaatatgccataaaaatccgaaaaatgccaaaagaagcgcattaaaatatgccctactaaaaactgacaaaaaacgaatttaagccataaaaaatgtataaattgtatataaataggaatagtatgacaaacatattcaaaagaatggctaaataaaaacgtatttaaaaaaaaataaataaaaatgtttcatttttgaatttacgaacgtaaatttttgtgtattttcgaattttaagatatataaagggtaaaaacccaactcgtactattttagagtatctttttttctctgttctctgataacttaacgctgtctcgcttttttctgtttctatatttactacataatagtacgagttgggtttcgtccatataaagtcaatttcttcggctgtgtatctttcgattttaatgcattttttaattaaaaaatttttaaaaaatggtcaaaatatgatttatttattcttgttttaaaatcgtgccctctaaactacaagtgccaatttttagcgtagaaaagctatttttgagccctcttttttcgtttattcataaaaaataaaaaagtcatcagaagggcgaaaaccaaaaggaaaaaatccggtgaaaaatcacccaagggcagtttttttttgtagtcagccaatcgaatgcggatttttcaaaaatgggtttaaaccataaaaaatgtaaaaaagaaaaatgcaaatccctaagaaaatccgcttaaaatcacccaaggcactcctcgtcgttaggcaattgaatctggacagtgttcaaacggttcactatttcgtactcccactgaaccggcaccgcctccccaacaaaaatttccgggcggcgcttcagcagccaattgtaagtttggtgtgccacttgttgcagtgccaacttttccccggtctgttcgttcaccagttcgaacggttcaattgtttgttcttccaagtaaaaataaatgttgtaactgccagaaggagtggtggcactgagaaatgcctataaataaacaatttttttatggattttgggggcaaatcggcggtgttggttggatgatcccaaaaaccacaaatgactatatttattagagctcgacatttaaaaaaaaagttctggacctgaattccatgttggttggacctggatttctggacaaaattccaagaaaatcctggtccaggaaaaggaatttgccaaaattggggtttggaacctggatccaggaaaatccaggactggatccaggtcccaggtcgggctctaatatttcaatcaatgtctctgcctcaaagatctagaccaacatataaaacccgcgaagatgcacgaagaaagaaaaggtggtggccattcccggtccgaccttcttgaactggtcgatccagttttcgaatggttgnccgtcggtgacacatttttaacaaaatgtctaatgatttttttgaaatttttaaannttttcgagggtgaggatagcaaaacaaggaagcatacttagattttctggacaaaaacccagg

SEQ ID NO: 15449 - DNA, 1038 bp, Heterodera glycines
aaacgcaattattgaaaatcttttccaccatttttgtctgttttccttccgatttggtcgtcgcattcacagaaatggccaccacttgggcggacatccaacggctagcggccgatttgcagagagttcagctggcagaagggacgaaacggtgggcgatttgaccttggggttttggctgctttgctttggttttgattcattggttcaaagtccactacgaattgtacttttagcctttctgaagcaaattgcgtggaattagtgaccatgctaatggccatggaaaaagtgcatttggtaattacaacggacggaaaggtggggagggagggacatggtcaactcaatgaaaacctgttaatttgtaaaatatgcaggagtttgtcacgcgtcggcatttggtcaccgaatgtgccaacgaatgtttggcctccggcggtcgcattgcgttgacggaattggctgcccaactcagcgtcgacttggaccacattcagacggcggtcaaccaattgttggcaatgaatcggcactaccgaatgaccgaagacgaaaataccgtcgaagacatttcgacgcccgccgaattcgtcgtctgtgccggggaactcatccaccggtcattttttgagcataatttcctttgaatttattaagctttagtgaatttatcaacgatttgtgctttcgtcttaatgcacgtctcacggaatttggccaaatgtcactgtttcaactgaccaaacaatgggaagtgcgttaagggaatggcactcatgaagaatgattagtccgataaaattccccctccccccggcatagcaatagcactcaattgatttacgaaaaaaaaattaaacgaaattgttttaatccggacaaataattttaacattaaattaaaatattttccttgtattgtcagttttacattttcagttgcccactgaactgttcaactttcacattttgcctgaaattagctcccatccgtccgcgcgcatttgtgccattcgtttcgaggacattctctgc

SEQ ID NO: 15450 - DNA, 965 bp, Heterodera glycines
  misc_feature (36)..(37): n is a, c, g, or t
ttttcagattttcttcagaccaaccacttttgttannattgatgacattttgccaccacaatttacttttttgacggacggagattatgccaaaattgtcgaacggcttcaaaagcgcggaaatggcgcgaatttgcggtgataattccgcactttcttttcgcttttcgaattccgtcgttttagcgccacatgcgatcgttcggtcgtttttgagcaccctcaactgatggacaattggttgaaatcgcttgaagaatttgtgcggaagcgagcagcaaaagacgcacccgaactgagaaaggcgcatttggacacacttttgggggcaaaaaagacggagaaacagcaaaaacagcagcaaaaagtgggtggaggggggggggggaaagaaattaatacaaaaataattgatattctctcataaaggacgaatgggagacggacaaaccgacggggagcaaaaagggaaaaagtgcgggagcaaaaaggggagggggaacggcggcagggaaacggaggggaggcggtgggacagagacggaatcacagcccaaaaatggtaagggaagcggacgcagggacacgcaaggctagccaaccatgctttctggggtgtatgccctgcgacagtcccaggattaaggattttcgaggcttgcgggtgtgggtggggttggacatgagaagacaattcgcaatccgtagccaaaaaaccgggttgacggataacctttgattgttttaagtttcttgttattccataaaaatattcaccttttggtacttatttggtttaggggacacttttgacatacattttctagtctatatatgtgtttttgaaattaatgaaaataagtttaaggggtttttagggtcgctgatcaccatacatgtactagtacaaggggtgcgccagtcagacccccatacgtcggacgttggcgcagggggggtgcgcc

SEQ ID NO: 15451 - DNA, 3183 bp, Heterodera glycines
tgctgctcagtgaatgcttttgctcggttggcgccatcctccggcggccgaaagtaaaaatgccatttttttttgcaaaattttccattttcacctcccctttttatttcagtgtaacaagtccaagtacgacgggatcaacaggttcaactatgacgacaacaacaacgacgaccactaccaccaccagcagcacgccaacgacgccaaaggggacgacgacggaaaattggagcgaatcattagcggctgctgttggcggaaagaccacacttgtgctgatcatcgttgggtgcgtttgtccttgtttaccatcattcattggggaccgaccatgacgaaggcgtgtttttttgaatgtcgacaatggcacaaaattctggcatttttgggtcgtttggggaccaattctgacgaatgagtgtttggagtgccggcactgggacgaaattccggcattttgggttgttgggggatcgaccctgacgaatgagtgtttttgggatgtcggcaatggcacgaaattctggcatttttggaccctgggatttcatcatcatcacagcagataaaaagcagtagtaatttcacatttttccccatttgttttttcagcgcactgattgcaatcattgtcctgctcgtggttgttgtgtgctgctgctgctgcaaaaaacgcaaacgccgccgccgccacacttctgccgacgacgacaacgacaaggaggacaacaaaaagcgcaaacgtcgccaccacacttctgctgacgacaagaaggaggaggaccactaccacattgaccagcacaataagaaggagggggagcagcacggaaaggaggacaacaaatcgccgatacaaagcgaactgaaagtgtcgacgatttccgccgtgccaagcgactacaacacgaacaaacggctgggcgcaacagaattggacgtggaagcggaagaggtgccgaagacgaagccggttcccaaaaagtcgaagtcagaaggaggcacaaagcgcaaactgtccaatttcttttggtccaccggcaccaccgagaagcgaccgagcgcggcggaacatggcgtggaagtgccggaaacgattcgtgatgatgaagattgaagatgatttgaatgatggtgttgtattctgtatatacctatattatatattgtatccagtattcttctgtgtttagccatgcatatgtttatgtattgtatgtgcgtattattgtattatatttacggtattcaaagcgatgtatcatttaacacattcattgttggtatataaattctattgtgttgttttgtatggtctgaaaaaactgaattttcaaaaaaaattcgtacatttctaaatgattttgtttttccgatcgactccctcagcttgtttaattttgttggcccacattttgttgacaatttcacctccgccgatttttcagagaaattgcacgaattacaatgacagtataaaagcccgggggcactattattcaactttgggctttaatggaggggtgggggagggctataaaagagattcacacaaaaaagaaaaataccgacgaaattgtactgttttcaaaatggaaaaattgtctaatttcaaaaatcgaggcacaaaatacaacattcagcgacgctttacttcccttatacaagacaaatacaatatgtacatacagaatatacacagtgaaatcagtgacaaaatcagtcatttgatcggataaatacaatttatgaaacgataatgatcagattatataattccatccgattgtccattgtgcttagggctcatctgctgctgctgctgctgctgctgttgatctgcagtttgaaaatccttctcagttcttctcagccaggcaacggtctgaaaacggaggaaaagcgtaagaaaaagccgaacattaaatttgttggcgactcgtccccatacccaatttcgtcatccgagaagccaatggtcacccaattcgtgagacgttcgctgttcacgcgcgacacgcgcaaccaggagaccatggcagcgtcactgaagtccgccggacagcgcagaatcttcacgaaggacaccacgccacccacagctggatttggatttggatgcacattgctcatcagcgtcagcttttccgccgtccgaatgttgaccattttttcactcctggtgtagttgaattcgaacgaagtgagcaccatgtatttgaccgggacggacgctgcagtgaatgactgtgttaaaaagaaggggaaatgcgatcagatcagttgcagaataatgatcaaaaaagggactctgttgcagttcatacggtcataaaaacatttgacagttttaatacagcataactttttctagaagcattcaaattcaacattcttggtatcatttgatagtccaaagagtcctctattagtcctaagttgattttaaaaaattcattcaaaattcaaaaagtaatggtcaaaaatgtacagaaaattcatttttttgaagttttctggttacaacttttttgaaatataatgaaattctttgaaattttgcaggctaataaaggacactttgggctatcgaatgataccaagaatgtttaattttgatgcttatagaaaaagttattattaaaattgtccaattattttatcgtcgtgtgaactgcaataaaaacccaaaaaaggtcagtgaaaaattgaaaaatccgtccccatcgattgatccaccacaaatcccaccgagcacaaatcgttgacgaattggtcccatcctttgctccatttggtcaatttgaacaccaacggacgaccgtcagggcgcggcatgtgcagccacatgtacaggtcacgggccgaggtgtcagcagcatatttggtgttgtcaacagtcggacgttcgggcaaaatcggggtgatgatttcgacaaggttcggacagtcgaagaggacggttggcgacacgtgtttgcgcatcagtgccagttgtttgcgcttcaggctgaccagcgtgcgaagtccgttcctcaacaggggccaaatgtgccgtgccatcgcttgccaagcgcgaaattccgtaatcagatggttgaactgcagcgagatgttggtgctgaacaggcggcgatttcggcgcaggaaattgatcacttggacgtccaaatacctgca

SEQ ID NO: 15452 - DNA, 1846 bp, Heterodera glycines
ccacggtggggtgaagtatcgctacagtcgctcataaaaatagaatgattaaataacagaagctttttttttttggtctatgccaccttgatgctgcggattgcccgttccgcaatcccggcgtgccactggggtgaggtgtgcatgcaatggtgttgcacctctttttcgttgaaaaagcgctgcacgggggcggcagtgaactctttgccctggtccgtcatcagcttccatggcacgtagccgacacgtttgaatatgtgttcaaaagctcggatcatgtccactgacttcttgctcttcaccggctccacacacagttggcggctcagcgtgtcggcacacaccagcagataggcattgccacggttgttgcgccgaagcgagacgaaatcggccaggtcagcctgccagtcggtgtgcaggccggacgccagcgtgggcaggcgacggaaacgacgcacggcacgccggtgcagcgtgtacactcgctgtcgcgccagatagcgacgcacctccgcccgtcgtatgccccttgttggatgtactcgctgtgcctcacgcagtagcggctccacactggtgaaggcggcggccgaccttgtgtccttgtacagcgggtccagcagttgttcaaccacaatttcgcgctcttgtttgggtttttgttgttgttgttgcttttgtcgtcgcatcaccataacatgggtttgaacaaaaaggtattgttgttgttgttggaccgttttgcataatcagcagcggttgactttccgttctttttaaatgcatgcaaaagtgtagcagcggtggagcaagcagccgccaccacccatcttcttctttttctttccgctttccgcgccgctgttgccgaacagcatccgtaccatgcgcgggtctttccgagcattgccaataaatgttttgtacccaggcggtgccttctccggtttgggctcagcaaaatgaaaagtgagtaaagcatccaaatcgctgttcttgatcggacggtacgcgccttgcatcagccggtacacctgctgtccatctccgatgcccagcgtgcccgcgttgcgtaacgcatagtcaatggcttgtcgtttcctctgctcagtgtcacgtaagactgctgctgctgctgtcgatgttgatggatgcagttgcacgtccgcttcttcccgctgtcctttccttgcggggccaactgccgccatattttggggtcggtcgtcgttggagctgtcttcacgctcagtcgtctcagctcctcctcttcctccattatcagtgcgtgtcaacaaggaggcggcagacgacgatgacgggaagcggctagcttcggcgccatccgtagagactgatgtcgtacggggtgaccttttggctggtcgttgtctgcgacgtggaggctgcctcattgtagacgaatcagagtgcgacgactgctgttgttgttggtgcggcgccggctgttttggttgaggttgttgttgttgttgaattgttcgcgccgcctcggaaagtgcatcgcgcagcagccccttcgaggcttcgtcggtgggcagttgggtgagacgaacaggcgctggacgctcctgctcatcctccagcaattttttgaaccgtttgaactcctgttggtaatggatcaaccgttcgtcatcgttcagaaggtgtttaggttgttgccccgatgacggcgatacgccgtccgtgctccgggtgacgttgctgcgtgcagcacgcgccatgcgctttgccgtgtgctcaattggcgtggtatgctgcggtaagccgcccctcgcagaggatgcgtcggcaacaggagccgagctcctggcca

SEQ ID NO: 15453 - DNA, 2630 bp, Heterodera glycines
ggtacagttcctccggcactagcagcatgcgggttgtgtgcttcatttttgtgtgctgtcttggcggttcataaacctatctgccagcagtggaagcacaacgctggccaccaagccagccaaggccgggacgccgcgcccggtctgctgtcgcagcaacagtctacgtgcaccgtgtccgcttctcgcacggcccaacgcacgcacgtgttgggcctgagcgcgcaagtgcttcagatgagtgctcctgagcgggacacgtgcacggagaatatttaacgcactttccaccagacacaacaactgctcactgctcgcccccctcaccagctgacggtaggcacgtgcgcgtgccgagcgacagttgctcagctgcttgaaaaagctggtgttttgttgaatgtattgacttggtgttggcccttttttcttcgcttgcttttgttgttgttgttgatgctgttgttgtctcttttctagttgtattgtttctggtctgtcagtgttgctgttaccgttgttgtttccactcttatgcttcttccgcattgaacattgctgcccggtctcgtggtgcgtacacaacggtcagctcgcccggatatatatgagctttgaggcgcatctgtggccgggtggtcgggtgcatgtccaccaacagataaccaaacgggtccgctgtcgcgtcatcgtaagcctcgaggaagtggcggagcgcacccgggaacagctgaacgcccaacgagcgtacctgaagtgcgcccgacggattgcgcagcagcaccagatagtgcgcattgttgcgtgcaatgcgcagctcgcggacgaacaaatgctgcgtgatcaataccacactgacgccccagttgtgtgagccacgtgtgaacaacgtgtccaggaagggagcgcgcatgccaaccatcagatcgtccaacaccagcagcagtcgaccattgcactcgtttgccgcccgcttcactccctcctcgtcaggcagcgcgtggcagacacgaacccatcgaccactattaccaccactgctgctgctgttgctgctgctttttttgacaccattagttgatgttattgttgtttttggagtgctgccaacgctttccagctgttgcaaacgcagcacgtcctcattcacttccccaaaacagtagagcaccccatcaatgtgggcggggccaaccagtgcgtccaggttggccagcagatggagcacccatttggtcttcccactacccgtacacccggacacacacattgtgaacggatgtacaaacacggggtttgcgtgcgcaagctgctctgactgtgtcatctaaaaatcctcatttttcattctcctcctttgaccaacttctttatatatgctctcaaatttaatatcacattttttgacaatttttgagccacacatatttaatataaataagtttttatgttgaaactatttattgtttattctctaattattttatcaatggacacgccgtcacatgtatctgatcgcaaggccggcgatggtgttggtaatgctgatgcaccggcagcatgccaacagcagcagccgagtttggccgatgacgaaccgctgttggtccgacagccaaaggaaacacctgcgcaacacccgatggagaatgaggaggaaccgcgacaggaaagcgcactgcttcctcagcccacacatggggatgacatcagccaaacggtcagccagttgccacccaccacagtgcacaaaacgcgaaattgtcaaaacaaaaaagtcagttgctctcgtttgttaagatgtcgaagctgggcagcgatggtaatgatgaacatggcggtgtcaaccttggtggtggagatggtggtgatgatgggcaagcgttgccaaccgaggatgacgggctgggcggtgctcatctccctcccctattgttcatcgatgaggaggaggaggaggagagccccgagtcgcgcgctggggatgacgtgaaccgagtcggtaacggtcagatttacactgaaaaagtgaagcaggaaggggaggaggaatcagacgacggcaacgctgacatggattctgtcagccatgacacgtacagaagcagcagcagtagcagcaccatgagttcgtcgttgttcttgctgcatgactgtcatatgcgccaccactaccaccacgacaacaacaactgcaacagcccgccacgaaaacaagcggcgacagagctgctcaagcttccgctcatcgactatttgtgtgggctgaacaacgggtgcagtgtgagagagctccacacgctgcttcagaccaagggcccacgtgcacacatgttggcccatctgcaacagcgctgtctgctgcgcaccgtccatttgcggcccgccgagcgcaacattgcgctacatgcgcatgccctaagtgccctaagtacaaacctgacctttgcatgcggcggttatctcaacctcacggtaataaaatgttttttgaagaagcgccgcgcgcatttttttttgtttttgcctaggtgcgtcagtacttctatgccaaacacggtgtccgtttgcgccacccaaacctgccggcgaaggtgagcgcggtggtggcgcacacatgtcctattatc

SEQ ID NO: 15454 - DNA, 2613 bp, Heterodera glycines
taatgccgcagaaaaaatggttaaaaaactaaaaatccgggctctactaataaatagggctgccaattttgtgtactaaaagtggtcaaaatatgtagataaatatgaaagaaaaatcccgaaatatatacaaaatatgcaaataaaagtcacaatttttgttcgcaaacacaaaaaagaaagtgttttcctactaattagagcatggaaaagccagcaaaaaaatatgtatttacttaaaattggcagccctagtaacaaaaatatcaaaattgaatgatggtatttaaatttttattatttttaaaaaattttctccttgtaaacattttgtttgtttttaaatgaaatgcttaaattaaatgttaaattcaaatttttaaattttcctatttatttccttacactgggttttttgaacgaaaaaatgctttggttaaaaatttcaaattataactcttaggggatttatttaatcgcttaacatatgcttaatgatagtttctaaacaattagtgcttccgaataacatcaattttataaaaaaaaattggtagaaaacgaaagaagttatgcacaaaagattagtccgtcggcgagtcgtgtgccggcgagttgtcatgtaccccgactgaagcggtgcattgcggctggaatgaatacgacgggcattttcacttgtaaaatctggtggggcagccaacagcaaacattggcatttgtgcaacacaaggaacagcaaatggaggagacgaaaaatgcaaaaaaaaaaaaacaggaagaatttggcattgaaatttcggtgagaaaatgccaaaaaagggatttgctgattaattgcaaatattttcgtaaattactcaaacctttgctattttttcgatcatcaaatcataagtgaaatttatgaaatttcttttatttaaaatcaaattaaatattttcatggtttcattcaacattttttgcttcattttttcattctggaaagttatgaccaaataacacgtcttttaaaaagtaccaaaatttgactggctaatttacgaagtgtgaaaatgtggaattattaaaaaaaatttttttttcaataaatcagaagatttaattttaaaattttaaaatttgattgtataatcatttttgattttatttaattttatttgttttaattattataaatttttgaatttattaaggttaattattgtaattaattataatttatttttttattttttcatttatttgaattcttgcaactaattttgacggaataacagaactaagtgggaaattgcaaaggctttgggagccgaacacgaaatttgttgggctgattgtccggataatccgtcacattgctgggcaaaaacacaaagaaactgttcgacatgattatttattttttcaacaaaatgaaaaaatacatatgcttttatacaagctgagactcattaatccattcccgattgggatatcctataaatttcacaagcatctcggtggacccatacgacagttttctctttctgtaaaccttctcgatgcggtagctcgtctctgcatcctttctgacgcgcgccagctcctgatcatagaagctgcccttgaatttctccccgtgttcatccctcagtttgtacagaatcgggcgcaccgctttcaacacctcgtcaatctccaggatttcgtccccgtaatttggcaaatatcccttctcaaattgccccttctctctgctcatgcgtacaaactggtcgttacggaagcgtggcgtccgcttttgaagagcagggtgtccgtacagtcgcttccacaccttttgcgcatttgaaaagttgacatcgttggggcgcattccgtgaacacgagacggagcgctgttaattccatccactgtttctcaatttcctgctcatcgaagaattccttcagcaatctgttcttgaattcggtgcccttgtctgaaaaaatgcgatgcgggaccatgggcatttggtcgatgagttgcttgaaggcatccaacatctcctcggctctcttgttttttgcgcggtacaacaaacaagcgttttgagagcacgtcaaccgcaacgagcaggtatcggtgaccccgattgtggcgcgaaagcgcctgaaaatcagccaaatccatttgaacatcggtcatgaaacccgccgcaacggttcgggcccttggaaagtgcaccctgcgggggcgcatcagagtgtacgtgcggtgcccctccaaatagtgctgcacatcccttttccgtaaatttttcaacttttttcgcgcctctttccacagtgcggtaacaccagcgaatgccgctggggaggatgggtcgttgtacagcttgtcaagtgtggtgttgatcaactccactttttcgggcgaaattccttcttgattgtctgcggcgtccgggttgttttgctttgggatggcctctttgacggagccgtccatgaatacaaaattgggtcttgcctaagcctctcttccaatatggccgctccaggtggcttaatggtggggcggcccgctctccggtctattatatacttgagggccattcgaaaattgctatgcgccaacggtttgcc

SEQ ID NO: 15455 - DNA, 1712 bp, Heterodera glycines
  misc_feature (1541)..(1541): n is a, c, g, or t
tcgctgacgattttggatgaaacatttaaaatgtaaaaagaattgattgcacggaagccaggaatttttgaaaatttgggtgttttttttaattttgtcgcaaaccatcctgttcatttctaaaatttgcgatataaacgagtcagaattttcgaaatttcctcccaccggacgcaaataaaatatttttcaaattttttctcggcgatgtctgtcgacactgccggacaccaattgttctttaattaaaaagggatcaattgaaattctccccatttaaacagtcaaatgtcgttacattaatagtttaaacttagattttgttaatcgaatgagagattatttctttaaaaaatttttttcaaataaatggttgcgtttacataatgggttacggtaatacgacgttttttttctaattggatgtactgatctaaatttctatgttcttgttcttcccccttttttcgttctctactacaattccacgttgtatttgaatttcgatccttccacaaatttttctttttccacaaatttttgctccgttggatgaatgtgtccagcggcataaaagttaacttttgctttcttatttttcgcatccatttccatggcgacaaaacctccgccgagatattcctcaggttttttaaccgaatccggatatctaagcaaggaaaaatgttcaaaaatgcatttaaattagaataccaaatttaaaccaaaaataattaatttaaaaataaatacatttgaaaagtaggtaaagattctccttaaaaatttggaaacaaaacctacgtaaatttgagcagatgcttgtattcctcgggaacgtgctttttttcattggcttcttccattcgtgagccggcacccgccacaaacacttggacaccaaatttggtcaccaaatgcttcaaattgtgctcatggcccgacaaataggcaccgaccttgtgaacactcaacaattcattgaagcgttcggcacaagtaaagctacggtcgccgtcggtaacataaagcggataatgaccagcaacgaaaagaaagttgacgcctcttaattaatgggggaaaaagtgaggaaaagtcaaaataggaaaattgccaaggcaaagtcacaaatgtggtggatcaaagtttcaacaatcattcagagtgatcatgccacaaaatttaccacgcggttaagataaaagagatttagcgcactaattagcatctatttatcaattttaacgttaaaacacaattttggcaaaaaatgttgggaattaaaactttgattccgagtccggagtaaacaacaattttgttttacaatagtgcgttcaaaaaacaagccccaaaaggcaattgcttgatttagaggcaatttaggtaataattgatttcaaaaataactgttgtggattcttttgaacctcacttttgtaaaatgagtttttgggtttgtgagaattcttggttcagatttaaattcagatgaaaagatgccaaattttgacaagcgttcttttttatttccttanaatacttattccgaaaatggtatttttaagaaatttaaacattaaatacattaccacaaaattttgtggtatcaaatttaaaccctttatcggttgcttcccggattctcagtaaaactgatagtaattaccggtgttagcataattacctgagatcgcattaatcgattt

SEQ ID NO: 15456 - DNA, 1065 bp, Heterodera glycines
aattataaataaaatgtcctctcacttttcatttgccagtttcaattcattttccagccattcgaagtgtttttccgatttctctttgatttcttcggtaaaagttttctcatctttaaacattttccgatttctgccgcataaaatgactgtgtcaaccatcacaaaacgaacacttttttccaaatttatgccaaaattgtaatgcacggtgtaataaggggcgggaaaagtcctaaaagaaaaacggaaaattgggcatttttcataaaaatgttaatttgaatatttatattttaaatttattaggtaattgttttttcttttttttaatttagcatttttgactatttatttattagtccgttattcaccatttttcgcctataatttcaatttgaggcgcaattgggtcgtatccatccaaatgatgataatcccgattgcccgcaacggtgtaccagggcacatcttttgttccgacattaccaaaaatgttcaaaaaattctaaacttttttcatattagcccgtcatggcggattaggagcaatgaattcctgaacatattttattttatggccccatgaagcacctaagaattattaaaaaataattagagattttgccaacaagcagaatctgctaacagccagcagctcaagagcaagttgttgtgccgagaggcatcccgggaaaaaaggaatttaacatatttgataaggtattttgtaaaaaattctttattttttattatttttcattttccgaattcccagtgggagggcggggagcagggaaggtccaaggatttcggcttggggaagtacctcccccgggcgacgaaaaaatgacaaattttgcgattttgagccatttttagcagattttcatcaaaaattgtcggttttttgaaaatttagcgaaattttttggaaaatttggttgaggctaggtctgggggggggggggtaccaccagggaaaatctaaaattttcagcaaaaaatactatttttccttaaaaaattcgggtgcggaggggccttgggggggggggtggggag

SEQ ID NO: 15457 - DNA, 4236 bp, Heterodera glycines
  misc_feature (1259)..(1259): n is a, c, g, or t
  misc_feature (4195)..(4195): n is a, c, g, or t
atttatgacacaaatccgctgctttgcctttgctcttctttgttcactttctctgtttgtgcgcccccaccaaattggtgatcgtccgaacgttggcctccaattgttcggctgtgctgttctccaactcgtgcacgaccgactcgtcataactggcactggaaaaagttttaattttggatataattaaaagcataacgagagtcatatatgctcaaggagaggcagaaatatgagaaatttcatttttttcaaaattttacaatgaattactaagttttttccgtagccattccatttctaacaaaagagaggaagcaggtaaggggaactgtatattttaggacaattttgaaaaaaaatcagccctaattaaatgcccactttgcctcctctgcgatgatgccgaaaatttcggcctccaaattctcgcgtcttttcctctccgaatagccccgttcggtcagccgatcgaacagcgagtcagtggcacaacggaggacaatgacgaggtcgaacctacggcaaattgggagggggagggcatgaaacaatgtgttttctgttgtttcttttccttaccatcgctttgggaacatttcggcacagtgatagtccaaaattaggccgcccgcgtcagagccaaagcgttcctgaaaagccaatgaataattacaatttaaattttatcgtattttaaagcaatgaaagcggtcaaaactatttgagtttgatgtgactgttgttgtgtttacttccaaatggtcaaggagtgcgtcctcgttgagcacgtgggtgtccaattgggcgtcgtattccgcataaaattcgcgttccctaaacccattgaagccgttattatagagtaatttggtattggtcaataatcgaaaaaaaactacttatttatgaccaacaaacggagggatgaaaaccgaaaatttttccttatggtttgaaatttttaaagataaatttttaattccaacagttttttgcctctgcaaagtaaaaaatgaaaaactttttggcctcactttataatcgatgcggtgtcgatatgctccatgccaacattttgtgcaacttttttggccaacgtcgattttcccgcagattaaaattttttattatcagtgtataaaataaatgaatttaccggtccccggcgttccggtaaccaaaacattgggcagacgacgccccatttaaaggattaaaaacatgaaaaaaccaacaatcgttgaaaaataaattanatattcgaagtgagaacgaacagaggcaaaagaatggagtaataatattaatattttatttattgaaaaagcataataaatatggaaaaaacaataagacaatggaaaattgggtgaaaatcctccgtcttcaatttgatttcctaatttgaaaatgcatcgaaaatgggcgtttatatcaaatcccccccccccccccgctgtttccccctttgtcgtcgtctctctcatcgtccgattcggcccaaactgaggtccgcgcgtgggttggccgtcaccttttgcacttccacgatggtggcgttgatgcgcgtctgcaactcgcgcatccgcgccgtgtgcagcaggcgcaacacgcgcaaagcgttgtcaaacgaacgcgagccgctcggcggcgtaccttaaggggaaaggggagggggattaacggaaaacaaatgcataataaaaaatggacaaaaaatagtaaggaaatgaaaccccgatcattgttggacaaataaaaaaataataaatttttgtgtcaaaaaaaaatcacaaaattttaaagtcgacagaccagttgccaaaagctccaacggcaccacattcaaaggctggaatagaaaaaaattttctaactgaattttaaaaattaattcatttaaattatcacattttttggcgctccgtcgcccccgttcaatgccatttttatgtcaacgactcgtttttcaatggcacggagcatgacccgcgcattcggatgagcagcgatgccaaaagggtggccaactcgcgcacggtttgtgccaggtcggaggctgaaactgaaaaggagggcaaaatttgtgattcttcaaaaagcgctagattatgaaaattagagcaatccccaaactgcgtctttaatttttgtattcgaaatctttttatatatcaatggttccacaaaatctcgacgtctataatttttttcgtgaattttcacagaaatttcaatcttattaagtttctagcgatgattgtctcggcgcgatttcgggcggcgagtaaacggaaactaatgacaaggaaatgatttctaccattgtttagtgcactgctcgccccatcctgcgacttctgagggctgtcgacttccattaagcgcaaataattctgaaaatatccgattttttttggtttaaaaggtagaacggtgaattaaacggtaattgggcgagcaattaagcaagtaccatgtcacattccattgcaagtataaaatgttaccaaacatttttttattagaattatgcggattcaaaaaataatatgcaatatggcaatgcttacaattaacaagcaaagaaaaggttggacaaagtgaaaaaggagtacatttacaaaacatttcttggaaacttttttgattaagactaaattaaattaggtaaatcaaatacaattcaaattaaacagcaacaccttccaaaaatggaatttggatgaggaaaaatttcaagagctaaacagagtgtttaaggaaattaaatggagaaccaaaattggacaataacaattccgccgatttaaaaaaccaaaatatgattggacgaataaatgcgcaaaataagaaatttaaaaaaataataaatcgaatttcggcatagaattgagaagataaagaaataatggcagacaaaaaagtgtgttgctgctgctcacattcagcagaaacaggaagactcgcgcgtcgtccgctcgtcactgcgactattgccaaaatcgatctgatcaggaaattctgaaataggagaaatccattaagagttcagttcaatggatagataggtctctttagagaagggccaatattataaaacagaggttctattttctttcccaccatcgctctacccccggcgcaccccaaaacgtaccccaaaacgtcgccgcaaaaagtatagaaaaagtacaagaacaatttggctacatgtcgtttcaatatatgtcatttcaatactcagtgaaaatgtgtcatttaaatactaattgtaagtcgtttcaatatatgtcatttcaatactgtcgtttcgattcgtttcgtcgctcaattataacgtcctttcgtgactgccttatgttaaccgaaaattttaatataggatattcttcataacaatggttaccggtgtaaataacaaaaaatgataaatttggaatttgggacaaaggtgagaaattatgggtttcttggatttcccgaagtttgggtcttatatcagacatagcaataaatgaaaaaattcaaaagttaaaatgaatgaaatgagaaaacataaaagaaatgttaataggtatgtcaaatccaataaaaatatcttgaaaggacttagtattgaaatgacatatattgaaacgacttagtattgaaatgacatatattgaaaggacttagtattgaaatggcatatattgaaatgacgtatattgaaacgaaatgcaccggggacaaatgcgtaatgacttttttgtatatcgatcaaattatataattccgtatcgatctacctaaatgtgctctttataagcgattaatatagcagaaagttaagcttgaaaactaaaaaagtctcaattttgtatattttcgggaacaatttcttacccaattcattgttgtttttgtccccaccactattttttttagctttaaggccgcaacattttcctgggcgacgatgtgttcctcaattacaactgttgcgtgttggacgtttgtcgggtggacattggggacaaatcgatggttgggccctttacgcggctgaccacccccgggaccgagcagtgcgggaccagggctgggaatacggaagaccggtgcgcattgggcgaggcgtgtgggtcggaggcggagcggtgattttgcccggcgtgacggtcggcgacggcgcaatcattgggtgggngtgtgtaaacaaattggcaaaaaaggcaatgactgactgat

SEQ ID NO: 15458 - DNA, 3160 bp, Heterodera glycines
actaatcagatccaagttggtccatcgccgccagtaatcgttaggccaagcggacagagccatccggtgggcacttcccacatgaatttgtttgccgatctcgcaaatgcgaattttaacaccgacggcgccgaaagtgataaaacagacacaacgacagtgccgagtcagtaacaaataaaatgaatgttgagtaaaatcgaaaaatttaattatatttttaatggaacagatcaattagagaccattgttctgggttttgacttggagttgcaagtcgagaaaaaaacggggttttcttggagggttcttcttggcattggactcaagtcaataaacgacggtctcttatccgtttcccaccgaccgaattggccctataataaagatgaattctgctttcatccccacaatatgtagtaccccgcactatcgtccacagtgtctcccattcgcaaccattggacattcttttgcgtcagtcgtcggcagcggaggcgggagacagcagcagaagcggaaggacgagtggggagaagcagcgaagaaatgccacttcattttccccatttagcaagattagtcactgcactgggcgaggaggaagcgggcgaaaatgccaaattggccaaatgcggggaacggcggtgctcgacaacgccgagagaactcggcgagagggggggggggggaatggtggcttatttatgggacagagctgtcccgaaggttgggcagcccgatgttccaaaaatttctggaattgcgaaccgggtcggccgagctcgatacatacatataatacatttattattagggcccttgatttgcatggacttccaatttttttgtaaatttatttcggtctaaaaaccaagaatcgtatttttagtttggtttgaagttgtatgtttttcatgtttaaaatcttatttaaaataattttatttgaaaattctttgttctcacaattagaaaaaaagattttctctaatttgttaacgttttcattgacggcgtcacgctcttgcgtataaaattattaattaacaatttgttacatcaaatattaaatttatataaatttttgtttgtaacgaattaaactgttttttgcttttagtcgcaaagttttaatgcttttaaattcgaaaatttgaattaaatttatttttttccatatttttcagtttttatcatgttttaacatttttttcaaaatttaatccatatttattttttcttccatattatattctattttttggaattttttgtccataaaatccaggccctattaattatttataaaaatgatgatatttcacattaagatgaagcaagtccggccaagcaacagctgatttcagcagacaaaaaagcgaggaacaaaaaatatgtttttaattcgctgtttttaaataattaaaaaagtgaatcccatcaaattgcgttgggatttcgtcaaatttgtttaaattcccccgtttcgcttcagcaatgcctttctattcgcttatgtaaaccgcgttctgcctgctgcttccagcaatgacaaagaacactttgtgggtgccggagcgatggcggagaatgacggcattcggaaaacgaggaattttggtgcgcgaggacaacgcctaataatgccattggcaccaaatttgagaatttatcggcaccgccgacaaattatagggcgaatgcgaagagaaacagaacaaaatggacaaaaatggcaaaagatgaaaaagtgacaagatcaaatttgacagtgatcaacaatatgttaattataatttactaatgaacgattatcatgtttatttaactcgacattgagataaaaaaaagcagaggaaactcccgatcgaatggtaccgaaaaatatttaatttcaattataaatttttatgttattttatgatcgcgtaaataatattttacagttgtgtgtagtttttaaggtcgtgtaaaactacaatagagccaaataaacaatattgttatcgctttttttgactccaaaatctctcatattttttgaccaaggatgttcatattttgtaaagaatattccgctgagaaccctacaatattttatgtaatattttaattttgctgttcattttgcttggggccattttcgcgtctcaaatggcaaatactcaaatgactgttttatgccgatttgttctttgtctccttttccccattcattttttgctgtgcgtctgctgacccttccgcggcattttctgctgcttcggtggggtcaaatgtttccccgccattctctgctataaatcgccgttttctcaacattcatcaatccatctcctcatttaaattaaaaatggacttttggatttgatttttctattaagactaggactttcactcccatacggcgaactgcgtatttttcccttcatgacccggcccaatgtgctactaagaaatgaagacctttcatagcaattcatcagctctaatttgataaagcattattgattctttcggttatactttatgaatagggtggggatttactggcaaaaaatccaaaaattaactaaaaagtggcaaaaatgccgaaataatggctgtggcaaaataagtgacgaatgccaaaaaatggcataggtaattaattttagtggtgaatagtctaaaataatgctcccagattaaaaatagtggcattaaaaataggcttcttggtgggccggcggtgggcggggtccaaaccctaattaatatcatagcacccaaatttccccaaatttcatgtcgccccttgccttcgattgctaatgtttttttaatatttttggcataatgttttttctgaattttttaaaatcctttctcttttatgggtctttttgcttccgctttaaagcgttttaagctttaaccgttcactggttcaatctttacaatctttgccagattgggattaattgggattttaatggagcgtcaacgcacttcttccgaaaggtcaatttcgagtgccgattcgtgggaattggtaaagattgacgaccgtgaaaaggtgaattttctcctcctctgataaacgaatcattatccaattaaaatggatattaagcaattgtaaaactttgtgaattccttgtcattttaggaagaa

SEQ ID NO: 15459 - DNA, 1060 bp, Heterodera glycines
tttcaagttaaaacattaaaaacaacataaataaatgcgttcttaaattattcattaaattttcaacttataccattataaaaataattaaaattaccaatcaattaaatatttaccaaattttttattttattctatttaaaaaacaaatattttaaatatgtttaattcggtaattgtgtagaattatggaccccggcgaaaaataaatttaaaaaactggtccttatttgttaggggtcatttgaaatggggtctggggttcgagcccgcttggttgcaattattttttttaggatacttgatgaaaaaccatagacgaaaacattgattttccgaaatctgatttcaaattcataatcagcgcattttttcaccctaggaaaaattaaaataaattttttaaatttattttcgttcgggacaacaatttacacaattgcctttaattcattcatcgtaattttcaagttataaacatttaaaaatgtgcataattttttttttcaattaaatcaccagtattatattactttataaaaaataaaattttctttagaaaataaataatacatttttaaatttgtattttaaatttgtaaaggtaccgcggcgattgtttgaaccaggccatctgcaaatgctcatgcgaggcggacccatcaaaaccggcaaaaaatgtgtgcacaaagtccaactgcgactgcttgcgcatcaaggagtcgtgctcaaaggcgtgccaaatttaatttaaattattgccaaatttaatttaaattatttaaaaataattttttaaatttttttcagttatgcgcctgtaaacaaatttgcaagaacaaagagccgccaaaacgggcggcaaaagtgaacaaaccggcacaggggtgtgctttttatttttgggagtagctccttcccccacaacttagaaaaatttcagaaaaatcttagaaaatgtttgttttatttttttccaacgagtttttgtgaaaatttttgaaaaactttagtaattcttcataagatttattaaaaaaaagtcgctgggaaaattttc

SEQ ID NO: 15460 - DNA, 2889 bp, Heterodera glycines
aaatagcaaaataattatgaaagatcatttgtgaagaaaacaaaaataaagctaaaattattaatttcgaagaatattgagtaaaaatcgaaaactttccatattttcattatttttggcacaaaaattccaatcttatgaaataatacataatcgagaaaatatctaataattaagttgtttttttaggaatttaaacttctaataacaactcttttttttcacttaatttaatttcataatttcaaaaaaaaaattcgaaaagcatttttttaacagttgcaaatgcggcggagattgtgccaacggagcatcaaaattccatgtgcctaaacatgttcagaattgtttcctggaacataaacatgagagcaggtcaattgggaataattatttattttttaattcaaaaaattatattttagacagcaagtttttaaattccaaaaaaaataaaagaattttttcaaaaatattttgtgattttctctaaaaaggaaaactttttgaatttcaaaatgaaaagaatttttccacctggaaatttaatttaaaaaattataccccataaaagtggcctaattgtgacactaattggcgacggttacatttatcgtggcgactttttccatgactcaaagaatgagccgcatgtggaggagcaattagttgccgcaatttatgatctgatctccaagtacaaagtgagtagaaaatagtattagaagtcattaatatttaaaaaaaatttttctattaaattttgcccaaattttcaataaaattaattaccttttttgtgctacagtaattttcattttttttttacattttaattgccggaatttaattttgatttcaactgctaatcacccatcactcattactcaaatgttgatgtaaaattaattacaattttttatttttttgtaattttaatagtatagtttgatctatttttttaattttaatttgcatggccaacctatttttttacattttaattgcctgtcatcaattaattttttttaactgatacttccatccacaaattgaggttgattatttttactcgagttttgggtgtaaaataagctatcattttttggtattatgtgtatactaaaattttgtccatttttttatttattttaattttcaatggccaacctatttttatggcattaattgcctgaatttacttttaatttatcccataaattgaggttgatctgtacgaaattgtcatttttgtgtccaagagtccatgctttcaccaggattgtgagcccaaatgtgaggtggtggacgaatgcaaatgcaataaaggtgtttttttatatttattgactattttatgccttggaaaattcaaaaatacttcaagataaatttttaaaaaaactttttgcccgaattttatttttgatatattttcattttaatatgcccttgaaaaaacaatttcctgaaaaaaattcgagaaatttttcgcccccaatattaaatcattcaattttttggcgtttttaggattttttcaaaaatcttaagttttttagggtggtttttttttgtgttttttttgtctttaggtcagtgtatttttgcgaaattttttttgttgaaaaagccaacctaaaatcaattaagattttaatgaaaattaatttaaaaaaaacaattttacctaaattatttttcaagcttgtgctaaactgttgggattgcttttgtcaaaggtgcgcaaggagttgagcaaagtggatgtgcgaatgacagtcaaatttctgtgagttttaccatattccctaaaacagagccccgggggttttatttttcaaaatcttggaatggtggctttatttcatggggaactgtaattaagcatatacgagacatgtttgtatgattagttaaatatgagcattttaaaaattaaaatggatttgaaatcccaaaaatttcgaaaatccaaatttgcatgcctgtgcgaaatcctctacatattagctaaagataagcaaaaaacaaaaaaaaaaactaaaaacttatttaacatgcaaatttcacttttctaaattcccacgcattcctaattatcatttttttgacctaaaagagatggtttaaaaaaagttctaaatggctgaaataggcttataaataggatttaaatgctaaaaaaaaataatcacataatttaatttaattttaaataattcttttgtaaaggtatccgcatttgaaccgtggtgatctgtacaccaaacagggcattttgtccatgttacagtcaggcatcaaagtggaaccactgttgttgaaggtggtttttgaaaaattttttgggaagttcttgatgtcatatttttgtaaatttaatacattaattgtctgcaaatcttgtaatagatggtcattttatgtttttttttttttgaaaaaaattacattttttttgtatttgtccaaatctttgttatttaaaaaattaaaaaataaatcgaaaacttggaaaattgcaaatataatttttttgggttttcagctttttcttgcaaattttcattttaaaaatttaacgaaaaaataagttttttaattaaaaaattacaaaattcattgtacgaactgtcattgctcctccctcccggttatggggctaaaaaagttttttttttcaaatttttaaatttcaattaattacactaattaatcacataaattaattaaaggattggagtgccgtcatggattgggcaccacatccagaacataagggcgaatatttgcaggtagtgtataactatctatctattcttgtatttgttgtaattacattcattcatcattattcaaataggggtatttaaaaattctataaaa

SEQ ID NO: 15461 - DNA, 1674 bp, Heterodera glycines
ttattttaggaaacaaaaattgatggttataaatgagaaaaaaatgaaatatttatccgacgcatttaaaaaaaaatatttaaaaattccatttgtaaatcacataaattggcaaatcatttttttcattaaatatcgaaaaatcagtcgaaaaaattaaaatattttaaggctcaaagatttgaaccaaatggtggacaaaaataattaaaaatattgatgataaatttgttttcatttattggaatttattagtcttcaaaatgtttacgagaaaaaagggaatttatgcgcacatttgttgcacttattattattattattatttttttttactgacgcaaatgaaaattagtcgatttagtccaattttattccatttcgattatgtaattatatttatttatttttaatcaggtcatttattaaacttaattaatatatttaaaaaagtataaaatacacaaataaaaaataatacaataattaatacttttaattaaattaaaatattgttgactcattattattaaaaaacgcatttaaaacaaaataaattgtatattaatttaaaaatatttccagagtaaaaattggaaatgaatacgtttcttttctcttaaataagagctccgtttaatgcgtagatgcttttattgtaagagtcgtgactgatcaaaggtcaaaaggaaatggaaaggggcggggaaaatggcaaaaagtgatcggaagtgaaaagtgatcaggatcattgtaaaatggaaaacatgggctgatcagggaggcgtgaaaataaaaaaaaagatatgggccaagggacaaaaaaaacgggcgaaatggccagcaatttgcgcaattgcgaacaaattttggggggagcgtgacgaaattcaattgaaattcgaagctaaaattaaaagttgggcgaaattcgatcggattttgggttgatcaaaagttggccagaaaagcgttaacaatcagatcagttttaggttaaagaagggaaacttttgaatatttgtgagtgaaattgggcaaacattaaaaatcgtaaaaataaaaataaaaatcgtacaaattaatttaaaaatatttttagaaaatttttggtttgggtttgataaggagaagacagtctgtatatatcataacatttttaatgacgttcagctgactaaatagtgataaatttcttcccactcgttttctctctttcacttaaatactctctctgaattaattttaaaaattttttggccattaaatgctcaattagtatggcctactgaaatcgatttaatttctgctgcccaattttgcattaatcatcatcacacagaaaacaaaatataaaacttaaagcgtattttaaaatgaatcattaattttattcatctctgctgctgaatcaacccctctatctatagaaaattcaaatagaatcgcttttttacaattttcctttttaaaaaaacgacacgcgattaaaaattgactaatttagtaaaattaaatgttttataaatttcatttttgaaatctatttttatcaataagaagattaaagttaaaaaacaagaagttattatacaatgcatctccctaaaaatgaaaatcttgaataaataaattatttcctactttttttatattaaaaattcttaaaaaacg

SEQ ID NO: 15462 - DNA, 1776 bp, Heterodera glycines
tccccctcacccactcaaattcccccccccccctaatggctcaattagtctcccgccctatgccacgcaattagcaacagcctttttgtcttccgtcccgcccctctcataatttttcaatttttcatcgctttttccgccgccgctcgaaattggttctaaactgatctttctacgtatcacttgcatatgacgcggtggttcctcacacgtttggaacagtgcgctgctgcggtggcgcatcccaaaaaatggaaatgacgcgaccgacggtcgtcgcattaattagtgattaatgatgagttaaaatttggtgaccatccgcggtagaggggggaagtgactgatcaagggcaaagtttatgatcaaatttgggatcaattacagtgacaagaacaatcaatcaatcaaaaaaacaatcaaacaaaggagttgagccaaattgggtccatttaatgatagtggaattgtgctattatttataaaaagcgcactataatcgctttcgtaaattcgccattttacatagtttcccaagtaaaaattgccataagcaactagataaaacaaattcaaatggtccgatagaggagctataagtctagaaattttaaaaatattgtttatttccaaagaaattatattcatttttttctggtttgattacaattttttaaatttattttcttgaaaaaatttaaaaggctaatagagccatcgtcaactggtctcatttcttctgagaaaagtctgtaaaatggtggatctatgaaacacttatggtggtagttttttatgaaatgacccggcatgaattgaatgccaaagatagaagagtttgatagagtcgagatagattccaaagctattgcaagtttaaagtttaaataggtaacaatttcaactaaaaataaaacctcaaaatttggagttcaggaaaatatttaaaatgatttctgtggcgtcaaaaaaatttcctataattaccaatcatttccccatttgctgttatgcagaactgctgaaatatgtacgactggtgctgttttggtcatccaatccatccacagtcaatggtttggcctattaggggggcggcgggggccttattaattcagcacaagcgggcagcggtcggttacattactccgattgcgattggcggggagcggggagaggcggtgggcacacagtttttcgtcccttttttatcttctgattgcccataataagtagaaattaatccaccacaaattatgcacgccaaaaagcacatcgacgggcgggcgggaagaagaaaaagcggaaaaagcagaagcatcggtgagcagccgccgccgccgatcatccgccgtccaaccagtcggtcgttctccatgatttgtcgttgttcagttatgcggtcggtcagtaatcagcggctactaccgccgattggattgaaaaggaatgaataaatgaatacgcattcaatcgggggggggatgctaatgggggagagcagctaattggttggatgggaggggaggggatgaatgaatggcacttgctaacaataagctcggagatgaacatataaagttagacgacgcaaaatctctgtgtgaccagcagagtgcagcaggacgaaatgatttttttggattggaaaatagggattctcccgaatttttatgaaaaaaaggaatcgaaaagactaaatttttgcatggctggaaagaaatgaattttattgaaatgacttatctaataaaatcaaaacccaatgatcaaaa

SEQ ID NO: 15463 - DNA, 837 bp, Heterodera glycines
aatttctggtaaatgaagggaccaatggtaccttgagtttacaatttggaaagcattattttttttcatcctaaaaattaaaaaaaaaatttttttttgctcttttcagcgtgcattcgcttcttcgcctatctgtgcaccaccgatgacaacgcattgaccaaatttcccaaattcacggccgatgttttcgacgcggtgttcaggtggaaaggcgaccgatcacacaatttgtttttttcccaaaaacctccaccaatcgtttggtagtctttctttttaaataattagccatccaaaacgattcataaataattagccatccaaaacgattcactctgtcggctggtccgaacccatgacaaattaaaattagggcgcaaaagtccatcattaactaaaaagggaatcaaattttattttcttggccacagatttgatgcattcgacgtcacgcgtcgtcagttggccttcgaaacgttggcagtgatcagttcgaccagcggggccaagcagatattctcgcagaacgaaagtccgttttttggatcaattggactttttcttctagctcactactaatggtttcggtccttttatacttcccaaactttcagctctctacaacatgcaacgggcgatgagcaatttggctgtggcggtggcaacggccgccgagccgtcgctgaaggcgcgtcatttggaagcagttcggatgttttttgatcggattgccgacgaaagcggttgccaacccgaacagaaagttaggccaatctatttgtatatggtttaattttttgtgggggctaaactcaaaaactgtcccctcccctc

SEQ ID NO: 15464 - DNA, 1088 bp, Heterodera glycines
gggggggggggatgccattgaatgcatggcataatcagaacggagggggctataatcccttgctccaaaaccgggaatattctctcggtgtgcgagtaaaatacaaaaaaatggtgcaaaccattccctaacaaataaagagtttcagacggacgcgggactgaaatgtccaattcctaagcggactcatttgtctgttgcctttgttttttgaacatttcattttaagggatcccatctccgaagttcagttggccgctctccgcgtgctgatggcactgacgcgccaccaatgggcgtatgcccatttttgtgccataactgagtgagtggggttttttgcccacctttagttacaggcccgtaaccagaaaaagattttttgttttgtgtaatttcctaaatttttggtgtcgatggcaaaacgggaaattattagccattttcgccaaattttggccatttttaagacaaagttagggctttgatctattcgcaattataaattttttaactatcgcttttcaaaatgtttctgttgccaatttcaaaccccttttccctccatttcttttcagtttcgtcaatttgctggtcgaccgttccgtcaatttcgacgccgacgcgatgcagctcaaatacgcgctcatttgtcgcttggttgaggccgcgccgtccgcgctgaacgacggacagatggaaatgctgcgcgactattgcacgaaagggcctttttggggggcgccggtggtggaagtcgcgacggaagaggcggcataaatgaaaaggaacgaatggatggacaaagaggcggagatgatttcacaaataaaatgatgtgttaattggaaaccataattatatttcgaatttaaatgaaccattcattggaatttccatataaaaaaattgattttttctctaaattttccaaaatttttttttaaattttgcgatttttttgggcgaaactccatttatgctggtcgcttatggaatggagttaagcaattcaatcgaaccaatggcaccagaaaagaatccatcctttccccattttttgctggacgagtggaaattggacgaca

SEQ ID NO: 15465 - DNA, 1409 bp, Heterodera glycines
gtcgtcgaaaataaaaaaattcaaaattcgctttttgtttctaaaatagattaaaacaagcaaaattaactagaaaccattgcaacaccagaaaatgatcattctacacagattctaacataaaagttaattttgaaatttcgactttttgttcgaattcgggtacggtgttcaaaataggtcgaaattgatgccggattcatgatcagcgaccctggaaagccatggaaacatgttttcatgacttttgaaaaaaaaaaaattttcatcaaaaaggggggcaaccatcggcagtattaccaaaccggggaattaaaatcatgcaccaaataaaggagggttaaaaatttttggatttttttcagagattttgcataatagacatgaattttggtgaatagttaatttaaactttttattcgcatccgggtttggttcgaatagggccgaataagtgccaaaatcggtcatccctaccctgaaaacccctaaaacaatattccaaaaaaaaaatcgagacagtcctgccccatttggttttgcaaaatttttttaaaatttattttcaaggcctccccccgttgggttttcctaactctaagaaaatgctaacttttgtgtccaccctcacccatcacgtgaaattaaccaaccttgttgaattcgcgccactgggcctgcaatgctttgttcttttggcccgggtccggcgccaccgatgagaacactgaacggccaaacttcggttggcgctccaaacggcgcaccgtttccaccaattcctcatccgagcgggcggtgcacaactcggggtcgaattcgtactgaaatagttggttggcctatggataacaaaaatgaaaaaaaaaattttctttccgtgtctgagttcaaaagtcatcggaatcacattcgggaatttgacttttgaatccaaattttgaaattctgcccaaaaaattttttcgcatccgagacctgctgaatggaatcaatcggacggaatcccatttgggggttttatgatttttcaaatccgttttttttgttataaatccgccccttttattacgccgatttcccaactttttttgttcacctcgccggtggcacagttgatcacgatcccattgctcggttcgctgcgaactctctgctcaatcttgccgatgttgaacatgtagcggctgaagatctcacccaagccatcgggaacggatgaaatttgctaaatgattggattttttgaaaaattggaaaagtgcaatttactgtggaatcctttttctttaacggggcacgttttgggggcctcattttgcagaatttcaatcggaaaatttgactaaaaacttaaaataatagaatatcatattctactttgtttatggatggtacattattgaaga

SEQ ID NO: 15466 - DNA, 927 bp, Heterodera glycines
  misc_feature (89)..(89): n is a, c, g, or t
  misc_feature (920)..(921): n is a, c, g, or t
atcaaaaattatttttttcattttaaggcatcttaaaattgttgatcactggcgcaagcgaatcaatcacagatgaagcggcaaaatgnccagcaaagagccgggctttctctattacactgccggtcctaaaaaaattttaattgcaaaaaaagttttccgcttttcataaaggtgttcatccgcatgacgcaaaagatttcgatgacggacgaacgttggatttccttcgctctcatttgaccacaaattcgcaatgtgtcgcggtcggcgaatgcgggttggacttcaacagaaatttctcgccacgggaccagcaacttcgggttttcgaggcccaggtttttttttttggcgtttttaaatgcaatttcatacacacaaattccagtgttttccattcttttaaattttttatattcaaaaatcgtgaaaatgtttttccgtggggctttgacattcattttatccaattcccaactgatttcaaaacaaacatcgaaaaattatttttcctttttgttagtgctatttttgtttgcgttggcttttccaggtccaattggcatgtgagcttggcaaaccgttgtttgtccatgaacgtgaagcgcaccaagaaatggtggccattttaagtcgccacagcaaatcgttgccgcccaccgttatccattgtttcactgggacagaaatggaggccaagcagtacatggacatgggactgtacatcggactaacgggtacgagaaaacctttttggattatgaattttaaaattgtagttgccagaattagccaaaataaatgatccatagaagaaaaaaatttttttttaattccaaggcctttctaggactaacaaaccaggaatccatggattgtgctggctgtttaaacctgtattactgcccgaatcccgnngactct

SEQ ID NO: 15467 - DNA, 2827 bp, Heterodera glycines
catgctttcatctagagtgcagcgggaccgggaaatttgggcaagaccgggaccgggactttttgggttgaaaaaccgggaaaaaagccgggaatttcccggtcaaaactggtcaaaaccgggaccttggtactcagttgttctcagttgcccgtgttcaggtcccggtcccgctgcactctactttcatcatatttctccaatttgctttagtggacctcgccggttgtgcggggatgcgcctgccggcaacggataagcagggtcacacaatcatttgcgccggggctggctacccatcgcctaccgcggcatgtccgtccggctatcggtgcacaatgttggcgcacatggggtacggtagtggaatttcaatacgataacgaggagaaaattgaattttgcataagttagtcaagttccaattttgggttgattttaagaattgaatgtttttaaggaaaaaattccacacgtttcgataggcaatagagaaaattttggaattttagagaaatttattttgaaaattttttttgtaccttgccaattcgacagtcttttgaacattttgttcatttttagagtttgctgtcattcagcgacgcaaggtttgttatttccatgtttattctttccacttttctgaatgaaaatacgcaagtcaaatcagggataggcgccgcctggaaaatacgaaatacccaaattaaggtgtagctttaacaaaacaaattaaaaataattaaatctgattattaattgctaaataaatcgaaatacgggtagccctttaaataaaaaatagaaaatttttttataaaaataatcttacaagaaatcgtctcgaaaaataatccaaaagtcaaattacggatcaaaattgcggaaaaatcccaaaaatccgtaatccgcaactccaaaaaccccgcaatttccgtaatccgcaatggcgcccagccctgctaggatcagtacttaatgcatcaattcttgtcttttttctgattagaatgcatcatcaatttatataattaaatttattaaaaaatgccaaaaattattaaagttactaaggattttcctgtttgccagagaaaggaattcagaaccgaacctgaaaactctcttgatgaaatagattatcatcagcagaatttaacaagtttcgcaccgcttcgcattgcaataaaaatttcagatttgtatgaggccaactatcggcccacttgcccaaacggtggccaagcacttcaaatgcaaacgcgaggagtgccaatgactctgatcggtaaaaaatgcgcggacaatttttgcccgaccggcacaaaatgcgtggagaaggaagtgtacgcgcactgctgctaaaacagcattgattggctaattaatgaaaggaaaataataattaatttgtttttttttaaattccaaatttttgtttcaaagataaaatgatcacagcaaattaataaaaatagcacaaaatggcatttcatctaaatattcgaaatgacaattggaatgcttttcctcacattattaattttgttttatataaacagtttaaaatatttctctgtgtaaatgattgagtattttctatttaatggacaaaaaataacaaaagtctaataaaattgaattttctgaatttattgattttaaaaaagtaccaatttttcaaaggtaccggtaaaagctttgaatttctgagtcacaaaatttctggaatttttttaaataattcaacaattttcgttaaagctgcctattattttaaaattccaaaagattcgatgagaatttttctattgtttaataaattgacaatctcttaaatttttttgcttttaaattgctttttgatcaaagctttggttaaatttgcggttttaggctgtttaaaaaaagaaaaaataataaattttaataaatgctttaaatgaaataaataatttaattttttttcttaaaatttctccttctccatcaatttccttctctaatttctcacccagacccccatgttaccagtgcttaattagtcccgccgggaccgggacttgaaaaaccgggaattcccgacccggtcccgctcagctctaatataaatcgctctcgaattttggaatttcattcttcgtttttattttggtaggtgagcaattccccttttcatgttgttaataatacctcttattaaatgtattaaaattaattcatataattaccatgttttccaattctaacatctcaaacccaaccaatgcgccatcgtcggaaaatgccttcatgccatactttcccattccgtctttggcaccggaaatgcgctccttcaaaagtgctcgcttcaaaaacaaaatatatttcttcatgaccgaattctctaattttatgaaaatacatatttttttcctggattctctatgctctaaatagtaggaaaatcaatttcttcttttttttgtgttttgtgaacaagaatcgggacttttatttacatattcggagtttttatacataatttacatatttcgtgattttatacatatttggtacatattggatattttgaagatttttatataaatttttggaaatcctcaaaagtaattcaaaatttcggcaaattttcatttttttaattgtacccctaaaaacggtaaaaaagagatatcaaaaattaatttttaaaatattaaaaaatttgattctaggcctacttaggtcatttttatgcaattttatgcctacacatatttcgggattttttttacatatttatgtacatattttggccactttttgtacatatttttga

SEQ ID NO: 15468 - DNA, 1152 bp, Heterodera glycines
tcatttctttgctgtcattttttgtgtaattttaaagaattaatgctttttatttagaatttctatcttcaaaaggaaaaaagttattccagagacttggaaaatttcgatttttcaaaaaattcataacacccttccgaataagtctttgtaaaataaaaatactaaaaaaattggcatctgtgaaaaattgctttaatttatttataaaaagagtgttcactaacttcatgtccaactacaaataaatatcaaaaataataataatcttctcaattcatcatctaatttcaagcaatgttattcggttcagcattcattgggtgtgtgagccggccaatccaggcatagaaatcacactttccgagttgggcacattttgaacatggacaccttaagagattaaatggatttgattattcctttcttaattgactttacccttgggaccgttgattggcacttggccaatgctaatgccaaactctgcacatttcgagtcaatctcagtgactttctgaccaaactgcccactcaatgtctgccattcgctgttgttgctggcatgagaagaagcagaggcggcaatggcgaacatggcacggacgaagccgaggctaagggcacactcatctaaaagggggaagagatatttaaaatgatttaaaaataaataaataattattaggcaattgtccattaattggttattaccagcagaatgagtggcaagggatgcttcgatttcggccaaaagagttcgatcaccgccattcgagcagccgatcagttggcctttcaacgcgtccgcaacattttgggcatccgagaaaggaactgatcaaacagcaaaatgtgagagaatatcacattgatcagctgctgcttgatcaacaacacgctgtagctgatcaccagccgcaacagcaaccgttggcggtgatggagcaaggcgaatcatcggcaattaaagaaattgttgctgttggagaagacggagcagggaaaaaggtaaaagaattcaacaacttgttcagttgagctatagaagcgcgtcgttgagcagcggaagtgttggctaaaggacctttttgggcgtaggagccaattagagttggggacaaattactgaagcttcggggttctccatat

SEQ ID NO: 15469 - DNA, 3665 bp, Heterodera glycines
  misc_feature (3476)..(3476): n is a, c, g, or t
cttcaaaattgccggaaaattgtcgcggtgcacaagatcgatggatgtgcacttcttcattgagaacgggttcgcactttttgtgatgtggtgagcaccacattgcaaagtgcaccattttccttaacatttttaccataaaattgaaaaagcaaaaatagttcaaaagttttacgagcgaattgtgcgagtcgaccaaaattcgggagcagaaaatgcgcccagatttgccgaagcaaatatatcgggcgaactcattgaaaaagcccgggtcacacagctcattgttattgaaacggaaatgcaggtagagctgtccgtctgacatccattcttttgcactgatcatgtcaaagttgagagcaagccgtttctgaattgacaaattaaaaataaacaaaattaaattaaattattattacaatttgggtgaagtttaggtgacgcttggcccgaaatatttccataattcgattaaccactgcgataccggatggtggacggccttaaattttgcgaaaaatttgaaatttaaatttttttttttttcccacttggcttgggtgttaccccgccaaataagcacattatgggcagtgagtagataatttcgaagagaagctcggctggtaatcgcttgggcatcatattggtcatgaaatttgaatgaatgaatgaagagtgaattaaaatatttttgtgcccggttctcatgggctcattaattattcaatagttaatattgacttcaaaagacatttgaatttgccgacaatagtgaaggagataacttcaaaggaaatttgaatttgccgacaataaggaaagagagttcgagaaaattaattggtattcggatggggacaccccgcccctaggcttcataaatactcagccaaatcacatttcattcatatctgctcatgtttttttactcactttaataataataataaaatttgtaaaaataattaaattataataaaatttttattttctgctgttaaccagagcggttgcccaattattgggctccgtttatcctggcagcacttgtgtgtcttttagggcttggggttgtgcgcgtgacctttactaattatccgagccgtttaggtgccctgtcgtcttgtgcttcatgggtggcagtgtgctgctcttcagggcatagttggtttaaaaaatctttaaattattattattattatccattaatttgcattcacaacgacaatttccatgcctcaaaaattcgcggccgttgcggaggagggagtgttagcggtgctgggggaggcgccgggtgtgaacaatcgcatcaattcattcatacggttgctcaacgcgttttgttcctccaaaaattgacgcgtttcctccggcagcacacgacgcacacaaatgctttaaaaaacaagaaaataactattaaaagggtcacatacattagtgttcgatattttgaaaaaagcatgggcctgtattttcatgacaaaatccagccggaaattgatgcactacgtttgcacccgccggtttcccctccgcccataccaataagtcccccgcccgaatttttcaatgcttttttttaaattttttaacaatcgctataaaattttcaatgaaatttcttatagggggttaatttttaaagggtcggaattgaattttgctatttattgtatctaagtatttaaaattaaattttaaaatggtatctttaccccggtttcaatggctcccgattaagacgagtttgacgaatttcgacaaatgcgcgccgaacaatggaagcgtattcgcaccgagccatcagttgttcaaattttaaattttggtcaggatggatgtccatgaagttgtacaagtcctcgacagcctgcaatcaaattttccgttttttgtttgctatttttgtttaaatttttcacataaaaattcattttcattcaccccattgaaaatgtcgccagaaattcggctgaatattgacgacagttcatcatcaccgcccatttttggttgattattctgattttgggcagctccgcctgcgccaccgtcctgccgtttctcttccatcgcttttcggcccaccgttcggatacatcgccgcacataactcaccaattgggaactttcgggaaacggatacagatagttgagcatctaacaaaaagcaaaatccatttagaaaggctgcaataagtatagtatatgcacacccctacaaaaaaattaaaaatttttagtcgaaaataataggaaaaaataaaataaaaacctctttttaaaccaaaagttaataaaattcttaataaaatttacagtgtttttccctaaaagtgacaaacgtaccgcatatttttggttgatgaccaaacgctgtaaaaaaatgcacaacaatttggacgtgtccttcactgtgtcagaaatttggttggtttgtccatcggcaacataaaaacgcgaataatactcgtggattgggtgcagcacagtcagaatgtcaacctaaaaagaaaacttttgtttacaaaaaaaaactatttaataaactttttcaatcctggtcggctcaacaattgcgtcagtgaatttggtgagacatttgcggaccaacgatgacaattgaccgccaggatcagaggcctggtatttcatgaccaatttcatcagcgccacaaaacacacattcggatttgtgaattcgcacagtcgaatcacaataatgttgagagaacggaatacctataaaaaatgattgaaacattaaaaaaaagccaaatcaattttaaaaaatcacctgtttgttaagtattttaagacgctgatcgctgaccaacgaaagaagtgaatcaatgaatgaacgcaaagtgtccgtacttatccgttgcataatggtcatttcgttagtcagctaaaagggattgaattagtggcattgttatgaaatccgtttgatggcatttcactaacagtgctaagaaagttgcaaatggaacgcataaattcactaagctcctgctctttttggtccccttccttcactccgtccaattgttcaagatgttggcttcgaatgtgaaagatttgcgtgaccatctaaaaaaataaaataaaattcccacttttcgaaaaaatgaaagaccgtcttaagaatgagttcggttctgtcaataatatactgccgtgttgtctggtcgttcatcagatgaagtaactgaaagggcgcagtcaaatttgcaaaatcccaaaaaaaacaatttttttttgaaattttacctgggctaacgcctcctcggcaatgttaagctgaagacaggaaatgttgtgcacagttcggtcaatgtgttccgcactttccagcgaagaaattgaagacactgactcactacgacgcgaaaaagtgctggttgggcgcacaactggtttctgaaaaaatcggaaaacattcaaccaattctcatggnggaacgggtcacaaattcttggtattataaaaattggttagttattgcatttgttgacaattttagtaatagcattttaaatgcgtaagagtggggctatgggtttctcatttctttttattagatggctcatctcatatttctgatcagatctacatcaaaaattttgatttttttttatatttttgg

SEQ ID NO: 15470 - DNA, 2992 bp, Heterodera glycines
  misc_feature (21)..(21): n is a, c, g, or t
  misc_feature (2928)..(2928): n is a, c, g, or t
  misc_feature (2959)..(2959): n is a, c, g, or t
ataaccgcattccaacgcctnttgccttaaaaacgtcaccattttctttaaaagttttccctataaattcttaccaattcaacgctagtatatgtcgccacgtgtctccgctgtgcctcatcatgtgggcacttgtagttacatctcgtagtctccttcttaaattttgacgcacatctccaacatagcggaaacaataatcgttcatcacacttcagctgcaaaaccggaatccgcaaccccttcggcgggttgaccctcactttatacaatcccttatacttcaaatcctctggtctcgtccaattaacatcaatctcatcgctcttcggtataataatctgcggcaatccaattgggtaagctgtaccgtaattcactgacggatacagactcacaatatcataaacactaatttttttcttctcatccgattttgcatacaatttcatcggcccagtcctccctcccgcataagccatccgcggatcaatcggccctttctcattccctctgtcgtcgaagaagtcccgcatctcttcatcctttttcagctccttctcaatttgacagccctaaaaattcacaataaaaatgtaaatgtcaaataaacttacccaaacttcttcgacgtccaaagtcttccgcagctccgtcaatctctcctgcgtctcatcattcaattcctgggccgaccttcctccaatcagttccgctgccgggtcataacagttcatacatccatgtatatagcatcccataacttcaatgcatttgtcgcgccctcccacattcgtaataaatccatccaatttgtaattcccaattttgacctcccgtccgttccccgcgtgccgtatctcaattccatcccgcttgctccgccactccaaatactttattgccatcacactggcgcgatcacaccgctcatatcccttctccggcacaatcgataactgctccgtcaataaaaacattgccttaaaaatattcatcgcaaccccctgcttcgtacaactcctcggcaaggggtcaaatcccttagtaatgtcgttaatcaatatccttctaaactcaataattgacagcaataaaatctccgtgtcgtttcggcaataattttttcaattcatcatccaaataaaaaggtgtctccttgttttcgttgtacctgaaaaaattatttattgttaattttatccttcttttcttaccatttttcgaattttataaatttatccttgttcatagatcccggcgaatagtcctccatcggtggcagatgttccaatcgtattccataattttctttcttgttgtaataataggggaaaaagggcttgtcctcacagtctaaattaaatgtcgccttcagcgactcaagcttcaccggcatcaataaacatgagtctctccaaatcagctttgaatgtttcttcgagttttgcactttaaattcataaattttcaatccattgatgagcggtagcgggttcttcccggtacggcagaggtaattaaaaacaaaatgacctaaaaatttaggatttaaaaattaaattttgaaattaccgtcaaaacgtccggcgttatgtgcaaatatgtacgtatcataatttgtaaaggccgttaaaatccactccacaaaatccttggtcggctcatgtccctcctccacctcgctccaatccttgatcctctcctccccacaaattttgcaattcgtcctgtttttgtcatcacagcattccgtacacgtcactctcaccgaaatataattaataacatgctccttctggtcccccttgtaaatagaatcctgcgaagtctccgaatcctggagttaaagacttatttttgttgattttatttgtagaacttacccaaactacaattctgtagacatctttttcctccttctcctcgatcggcataatataacacccccgcttggggtcatggctcacactacaaagctggcaataagtctcaccgcattcatgtcccttcttcgtgttaaataaatatgtcttatcacagatcacacaacgcttccataatttgcaagtctgatgtccctgatgataattataacactcccaattgtaaaagtaacggtgacactttgggcattcaatcttcactccactctccttttcacatggcattccccccactctattgcaataataacaccttgcccggcactcgaaagtatgtttgacatccttgtcaaaaaagcactcacaatcaatacaaaattttctcccacgattaaaaaaacagacgtaattcttcagaccatcccagtgaccattctccaaaaatatcggtacgaccttctctcgtcccataggggccttccacaaaacacagatcgatttccgcggatcagctgacttctcaaacgcaacaacccggtactttccggggtaaatctcatcctgaaaaattggtcatttctatgtttttcaccgtttttaaacccacccaatatttctgaacattcggcaattgctccacaccatagctatattcgttaatatcaattccacaattatgtaaaagctcaatagctgcgtccctctgtctcataatattgttcataaatcgattaaaaatgtttcgatgcacttccaaataaagctttgacgccaccaaagcataaaacaaacaaaatttatccgcatttgtaatccttaataaaattattattatttccatttattttttctttattatttaatttattttttaaaattttttttctgtttttttttttgctgctttgcttaattaaaaataattatttctttttttctttactttaattattatttaattaatttattttattttattttattttttatttatttattttattttaaaaatttaatttttatttattttttggctcattanaattatattttttaatatttttaatttattntttcggtttttttgttgctttttttcatttttt

SEQ ID NO: 15471 - DNA, 1168 bp, Heterodera glycines
tttcttattactcgaaaacattgacagagagagattccctttattttgccaaaaacattgccaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcagatattaccaatgtttgcgcttgtttcttattactcgaaaacattgacagagagagattcccaacatttgccaaaaacattgccaggcgcataccaaaaacaggcggaatgttttgggctaatgtttgggcatctctatcccggtttttagcgttttagccgatgttcggcaatgtttgtgtctgtttctggtagtgtatttgtcaatgtttcggaatgttctgcccatgtttttgtttcatattttctggatgatttagcaaatattgccaatgtttgcgcctgtttcttataactcgaaaactaactcgaaaatattgacagagagagattcccaacatttgccaaaaacattgccaaaacaggcgcataccaaaaacaggcggaatgttttgggcatctctatcctggtttttagcgttttagccgatgttcggcaatgtttgtgtctgtttctggtagtgtatttgtcaatgtttgggaatgttctgtccatgtttttgtttcatattttctggatgatttagcagatattaccaatgtttgcgcctgtttcttattactcgaaaacattgacagagagagattcccaacatttgccaaaaacattgccaaacaggcgcataccaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgttttcgtttcatattttctggatgatttagcaaatattgccaatgtttgcgcctgtttcttataactcgaaaactaagtcgaaaatattgacagagagagattccaacatttgccaaaaacattgccaaacaggcgcataccaaaacagggggaatgttttgggct

SEQ ID NO: 15472 - DNA, 1473 bp, Heterodera glycines
  misc_feature (52)..(52): n is a, c, g, or t
ttgggcatctctatccggtttttagcgtttagccgatgttcggcaatgttgntgtctgtttctggtagtgtatttgtcaatgtttgggaatgttctgtccatgtttttgtttcatattttctggatgatttagcagatattaccaatgtttgcgcctgtttcttattactcgaaaacattgacagagagagattcccaacatttgccaaaaacattgccaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttttattttctggatgatttagcaaatattgccaatgtttgctcctgtttcttataactcgaaaacattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttcggaatgttctgcccatgtttttgtttcatatttctggatgatttagcaaatattgacattgccaaaacaggcgcataccaaaaacaggcggaatgttttgggcatctctatcctggtttttagcgttttagccgatgttcggcaatgtttgtgtctgtttctggtagtgtatttgtcaatgtttgggaatgttctgtccatgtttttgtttcatattttctggatgatttagcaaatattgccaatgtttgctcctgtttcttataactcgaaaacattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttcggaatgttctgcccatgtttttgtttcatattttctggatgatttagcaaatattgccaatgtttgcgcctgtttcttataactcgaaaactaactcgaaaatattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcaaatattgccaatgtttgctcctgtttcttataactcgaaaacattgacagagagagattcccaacatttccaaaaacat

SEQ ID NO: 15473 - DNA, 1789 bp, Heterodera glycines
taataagaaaaggaatgaaagtgatggcccactaaatgaagccaaaatgggcgagaaccgttcatcaagcattagcagcatcaacagcaacttaattgatccaattaacagcaatttgagtgatctatccgattatgatgaccagccaatgttgatcccaaatgaatgggcaattaacatgctaatgtaattgggggatggattatttgatgaaaatgcttataaaatgaaatggaaatttacattgtttgagtaaaagcaaggttcacgttaactaaaaataagtaggatatgagtgttttaatatggagtcttccaatttttaaaacagtttgtgtccggcaatgccgatagcttcgccggaggaaattttgctgatttttaatagattttttcaccaaaagaggaaactttttaagaatttctgagctaaattttgagaaaatgatataaaaatgatagcaaatagtataaaacattcatattttggcattttttttttactcaaaagccatcaaaattcctaaaaatttattcaaaaaaacaaaatttcaatttttgagtctttttcatttataaggtaggaattgattaaaaaattgattttaatacatttgaaattgtttctaatattatcaacacagggacaattcgccttttgtgaatccttcgcaaagtttgaaacaaaatcaattcagttctaataatgaaaattttccgtcatcatcatcatcattatcattaccatcatcttcagaggcaccaaatattttgtatgaaaatgctaatgaaaataaaaatgaattgggatttttaaatgcaaattggccagttgtgcagcaaaaaacggccgataaaaacaatgattatgaaattcaaaaagaaaaacggcagaaattggaggagttacaaatggggaacggcgcattggacgagcagcaaattgaagcacagcgaggcttaaaacttttgtgtaatcaatttaataaaattaattattttttaatcatcttaaaggttaaaaaacaattatgcctccgggataattctggaaattttggccctgaaataattttttatgaattttttttttctattatttgttacaaatatttatttatttattttgaactctttatttttaagcaaataatttttgccttggatttactaattaggctttcggatttaaaatgaaaacttttaattcaaacctaacataattttcagtgcataatatatggtatattattatgctgagttttgccattttacaaatccaattggcgcccatcgaaacgaccatgcttcaagtgcagcaaggtgcaaaattcaacttttattatttgaatttggcattggagaaaatgaatgcggacaaaattttggaaaatatcggcactgaattggtgcaggacaaaatgatccaaaataacaaattgtttatggatataattggagaaataaatgtgcatgcaaaaaaagtttttggtcaacaattatatgagtaaggatttgaaattatttttggaaaaataatttttgatctatttaaatttatttgttaaatacataaaaataaattaatattcacaaaaagaaaagaatatgctttttgtctgtccaatttgtttttacatttttagaataaaatctgttcagccaaataatactcaagttgaagccgaaacatttgaaagcaagaaattaaaagtgctttatttttacatgcaattatttcgaaaattaattggtcaattggaaactccgtataataaaaattacatca

SEQ ID NO: 15474 - DNA, 2611 bp, Heterodera glycines
  misc_feature (2452)..(2452): n is a, c, g, or t
  misc_feature (2473)..(2473): n is a, c, g, or t
  misc_feature (2494)..(2494): n is a, c, g, or t
  misc_feature (2521)..(2521): n is a, c, g, or t
  misc_feature (2523)..(2524): n is a, c, g, or t
  misc_feature (2537)..(2537): n is a, c, g, or t
  misc_feature (2559)..(2559): n is a, c, g, or t
  misc_feature (2567)..(2567): n is a, c, g, or t
  misc_feature (2571)..(2571): n is a, c, g, or t
aaaagaaatcattgtgttggcatattttggcgtccgacaaacattggcactgatttatgaacagcggcgagaaaatgttttaagcatgtcaaagcaaagtttggccgatttgttaaatgaaacgacaaaaaatgatttggcatgtttactgttgagccataaagaatcgctgaatttagagcaaattgtcaaaaacatttccatttcaaaaaacgagtaagggaaaggaaacccccaaaatttgggagcgtaaattgtaaacatttttatgatacgctaggttgattttcatagtaactatttaaattttataatgctaatgagcccataatggtacattttaagcaaaaatgccaaaatcggtagaccaaaaaataaacacataaattaaaaggggtgatttttcaaatgtttttgataagaaaacataaaaaataaataaaattaaatttaaaatttttccagcttcggagcttctgtatttttccataacatattaattcatatacatcaaaagcacatcaaccaatataaagagccaatttataaaataattactttcgcacatctttatcggctgatttttgagtattttgatggtatattcaataagatcaatggaccaatcatacaacaatatattgggttggactataaaataatgaaagaattttttgaaaaaagtaccaaacaattaaacggactaatagcacgagggaaaagtgacaaaccatttttatttgctttgaaggaatcggaagaagcatttatcagtgattatttgttggaaaattgcacgcatttaattgacgaacaaaacaattaaagaacagatgaaaaaaagatcaatcaaaaaaagcacagtgatctgttggcgttgtgtttttaggaatgatttttgaatttatataaaaggatttgcatcccaccttaacattttagaattccgttttgttcttatttagatttagtccgaaaatgagcattttgtttttgggtgtgaccaacagcaaaagcaattcgattgggtagcctaaagaatcgggggcgcaataaccagaaaatatttcggcggaggaatccccccaagccctgcggcaattttgccttttacattatgctaaaaaaatttgttagccaaattatgacctaattaaatttctgggctttgtggcgggctcagaggctctcactcctccaaatggaaccatacaaaaaataaacaattttatttaaaaggtcatttggaattaatttatgttagatgtaaattggtgtttatttagttattgggatttttttatttcaaataatttctttttaaaggttttaatgcatagctttcctaattcatactaatcgggtcacacacaacgaaaaatgcggcctgcggccacacacacacacaacagatgttggccggtcacactttcatttctcaatgattatgtaatcataaatatggccacaaaatgttgctgtgctttcatttatgttgatcattctcattggagcattaaaatattttttattggcactaaaattcagcaaaaaatcctcatgagcttcaataatttcccgtttttaacttcgtattttgcgaacaaaagcaattttgtatgtatagttttaaatacgcaaatattctcattaaacttataaaaaccacaaaataagacaatttttataaatccgaaccctttaaatatgctaattcttttttaaaatcacttcgggtcagatcacaaaatcactttcatgttcatattttgcattgattaaaaccaatttgcaaaataatcaaaaatagctacctacgaaaatttttaactaattttgcgtttcatagtttcgtcaaattagtaacaaaatgacgattatttatatgtttcagaaaatgttttcccaaatttttgtttttattttatttctggcaatgtgcaaatgccaaaatgtccgggtaaataatggcaatgcccgtgtggcacaaagccaacagatgttaggtggcaatggacagaaatttttcgtcatccaacgggacacaaacgcattggatggctcagcatcccaggttcaatccagcggaatgggaggaaatttggcggtaaggcatttttagaaatatcgtaaaatttatttattttttaatttaaataaatcttaaaaatataaaaagaaaacttagtaattcaaagcttttaaattaaatggatgccgaatttagatttttctaaaattaaaaaatgcgcaaatttgtgtgaccaaaacaaaattaataattgaatattaggaaaataaactaacaattatgacttttaaatattaaaatttaaaaaaatataattaatatctatcgccagcaaaacatgatgcagcctcagcagcaacaattttcacaaaattttgcaacaccaccgcaggcacaacaaactcaacaggcggttagaanaatcttatgcttaattgcatncagcatcgtttaaaatcttanaaaggggatcgtagcattgcaacaccngnncaacgttatcccntcacaaaacagaatggccatgnccaatcangttncaaaataggcaaaatctatctaaaacaaaatacttctttt

SEQ ID NO: 15475 - DNA, 1709 bp, Heterodera glycines
tttcctatttttccagcggtccccaatacattttgtctggcattttaaaaaacaaaatcatggtagtaattgtcagtgaattagcataattagcgactgaaaatggccaaaagtaccgagaaaacagtaaagataattgatgaattaattacccctttttaaaatagactgttttctcaagcatttcgtcatttgatttgtctgatctaatcattaaatcctggagataattttgggatccttcaaaaattcattggaataatttttgcaattattttttaattctgcttccgttcgtactattttaaaatcccgagtttattgttgtgctgcccataatcctttgaaaggcctagtcgaaaaccaattaggcgtgggttaaatttctgcttttttcggataattaaatttttagtccatttttaattgggccattttcgtcagaatattcctaattagtgtaaaattccaaagccataaacaatagcaggaaaaagcgatgttcaccggcaaatttgttgcattttattttcacagtggccacccaatacatattggagtggcattttaaaacaaagtcaatgcattaattgtcagttaattagcataattagtaatcgaaaatgacaaaaaatacgttataaacttccgctttttcggataataaattatttaattgttctttatagggcacttttcgtcagatcattcattcctaattactgtgaaatgcaaatataataaataatttgatgaaaaagcgatttgcatctgtaaatttgtggattttatttttcctatttttccagcggtccccaatacattttgttgggcattttaaaaaacaaaatcatggtattaattgtcagtgaattagcataattagcgactgaaaatggccaaaaggaccgagaaaacagtaaaaataattgatgaattaattacccctttttaaaatagactgttttctcaagcatttcgtcatttgatttgtctgatttaatcattaaatcctggagataattttcgggatccttcaaaaattcattggaataatttttgcaattattttttaattctgcttccgttcgtactattttaaaatcccgagtttattgttgtgctgcccataatcctttgaaaggcctagtcgaaaaccaattaggcgtgggttaaatttctgcttttttcggataattaaatttttagtccatttttaattgggccattttcgtcagaatattcctaattagtgtaaaattccaaagccataaacaatagcaggaaaaagcgatgttcaccggcaaatttgttgcattttattttcacagtcgccacccaatacatattggagtgcattttaaaacaaagtcgagtcctcaaatgtcgggtagccttttacacctttttaatacccaaaattattttttcaaaaacttcgagcttcgaaaacttcgggttttttgggttcggcttcgagtgttaagccgagcttcgcccatcctggttgggacccacgcgtttgggcgcgggcgtttgggccccagcatgtttttccattcatgtataacttttttggtaattgtctaattgcaaatcaatagcttagaaaaagcttctaaaaatcttaagctttcgaatgaattttttctatttttccagcggtccccaatacattttgttggggcattttaaaaaacaaaatcatg

SEQ ID NO: 15476 - DNA, 2746 bp, Heterodera glycines
  misc_feature (497)..(497): n is a, c, g, or t
  misc_feature (1457)..(1457): n is a, c, g, or t
  misc_feature (1499)..(1499): n is a, c, g, or t
ctctcattgcatattttgtttgtagacctctgagcacacttactacaacatgaccaccatcaatcacaaccaaaccgtgttcgacgcgacttacacggacgtggccaaacggatcagcgacggaggcgccgatgggaacacaaaccacgaacattcggacgaggcgtaccgaaaagcggctcgtaggttttcgaaattattttccgattttttatttacaatttttgacctttaaaatgtggtgtgtgcacacaattgtaaagtgcctaaaattggcgaacaattcactaaagaaatttaaacattccgatttcaactctttctcggcagggcgtccgtctgaagttcgaatttcccttctacggccatcggctggcgaatttaaccattgcaactggagggtttctgtacgtcggcgatcaggtcagcagctgagaatgaggggtaaggagaaggcgaatttggtccggcggtttagttttgatgaaattttgggncatttgggcccttccgccccccgtcttccccccccccccggcaactctttcaatcgctgttcacttttgcctccttttagacccattcttggcttgcggccacacagtgagtgccaatgccaattggctcttgaaactccttcctctttcttatccacacactcacaatcagatacattgcgccactgatggccaactttgatacgatggccgacaattcgagcatccaatacggcgacgacggcaaacggatggtggtcgagtggagaggggtcacactgagggacaacagagagggttagtcgggggggggggaaagtatgcggaccaaatccaataccaaaataacgggagggaattgacgggacaaggctaaactcgccgggacataacgtcctgcttgaattttttttatatattttaaaaaaataccctcatttcagccggtccttttactttccaagtgcatttgtggcgcaacggcaacatcactttcgtctacaaacaggtactccccggtccgactgatctgtgcattgtaaatgctgcaattttccgtttttaggtgcccgtccccgtgacgaacatttccggtcagttcaaccaatcggggcgctgccaaaatgtcgcacaaaaaaccctatattaaaagttttttctcccatttaataactcaaccccatccgccgcagatgctcaacacccgtgcaaattgggcatttcggatgcctatttgttcaaccacaaagtgtccacgctgtcccaggccgttccacaaaacaaacgcgtgatccacgaggtatattttcagcaaggagagtggttccacttcaaaatggaagcagttcgccccctcccctcaaaaaaacaatttttgtttttaattttgttagttttttttcgtctcgatgcaattcctaatgggttctctttcattggtttgagtttatttctcttttntagtaccaccggataaccattaatcctgaacaaatccgcccncaacaccgtcgtcatgcttaaagcattgccaagtgagtctctcactcgtatcatttgtccctaattccgttttttccaaatccatccttttccaactctcattttacttttccctcatcttcttcccaatgcgtcagcttgtctcgaggccaacagctgcgagcagtgcatagcaatgcaactgaaggcgttcaagtgttcgtggtgtaacccgaaggacagcggcaaagggccgtggaaagagggcggaacggcgacgggggaaagcgtgcgacagtcggagaagccgttctgttcaggtggggcggggtgaataaaggaaacaacaaccaatgcgcgggtttataccatacaaaaacgaagtgatggaaaaagtttcgtaaattgtttcgaattgatgggaaaagtgccattacgaaagaccaaaaaatttgcactttggtggaagttggtactgccggacaaatacgagagcaggagaaaacgttgccgggagataacgtcgccgcaaatttattaaaattttagaaaaattcaagaaaaaaaactcaattttatctaaccaattcgaaaaattttttcaagttttttttctgggaattttgcaaattttgtttttcagtaatacctaggtttcaaaaaaaacttaaaacaattttttaatgttgaaaaaatgtcgttatatcccgacgacgttttggtgtgtacccggcaatacataaaatttttggcaatttttaaaattaatcgcttcagaccaactgggactgaaccgacaacgccaggaatggattgagggcaattgccaaatgcacgaggagaaccagtactgcaaggcggacgaacccgtagccaactcttcggcgtcgtcgcccaccaccggctcatccgccgctggcacttctcatctcggagcagcggtggcccctcccaaagccgctgtggcgtccgacagcggagcattgccgaccggcacaccaacaacgacagaaaccccaccgtcgacgacagcaagcagtacaacgacgaaaggcaaggatttccaattcagtaacttgaaatattttcaaaaaaaatttttttcagccactgcgaatgaaaaacgaattgcggaggagggctccggcggtgggctggcgttcgtcaccatgttcatgctgctcggcatctccgtctccgtttggctgctgtacgcctacttcaacccccacaatgggtccggccaactgctgatcaaagtccgttcg

SEQ ID NO: 15477 - DNA, 1568 bp, Heterodera glycines
atgtcatgaaaaagggcattcatttcgagacaattccgaacgctaaacatgaatttgaacgaaaagtcgaaaattatgcaataaaagtcaaagtgtattatgatatagtatcaattttttccaaggtagttttgatcaaattttctaattttgttcgagttttaaatacgtgagcagcgattccgaaaacctctcggaatatttattaggcaattttcatgacatttttaaattttcaacatgggaagaagggaatccatctactatcattttggttcatttttacaatgatttgcatgacagaaaccatttaaatatcttacaatttttgagggtttgaggtttttttccttggatccttttagagttgttgtaaatttatccccgaatcatcaaatccatgttttcatccggaaatattttttgttaatcaacaatgtttcgctctttttaggccctttgtccgtccgcaaatccggcagcatcgtccccgcaccgtaccggtctgaacaactttctgcaaacacaggtgtaccgtcatcgcaaacgtgcccattccccgcaagactcgcattcatttgattttgtctcaaagcgtttcaaacgtttgtaaaagcatcccaactttagcccttcccctccccgtcactccccacaaaaatttttttttgttcccattttttaattgtttcaacggtttggcaaagcattgtaaaatgacatggacaaagactgactgatgtggaattgttttttacttttcataacacggtacgaatataataataatacatacatacatacattcaattagagcccgaaattaaaaaaaaaaacccccggaacccagaattccggtttatgggatggacccggacaggattttggattaaaaaacatggactccaggccctgttgttttaacatatatgaaccgaatcctacaggctcttggtcctacattcgggtccaacatttccactgaaaaggggttgaaaaaattggtgcctttaattactatgcaaattgatgagaagaaatgccagatccgcctacactaccctccccctcccctctctttcccgtgaacttgaatgtttgaagtgttaattatctctttcaatttttttttttttgtatctgctgaaaaccatttgtcttctcttcttctctagttcatttgtaacacacgcacaacaaaagtcaaagtgaaaaaatatatatgtaattattttattatgtctcaacatttttcatctgaattatttatggcaataaaaaatgtttgttttttttttttgtctgattttttcgttgaaaataattcttttttttattgccattcattgttcaccaaaagctgtattttcttataaatgttcgtttgaaattttttttattgactaaagaacaaatattatacattttttcattaatcgattagtgaatttgttaaatggtcgtagaaaactttttatttgttagttagcggacagtgccgtttctgcgccaagaattctttttgctagaccatcaaattttcataaatctgtatcattcgaacgaga

SEQ ID NO: 15478 - DNA, 2629 bp, Heterodera glycines
aattccgacttccgagttcttacatttttaggggtcccatttccggcttccaaaaaatttttgtgcctcgtgaattccatccctgatttctagtacaaatgatgtttgaccggcagagagccgcttctcagttcggcaagtcccaaggactgctccgacttggcaatcgcttcttggagctctctccgttccctctcctcctccctcttggcattgccctcattttcttcttcctccgccgcttcatcttcgtcttcctccgctattccaccaaggtttccaccaccaccaccaccaccactgtcgtcacccttttcgagcagttcggctaacagtcgtccaatttcggcactgtttaaatccgcgaccaattggacatcggccggtgaaagcaattggacaattcgttcactcaatttctgaaaatgtcgggattagaatttgaaaatgggcccagattggacatggcatttggcatgaaaccctgcttcatgggtgctcagttaaatgacactcattcagacaattccaaacacggacctctaagtgcgaaaaagaagttgaattaatttcaaaattttccatttctaaccataaatgcggaattttgacgacatatacgtgatgttattgtcgagaatgatcagttttgggatacaaatgacccattctcggccatatccccacacccatacttttggcacttcggcttacaccacgggttcgaccactcgttccacttcccagccccaaattttccacatttataaatccgcccctcccccaaaagtttttactaaatttgatatcctcattaaccccatcccacttggtctgtgccgtcaagaatgcttccgtcgaatggcaaattgatttcgttaattttaaacagcgcattcattaggttgagcagtgaccgcagcgaatggcgtccccctttgctcaacatttgttgaacattcgcaattttgtccaatgaattggccaattctctgaacagcgatcagggatcaatcaatgtattgctacactattccagaccaatttgttataattttgcgattccgaaattaggcgactgtgccaaagcgggaaagggatgaaaatcctggggattccatcccctgtcagggttgccacggggcgagaaaatgccgggattcgggtcgggaaaagggcagaagaaaattcgagacggaattcgggataagaaaaatctgcgaactcgggtcatttcggaaaaacgttggacttcaagattcgggtgacaaccctttttcacggcagcgcctctccttggcacagcgaaacatttaaaaatttttgtaaaatgccgaaaaagagggggtaattaattaattattttgcccccagcgttttcaccggtgggtgtaattgagcagtgtcccgatgttggtcagctgattgttctgctgttctccgtcaccacactttgttgcactcaaaaacactgtttcaacatgtcgcatttggacagacacacggcacgcttccttctctaactgttcaaactgattctcggccttaaacgcaagggaaaaggatcgaaatttctctaaaaaattactgaaatttttcaggtttggaaaaggcaaattttcaaaaattttccaaaattaccccgggctctgaaaatagtaaatttttccaatttaccctggctcggaaaataacaaattgccaaattttacctcattggcatgcatccccaattttggatatgagttccaagcgaaaatctcgacccaaactctcgtggaaagaccccccccccccaatttagagtgttgaattcggggccattcttggaatgcgaaaatattcaatgtatctatctatctatcaatggcttaggctgctgatgctcgagaccgaaaatatcaaagatttgaccccgagattctcgagcataacactaattgagggttagtcattcgaacttcgataaatttggcaatttcgcccagaaacaaatgcatggaatcgggcaacgcagctgaacatcggctgcaagttgatgaacccgcttgacaaggcaagagagaatggcgtacaaaaagtcgcacgaatcggattgaatacggtagcgatctgacgcgaaaaacatttttttttttggctttcggcttccattatatcaatctggtctcaattgttggtcctttgttatatttcgatttatgtcggcgttttgtcctactttctgtatatgtaggtctttagtacctagtttggtaatatatatggattcattcgtcccttctcactacaaaaggatgcctcagaatcctctaatcgtcacagggattctgaggtcttaacgatgtccaaagtaaaatctgatcaggtattcgtgatcagcgtcataaaatagccttaattcgcgcccgtttttcaatttttgttggccttggacgggcgcttcgcgcacgttttttaaatccgttgaactcatacgggcgcttcgcgcccgttttttagcttgttagccgcttcgcggccttagtcgggcgcttcgcgcccgtttttcaatttttattggccttggacgggcgattcgctcccgttttttaaactttgtttacctcaaacaggcgcttcgcgcccg

SEQ ID NO: 15479 - DNA, 749 bp, Heterodera glycines
gtggaaaaaatgccaaaaattggttgggttaattgtaccaatttgtcggcaatgattggccaacgaactactccataaaagtgccaaaaaatggattaaaatgccaacaattaaagatgaattatgcctttttgtgtcggcaatgattggccaacaaactactccattaaagtgccaaaaaatggattaaaaatgccaaaaactcgcgcagattgtggcgccaaaaatggcattaaaatgcccaaattagggggtgaatagtgccaaatttgtctgccctgattggaccggggagacctttggatgatgttgaggacgcccgtctccgccgccacacagtcaatcatcgcttttcggctgaattcaatgcgttcaatgtccagctggcgcatctgctcaagcagctgtggcatcatgatgttgaagtgctcaaacttggccttgttggtggcgccaagggtggcggcgtaattctgaaaaaagtggggaaattttagaaaaaaaatttccgaatttttaagatttattttcaacacgaaaaaggccccaccagatggttcaagaccggacgggaccgggcattcatcgggtcggggtccgtaattcggctacattttgaaagatgcacccggaccgagaccccaacaaaaaaccggacgaatttcaagccagagaaacccggtccagcggcagttttcgaatcctggtcccatatacctaacaccaagggttggttattattctatgtt

SEQ ID NO: 15480 - DNA, 2506 bp, Heterodera glycines
  misc_feature (16)..(16): n is a, c, g, or t
attatcccaccaaacncaggctaattacaaaaatggaaatttgaatttccggtttgcatttggccaatgtccgtctccaatttgttggattacatctaccattttttatcccccaaatatccgcaaaattcccactcgtagttcttcttctgcttgaccaattcgtccgccctggcctgcatgttcttctccatcatctcgtagtcttggtacaacttcttgcgcgtcgtcctcaattgtcggcacttttccgtcagttgggggcacagttcgctgcgcaaccgttcgccgatcacctgaaaaaccccccaaaaaatcatacaaatatgacgaaaattcttacaaaatcctgggaccgtccctggacagtgaagaattttgtgccggattttccatgaatttattttgtattgacactcaaaattttgccaaattttctcccaaatccctcctgccccccccgcccacctcgtgctgtgatgccaatgcctccatctcggccagcattgtttggaatgccattgtcgtggtgtactgcttggcctcctcgctgtcctcattctttttgccccgtgaacgctttgccaaacttctgccaaaacaaaactcatttctttggcacaatttggccattttaattcggcaatttaaaattggtccaataattaattaattgaattaatcttccgattcttgcttcaatttggacgcgtattcctcctcgatgagtgcgcgttccttggcaaattggccgaaccgttccaaaaagtcaatgccacgcgaagtgtgtgccgaaacaaacggtgccttgtcctgaaacgattttaaatacatgttgatcaaatgaatttagcctaataatcgcggtttaattaatgaatttttaacggctaaaaattcgagttagatagttaaaaaatgtaaacaaaaaatatatatacgtaaaaatgtgtttaacagtaaaaaaaaaaattaattttgtttgggttaaataggaaaaatgatatgcatttgttttttttaattcattcccatccaattttaaaatattctagaaaaaatctcacctccgacatcccaaaaaagctatttataactaaaaaataattttaaattctgttgttttccgacttgctctgacccctgctgttaaaatcattaaaaaaatgaatttaaaattctcaaaattttatttgaaaaaaaaaataatggaatacatattcttcaacccttttcaaaacgaatcatctttctaccattatttttctaattttaattttctttattcacatgataaaactgttcgtgccccaaatatgtttcggcataaatgccgccgactccgttcgcagcaccagcaaaagtgcccgatgatggcacagttttgccaccattcatcgcagcaaagcccgccccattttccgctggggacgaagtaaacagtgaatagagtgccgatgccgagctgctcagctcggagctcagtgagccaatcgtcagtttatgggccgctttttgtgccaaccgttgggcccgtcggctgagcgtcgatttgccgtccgccaccaccgatgccgacgacgacgatccaccactaatgccaatgccattcagacaaatgtgtgaggcggcggttgaaatgccatttccatttctcagtccaaaaatgcttggccctccattattgaaagccgggccaacaattaaattgccaccgccgacggcattagaggaggagtacgatgatggcaaaaatgccgcttttgatgaacccttcttcagagttccttcattgttggtgccaccaacgaagccggctgtggcataaattcgcccctctcgaccatggccatcggttgtacagccaaacgaactgatcggcaaccgttggtagtccggcaatttcaccgcaataccgccgttgccgaccagtgacagccgacgctggggacgattggtgccggtgccaatgccaccaattttttccacattgttgtttgactgctggttgagcacgccagtcacactgtaatggaggccctgatcaccaacaacagaaacagcagcaatggtggacgaagacccggcgctgaagctgctctcggtgccaaaactgttccgattattgttgctgtttccattgttgttggcatcagcatttgatcccccgtcgttcattacttttcccccaccattccgcatttggtgatactgctgctgatcatgatcagcctccactttcgtctgatcaccatcactaccgttggtaccgttgttgccgtactgctgctccatgtcgtcaccgtcgatcatcccaatcagttgttgctgttgtgccaccaccgccggttgtgattttgtagctgctgcagagaaggaggcagtcactgccgtccttctcaagccccctattcctgtagctgctgaaccaccaccacaaccagcagttgttccggctccaccaatgtaagtggttgtggtgtgtgtgatcacttttgctgtacca

SEQ ID NO: 15481 - DNA, 3859 bp, Heterodera glycines
tttacatagagcagcagattgcgcgatatattctgatttggatggtccaaattctgacaaaaaattactgcttttatcataaataaatatgttaaatttgtctatttttaaactgtttttagaaaaaagtgccatattttcgcaccttctttttttaaattgactcttaaatccgaattctaggtgtttatttgagaccatgcatacgcatataggcgatataatggaatatacaatacaatggaatacagctgagaaatacatattatgctttatatcgtttcatcgcattgcatgtttgttggcaccagcatcattcttcatcccactcgtccgtcctctgcttaagtttgcatgatgatggcacttccgttcttctgctgctgctgttgctggcgatgaatggcgacattggcacattccgtggcgacatcgttgcgcaatttgcgattagcggcagcgaatgaagcattctcgggccgttttttcaccagcgaattgttgaagaacatctcgaagacgaacgaacacaccatgacgatgtcgaacacctgaaaaatccagaaattggaaaatgcagaatcaaatgggcggcaaaactcacaaaagtgaccaacggcacatttgtgtcatccgcacggaagttcatgcaagaccaataagatgtccaatagagcagcaaacacgatgaggcccaagcagagcaacaccagcaaaagacagaatagagggccatgcaatagtcgaagcacttaaaaatgaaaaacaaaattagtaaccgactcaatggaaaacaagcaaatttttgcaactcctaacccgacaaaagcaaaactgatcacaatttgatcaaaaaaagcataggatttcgactgaaaagcaatttggtcgcgtaaaagcaaaactgatcacaatttggtcaaaattccaccggatttcaactgaaaagcaatttgttcgcgtttttgtcgggctgatgtgctgtctgtgttcacgcattgaactcacttcatattctgccgcagggcgtaacatccgggcgaagccaatgccaatggtgagaagcgagcacaatgcgagcaacagttggccggaaaagaagtccacaacattgtcgaggagatttctgttcttctcagtccagaaaaaaaacgaaggctgaaaaaacaaaatggcattttatttcgatatttctgatggcattttgctcaccgtcgtaatcggaatacagtggcgtccagggcacggcaatttggcggccaattcgtccatgaattgctgctgctgttctttgattgggagaccgttggtgctgctcatgaacagttggttgtgccatttgcgctcgtccaacacagcgccgaattcgcccgtctttgagtcctttccgatcagcgtaaagcgtttgcagtggccaacagagatgtcatggaggaaggcctgaaaagcatggaaagaccgttaaaaaaaattgaaaatgagcagcagcacacctttggacagacaaatgtgccgcaaaattggtgaaatgaaagaagttgccacacgaaggccaaaccgagcacaatttgcaacagtttgaagtagacgatcgtccgcataatagaagaatttaaaaatgtgaacggacgcaatgaatgagagaaaattttgcaatgctcgcctttatatagacaagcaaaaaaattccgaaattaagggaaaaaaagttgtataaaagggcgacatttcctcacttttcctcacaattcacttcatcgccctcatattatattattattattatcgtccatcgtctacaacacttcatcacacacgaagcggacgtgcccggcgcaacaacttcaatggaggattactgtttcgacgcaacggcagcagcagcggcggagcagtctcggcgtcaatcgggagcggcatcggaccttgtgcaaggagacggcctgtcaaccggcttcctggacgcgatcatcacgaaggtcaaccgttcgcctcctcagcgcttcacggaagaggtagaaaaatttttgagtttttcaaaaattaattttcccccctttttcccccaacagatcagtgacgatgaaatccgccagctctgcaaagcggccacggacgtcttccgaatgcagccgacgctcgtcagaatccacccgccggccgtcatcgtgggcgacatccatggacaattcgcggacctgaagaagatcttctcaacgcatggcctgccgccggagcagcagtacgtcttcctgggcgactacgtcgacagagggccccaatcgatggagacgatcatcctcctcttctgctacaaggtgtggtttttgggggatggggggagggaacccccaaaaaatgaaattcatttccccccatttttcaggtgaagtacccgtccaacttcatgctgctgcgcgggaaccacgagtgcgccaacatcaacagagtgtaagtgaaaaagttttttgtgtgtttttttgtgattaatcattcccccccccccattttcagttatggcttctacgatgagatcgaccgccgttacccgcgaccgggcgctcgtcgactcttcgacctcttcaatcaagtcttcgcctggatgccattcgtcggactggtcggcgagaagatcctctgtaagttttgggggagggcaatttttggggttcaataactgttttccaactgattttcaggcatgcacggtggcatctccaatcagatccgcagcctggaccagctcagcaacttgcttcgcccgcagaccgagccactgcttcgttcgctggaaattgacctcctctgggccgacccgtcgacgagcatcacaggcgtcgccccgaacaacagaggagccggcgtcatgttcggcgcggacgtggtcgagagcgtgcgcaacctgctcggcatcgactacatcgttcgagcgcatcaagtgagttttttttggcttttcatttcacttttgctttctataatttttccccttcccttctttttcagctcgtcatggacggcgtggaatacttcgcgaatcgccacctgatcaccctgttctcggccccccgctacaccggcaagaacaacacgggcgccacgctgctgatcgcgccggacctgagccacacaatcacgcgcttcccgccggcctgaggacgacgtgacggacggacagaacgcgcacacacactaactgcacacagaaggatggtggaactgcccggagagcgatgcgtgtggagaaatcggatcatctgacccccccccattgttgtattgtattgtattgtaaacccccatttcacatgatgaactcccccaaaaactgttgtcatttcaatatttgcgtgtgtgaatgtacgtatgtatatgctatgtgtgtgtgaataacattgtaagcaaaaaaaacaaaaattcaattttcactagacaaaattcgtttttttaatatgtagaaaattttaggaaaaattttggtgacttagggaagcaacttttagtgacgaaaaatgccaaaatagtgacataattttcagccaaaaattgagcaaaaattgtggctttttgagaaattttgaggatttttgaggcttttggggaaaatcctcagaatctttaaaattttgataaattggcataatgtttggcaatttaaagaaaattacaaaatttttcccggcggcgcctatcggcaccgccggccccccttgcgccccaaaagttttttgggaaaagcgccgcaaaaaaatcaacttcgtttttcatgttcagaatcccataaaatgcttatttctaacaaaaaaaaatgctcaaggggggcatggacaatcaaaaatataacatttgaacattttaa

SEQ ID NO: 15482 - DNA, 1348 bp, Heterodera glycines
ctgtgataagtgacctcattattaatttaaataattataattttgacgttctgtttaattttttttgatcttttctaaattttggttgttttttttgtgatttttggtttggataattttgtttctcatcatcgcctccgacttttctttttattattttgcttcgattttaataaatttgtttgttttggcctcgcttaatcgttggtcttcgagtatcaatttgtgtgaagcggtggaattgaagtttttatcacttggcgctcctgcagttctgggtaagcttcagcggaaaatttggagtttttggattttggtaaaaaaaaagttgggaattgtgaaggttaaatgaaattggatattagtgactcacagattgagcactaaaatttttttttttttgatctacaacaaatctgaaagatagatccacaggttggactatcaaatttcgaaattcgcttttcacttcactcgccgtttttcgcgtttctcgccaattgttttgtttctcagcttgaacaaaacactgattcacttcaaattggttgaatattgagtgacactgccagaaagaagtcacaataaattgaattgaagcgatactctcaggaagagattgcaccacaaagagtgtggcattcaattttaagcgtaaaaagcgtgaaaaacgatgattcttcgtacacctcgtaggaatgcgaatcagcggcgtttatttggagatgaagaaaatgagcagaacagaaacaatcccgaatttttaatgcgttttccccctttcccggaaatgaatagaggaaataacgcacagattaatgggaatgcgaaccattcaggcagacaaatggacgaacaagagatacgagacaatttgttggatgtcggtgaacagcagaacgaaaatggacagcaaaacgaattaaatgatgacgacgaacgcagacttttggatcaaagtaacgggaacaggggacaaaatgtggaagaaaatttgagaaaccggggtgaaaatcggcaaaatgaattagttggtaatgttacgcctcgcagaaattttgagtttgtgacttcaactccgaatataagtccaatccgtaatgtcccacagctaaattttggcggcaatctgagaaactgggaaaggcctagggacgcgcttggtcggttcatacgcttagacggcgacaaccgccaagaagcggttaatgcgccaaaccataacgcaaatgcaaatgcccaaatttttccgcaaaatcctccagttccggtcaataaccagaacaatttggggaactaccaatggtggtgcccaaatccaacaaaatgcagtcaatcaacagcagct

SEQ ID NO: 15483 - DNA, 2086 bp, Heterodera glycines
aaatcccaccaaaatgcagtcaatcaacagcagctaggaatgaatgggatgtttgcacctccggttttgtggccacagatgccgatgccagtttttcatccgcagcctcagttttacaggggtcaaatggtaccacaatcccccatccaaaactatgcaccgtttttaaacaatcaaatgcctgcaatgcttccacaccaacaaaatatccagcatgctcaaatggctataaacgccgcacgtcagcaggtgaaccagcagccatttcaaaatgcacagcaacaggcggtcctacaccaggcgggcctgagtggacttgaatatgcgatgattttggatcgtctgccggatataaagggaaacgaaggcagcgatttgattcgcaatttctttaaaaagtacagtcaatacacgattgattggcctaacaagaagcgtatcgaatcgttggaggcaaaattaagtggccgtgctgaaagagcctataatgccgctctggccagcgaaccgttcgcttacgaaaacatcaaaagaagtattttacaacaattggaggagacggactgcagagaaatgagtgcattcaatgatttgatgaatggggtactcagaaaatccggtgaaaacctggacgatttggccgatcgaatttcgagtcttgtacgcagggcgtatccaggactaacgcgaaatctggcagatgaatactcgatcaaacatctgattagaagtttgaataaccccgaactcgcactgagtttggagcttcatcgccgtaatggaatgtcatttgatgaatttgtggcgttggcttcgcgcgcagaaacaacccaaaaagcggcaaagatacaaaacggggagcgctcaaaaccatattatgagcgaaacttccagcatacgcaccagggtgaaagaaattccgaaatgatttctaaaaatttttcgccacgccctatttgttacaattgtaacgagcccggccatatttcgagaaactgtaataaagcaggggcacagtcgaaccgaaatgcacccgcattttttccacggaatcagcaacaacaacagcttcataattcgccagctacgggagcgaaccgaattgttcaacattccaaaaatggagtaaccccagcggtacgctcacaaaactttcttaagcaaaattgcataagaatggaagaggaagttaaaaccgacgcaaccgacgcaaccgtcgcgggtgttaaactggaaaaggaagttatagagtatttgagggatgagttggagaaaagcgaaactttttgtagtggattcgaaccgaatgcaatgattggaaaaatggtgacggtggaacttggagtgatgggaacccaaaccagaggaatgcttgacgggggagcccaaatttccttaatgggtggaaagtttttctatgatttgataaccagtggtaaattggatcttcacaaaaccggatttaaaggggtttcagcccgaatttcggatgtcaatggtaaagagttggaatgtttgggaacgacttctcttccagtcgatcgaaaaggttgcaggacaacaaatgtctgcttccatattacgagtgctccttttggttttgacttgttaattggtaccaatgcattgcgttctctgggtttttgtctttatgacattcccaataaagaaatgattaattttgaggaagtgaaccatcaaaagaaaaaccagatcagtgttatttatcaaatgacattaaaaccgcatacaatgcaattcgtaacattgtcagcaggaaatgaatggaatggcaaagatgtgttaattacggctgccaatgagaaaacttttcataaattggagccaatcgtcggaacagttcaagatggaaagataatggtgtccattttgaatacatcagataaatttgtgcagatttttgaaaacgaaataattgctgaactaactcctgcacttttgatgtgggagactgaaaattcgcttgcttccgtcattgttagtgaataataataccgtttcttcgattgatgcacaaagagaataaaagaaagagaattcgtgaatttgataatcagtcgaacgg

SEQ ID NO: 15484 - DNA, 1398 bp, Heterodera glycines
  misc_feature (1360)..(1360): n is a, c, g, or t
ttttcccgtttcccagcggaattcccgttaaaattgaccgttaaagccgggaatcccgttcccgttccgcgctttatctctttccgttccaggaacttttttttaccgggctctaatttatatctttggtgaggcaaactaacaaataaatatataaaatgagtgaatgagagtaagttaatttaaattttgaaattctcatgcgtatttattaacaattttctttttttttgcaattttattatcattgaattgtcaaacaaaacaattccgatcagtttattttccaacatctatataaatgtttaaatttaaagtatcaaaatgtgaatgatgaatgtaggtgaatggatgtatggatcgatcgttcgatcagaaaggatgaagacaaaattgttgttggcataaaacgaggaaaaataaaactgtgaaatataacacacacacaaacagacacacaaagaattattggaccgcttttggggtctgatcagttgatgtgtcctcctcctcctcctcttctccctcattgttagcatccttctttttgccctttttattatgccccgtttgtccagtgacgatgatgttattgttgttgtggttacgttgctttacgttcggcgacgggttggagtacaccgagtgcatcgactcgccagcagccaacgagttgaaggaggagcggcacgactgcagcgacacgacactgcccctgcccaggggagaaaagtgggggtgaatttgggggtgcaacacgttcactccctcgcattgtttcccaccagaaaaaatttaaaaaataaaactgaaaattttttaattttaagtttttgtagttttttctagaaaaaaaattgaaaaaatttatttggaaagataccttattaaattttatggaaaaatctctatgaaagttagaaaaataaaaatttacatttttttttgtgggaatgcgggggaagagggcaaatggccaacatcaatcgatgtgataccgaagtaatatatattttttttaattatcaaaacggagaaaccttttcaataaactaaaaaaagaaataaataaaaaaatttcaaaagacgaagaaaaatagttagaaattattaaaaacttaaaaatgtgaacccacttgaagtcggccgagttcaacacctcgtggtagaccatcagccggcatttgtgtgccgcggcactgctgctgctccctgcgccaccacccccgcttttgtggtgctgtttctccgcaatgttcgcggccagtgaaggcgacgttgtctccgccatttcagtcccgccggacgtgtcaagcactgttatgtttgatggcttcgctgcgagggttgtgccggtggncggcgttttcgaagcggcagtggcagccgcggcgtcgg

SEQ ID NO: 15485 - DNA, 2359 bp, Heterodera glycines
gggggggggggggggggggcagggagggggaaaaaggtttttcccaattttttgccccttggaatttttggggcccccaacccaaaaaaccgccatttcggccgggctttttttggtcccaacccaaaaaggggttccctttattcaatattaacccctggactaattgtaaaaagggaccaatcctttttatcgtttttcgagactttattcggtttttcgaaatccagtttgtgaccagggcaaaaaaagccaaaatttacaaacgaaaaagtggtttaagagtgatttgaacacttacaacatcggaatgttcccttgtaagtagtaggctttctagaaatttatgggcttttttgccaaattgtcacggctccttgaaaatgttgtacagtacacctgcatcgagtcgccttctccaaagctcagcggttgctgggccaagaagagttcaacgccaacacggaaggtcggctcgccaattattgccttaaaaataaaataaaaaagtaattaaattgtaaaaatccaaaaaagcaggggggagggaggggtatgtgtacctcccccccgtgaaatgaaaaaatttttaagaaaaaggggtaaattttgaaaattatgcacaactttcttatcaaggcggcgccaaatggtaccggctgattcccagtgaacttaatttttgaaaatttgacccaaaaatggcaaaaattgtcattttttggcgcaaaccgatacaaattcctgttttttcacccgggcgctataaattttgaaaatagcgcaaatatcaaaaaaatttgcattttttggaaataattcatattttttttgaatttgagcttttttaaattgatattgttattttttctacatgaaattgaggcgcatgcgcgccgctgctgctgcccccggcggcggaggacaacaaattggaaatttcgtccaccactcgctcaaccgggcccattacggtggcggccatactgctcgacaccgttgccgaaccgccgccactgacggccgcgccggcaccgcccgccgttgccgcattggaagaagttgccgcgtttggtggtggtgcagctgttgccgaaaaggaggcggacgagtgcttctgctgttggtgagagtggaggggaacagcgattttctgagtgattgaaaaaatgaaaaaattaaattttttttattccaaatttgcatgttttggcacatgtctaaaattttccaaaaaatatgaaataaaacgaaaaaaaaacctaaatcaatcaatatacctactctcaattttccctaaagaacgtagtttaataaaaattgtgttttaattaaaaaaaaaaatcatagaataaatatttatttttaaaaacgccggcagccgaaaaattttgaaacattttcaacccaaaaaacaaagactcccgtatattgttggtaagaaaatttcaaaaaaaaacttttttttttggaaaactttgctgcgattttttcgaaattttgtgattaactactaattgtaagctttttcaaaaaatttccagaaaatcgctgaaattttttcaaagtttttttcttgaaattttcttactaagaaattccctaagaattttttataaaaaatttcaaggtttgaaattatttaaaaaaaaatttctgggagaaacaacggtgagggaaatgaagtgcacccaaaaaataccttttccgtgcggtagatgacgaactcgcactcgccctttgtgatgtcaaagtcccaggtgagcactgacccggcatggtcaatccacacgtaaatctgggaaacgcaattggtcgagagagaatttattatttttgaaattttggtgcgcttttcattaacaaattaggcatttaaaaaaatcaaaaattttcccctcgcatcatttttttaattttacaaaattaatttttttaggttttttaggggagggggcacaaccaaaagatttctctgtgacatcatttaggtagcttaatattgactgggtggatgaataatgtctgggcagtcctaatatacagcatccagaattttttttttttttgaaaaacggttaaaattgttaaagaaaagtggcacaaaactttccaaaaagcctatcctaacccaaaaaatttttttttcagttagggcattggccccacccattcattggccattggttttgttgctagtttttttgggtttcccacctcatacggcgcgcctctgttcaccgtcacattggtgtacgcgttggtcaggcaattctccgcactctcgcgcatcagttcgtcgctggggattggcaaatactcagtcttcggcaccgtccatggcggctgtgcggtggcc

SEQ ID NO: 15486 - DNA, 926 bp, Heterodera glycines
  misc_feature (876)..(876): n is a, c, g, or t
ttccttttgacgggcacaaataatttgatggatttgcaatttacgaatttaaataatttttaaacttcacaaaatatacgcacaatctttttcaattattccataaattgttttaaaattgttagaattttgtgcctaattttactttgtacagcagcgaattctgtaaatttgtcgtccgccaccttttgcttcactcaatgaaagtgtcacaacgtccaaatgcccacaggcaaacgaattttcagctttgcccatcattccaaagcccaaggtcggcgcgggcgcagtccggaggatctttttcacttcctttcccccgaggccattcgcccaattttaaccgttttcttttatttttttctccggaggggcagaggacgggcaaagtgaccgacgacgaccgaccgaccatctgctgctttgccgccgccgtcgtccgtccgccgttgggcgtccctctcaacggctccgtccgtccttttccattcgtccagctgtccaccgcccctccaccaatttacctcaaatcttttgcatttacattttcactccaaaacataaattttcttgggcccactcacgtgtttgcttatgttctggataaaagcgtcttttgagaagagatttattttatttttgaaattaattatccatggcactaatttcaaattcaaaaaacagcggtgtttaatcccacgcgggcacataaaatgccaatcggcacgaccattattcttcgaccagcggcgaaaaggacgccaatcgaaaattcattcccaattttttgtcttttggttctcttccaccaaagtgacatagttaattcatccaaaaaagaaacaaattcaaagaaataattggtctttcatttanaagtcataacggaggaggacgaaaagcgggacgagggggggggggggggg

SEQ ID NO: 15487 - DNA, 1646 bp, Heterodera glycines
  misc_feature (7)..(7): n is a, c, g, or t
  misc_feature (1596)..(1596): n is a, c, g, or t
ccccccnccccccaccgcttttcgtctccccctcccctcccaatgtttgttctccccgttccttggcgctatttttgcttctcccccctccctctaaattcgtcgttttgcgttcccatcgctttttggcgtcatttgtttgctcaccgctccgagttgggacatttttgggaacttttgctcgtcccaaagcgatggccatcgtccactcgaccaagtcgagcctttctcgacttttccatttcacatatccccatttttatcgccgcttttcgtttaaatgtttctacgcctttcgcgattacttttgctaattttctaaccatgaccaactcccgaaaatattttaaaaattaaaaagcaattgaaagtgaatgcatagacaaattattctttgtgtactgctgaaattgaacctgctgtttctgatggacttttcaatgggtggacccgaaaatagcttaaaacttcgggcaaaagtccgtttgctttgcgcaaatggctgaaacttcgtccgtcgttgaccatcgcttcccttccctcccatccgtccggttgttcccgtcgaggggcgggtgtatcttcgagaagcggtccattccaaaaacatgggcctgaagagcatcgccaccccggcggtacccaccgccgccgccccgtcacccgggaacaaaaagacgcatggacaacggacggaccgagggactatttttgtccacagggataaagccatggggggggggggcgtcgtccgctgtgtttgttgtttgtcttcagcgagtggggaaagtctgtgacactcccccggggcgacgacggggaaaacgacgacggacggacggacaaaaagtttgaaaggggaggagcctgcggaggacggctggaggaacagcaaaactgcagaatcatatccatccggtggacgaagcattcgttcgtccaaattgcgcgaagccgtgcccaaccaacggccgaagagactttgccggactgagttggccatcactcgtccgtctcccccccccccaaaaaggcaacaaaaaacaacgccttctccgccatttgatccttcgtcgcgtgtgttttatgccacgctcagttttttgctttcaattcgtgccttttcattatatattcatgggcttggaaatcccgaaaagaagtaaaagtcacgccaaaagagaaggttgaggatggattgctcttccatttttgtttaattccgtcctttttcccctttttataataaattcttttggcttttttttcgcttccgtccgctttttctttcttcgtcctgattagacaataaaaaatcgtttagcttcatccgattttttacacttttcaccccaaacgcttgttgaaaaatgtccacccattggtccgctgtttccctttgcattttcgttgccctccccaaacacacttctggaacatttgtcgtctcgcggcaaattgcccctggagaccagcaggaacagaccctcccgaaacccgtcctccccctgccatcggcaaaagggttcattgggtgttttggcctcgtaggagtctccgtgcttaaaggggccgtccccgggagggccatcagcnccgccgccgtttaaaggggcgccgtcgcctcactcttatcccgtccatcc

SEQ ID NO: 15488 - DNA, 3512 bp, Heterodera glycines
  misc_feature (3408)..(3408): n is a, c, g, or t
tataatttttgaaatcgaaaaatatattacaaaacaaaaaaatttattaaatcaaatctcaaaatattatgacaataaaataaaacacaaatgaaaatttttaatttaattgacttagttcgatccccaccacagaataaaattattttcatcattttttattatttgttagagtaagtaaaagtaaaactctttttaagtttaatataatttatatttttattttttaagtaattttttatgaatcacaaccaaattaatcaaaatcggaaaagaaaagaaaaatgtgaacaaaaattatttaattgctattaatttgaacatattccgtaaataatttttaatgcatttaaattggaggatttccgcgcgaaaaagatgtttttctgtttttctcatctaaacaaggtgaaggaaaattaatcatttccggtggccactctaataaaatgtaaattaatggattaataaaaaattaatcattattttactttttcttgccaataattgctcagtagaataaaaaataataaaattttattattttttatttatttgtaagacatcagtaggatttaggtttttcttattataaaaataaaaaattgttaaaattatatttaaaaaaaataaatgccatttttcattgagaaattttgaagaaaaatgtaatttcacctattatttgttttaatatatatttgatcatccaaactaacaattagcaagaacaaagaaataaaatttgttgagggttgcttacatatttttttttttgaaaatattttgcaaagactttatttgatttttgcctcggttcgattcccatacagaataaaagtatttcttattcattttagctgtaaaattattttaaaaatttaattacaaaaattttctaaccaccgaaaaataaaaaaacaatttaaatatttctttcattttttaaacatagccaaaaaattcaattttttgtgaaaatcgtttaataaattgtgacaagaattccgaaaactgccggacccaaaatcataaattttgaaaatttgatcatttaatggacaaaatctgttaaaaacccacaactaaattttcttaattttccccggcggcgtctatcggcaccgtcgtactctctactcaacaaaattgttgtaaaaaatgtgccaggaaatagaactcatcaaaagtaaggaatttaattgaaataaaattttcaattattttaattttatttcattaacacccaaaaaatcattaaagataaagacgcaataatttaatttaaaagatacacacctttctgttaaagatataattttatctaatatttttattgaatatcttatatgttaaaatggtaaaaaaatttagttcataaaaaacatatttgattatttacttttgcataaaaaggcaaaaataaaattaaaaaatgagtttgcatgtcagggatccgaacctgtgggcttaaaaaacgaggactagctcactaccgctgcgccattagagacctgatgaaggcgcaaataaattttaatttatttattcactaaaaaactttggcacgtcataactcggcactcgagttcattccgcaaaaaataaaatcacttttcttaagaacctgtgggtgctctatccacccaccaaattttattcggaaatcaaacggacacctggggaccttcctttttttagccgagcttcgcccagccctggtgccgataggtgcagccgggatatgcaataatactgattgcaaattacaattttggaaaaaattacctaatatgtactttttattgggatttttgttttaatagaaaataaaaattatccttttggtcgttgcctttttttggatttttgaggttttttgaaattttctatcaaaatttctaaaaactaataagattagtcaaaacttattaaacatttttgttttaaacaatttatatccgagccataaattttaacttctttaaaatgttttattgttgaacatgaaaaaacaacgcgagggtttttctctaatcaataaattcttaaaaatttatattaatttcaaataaatattttattctctattttagctttacatttattttcgtaatgaatttaattttgttggttttactgcttctccattccaaaattgatcaaacacattctgctgatcatgacaacaattttgaatgccgcaatgttccaactgatcaaatgaaaccatttcaatacaaatcggaccgatgggaagagaaaatggaaatcaaaatttctggaaccaaactccaccagggaaaagaagtacaaataaaaaataagtcaagaaaaaacatagaaaaggctttaacaacaaatgcttcaaagcataattattttaaaagtggaattagtttaaatgttttaaaattcaaatgattaaatagaaaaaatttcgctgagttttaatgggatgattatttgtttttttttcatatatttgagcattggtggggccagagaaccaaaaaaatgctccgaaatcctaaatcaatttatgaatcttaaaacattaaatatttcaaaaaacaccataatgtttttgtttgtgcaattgcattttttacttttaagcatgattttaaacattaaatccagaggtttagactaggaatttatcttgaatttcattgttatttttcatttaaaattttagggattttaataattaaataatatttctttagctttacattggtttttctaccgccgaaaatgacaatttacccaaaaaccaatgtgttgtcatcaaaatttatggtgatgaactgaacgaaaaagctctctatgataatagcatcaaattttttcatctattaaaagaaaatgacccggagaatgagcacattatcaacttaatagaccagtaaatcaaaaaaaattcaaaaatatgaataattaaaaatttgttggtaataaaaatcaaaaaccgattgattttgagtttttatttgttttttataactaggaatatagttgccaaaaactgtcaaaatattagtttttaggttctaaaaagaacaccaaaatacgtgcaaatgggaaaatagttgctcaaatttagaggtgtaaaatgactaaatttattcaaaaaagcaatcaaatcagtagagactaataattattaaaataaaaaattctcgtctagaaataaataaataaattttgaagataaatttttaagaaatttcatttcttagtggtctatttttgaaaatttttcgggtcgaatctttggggtttatttttctgaaatttttagggtcggttctcaggggaattttcgttttattgcatttttgttaataaattttgagaaacaccaaaatagttttaaactttttttaggtttttaggttctanaaataaaaactagaaaatagttgctaataactcgaaaactagcttaacaacaaccaaaaaaatgtatttcgtgcgtttggggcctcgagaagctcaggaaaaaa

SEQ ID NO: 15489 - DNA, 1274 bp, Heterodera glycines
accgacgatgcaacggttgggtcgttagacgaggacgcaatgacgccggtctccgtttccttttgttgattatggaaccccgtcgacgagttttctgaacaatgccggagcaaaatgagaaaaggaacgaaaaaagtgccagcaaaaagaaaaagcgccatggacggcaggcacggctcaccgaacgcgctgctgttgacgtgcgacggcgcgaaattttccttctcttcctcgtcctgttgctggacgtcgtcgtcgctgtttgtcgtccttctcctccttcaacaccgctgctgcccggctcgacatcaatagtcatttcgatgaatgaaacgaattggtatatagctaacaacaggataataattgtgtagatcatgtaaaaaaaggaaaaaatgcccgattttaacgattttcgcttcctctggaagtaatgaaatttggtgggaaggggctgttcttttttccttaagaattttaacttgaaaaacgcggaaaaaccccataaaatttcgttgaaacatttaattcaaaattccggacgagaagttgaaaatattcggaaatgggcattggctgacggaatgcgaaaatacgcaaatgaatgaatgagtgtgggatgagcgaaatcgccgaatttcgttgcttttatactcgctgcgcatgcaccgaaacaaacgacacgcgcggagactgacaaagagacgactctttcccgcctataaaaggcgcttcccttcctcccctttcccatttatcaatcgaattccttccgcacattcatttctccgctattttatacttctgctaatggtctccatcgctgtgcttctgcgttcgcccccttcgcttctgctcgtcctttcgctgctgttccttcacaatttttgctgctccgatgctaatacaaacagcaccacgacgtaagctgaaaaaatgccctcattttttgccaaattaattttccctttccgttttattcagtcagccaccatcaacatctccgcctccgtcttctgctgttcctcccaccaatgctccgccgaatggcgcgacgccggcaccaaacggaggcagcggcgaccaaaagatcttgatctacggactgatcggatggtgggggctccatttttgaaggcccttttttaatccgcgccgtcgtatgtataaccgtttcagggccggttttgccactctcgccgctttggtcttgttttattgtgcgttctgtcgaaaaccaccggaaaaggaagaagagcccaccacaaccacca

SEQ ID NO: 15490 - DNA, 704 bp, Heterodera glycines
gtcagcattgtttaatacacggaaacgaactgaacgttccagtgcttcaattaaatatcatttaaactatttttagactaaaaatgaaaatttttaatttttcgacttcttgttcgagttcgggtccgggatttggaattggccgaaatggatgccggattcgcgatcagcgaccccgaaaacctatagattggcttcttttattctaaaatgtaaaaatttttgtatatggggcctaaactgcacaagagccgtaattttttaaaatatttgtggtttagtggttgggtcaatagcagttcgtacaatgggcagttcgtactatcggcaccgccggacccccttttcaccgggtacccgatacccgaccgggtaccctacccggtttaaaaattggtacccgacccggtacccggcttttcaataaccggtaatacccgggcccggtttttgcccaaataccagggcccggcctaccctaatttagacaaaaacacccataaaaattgactattctggcataatttataatccttaaatttggtgatttttagaccccccgcccccgtccccgggggcgagaaatttctcacccccgcccccgcgactctgacccccgcaacccgcaatcccccgcccccgcgaaaagccacccccgcccacggggtccgaaccctattttaaactattgaaatcgacagaaa

SEQ ID NO: 15491 - DNA, 2115 bp, Heterodera glycines
tcaaaaacaaaatttcgaatgcccatatcatttctctaactcatcaaattgcttagcttttgcttagaaaaagcttctccttatcatgagctttcaaatgataccaagtttttccaatttggttgggaaaaagcttcaaaaataattcccaaaattcgtcattttttaatattttggacaaaaataaataaaaatattcatgttgcacaacggactcgaaccaccaccctttgtccctttactatcttacaaaaaccacttcgccacacatgcaaatctttttggaactgggaggccaaaattgaaacggtgtgtacatcaatcctagtttcaaggaaataaagcattttccctggcatttcttttattaactatccgggaacggatttatatgtgctaaaaaaccccaaaaatatgtgctaaaaactcaaaaagggccaaaatatgaaaaaaactgtttaataaaaatgtgatttctgcaaaaagtctcttttttttatccatttctgctaattttttggcttaaatttttcttgctctcaaagacttacttatttttcggaattttcttcgctaaaattcaaactttgcctatttcgtcttattttgtttttttgtgagactaggaatttcctccccgttccgcgactttactctccctggagcatcggggagaaatcctattttaaccaccatcgcgccacagttatcaacaacggcggacggacaatgggaagtttttggacaaatgggcacgaaaatcccaaaaaggcatgaaataggcatttaaatatttttgttatgcatttttagggagtaaaacacgtaaaaattaatcaaaaaacttaattttgatcatttaaatgattcttaaattttttaacaaaaaaaattttagcaatcaatttttaagaaaatttttcaattcgtagggtgtattttctaaaaatttttgggtcgtttcttaggggtgtatttcctgggtttattgcatttttaatggaatttttcggaaaaaaacgccaaaaaggcagtataacggtaaaatgccaaaaaggcaaaaaaagaaagaaaaaagaaagatggaaaatgtgtttttaagcacaatatgtcgaaactagtgcgtagaaaaaaggcatatgcctcaaagtcggtctctagtgattagcaccagttggccaaacgatttgactcgttggcctttttctggttgaagcatatctgcgtgtgaagccgcccggcgctgcccttcataatggtgctaggtcgtttcttaaaaccgccaaaattgctaaaatgaccgaaatgttctgataaatttaaaaaagagcaaaaataaaaaaagatagaaagaaaataaagcttaaaattaattaattaattaattctcgacaaaatggacaaatatgaaaagtgaaatgagaaatgagcacaaaattaaaaaaatgatgaaagtcgaaatgaattctcaactgggcaattggaaaaaggaaaaataaaaataaacaaaaaatgaaaaaggaaaaaggaaaaaaacagcaaaagaataaattaaagcaataaaaagggaattggcaatgcgagagaattaatgccgaattgtgcagaaggcttttgggtataaatagcgcaaaatgccattcccttggcacccaattttttaaattcatttttaatccattttaaatccattttaatccatttttagtccattttaatccattttcgtccatttttagtccattttaatccatttttagtccatattttaatccatttttgtcccctgcatctccccatttttatcctttttatcccctgcccctccctccccttcccgcgcccgttttgccaattccatggcaaatttcagctgttggcacaaatgcctgttggcctttgttctcattctgatcctcccgctggacggaccaattcaggccaagaaatttggtggaggtggaggatttcgaagtgatgataagaaaagatgtgatgatgtttttccagggcattattcgatcatatctgtcccggacatttcacacccttttcgatcatttgtcctgctgctgtggatatctcatcaacaaacacttttctacctgttttatc

SEQ ID NO: 15492 - DNA, 535 bp, Heterodera glycines
taattaaaatttcaaatttggcaaaaagtgtcacttttgtcgcactaatggagccgccatctgtccattaaaaacattgtgctaataatgataaggaaggacaaaagaaggacatgcttacataaatcagtcaaggacaatttccaacagtttttttcgaccatttgtccaggacttttcaggcatttttcgagcatttgtcctggacatttaataaaattttgatcatttgtccaggacatttcaaacattttgcgatcattattaacccaggacagttcaaaacattttttggaccatttgtccaggatattttagacccttttcgatcagtcatttttctatcatttgtcctggacattcccatatatttttttcgaccatttgtccctgcccaattgtccctgccacccgccattgattgatcagaatggtcgcgtgtcgcccacaaactgttcctcaacaccctgcttcaacgcgcatggcctgacaaactcttggcccgtttcatgaagccatttgttggacacccatt

SEQ ID NO: 15493 - DNA, 1834 bp, Heterodera glycines
  misc_feature (1597)..(1597): n is a, c, g, or t
  misc_feature (1697)..(1697): n is a, c, g, or t
  misc_feature (1720)..(1721): n is a, c, g, or t
  misc_feature (1748)..(1748): n is a, c, g, or t
  misc_feature (1753)..(1753): n is a, c, g, or t
ttgtcttctacgagccttaactgtgttttgaattgtttatgataagtttttggacacttccagttgaggtcctatgaaaaatactggaattgtatgaaaccaaaggggggggggctcaaatttgaatttcaattttataccgactgaaggcaaaacaaacaaataaatattttcgtcggaaagaaacatcaaattaacgagaagagatcaattgtccattcaataatctccaaaagggcgatcaatccgtcactggttctcccacatcttttcgcacgtccagcatctggtctttggagatgttaatgtccctgagcctttttgagacagtgtgtcccgcttcaccgagtccaacaaatgatactttcgctcgcctaccgtcgaaatggacgcttaaaagatttggattaaagcagctttccaaaatcttatcattcggatctgaacaagcactcttcggacttactcgggttctcgtccccagttataaaatcaaaccgaaaagcttcgaaccaaggcacttttccaaaattttccaccctcccccaattcctcggcattttccaccccttccccatttttaagcacttccccacccccccccctccactattcttttagaattttccacccctccctacctaatttgttcggcacttttccatccccttctcaaattccttcggcacttccccccccccccgcaattctttggcatttttccacccctcccccaattgtgccacctttgatgcgacaatggggcacacagccggcgtgcaaaaaacggagcatttttgaagaagtagaactttataattcaaaatgttctaaaacaaatattttaaaaatgtgtcgagagaaaactgaattaattcatgacatttaatttcttttttacacgtttaatccaattcaaatttttcataatacagatagagaaacttttttggtcgaacaaaatataattgttttacaaaaacaaaggctcactaaaaagaaaaattcgaagcaacacagctttctctagtacatccaattgcattagcttgaaaaagctcccattagtcttgagctttcgaatgatagataccgagattgttcaatttaaatgggaaaaccttcaaaaatttttcaaaaatctgtttttttttctgtttcacctttttatccttcgcttcgaaacttttaggcaatttttgtcaaatttttgatatacacggcgagtcaattttgggctccaagtacaattaagttggttttttcgtcttagtggtctgtgagttagtcaacaaaaaggggtctcaggttcaagtcctccttatgttgtgtgttaatttcaatttcttcttttaaagaagaaggcagaattatttttttattaataaaagttttcgtgtcaataaaaaatcatattcaaaacgcgttggttacgtacaacatcgacaattttatgaattttttttagcttataactctgtgaatactagagcaaataaaaccattttatgctcattttgaagggaaaattctggagaatattgtaaattttatttggtttggccttaaattgtggacttggctaaaaaagaattanaattatttaaatatttgctatgctaaaaaatttttccctatgcaccgattttcttgaaattttgcataatcccatattttggccccctctagcgattccnaagttattttgagaaacttaagnntttaactcgagatcggctcttctattnttacnaggggaaaccctccaaaaaatttaagttttgcaaagttttgggcgtctgataactaaatataaataaacttatttgcactg

SEQ ID NO: 15494 - DNA, 1520 bp, Heterodera glycines
aaaaaatcgtttttgggcataaagcggcgtgcggttgagacgatggaaacaccagcgggcaattagggtgcaactcttcagcaaaatgccacgccagtaatggcgaacattccgacaaagaatgtcacaaaaaaagtgaaaaatcgaattttttttttactttttcacatttttgttttaaagctggtgaagcgagtccgccatgaaattgaactgccgccgccagtgccgcaaacccttcaagagttggaacttcccgagcagtaccgaatctacaaacgcaccgaagaagcgcaggagcttttccttctggcggattctggaacatacaccgagaatgggcgagacggacaacagcgctgtgttttaaggggagcttttcacatattttctaaatttaagaattctgatttttggtcggctttctttcggaaattgggcttccgaaatgaagtatatttacgctgatggaactttcgcaagtgcaccgacgctcttcgcaactttacgtcattttggcgcggtacttttttgccaattttgtttttcaatcgtttttctcctaatttcagtcgtggaaaatgggtgtttccggttcttcattgtctgcttacgtgcaagtcgcagtccacgtacgaaaagatgtttgacatgatcagaaaccgctggccgacatttgcaccgaaaaacgcatccatggacttcgaacaggcgatggtcaacgccctccgcgcaaaacatccacagtgctcaatcagcttttgtctcttccacttggtgcgcaacatgaaatctcgcctaacagacgaacaaactcgcgtaagaaaaataaaaatttattgattttgaaatctcaaatttagcgtttcacaaccgacgctgcctttgcacaagctgtcaaaatgatcacttcgctggcctttgtgccgcttgaggacattacaccggcgctggcagcgctcgaagatcatcttctggatgagcttgagggcgttctcgattggttggttgagtttaattttttttcaatttcattagtaattttaaaggtttgtaatcaactacgttggacggcttcgcaacaacggcacacgcactcgccattgtttcggcccgaagaatggagcgtgtatgagcgcacaatgaacggcagcgaccgcacaaatagcttcgccgaagcgtaccatcgcacgttgcaacttgcgatcggacatggacaccccccaatatggaaatttatcaacattttgcgcgagcaccagaaaataatcgacgtggacttcgaacatttccgcgccggaaatactccgccgtcgaaagcaaagcgttaccttgaagcagatagacgatttttgaggatcctggagcgctacaatcaagaaaaagagcggccgcaaatcgaaaatgatcaccaatattgccaaaaccaaattaatccgaatttgattaatgaaatgcttagggaatttccagcaattaccaaatgaatcaatgattttcttttttatttgcattattat

SEQ ID NO: 15495 - DNA, 1422 bp, Heterodera glycines
cgccgaaatctcgtattatatcatttcctcatatctttgctgtttggcgtgttatttttagattagttttgtgctaatttaactttggtagctttttgtcgctgtttcctaattaactgaccgatcggcactcacacaaagcacaaataattaaaacattaaacattattatgtacctattcaaccgaatcatttcaggcgctaacgaattacgctcgcgtggacccatacgaagtaaatcattcactccgccagggggggggggattcggaatctctccccctcaacaaatatacttaaaatgaaaattttgcttcgacggcacccacttttttgacttttttggcattagcacccgaaatttttggacgaaaggtaaaaaggaaagccttccgattttaacctccgaattatttttttatttcgggcacaaaacttcacacgtacaaaagaatttgtttattccaaatttagttgtggattccgagacgaaacccaagtcatccgacctgaaattcgtctagccaattgcaatacgctcacttagtgccggtcaaacgatgatcccttcccccgcggattattcgtttttcaatggcaccataaagtgtcctttttgttgcctttatcatacaaacagaaattaaattcgtccgatgaaatgctctttcccccgttcattctctttccctatccaaagcataattcgcatcgttgtccccttccctctatgatttttgtgtgtaaatgtgtcctacgcccccccccccgcttcctagttaaattttggacacttttgaaattgttgtgacccctctcctccgtcatggtccaactttgcgggtattattgtcctcttattttcgacatgacttaccatacacatacaattgcttttgtcaatacaatcgcacattcttaaaatttgaaatgtccaacagcaacttccactttttgctcagatcgcccaattaactaacgaaagattctattgctgtatttgttaattaattgaaatgtttaaagtttattttcacacacgaatgatgactgatttcacttcatgtttttaaattaaaacagttgataaattcggtttctcagtatgggttttgtccaaataatttaaaaaacaagccaagtctatgtggcaaacacttagggtcaaatcaaaaaatgaaagtaggaaaccaacaaaacaacagaaggtaaaagaatcacaaaatgaatgaacacggaataatcggtaatacttgagaacctaagctacataaaaaagaagaaaaaacccattagctcatatatggtggcctcactaaaaaggggtgcaacatttgatcatattgataaacttcgaaaagtttagaatttgcaaattatgaaagaaatcaatgattgttgcaaatctgatatcatattcgt

SEQ ID NO: 15496 - DNA, 1432 bp, Heterodera glycines
  misc_feature (23)..(24): n is a, c, g, or t
  misc_feature (60)..(60): n is a, c, g, or t
taatgatgaaatcaatgatgtgnncaaatctgatatcatattcgtgatcagaagcatganaactacgggtggggctttcataacagaaaaaggattatttttttacagagcccatctccagtattaccgactaatcagaatgaatttggttggacatgggtttcattcatttaattaaccgaaatgataaagaaattaacaatgggagcgcttcggacgtgctacgaatacccgttgcctgcggaggtggaccgctggacatcaaataaacacacaaattggccggacacttcgcccagaagctgagcactgtttgctaaatatgaattttaaaagttttcaggaggggaaacggtgggatagaatccggaagggaaagggaagttcttaaggattacacggtgtctcagcccttatattcaaccggctaatgtattgtctatgttttaatgcatttgtcaatttaatagtgcttaaactcattaatcgtgataaaattgtaaaaaatgcataatataaataaatgaaatggaaaaatctggttagtccgcccacccattcggtttttctcacccaagcgattggatggcagtgcaaaagctgagcagggattgacaaaaggcgcgccgttgttgaattcggggaacggtttcttttgttgtgtgagagatgtcgtgggaagtgaagcggacggcggttgggcgggcgattccgtctctatcctcagcaaagtctgttggaagcatttaaaacgtgaacaatgcaatggttttgtttgtgtagacctcgtaacaattgctcgggattgcctgggcaatgtccatccgttgcccaccgatgttcatcaccacgcgaccactgcgaagaaattgcaatttgccaatttgggtgccagttggcattccatcgaaactgtgctgctgtttgggcaaatttggcggattggacgcctgcgaagcattgagcagaaaatcaacagaaaaatgaatggaattgaaatttgcgaacatttaattgttgagaatcaattgccattgggtgaagtgaggtgggcggaagttggaagaacgcgacagagttggaaccttaagaaggaaaggaaaaaatgttatctgattgtgtcaactttgttaattttttacaatttttcttcgatcgaaagtataaatcttaattaaaaaataatttaacatttctatggttacttgtaccataatttttttcaaaaaaacccattgaggggtgtaaagtttcggtttctaatattgaacaaggtcataaaaactgcaaatttctttggcgatgcctataaataccgaagaagcccaaaatcccgttcaaaaaaattgaacaaaatgctcagttggtcattttgggtaaaaactctcaaaaaggttcaattatattaaaataattaatttaaatgaattag

SEQ ID NO: 15497 - DNA, 1835 bp, Heterodera glycines
ttttttcatccccccccccccaattgctcctcaggttgtgctgcgccgtttgccgcccggcatcgttcccgccgatttacacgcgcagttcgccccgttgccggccggcgagccgcacgccttttggttctgcgccgcgcccggcagcgccccggttggcggtggcgccaacggcaataccagcggggacggaacgaacgcggccacaccggtggtggaggacgacgcggacgaagtggcggcgacgctgcggcgcgcccgttgcgccttcgcacgcgcctatttggtgtttcgggaggagaaaaatgtgcgagaaaagttgtaaaaatgggataatttttaaatccaaaaatcaaatagaaaaaaaggaaaagtcggcagcttggaaaatttgtccccctattaaaagttgcatttttaaaattaatacaaaataaacatttggtgggactctttttgtttggaattttcgggggacaatttaaaacaaaaccaaaaatagcctctttctgaaaaaaaaatcaaatacaattaaaaaaaaattgcggcggggacaaatttttaaaattatttggaaattttttttttttacattttttaagcactcaacatttatagtaccaaaatgttttttgtacataaattgttttggtttttgttttaggctttgtctttcgctgaacgtttcaacggctatgtgttcgtggacagaaacggtggcaccgaaatttattttttagattttttttttttgctatttatttttaatgctaacaaaaaagtacactgaaattttccccctctttttcggcattgaatcgatggccatcgtcgaattggcgcccaaccaaacggtgccgaaacactccgccgaaatggccaagcaatgcgacgagcgggtgaacacattgacaaatggtgagaattagggggaaaagcaaaaggaacaaaattaattttttttttttcttgaacgatttaaatttactaaaaaatttaaaaaaaatttcagcagcgaatttttggggtgcttccatcaaaaagcaaaatgtttccacttacttgtaaaaaaccaatgaaacttgttttaaaacaaattttcttgtcaaaattccggtcagtcactgtcaatcatcggcccggttgaaagtcggttcctagcttttctgaacctgtttttttttgtaatggttatttcccggtccctggctactcatataattaaatttcgtcaaaatccatgctaaattaaaccaatttttctagcaaattggaggcctgccatgccctcactcgaatttctaatccgagttccagaattttctttctttttgcgttttttcccttttttttgctattaaattttgaatttccgacccaaattctaacacctcccccccccccccccatttccccggcagatgtcgcctttctgaagttcctgcggcgtcgcgaggcggccacggcggcggacgccgacggcggcggccctcggcgggtgaccgacttcgacgagttggtccgccagttggaggagaagcagcgccgtttggaggagggacaagtgcaggagacgccgctcaccgagttcatccgacagatggcactcgaaaaggtggcacctcccgaaaattttttttttaattttcaaacttatgttagaagtaatccaaaaaaaattgataagaaatttcttaacaagaaaatctccaggaaaacttttttgaaaaaattttcagagatttttttattttccaaataatcgctgaaagatttttcggaaaaaattttttcttgaccaattgctgtccgaaatttaaaagaaataaaaaaat

SEQ ID NO: 15498 - DNA, 2281 bp, Heterodera glycines
ggaatattgccaaagaaaaaaaaattcatggcgcttactttatttttcttatttttttagttttagaaaaaatccaatttcaaaaaaaatgtggggtgaccctcctcttgatcaatcataaccagtcaggctcctctcatattattccactcgaaatgcttttaggctcgtaaaccgcgccgtagttctgcgttgaaagcggccgaaatggcggcggcgggcggcacccaattgacaatgggcgcaaaggagataaaaagtaattttttattattttcaaaatcctttcaaaaaattttttttacattttttagatttattttttaaatgaaaatttttttaaataaccttctgttccgtaaagggacgggaggcccctgaaggtattgcaaaaatttaaaaaaaattgaaaatttctcgttatgaaaaaattttagcatttattaattttgcatttttaccccaattgaaaaatggaatcaaaatattttaaaaacaaaaaaagcatttttctgccaatttctcttcgcctacattttactataaatttttctgccattgacaggccgaaaaatggtagcgacggacgccgacgagggcaacgcatcgtcggcactgaagggcgcctcgcgcaccaaagtgggccctccgtttttagtttttttgaaatatttttttaaattgcgccatttttatttccgtttttcttaagacgcgcagagagcgccgccgacggaaggaacagagggaaaatagggacgaagaaagtgaggcaaaaaacgcacaaatggactataattgagaggaatgttgtcctttctatacgggagcagatcctgcgattttttccgattttttttttgttgaattttaaaaaaatcgctgaaaactttacaaaaaaactttttggcgctagtttaaaattggccaattttgaatttatcaaagagtaaaggggggacccttttatttttcaaaaaaaaatctgataaaaaaccatgaaaattttgatctacggggtttttgaggtcgctctgatcacgaatctgacaaatctattttgaccaatttctaatcccgaactcgaacaaaaatcgaaaatttgaatttttcggtttacgattttttgttcaaaattagattataggaaattggaaatttgtcaaaataattgaaagattcgtgatcagagaccccaaaaatccccaaggaataaattttttttcaaattataaaaaattttctaccattttcataaaatgaattctcgggggagggaaatgatacggggggggggggggggaatcgtgttgttcccatcgctcccgaccaattttttcaaaaaactacccattttaatttgccaaattccatttaaatggagccctcagggctttgttctcaaaagagatgcattctttaacttgtttagtggtgtcaatttagcacatttttcagagaaaaaggcgcctgggaacggcgaggacggcacaaaaacatcggcaaatgccaaagggaccaccggcgccgccattcgcataaaggtgagcacagcagaggtggaggaggatgaggaggaactgcagcaggcctatgaacagaaaaaaatttcgagcgaggaggtgaggaggcggcgattttttgctcaccgcccaagaaattttctttaccggtgccattttccaaacttacaattaggcctcggcaaaaaaaaaattgcatttagccaattaatttaaaatactaataattataggaaattcttaatttatgtgtcgagttagcaaattgggcagacccaaaaatttcggggagggcacccgaagagcttttcttttttattttttgctcttcggggcaaaaaaaaattattttccaaaatttgagggaaaaacaggaattgtagcgttttgcgccaaaaattggcaaattttcgggggcgggggggggatgcctgctctgtattaaatttttgagtttttttgatttataaaaatcaaaaaaaaaaaattttggactcgaaaccaccaaaaaattgattttttcccctttcctctgttccaaagagggatatgcttgaagggtccactgcgtttcggcgctcccgtttcggcgccagcatgtttttggccataacttttttctttgtaaaccaaatccaacattgttggtgtcgttcgaaagcttaatgggcttagaggttttttctaagctaatgcttcgcgattagacaattaccaaacaaagatggacatgaaaattgcgaaaaagtcgaaatttt

SEQ ID NO: 15499 - DNA, 1528 bp, Heterodera glycines
  misc_feature (1299)..(1299): n is a, c, g, or t
  misc_feature (1377)..(1377): n is a, c, g, or t
  misc_feature (1429)..(1429): n is a, c, g, or t
  misc_feature (1473)..(1473): n is a, c, g, or t
  misc_feature (1497)..(1497): n is a, c, g, or t
ttgaaaaaaatatttaaaattgtattacaaagatttttctcttttattttcagttgcgtgttcccattattgcaatgtgcaatctacagcagaaactctcaaaaattgaaacacttcgtttggccaggtagaaaatgaatggataatttttatattaaataataaaactatttgtatattttagtatattaaataataaaactatttgtatattttagtatattaaataataaaactatttgtatattttagtatattaaataataaaactatttgtatattttagtatattaaataataaaactatttgtatattttagtatattaaataataaaactatttgtatattttagtatattaaataataaaactatttgtatattttagtatattaaataataattgcaattataatatgtatacaaataataaattacttatttttaacaaaaataagttaatggaagctctttttcaaatttttgttaacttaagagaaaataatttttgaaattgtttttgtctatttaaattttcgaataaaatccttttttccccattttttgtcattatatataattaatttaccgtattactaccacacatcacaatgtcaaattaatttccccactttttttccggattatattttacttacacaaatctcaagtgactccgttgagtagggaaggttctgctgctggtgctcctactcaatgtttgattattggacaacaataaaagcgcccaatttttggccctcaaaagtgagggccctcaatcatgggaatttctccggaaggtcgagacacacaaattttgcatgagaaaatgatgggggagggaagagcaaaaataattgggcaaatttgcaggaacaaattaaacaaaaaaggaaatacaaaaataattttttgataaacaaagatttattcgaaaaaattttaaattaaataatattaaagtaatatatttttaaaatttatttaatttttgtgtgaaaaataaatttaaattacccgaaaatagacatttcattttcaggaactacatcaaagctttgaaccaaatggcagaaaaaggcgcccaaatgatgtccaaggtggactatgcgcgaattttgtgcgaagagctgagtgccaccaccgcaaatcaaattgccacttgccttggcgttccgccaattttactccgagcgatgccaacgcaacgccaacaacaacatcaacaagagtttgacgggacggcacaatcacagaccgccaattgcactccgaccaactttaagactcaatcgngaaaaggatgttttagtgggaccattgtttgaccaccaaatgccacgaatgagcaggaccgaatgtcagcaataattntgtttttaaatttgaaagtaaaaatattcatttaattaataatttccattanattatttgcaataaaatatttttcgcaaaaaattattaattacncatcaatgagcaaatatttcattnttatcttacctttacaataatatatgataaa

SEQ ID NO: 15500 - DNA, 2010 bp, Heterodera glycines
  misc_feature (1901)..(1901): n is a, c, g, or t
  misc_feature (1973)..(1973): n is a, c, g, or t
ttatttgctgctgatcacctaaatatgacagaaatgggcgtgttgccgctgccccaatgttgaccaggacaccgccccgccacgttgatgtaccacagctgaacagcatccactcgattggccacaatcatgcgaatgaccgtgttgaagaagtaggagccgaccagcagcccgcagatggccaccagcgagcggaacaggcgaacactgttttcggtctgagtcgttactgaacgggggcggactcaaatgggcgattctgtcattttgtgtttatgatcaggatcattgatcacatttgccaatttacaacccaggggcgttactgtattcgacttaaagtttgttcgcgttctgtattcgatttttttaaggataaaatcgaggccctaaaaagccacaaatgttagaccgaatttaagttttatgcatttcattaaaaaatgttgtacaaaatgccaaaacccttccttttaaatttcattagccttcttattttattaaaaaaaaataggcaaaaaacttaattcccttctaatgattgtgcattttagctaaatatgaaaaacattacccttttgccacaccaatagcgcgatggtcacgtacagtatgaatgtgatgatgcagacgagcatgttgtagttgtagatcaggttgaccggtgtgcacgtgtcgctgagttgacccgtgacaggcctaattaattgtaataaaatcaattaattaaatttcgaaataaattaattactctgtcggattttcaattgcatatagcaacacacgcacagccaaataaatgcccgggacacagctgagcaccgtgtgaatggcaaagtaggcggggccctcaattttattacggctaaatttgtttaatttgtattttaattgaaaattaatttaatttatagaaataaaaaaaagagagggacggagagataaagtgagaaaatagagaggggctagagactatggcaaaataagagcagagatccgagaacagactgactgttagagaacaacgtgatattgtggttaagccccgcctctgtttgggagagtaacaaattggtataaaaaaggaaaggtcgaatagtaaaaattgaaatttattattaatagcttacacaaaatttgagagaaattctctctgataaagagagattttaaagttttaattttgccaacatatcgcttacaaatcaggcaccagcacggacaacagtcggtccaccgccgtgccaatcatcgtgaaaattgcggcattgtagccgaagattgattgaagctgaaagacagcactggcaaaataggggatgaaattgcgcccgctgaatatggtgaacaggaaaatgtaatggccgctctggtgcaggaactcgaaaaaggagttcagtgccaacaaaaggtggctgcacccgtgcagcgatctgtcaaagcgaaaaaagtgtgaaaatttgattttgacacatttttggtaaattaacaaaaaatttcactaattttggggtaggttttgagtcttgtacttcaaatctataaatatttgtaggctggtagtccttattagagtccgaaaatttcaaattttctgatcccactccgggattaaaacttaattttgcgggatgatatcccaagggattgatcccacaaaatcccgtcctgttccaggcttcagactttgtgctaacgtactttcatgcaaaattatagccattctacctacaagaatgaacaatttaaaaatgaactttcttgaaacctctttacccgtaattagagggattaaaatttaatgtaaaaatcaaaaaatttaagcgcttttgataattcgattcgcattttactaattgtaagaatctttgtaaaaaatttcaagtaatcttaattgctgngaaaagtacaaaagttttgaattcttcttacaaaaaaaaccaatcaaactttttgtggaaagtgaaaattanaaaaaaatgagaaaatttaataaatttgaattataca

SEQ ID NO: 15501 - DNA, 1924 bp, Heterodera glycines
ttaatattaaggaaatttttttaataaatattaaaaattgaaagcattttaatttttaaattattaataaaaaacaacttggaaattaataatatttattttatttaaaatgaaattaatttttttacaattcagaaaaaataatgctattctttaatttaaaaaaaaataaattcaaataatttacaaaaaatcttcaaattaataaatacattagtgattaaaagaggtatacagttattagaagaggtacaactgtgattagaagagatacaactgtgattagaagaggtacaacagtgattagaagaggtacaacattgattaaaagaggtacaacaatgattaaaagaggtacaacagtgattaaaagaggtaaaaaagtgattaaaataggtacaacattgattaaaagaggtacaaaagtgattaaaagaggtacaacattgattaaaagaggtacaaaagtgattaaaataggtacaacattgattaaaagaggtacaaaagtgattaaaagaggtacaaaagtgattaaaagaggtacaacaatgatagaagaggtgcaacattattagaaggggtacaaatctgattaaaagaggtacaaaagtgatcagaagaggtacaacagtgattagaagaggtaaaaaagtgatttgaagaggtacaaaagtgatttgaagaggtacaaaagtgattaaaagagctacaaaagtgattagaagaggtacaaaagtgattaaaagaggtacaacaatgatagaagaggtgcaacattattagaaggggtacaaatctgattaaaagaggtacaaaagtgatcagaagaggtacaacagtgattagaagaggtacaaaagtgatcagaagaggtacaacagtgattaaaagaggtaaaaaagtgatcagaagaggtacaacaatgattaaaagaggtacaaaagtgattaaaagaggtacaacaatgatagaagaggtgcaacattattagaaggggtacaaatctgattaaaagaggtacaaaagtgattaaaataggtacaacattaattaaaagaggtacaaaagtgattaaaagaggtacaacagtgattaaaagaggtaaaaaagtgatcagaagaggtacaacacgattagaagtggtacaacagtgattagaagaggtacaacagcgattagaagaggtacaaccactgtcgaaaaggtacaataattgttggagaggtacaaaaattgttggcatggtacaataatggttaaaaagggtacaatcatggttttaaaattaaataattaaggaaatcgtttattaaaaagtaagaatttaaaaaatacaggagttctttaataaaagtaaataaattattattttaatttaaaacatttttcacaaaaaaataatttaatttaaattaaaaatttttattttttatggattaaacaaaactatttatatttattaaaatgaaaattaataatataatatttatttaatttgaaatgaaattaaacatgcaaaagtaatcaaaaaatgcacataaaaataatgtacaccggccggattcgaacttccccccccccctcaaaatgatgcctcagaatccccaatcacacagggattctgaggtcttaacgatgtcaaaagtaaaatgtgatcacgtattcgtgatcagcgtcataaactacccctaaagacatgtttttggaatattttcggtgaaaaaattttttcactcaaaaatcctgtcacccccctttggtaccgaatcacaaaatcacttttatttttgtatcttttttttaaaatgtgataaaaatataaaataaaatttatattatagagcaaaaaattgcggatttttgtagtattttacttttcaccaaattctgatcaacactctgatcaatgatcaaccccccc

SEQ ID NO: 15502 - DNA, 4042 bp, Heterodera glycines
  misc_feature (152)..(152): n is a, c, g, or t
  misc_feature (1048)..(1048): n is a, c, g, or t
ccgtacagatcagactggggtgctcttgaaaatgcacgatgaccaagctaaattagccagataaaacagaaaaccaaacgcaaaaactgacactggcaactgtttcgtgttcaaatcaatggtatcgccttcaattctcggaaggctggttntaatcaccggctcgagcaattcacgtgcaaatcgaagcccgtccatctgcttgagaagcatgaatatgcctgccatgtgctcgttgaattttgcctaaaaaacgtcgtattttataccattaaacttccttttttgtccaaataccatcgacgatcgtgttatcgttgaaggaccgcctgactcatccggttctaccgatgatttgcactgccaacatcttataataggaactaatccgacaaaacttcatgtgaattatccaaactacctcatttcttgagaaaaaggatcgtaaatttttccaatatccattgcatcatattgtcttttacaattcgctccagtacagcgataatgtgctcttaagtaatttgtagataaaaaagttgctaaaacgtacttatgaacatcatccttctcgcgaacctccaatttttgacgaatgtgatcgattttgtacttggctacgttaatcacggccttatagttgatgaaaaggtaatttacttttcgtagctttccatcgactaaattttatttatacatataaagaacacatgttatatgcatatacataccttcttctggaacgagtcgctcttttacaattttatcaacctaaaaattaacaaaacgaaaacaaaagaaaattttaaaaaaaaacttttaatgtaatgaggaactttctcaattgtctttggtcaattttacatagatcacgcaattcgtcttctttgatgatgaccctcttttgtatatattcacagagaacgtaatattcaggcccatagaaatttttcaccagcaagatgacaagatatttgagattttcgggtatttctgttagcaccttcttatcttcctttccattatttgcagacattttgttgcttanataaatatttcacaaaaatggaccgccatttttttcaattccccccccccccccccctctgcgatggaagtcaattgggcgatgctattgggtgacaagccaactgggctatttggtcacagattaggccagtccgtcagttaccgaaacgggacttgtttgtttttttttgaatctcactttattttgccaagtttaaaattttctattttttcttcttttgttcctaacaaaagaaggtccccaggtgttttgtaagtcaaaaccattgcaacatcaagaaatggtcattcttaaagatacaacataaaagtaagttttggtaattttgaatttaagtttcaaacaaaaaattttcgggacctacatatgaaagatgattgccattggttttcttttttcatgcagtccgaataactcacttcgcttctccatccatttacaattttgagattttagagttgttttattacagctgatctaaaatatttgaatgtcttttggtaagcagaatgcatgggcacgtccccaaggtttgtttcacctgaatcctaattcctattatattttatttaaatttaggttcttctcaaccgcaacaaataaatccgaatcttttcatggcaactgcgggacaagcgttttctactcttcccgggatgcccattaattctagtttgcttgtgaatcaagctgcttttacaaacatgaacacggtattggctcaagctcagcgccaaatgcttccgcaacaacttcaatcgccacaacaacgcgtcactcccacaaatactcagccaaatcgttcccaacgtacatttattggaatcgttacaaagctaatggagacatacggctttgtcgatgaagatgtttttttccagacaaagttacaattattatcagcctcgaatgcatatttccatttagtgttataagaggatcaatgccaagagttggagatcgagtgatggttgaggcaaattataacccgtctatgccatttaaatggaatgctcggtcaattgaaaagatacaaaatgtggaataccgtcaggtatcacatttttacttccattattgaacgttatcttttaggaaacaactcaacaatatcaacctcaccaaaaccgacaggtccaacaaccgcaaaacgggacgtcgagtcgttggaatgatcgtccgccacgtgatgaatttcctcgtgaaccgcgacgtcagcctccaatgtccattcataggactcctcctcgggatgccggccgtaagttacgttaaccaaaattattacattttatttttaagaaaaacgacctctttcacgacagcgttcaccacttcctcgtaaaagtcctccacgtcgtcaagaaagcacagtttcaaaaagggagcgggaggtccgcgatgaaaccgaaacccgagagaaggaccgagagtcgactcgcgcacgttctcctcagtcgggcaagcgagacactgcttcaccacctcgacgtcggcagcgcattatcccccgttaccattgtaacgtgtcgaaacaaacaattccacagtacacgcttttttttctatttttttcgtgtaattgtcaattaagtggcgagttaaaatatgcagaattgcgaaaacgttattcgagtctttacataccgtccgactttattcgctgcaagttcagctgggttgattctgtgaaactcgagacgcctcttcaattttcgccacacccaatcaaatttcatgtgcttcataaggatgtcgatgttttgttggacgagggcaaacaattgccgttggaaaaccctccagatgctgacagtcgttttgttgtaaaggtaatctttcaaattaaattagtttatttggattgattttctctttttccggttaggttttacttatctcacatcctggacttactgcgcttcgccgaaaattgagcggacttatgccggatgggagcattgatgaatccacagaaactcaacccttatctaagagtatccaaatacttgttggtaatatttttaactgttttttttaattagtcgtttaatttcagggtatcgtggaaagggcgagtttatgtgcatcggcggcgtgtggtcaccttcgttggatggtacgaatccacttgacccgcaaagcatggtcaatactgcgattagaacgacactttctttgactgggattgatttgtcaagatgtgcaaaatggttagtcgtttggtttttcaagttttaactttctttggtaaatttctctctctctctctctgtctatgatgctctctctttctcttactctctccagcttcatttaggttcacttttgcgtttgattgttatttccgtttatttctctttttctgttcttgccacacaccctttaaacttctgatgcaggtacaagatgctgcatttgcattactttcgacccgagcgtagtcgcgttgactcgtgtgtgctgatgttgcctgataccagcaccattactgactttcagctctcagatgagcaataccaacagactgtgcagaaactccaggaccaactggcgtctaaattgtctgcaatcgatgcgcaggattttgtctcaccaaggcgggaaaatgagaaggggttaaatttggattctggcgatggtgaagctgctgcggcggaaaccggcgaaaaaataaatcaggaggagagaagcggtagtggtggaattgatcagtcgcccaaacagccggcggttggggaccagcatcagccagaaatcacaaacaccatctctgctgctgaggtgctttcatcaaagcgatttataaaagttgtcagctcgacctcaatgtgttcgggagttgccggcggggtcgaattcttgtcatagctactgcatccaaccatctttattttattataattcatgcatacatttaaatattctcatgcaattctggtctttgcgggggttcttcctctaacccagaattacaaaattagaaaaata

SEQ ID NO: 15503 - DNA, 1226 bp, Heterodera glycines
  misc_feature (1136)..(1136): n is a, c, g, or t
  misc_feature (1186)..(1186): n is a, c, g, or t
ctttaactcaacgagaaatgagcgaaaaacacatttttttattcgaaatttttgcgttttaacgcccctatccgaccctaggaatccctattttgggtgttcgcccctaaaataagtttttatccctattttggcgtttcgccccaattttcgcccctatttcgagattttcaaatttttcatataaattcacaaatttttttacaaaaatacaatgaaaaaaaatttttttttgacgcgataacattttttggcaattcatttataaattttcaaaaatttttccactaaatatgcttttttcttgaccaaatttttgtaatttattttctttcttttcaaaatttagatttttgaaattttagttattttgtaaaaatgtattcaaaaatttcgaataaaaataattttttgtatctctaatcaatgaataaaattgtctgccttaattttaacttatttacatagaaaaaacagcatttttaataaatttcacccctacatttgaaactttttcgcctctattttgcccctatttcgcgatttttctgcccctttttaggttcctattttggactttttcgcccctaaatccgggccctagtaaaattaagaaatttaacttctattaattttttcgttttcatctgacgttttttaaattgaacaaatttaaggacttataaatattctaaacacaaattgtattaagaagccaagatttttaataatacgaatatatataaaaacttcaaatgtacttttctataaattttgaaaatctaataactctacaaattgcaccttttttgctttgtccttgttcactttgccggtttcgtcccgagtggcggcacacaaattggacaacagtcgtctgtaagtgccactggtgtcgtccacaatgtccatttgcagttccttggtgaacagtttgaagtaagcctgaggaattaaaatgtagaatttagggctataaaattattatttttaaacaaaaataatttttgatttttaaatatgcgcactttttgaatggcacgaatttgctcattgcttcttgtgaccaaaatattcgttagaacatactcgtctgtaccaaatccctggaaattactgcagaataaaaagatganaaatagagcaattgcattttctaatttaaactagggtttggaccccgtgngcgggggtagctttttcgcgggggcgggtgagccccaaaa

SEQ ID NO: 15504 - DNA, 1087 bp, Heterodera glycines
ctgcagaataaaaagatgaaaaatagagcaattgcattttctcttgagcaccaatacaatatggatattcttaggcaaattcaaaatttcctattttttgttcgcgacgcctattgacacaacagccccctactgaaaaatgctgtaaaagtcctgtaaaagaaaaaagtcacaaattttgaatttaaactagggttcggaccccgtgggcgggggtagcttttcgcgggggcgggggtgagccccaaaaacatgtcccgcccccggggacggggtccgaaccctaatttaaactgaattttggaattaaaccatgaaatttctgtcgaagttaaacaaaaaaaaaacatgaaaactcaatctattgactttaagtttgttgcatgaggggtacaagcggtaggcattaaatttgctaaatgttacttttatcgcattgtgaaggctaattgcgtcgtactcgtcccactcgtaaagcagtgctaggataagctctttgggtccttcgtttggcagctccacgctaatagactcagtgagttttttgtgaaagcgaattttgaattccttggcaatttggcggcgcttaaaaattaattggtagtcattcagcgctttttggtttcgatttagcaatatttaccgtagtgaaattggacaaaacgagaatgttcaaaatttgctcagtgtccggttgattttttgtgaaaacttgtgacaggataccatcaccttgcaccagccccgttcgaaaaatggatttgtaaattttgtcggcgtttgcactcagtagtttttttccatcttaaaatttttttaataatacctttttatttatttcatgaccaagcccatatccagaaaaaaatttacaaggttatctttcttttttgttttcgccaccaaaatttttcatgattatttccaataaaattggtaaaaagattgaccagttttcataaaatatctatctatatatgatttttttggtacttccgggttttgccacccccctgaaattttttttctctaataattttttctaggataatttttgatgctgatcatgaatatgaacctttatttt

SEQ ID NO: 15505 - DNA, 2347 bp, Heterodera glycines
ttaagccggttttgagccaaaaatgcgattctagaaaaaatgtgaagtttcgtctatttgttggaattcgggttcaaggttcgaattggtccaaatggatgtaagaatcggattctccgaccgtaaaaacccaaaaatgactttgctttgagaaaaaaattttgaattttttttggaaagggggggggcaccatcggcactgtaacctttttaaatttttcacgtaaaatttcacggtaactcacgtaaaacacgttatggctaaaaataaaggtcagattctttatcagcatcaaaaattagcctagaattattagaaaaaaaatttcagggggggggggtgacaaaacccggaagtaccgattttttttataaaaccaccgtcactgccacccaaattttgcgtatgtatgagctttgagggttcgccgaggcttcctgaatgaaatatttttattattgtaaaagtttcattattaaaaaggtccaactaatagaaaatattaaaaagcaaataaaattattacattaaaaaattattccatattttcaaacagccaaatgtttttctcagaaaaaatcgtacccgccaatttgctttgacagttagatactactgctccacatgccaaatctgccagttgaattcgacgttcacggagaatagattgacaggcaacatccaattcctggaagttcgatttgcagatgggcactcctccgtttattgttcgaagggtttcgcacatctctgagctacgaataaacacatctgagattgggatgcaaaatctgataaatatgtaaggtgcatattaaggttgtatttcacaaaaaaccatatccaattttataaatgcttaaacaaatttaattaaaagcatgaaaaagtttcatggaaaataagttaattgaaggaagtaaaatattgaagcccgcggaactgggatttcggcactaactcacgattttcgttttaactcaataattataaataagaaaacaaaaatgtctttttattatcattgaacttgccaaatatgaacaaaatccgattattttatgaaaattcaagtttttaaaacctctgctggcgctcaattggcaaaaccggatttttttgaatgctgttttgcccgctcgctttttttttcttcaagttaaattgtaagagcgggtagaaatttggcctatttttttgatcagtgccaaagtgccgattcccgggctcaaaagattttaaatgaagaaataaaaacaaactaaaactaataatttgcatgtcaattatccgaaggttgtgaaaatatagaaatacataaaaatgcgctcaaaatttatttgaaaagccttgaaaaacatgcctgcctgaacgttgcggaaggacgagttagtggtaagcattgaaaaaagtccaactgcgtaagaacgagaagaaatgtccacaacaagagccgaaccagaatctccctgagttttaattggattagtttaaattctactatttttcaataattaggataaatatgtattttaagttaaatttataggaaaaagaaaaagtaataactatatcgattttgttaaaatataatatttttcacacttattaataaataataattacgtccctgatttaaagtaaaaaaaaaaacacttcaagtccacccaatgatcggctgccggcacaaagatggtagcgttcattgaagccgctggccttttgtgctgatcggctaaaaattttttaaaataaccaccaaatttaatatttttatataaactgaatactatataatagggatggctagggccgtggtgcgacttttggggatttgcaacttggggacccgacatttggggatcccgacatatggggacccgacttttagggacccgacatttggggatcgaacgtcatttggggatccgacacttagggaacccaacatttggggacccgacattttgggattaaaaatttaattttatgtcaaaaattggacaaatttagcctgctttagccagataattccattgcattgcaagaaaaacaaaataatatttttaaaaataactctgtttccggactcaccgcaaggaagtagcatagccctgctaaccacaagacaatagaaaatcacaatatattttttatgtacagtacacccctttccaattttttttaaaaaacgcctttcccaagggccaatgggaacatacattcttcagggacattcaatgagttccagaccgctttgctgtctaattgcgtacaacaaatgccgagatcaacttttctgtttcttatctttcgagtgattttatgaggtgctttaaattaatt

SEQ ID NO: 15506 - DNA, 348 bp, Heterodera glycines
ggtagggaattggcggtagggaattggcggtaggtatttggcgggtagggaattgtcggtagggaatcggcgggtaggtttttgtcggtagggaatcggctggtagggaattggcggtagggaattggcggtaggaaatcggctggtagggaattggcggtagggaatcggctggtagggaattggccggtagggaattggcggtagggaatcggctggtagggaattggcggtaggaaatcggctggtagggaattggcggtaggaaatcggctggtagggaattggctggtagggaattgtcggtagggaatcggctggtagggaattgtcggtagggaatcggct

SEQ ID NO: 15507 - DNA, 2322 bp, Heterodera glycines
ccaagtaagttaaattgcaaatatctaaaatttgcactaacggctacgcattttgtatatgccgtctctaatatcaattttccaacatgtacgaattcgcttctataggatacatataaactgcctttttccaatgctttgccaattgttctatttgataaatgactacttaaatttcactgtttagtagaaaatggcgactgcagggcaattgctttttgatgagtcgggtcaaccttttattgttattcgcgagcaggagaaacaaaaacgtttgaccggcattcaagcgctcaaggcaactctttttaatttatttgacaaatcaagtcacttcagagtcatataatcgctgctaaacatgtggccaatacattaaaaacttctttgggtcctcggggccttgacaaaatgctcgtaagctctgatggcgaagtgacaattacgaatgacggagcgacgattatgaaagtgacttcgtttgttgttgttactctaattaactgataccactttagaatatggacgttgagcaccacgtggctaaattgatggttgagctgtcccaatcgcaggacgacgaaattggcgatggtaccacgggagtggtcggtaagtgacaaagtgcgtgctgtgctcattgtaagttttgccgaatccatgtagtgttggccggtgctctgctcgaacatgccgagtctctgctggacaaaggaattcacccgacgaaaatagccgacggattcgaattggcatgcaaaaaagccattgaaaagttggagtcaattgcgcaacaatttcccatcgatgacagagaggcgctggtcaaaagtgcgatgacttcgctcggctccaaagtgtgcgtttgtctccaagttttgagttaaaatatcattttagtgtgaacaaatgtttgcgccaactcggtgaaattgcggttgatgccgtcctttctgttgccgaccttggacaacatgacgtgaacttcgagctgatcaaagttatcggaaaagtcggcggacgcatggaggagacggcactgatcagaggagtagtcattgacaaaactttggtgagttttaaggattcattgaaaacaacgcctttcaaatgtgcagagtcacccgcaaatgccgcgtcgcattgaaaatgccaaaatcgcaattttgacgtgcccattcgaaccgccaaaaccgaagacaaaagtgagcagattttcaaaccaacacaagaattaaaattgatttcaagcacaaacttgacattgcttcaactgacgaattcaaacaattgcaacgttacgagaaggaaactttcgagaaaatgattaacgaggtaagcctttgttcccgagacaacccaggggtttggcatttcccacacgaagattaacgattttaactcatttcccaatcttttgcccatttaaaattttttgtttgttaggttaaatcatgcggagcaacgttggcattgtgccaatggggttttgatgacgaggccaaccatttgctgctgcacaaccaattgcccgcagttcgatgggttggcggaccggaaattgaagtattgggaagtaaataaccgcggctgaaaaatttttgttttcagttggttgccatcgcaacaaatggtcgcattgtccctcgctttgccgaattgactcccgagaaactcggctcggctgggctggtgcacgagctgaaattcggcacggacaacgagcaaatgctgtgtattgagcaatgcccgaacaatcgggcagtgactgttttgattcggggaggaaataaaatggcaatcagaggactaactgaagaatgaacacattcaaattatgccaaattaaggtgattgaggagacaaagcgttcgttgcacgatgcattttgtgtggttcggaatctgatcagagacaaccaaattgtgttcgggggaggggcggctgagttggcatgtgccatcgcagtggcggaagaagccgacagagtgagcaaggatctttggtcactttgccatcttttcatgtcttcttaggtcgctggcgtcgagcagtacgccttccgtgccttcgccgatgctttagagagtattccggcggctttggccgagaactcgggtcttccgccgatcgatacgctcactgagctgaaagcgaaacaaatcgaagcgcaaaacccgtggttgggcgttgattgtctgcagacgggcaccaacgacatgaaggagcagggcataatcgaaacacttctctcgaagagggagcaaatctctctggccacccaagtgggattgagaatggcatttgtaaatactcaaaaat

SEQ ID NO: 15508 - DNA, 1086 bp, Heterodera glycines
ttctcatgctcgagtcgccaatgctcgccatcagagaggagtacaccgattgggtaggcaatggctgatgacttacggacaaagtgccaattggcgtgggatttgcaccttaacaaaaaaagcccattcaaactttggcacatttaaaatgaaaacggacggactttcaactttggtcttgtaaagttggatgatttgattttgctcattccttcgaattgggcgcatctccaaaatccgctgtaactcagcggcatcggaatcgggcaaaatgcgaatgaaatgcgcaacaaattcctcctgatttgacttgtcagccatcaccgcctcaaatcaaaggaaaaggtgcaaaactaatcgctccaaatctattttttaaaaaagatggaccttcaaaaccatctccgcctttgtcatccctttgttgagaatggctgtgtattgcgtcggcggtttggtgacgacggcactttcaacggagggcaaactgagcagaaaagtctttagagagtgcgtgtccagcaaaagttgttcagcaccggcgatggaaattggacgacatttgaaaagggcgcccaaaaaacgattgaccaattgggaggctaatttcagacagaaatgggcgaaatattttcgactaaatttagaaataaaaaaaattaattaaaatgacaaaccgttcggaaaagtagtcgcgtattaggggaacggatgccctcagattttttcggatcgtcgaaacatacggtgactcatcgcccacttggtcgacatttgaccaacaaaaaagggaaaaacgtttttcattcgcttcgccgaatcccccgtcccttttttggtcactttattttgttcatcgcctgcaatgacggctcgcacatcgtttcggcgtcctgcaccaaaagcatcaacgcactgttgcaaatgctgtggaaaagatccgtctcctgaccgaagtcgccgtcctgaacaattaacaatttgtcaaataatatttataaagccggacgagcgacttgatagtattatcaaataaaataccgaaaaaatgatcaaaaaaaaactgaaatgccgatcgacaaaact

SEQ ID NO: 15509 - DNA, 2576 bp, Heterodera glycines
  misc_feature (41)..(41): n is a, c, g, or t
  misc_feature (59)..(59): n is a, c, g, or t
  misc_feature (2553)..(2553): n is a, c, g, or t
tcgggctgcaaatgtcggtacacgtgtaccctaaaaacacngcacaaaaaacattattntcattcaaatagaataaaaggctttccctttttataaaatgttgccaacgattagcaattaccgctatcttttgcctcagtttgtcctgcaattgcatcgtcgtctccgcactccaatcggcggtggcgaggacacaacacgtaaaaaaggtttggtcggcgtcgagtcggacgacgctgtcgtcgcgcatcaaattctgcagaatggaggtggaggcgccgattattccgcccgcccccggcgaaacgccgggaagggcctggggcaaaaaggcggaaaggcacccgtgggcgaactgacgaaggcactgacggaacagctccaccaatttgctaaatgaaaagaacagggaaagtaggaaatttataaaatgccaaaaattaaaaaaaatacgaaaataaatttttagaatttccacctgagcaccgcatttgggtcagcgaacaatttggttgattcggtgatgattttcttcaccaaaaggaataaattggccgccgatggcaacggaatggccgtcgcgtgcgtttccctctgcggcttttcctcgccgctgcgaattcgaagtgcgcattcgtccaaaaatctcagcaattttccgcgctgttcttgcacaaaaatatccatgtgagagtcgaaaacggaccaaatgacctaaaaactgaaaactattaaagcaaaatgaggtcaggtggaagaaaccctgtcgaaattgtaattgtttttgctcggaaagcgtttggcgagcagttgctcaaacatttgcgtgtgatttatggcatgggacagcaatttccaatccaattcgcccctccggcgttccgtcattttgcacagcgaattccttagggttttcaacaaaactaagcctccaattctgtgaaatttcaatggacttccaacctcgttattgtgcaaaattccattgcgagtttccgccccatttcccattgaggggggaatattttgacgacccctcttcgctcaaattcggccaatttgtccacaaaccaccgatatctgaaagaaggctcttaaatgagcgagtaaaaaaataattttggttttttacctttcttcgattctgtccaaccaggcgacgtcttcagagtccgcgtaaaggacagtgtaaatggccaattgttggttgataaaccaattgatgaaatcgtcttgaagttttccacccaaaacgctctgaaaataaatgaaaaattggcgatttgctctaaattgtcttaccacaacccgacacatttcagaggtttgttggtcgacgtggcccgtctaaattggcatttaaaaattgaaatataacttaaataataaatttgccttaaaagccgcttttaaatcggctgccaattggacggtcaattgttcgcggattttctgcactttgtccgtcagctgtttgacgtgttcaatgtgctgatagtcctcaaataacaacagaacgttgagcacagccggcagttccgttgtaatttcattgtatcgcctttcggtgacccattgagctggaaattaaattaatttaagtgacagaaatttttgtttttcaaagccatttactgagcaaattcactccgttgagaagcaattgcaaatggtggagagtggcgatggattcggtcagatttttcttggcaacgtccaattgtcgaatgtcttttgtcagttcgtgcacggaagtctcagaacaaagcgttctgtcacgaatttcctgcactttttgctccaattccgttattgttgtctgggcctaaaattggaaatagttagtttttgtattgctgaataattgtcaaaatgactgaatggacctgcagcaaagcgttgtttgcctcaagggcacatcgcccgtgttcagcgacagcctcggacagttcacggtcgtaattggcctgaacttttaaatgcggaaatgtacatatagaaatttttttataaaaaaagttacaatttcttcgtcaattttctttacaaacgaatccaaatggacaagtgattgttcggtagggaaaatggtgtttatgtaagtcgtcagatcaaagtcgggacgaagcatttcagagtcatcgacttgggccaaaaaagaacggacctcaattccaattttcattcaaagttcgaattgattgattgagtctatgggacactcactttggaagaatagacgggaaattcttcaaaggactgaacatcatcaacagtttttctcgaattcgacgccatttccgattgcgagtcgatgtcaacgctgctaatgctgctggccattggacaacgaaggattaacaaaatttaaagggctgacaatgagagagaacggagtcacaacacagcaacacaaacggcagagaagttgtttaattggaaagacgacaaatttaattccaacatttattcaaatataatgggcaaaaaaatgagcactttattatataaatgagaaataataattgggaagttaattaattaaaacgccanattaccataactttttttgcgac

SEQ ID NO: 15510 - DNA, 1101 bp, Heterodera glycines
ataaatttttggaaaaatttgtctgaacgtttaatgtgagaccgcatttttatccaataataaggacgaaaaaagaataaatgcaagattaggagaattgacaaaaaaaaacaaagaaaggtccatggggagaaaaaatttgtcgagaaagttaattaaactagacaatttgggatgtgcattatcaactagaagaaatgaataggattacataatgccaacacaacacaatttaaatcaattacaaagagtgccggtttgtctgaggggcaaagagaaaaggaaaagccatgttctataaatgaaaaaggaaaaaatgaaataaattgagtggagtgatgatggtgatcagatgatgatggatgaatttcggactacggtcgatcgtttgcccccgccccttctccaaggttcactcggtgcgctgtcgtttgaatccgccgctgtttccgccgctgtcaccaccgctcgtccccgggccggggcccatccgcgcggcttccgccccatacgccgggtcggccagcagaaaggcaatggcgccggccaaatgctttgtgtactggtccgcctcgtgcaacccttgtgagagaaaattgggtcaaaaccacaaaaagtggtaatttttggtaaaaatctgttagtaaatcacataactaaatttttcggtaccgtcggaccccccgtattctcaaaatttttggaaaaagcgcgccgcaaaaaagcggatttgaaaagaaaaaggtcatcaaaataggcggtcgacctcctcccctccttagcaaaaattttggtaaaagtggagtcatttttcaaaaaacttttttttcaaagtcatgaaaatatgtttttgaagcactggtggctttcagtttgtttccgtgtttttaaacaagaattattttttttaaaaggggggacccactcaacttttaccaaagtttttgtcggtcccccacccccacctttttaatgtttggaaaaacttacggtcagccaaacgcttgctgcttttcttctcgcggtccaactctgaaaaattgcataatttaatcaaataatttattttggcttaaatggtcattttttccatcccccccc

SEQ ID NO: 15511 - DNA, 1790 bp, Heterodera glycines
  misc_feature (1725)..(1725): n is a, c, g, or t
aaaatttcctaaaaaaaattgattacattgatcccttaaatttgtggtttttttttaaattttaaaattttcattacgcaaccttgtcaatttgtaagatcattgatggctttttggttctgcgcacgtagcgaatgccattttggttcagcttcagtcgaaaaccttctctgctccatgccgttcgatcttcatttgacacaaaaatttgtgaaaaatatttcttcgtaagggacgacgattgggaaagtgttgaggcaacaccacttttacgcaaactcatacggtacctttacatgggattgggctacggtcatttgtgtcaaagagttacaacagaagtttattttaattattacaaatcctatttaataaatttaaattaataaattatctgatgttatattttaatttctcaaaaattgaaaaaaatctattttttatttgtttaaatttataatgaaaaaaatcgctttattttttttcagcattgctcggcattttttatgccgtcccggggggggggggggtgcgccaggaccaatttttcgtacgaaggcccccaattttcaccgcaacgacttttttctattctgaacacttttctgacgacctttttttgctattcaaatcatctttttttgcggtgcgtttttccaaaaaaacttcgtgggaagagggtgtggcggtccggcggtgccgacaggcgccgccgggaaaagtttttgaattttgtatgcgttttgctagggaaattgttcaaattttaactttttcccccttcgtttgaaaacgtatctgacctgctggtcataaaagtactggttttgctcgtccaattccttcgcttccattttgccttgttcgtccgccatcgacgcttcgttttgctgactattggcgtcgaaatattgagtctaaatttttaaatgtttctttcgtggattttaaaaaaaagaaaattaccaaatcgtgcgtccattggtttttgtcctctttgagctgttcgatttgttgttgttggtcagcaagctgtacaaagaaaaaacattcaacaaaagttagaatgttatataaatgattttttgagagatttttctgaaaaattctactgatttgataacactttttttaaattctttaaatttttccaatgagcctaaaattgtaaattcagtcatttttggacaaatttccccgggggagtctatcggcaccgtgcgacccacctgtctcccacagttaaaaccatgtttcaatttggtttcaaaacaacattacaatttgcaaactcaccgctgtctccaaatctgccttttcctcgccgagtttggcatgctggtccttcagcctggcgtgctcctcctcccacttggtctgctcctttttcagttttccaatttcttcgtccgcctttgttcgctcccgcttgagtctgatgatgtcttcgtccgtcttcgtcctgtcgcgcttcagttttccaatgtcctcctccaacttggccacgcctcgttccaatttggctttttcggctgtgaagttggcgatgtcgtccctgaggtcgtccctctcctgcgtgcggttcttcaacatcagaagcgctgcgccgcgttgtgcttcctctttctgcttttcctggaaagcttttgggctttctttgtgccttggccttggcccctcccccttcccgtttgtttcttggtgctgcttaaaaggtcgggtggntgtggggggggggggctgtgtcccctggaaggggaagaaatcgctaattttcgaaaagaaaagca

SEQ ID NO: 15512 - DNA, 2508 bp, Heterodera glycines
ttgcttcatcaatttgtaagtttccacaattcatttgtcattcttgtctgctcacccgttcaatttaatttttgttttttctcctttaaaactttcaactatttaacaaaaaaatttcaggccaattgctgttgatggaagtgccaaaaggcggaaacaaagctcttcgacgtgccaacctcgattcggcccaatcaattgacggcaacattgggaacaagcgccgacgaacggtttgcccaagacttttcgggggggggggttagagacatgccaccaaatgcctaaggcctttggggcttctaatacaatttaaaattatttggcagctttactgtgccctaatatttctaggaagatccaaattggcattcttggtattatttgggagcaccaatttacaaacaattttggtcataattttttaaacaccatgaaattttttttgaaatttttctggctaatagaggaggaataagaaaatgtttaatttggacactttttagaaaaattacaataccttaaatctgtcaaatttttgacactcttactgaaatgtccattttaatttttccaattttagcgcaacgagggcaatcagcaacaaaacccgcaaccgcccgagttcccaccagtcattttggccgcacatcactcgcaaccacaacatcaattactgaatgtgagtttttcatggttgcatatttcaaccgattttgttaagcgtaaaaatatggaaaattttaaaagtttttctccctttttagcagggacattcgacaggcgcctttccatttgttgaccctcagcaacagcaacaattgacgccgcagccattgggcacgccggcccgggtttcagtgacggtgagggttttttagggaatcccccccccttttttcacgtttcgaccccttccccttttaagtatacgaagccgtttccgatgctggagcaacaacagccgcagcgcacccaaaatttgcaacaaggcgatgaagcggcgattatagagcgcgtccgtcagcgacagctcgcagaactcgctgcaatggaagcagctcgacccatcccggacgatctgcagtactgtgccccgtacaatgcctatgggctgaccagcatcgggtggcttttgatgggatggcgagaacagatggtcataaggtcagaaaaaggggcatttaccggggaacggaaattgagacagattggacacccgaaaattatgtccaatttaggctgtccagttttcggtgtcaattttgccagattatatttcgctctctcttccagcagtctgatcggcgtggtcacccaaagcggccccatggggggtgacaaggccaaattcaagggccgaaagctgattctacaatttgacaaggatgcatctcagcttctcaccgtcaaggaatgggagagggacgacggccggcccagcgagttggccagagcgcaagccagagaccgagtgcatttgcagcgattgaacgtcgtccaacagaagggtgccattgcaacaacaaacgaaaacactttcattttcactctaaccttcggccagttttcaaccatgaccatcatttcgcatgcggggaacggtatgggggggggagggggccggaagtggtcgtgcctttgactactaaagtttcccgatccccccaatttagagtgggccgcaaacgcaaccgtaccgcacaacttttttggcattgttagcaatcgcgccggtaagagctcaatgaattttttttgcactacaatttcccccaccccaaaaaacagatggaaccgggagtgccaatgtccaacagcaacaatcacaacagcatcaacagggaacatcggcggcgctgcatgcgcaagtgggccaaaatgaagaagaagaagatgatgaagaccttttgctgtgcattgaaaatggccaggaattgtccggcggtgatcggcaccagccacaccagcgcacctcgaccccggtgagctgagctgcccgggggcgagcaaccgatgttgttgttgttgatttggaatgttttaatgaaataataaataattgtatgtatttatgtgtgtatgtgtgtgtgtcggtgatcaattaatagttttctgctagggcagctccagagtgatcagtgagtggctgaaccgctcacgagtgattattttatgtttggatcatacgcgtgtgatcatttagtcggctggaccgctcgcgagcggtcacattatggtggggccgcacgcgagtgatcattggtcgcctggaccgcccgcgagcagtcattttatgttctaatcacacgcgtgtgatcgtttggcgcctggaccgctcgcaagcggtcacattatgttcggagcgcacgcgtgtgaatttgttgactgtatctctcgcgagcggtctctttatggtggggcgcatgcgtatgatcgtttgtcgcgcaagcgagcggtcgctttaaggggggggcgcacgcgtgtgataatctgttgactggaccg

SEQ ID NO: 15513 - DNA, 1324 bp, Heterodera glycines
gggggcgagcacccgatgttgttgttgatttggaatgttttaaatgaaataataaataattgtatgtatttatgtgtgtatgtgtgtgtgtcggtgatcaattaatagttttgtgctagggcagctccagagtgatcagtgagtggctgaaccgctcgcgagtgattattttatgtttggatcatacgcgtaatgatgatttagtcggctggaccgctcgcgagcggtcacattatggtggggccgcacgcgagtgatcattggtcgcctggaccgcccgcgagcagtcattttatgttctaatcacacgcgtgtgatcgtttggagcctggaccgtccgcgagcggtcacattatgttctgatcacaagcgtgtgatctgatgtcgcctggaccgcccgcgagcggtcactttatgttctgatcacacgcgtgtgatcgtttggcgcctggaccgcttgcaagcggtcacattatgttcggagcgcacgcgtgtgaatttgttgactgtatctctcgcgagcggtctctttatggtggggcgcatgcgtatgatcgtttgtcgcgcaagcgagcggtcgctttatggtggggggcgcacgcgtgtgataatctgttgactggaccgcccgcgagcgatcaccgatcatttgtcggctggagcgctcgcgagcgttcacattatgtgggggtcgtacgcgtgtgtgtgtgtgtgtgtgtgggtgtcccgatttccgaaaaagtttggaccccaggaattccgattttcgatttccgaaaatttttggggctcggaatgccatccctaatgtgtatgtgtgtgtgtgtgtgggtgcctgagcatacgcgagcggtctctaatgttcgggtcgcgctcgtgggatttttatttttcattcttaagccgcggcgaagcgcacggctccgtgcgcccggctatcgtccgctgttccgagtcgtcttccaccattcgtcgaccaccgggaaccgcgtggcggaacgacgcaagcagcaacgtcgctcaaaacgacgttgtcgacagcgactggagcggcagcgcctgcgtgccgaacggcagcctttctggcggttgctggaccaacagtgggccgacgaagcgcatcacagagagctggtggaagacgactggctgctgtacggcgaccagctggcgaccgcaagcgacgtgatcctggccgacggccgcccactggacgattggcttcgtcacgacgagaccgtcgccgattggacaccgctcgaccattcggagctcaaacgactgtccgacggtgtgcatcggacggcgggtgtcggagccgaag

SEQ ID NO: 15514 - DNA, 3096 bp, Heterodera glycines
  misc_feature (3075)..(3075): n is a, c, g, or t
cctcaccatgttttcatgaatgacagtcatatgaagacaatctaaaagaaaggacaaacgaatggccattcattcaattcattcattaatccgttcattcattcattggctttaatcccttttttgatcaattccctcgttcaaaagctatttgttatcaatggattgaatccctaatccattccctattcattatccgcttttcgttctgtgaccgtttccgttcgtgtcctgtgcatttgggtccgcccttttggcacggaggaggcgataacagtcgaattggtttgtgcacgcggcaaacgccagcggatactcgccgaaatacatccgtctgattgggcggtgtccgttttcgatttcccgatccccctcccacgcccattttgttttaccccgcgtattccgtcttgagattcagttcgacgtattcgtgttccaaggaatccgtccgactgcccttaacaaattgtaaattgtttggccattgaaaatggaataaattgccaactttttggtcgtcgggacagaaaaaagcaccgaagcatctgagcaaaggcaattaaagaataattgtcctaacaaatcagtgaccatagcatttggtgccgagagtgtaattccatcgcttaccgttggttcacatccgctccatgctgcaacaaatagttacacaaagaagggtcctcgttgacaattgcttggtgcagaggcgagagacctttgcaaatggtcattactaattacggtgattaatgtacagtgtttttgatggactgtaataatggctaacactcactgttagttaatcagatccattatttattcttcgatttttgattgtttgttgctttatttttgcccattttcgtacatacagtaaccaatatgttttggtgtgtaccgtaataatcctcggaaagcatcacgtcgttcaccaacttggggaactcgttcagcagtcggatggccaactccgtgtggatgggcccaccctgcatcagacaacagccaaccaaattctcgcccatttgccctaattggtcggcttttcctttgctttctgcttttcctccccacctctctcctcaattttccacacaatctctcggtacttcgcgtcaccttttaaatttgaaaatttttccaaatgattgtccctctttctcttttctcacctttcccgccccttcccccgtcaagcagtttcaatgcttaatcaaaataccaatgattcttccatccccgaattgcccctggcatttcgttgcctttcttcaaatccccctggttttgattggcgttttgattgaagtcgtccaaaatgttcggtccgctttttccctttccttttttgcgggaaaaagcgccaagccgttcattccgttctttgttgcgcattttgaccagttctgccaccgattccaatttgcccttccccgaattgtacatcgcctgtttgatcgttgtctgacaaatacgtgaaaagggatcaatccgatcagtcaaaaccatcgatcggcccaatcaatgggtcgattgtccaaatcccacctcgaagtatccatccacgatggaatagtcgccgcctttccgagcatatcgcatccatttgatcagctctccgcccccatgcatgtccacaagctttcaaatatgtttaagttagcattgctacactttccgtcctccaatttgccccttttcatttgctttgtctgtcgcccttttgtcctctcacttggtataacttttggtgtttgtcggtgcccatttgtgggtgtccaattccactcgttgccatttcgtgtatttacactattcagctttattatatcctagtcaaactcagtttggtgttaattggatgatcaatacttttatcattttagtttcttttttatcgaacaaacaaaacttaatattttatattatgcattcgaaggccgattcgaaatccaagacattggttggactgaatggaggaaaactcaaccaatacaatccattctcgacatcattttcattctcgactcattgtcagcaaaatattttatgggggatttgttgggcatataaaaaaaatatttaatattcacacacaaattcaatttgattgttggcattcccacggacacgcgatggataaatgggaatggttcataggacaaccgtcggtttcattggcggcacatttttgccaagtcaatgaataaatcgaataaagcctaagcaattgagaaaagagaaagcgcaattggaacaaaaaagaaaagcacctggcaaaatgaagagaaaaattagttggaccaacggccaaaaaacgacaatcacagcatttttgaccattttaaaacaccataaagcagtcacatcaaataacagcctttaaattaaactttaattaggatgccaataacgaagagggagggatcagttcaaaacatcgacaaagaaagaaaaagaaaaatgcatttaaatctcgaatgacactctttttagcgattaattttatttgaacacattttcttttctgaatgacattgtaaaaaaaaaggaatgatgacaggcacaaggaaataaagtaaaaaatccacaaaaaataaggcgagtacgctctcttcatctgctgaccgtattatgtacattgtccggttcgaaagggtcgtcttccaatgcgcccacgaaataccaaaagcaattttcatgtgacagtgttgtgattcgttgtggcacacatgacacccacaaggcgagatgcctgccttggaaattgtctgaaattgaaggaaattacaatttgacaaaagccaattagcagaaaaatcacattgggaataggcatcgttgtcaacaaaaatattgccccacacggtgttcaccagcatcccgcttctgcctttgagcattcgccgttttacttttttgagctttcctggcgaaaaatggacgggcacttttacctgttgaaagggggggggggcgtattcgccgataaaagcatcatgattgttcaattaccataacagtttcgtatgtttccgtttcttcgtattgaacatgaccacgaatggngcttttactaatccgatctcg

SEQ ID NO: 15515 - DNA, 2644 bp, Heterodera glycines
atttgtttgaattcataaaattcgaaattttatggcataaagtcaatttttttaatttgacccaatatttaatctatttgggcagagtaaaaaatgcataaaagaataatattaaatttataagattgttaaaatattaatgtttgtagatcaaatgtataaaataagaataaaaaaaatccaataattaaatgaaaaacaattagtttagaattaaatattaataaaaatttatatttatattactgaatgtttttaagtttttttctggagcaggccttcgccaaattatatatggactacatagggataaaaaaaaaattcttcaaaaaaaaaaactagtaaaattacaaaacacctttatggctccgatcacggtggaaattcgaattaatctatataagtatatcctaatcgaaaatataaacaaaagaacttttatttattattcatttaaattgactcatatttaagtgattgtgaattttcaaatattctaataaatttcataggcccaaaaagcgaaaatagaaaaaaatttcaaacgtacaaaattgctgaaattaaaaataatgttcatgttctgtaccataaatgttaaaaaatattttacatataaaatattatatattttaaaaatttactccagaaatcaagtacgaagtaaaattacatccagaatatctcatggaacatacgataaaatttacggcaatgatagcaagtttaaattcatattattaatttaacaaaagcaaaataaatataaaaaagaaatactttttgaataaaaaagttaattcaactattaactgaaataaattcaacaattattgttttaaatattttttaaaaacagagataaaatatcaaaatatttaaaaaaaattaaattcaatttggtatggtttaataaactttcgaaaaatgataggaattgtaataagaaagacttataatacaaaaatcaaatagtatgatgatctatacaattttaaataatcggaaaaagctaatcgaatgggttttaatcaaatatttaacctaactttgcaaaaacataagctttatctataagcctgaaaattctctataaagtctaaaagattttcgagctgttcaaaactggaaaaaatatttaataaaaatttggcaaaatagttaaaaaattcaaattttgtataattttcttgtcttttctctcacgaaaatccattctcttaggggtgtatatttaaccccgaccccgagtcggggttaagggtcgggttcggggttggaagtgtcggggtcggaatcggggttaaccccgaaaaatggccaaaaaggtcggggtttggggtcggggtcgcaaccctatttagaatcaataaaaaatgaagcatttgcttagaaaaagattttccttttcaaatttttattttagataacaaatttgtcagtttaattgggaatgaagcgagttatggttgttcaaaattactatatgtatggtttaaatgcaattgttttatttattttggttttttttttgaatatcctctcgtacgaaaaaggccgtacgaaaacgggccggcccccatagtgtatccatcttgccctcaaaatgggccaacgcgtcaggccaatggccaactgcgtcttagtagtaaaagggccaactgcgtctggccaactgcgtctggccaactgcgtctggccaactgcgtctggccaactgcgtctggccaactgcgtctgaccatctgcgtcttagtagtaaaagggccaactgcgtctcagttgattaaatagcaaaattttttacagaaaatttaaaaaaaaataaaaataaaatagtcaatacaacaaagtagggttgcgtccccgaccccgccccgaccccgaaatttttggccattttcggggaaaccccgactccgaaccccgacgcttccaaacccgacaaccccgaaccccgacccttaaccccgatcggggtcggggttaaatatacaccccttagagaaatgaatttttgtggggaaaaggcaaaaaagttataagaaatttgaattttttttaaccattttgccaaattttattaaataaagtaaatttatttgaaatgtagtgtagtagtagtgcatcacacttaaattactttctgtcatagttcgatacctgttgacgttttcactttaatttattttttttgtgattactatagttttttaaacaaaatcccataaaaattggtcatcattggcataatttattgacaaattagatccaatcttcctttcgttgaaattaaaaaatttaattttacttgactaaatcatgaaaagttaatatctttcaaaatattttttacaaaatacaaaataaaataaaatttcagggaaattcataaatttttggtgaaaaactattagaaaatagaccttaaatttcaaaattcgccaggcgctgcctatcggcatcgccggcccctcaaaaaaccaatttttccttaaaaaattttggctcaaaatcgaaaaaaatttatcattttttggacaaattctgttaacagacctatccaaattttcaaaaaaaattttccggcggcgcctatcggcaccgccggacccctttctcctaaaagtctttagaaaaagag

SEQ ID NO: 15516 - DNA, 3046 bp, Heterodera glycines
cggatgaaataaaatagaaatggtgaaaatcttcgccccacccgaggtgagggcgcatggctctgctgttttcaaaaaactatgcccgaacagataaaactaagattgaaaccagccaaaattcaaatgaaaatgtccatacataactgattttttcattttgaagaaaacaacaaaataacaccaaattgatcattccaacgaaaaaagagcaattatatgagcaacacaataattccataattcaattatgtcgatcacttcttaacaaatacgtttgatcaccacagaacaattctataaacgtcaaaatagcctcaaattcattgtccaatttcgcaattcaaattgatcgaccacttcacagcaattcattcattcacttctgttgctgaacactcgggccgggagcgggtttgagaagcctaaaaagcaatacataaattggacttttgatgaaaaaaaaaatcattctcttacccatcgccgacatcggctggatcataaatacccacgtcaattcggtttttctgattcgaaattcgccagccaatcgcctcctcttcccattttgtccattcgctcgcgtcacgctcaatcggacaacggatcaacaaaacgttttcgccatccgcagttattttcagcgtcaattcttccccaattctgttgatcaattcaaatggctcaacgaagcacaacggtatgcaaatgacaacgatgaaattggcatgagatgaagcattggcaaaagcctaaaacatgaaaatttaaaaataaaattaatcattgattggcacgcaccgttttgaactgaacaattttcagcttccaaaatctttcccgaccaatagagcatttcaacacctttggcacatcatttggatgcggcgtgaaaagccattttgccaatgctttttcatccgacgccgaggcactgtcgtcggcaggaaattcggtgaagaaatcgtcagtggcataaaggcacagaacgcgaagtgttggacaggaattgagaattgaggaatttgatttgcgcaaaccacacaaaattctctctgataacagcatcgcaccaacgttgagcattggccaaatgttgtccacaacagacttcaaaattgcgggattgttagagtcgatggtcaaattaattggacaggcggcgaaaagtggacgcaaactgtcaagaaaagcgatggcattgagattgataaagcttaaaatgggatggggaaatgttgtctaagttttttacataatcgcccaacttaccatacgtcaattcgctgaaatccgtcaaaatttatgggcaattgaatttgcggaattggcatcggttgcccatgcagattaacaatttgcatttcaatttcggcattttgtccaatttttcttacaattttaaaatggggcagaatttccatagcaaattattaagacagttttcgacggtttatgtatatttgcttaacaaaaattgaaaaattatgtgaaattagcattccgactctattcccgtgtttaagcgtccaatcagtgatcatccttaatttcttaggccaaaacttttttctcatttggtcaatgcccacatttttgggtatcaattgaaagcttggagtttagccaagtttttgtatagctaaattcagggctaaagccaacagacaaaaaacaatttgtgaaaaggttcaaatttggatggcacgcgtctgaattggggtggggaggggtaaaagcaaagttttcaaatttggatggcacgcgcttaagtttgggaggagggggggggggggggcggcaaaagcaaagcttcaacatttggaaggcaagcgtctgaattgtaagcacaatatttttgtagaaaaaatgtgatattcattgacattttctttgttttttatacgaatttttgaaggaaaaaagtcgggatttaataaatttgctttgcaaataaagaaaaagaattctgcgctaatattttagtataaaaatgccttttttctttttctcttactcatttatgcaattctctcatttctccctataatttccggtcattttgatgccgagaatgtcttcagaaattctgttttggattccctcgttttgatgctttcccaattgttttttcattttgtgccatcattctttggttctttttcaccatgtcaaaaaacgacgagccctcacaaaaaagaaatgtaaataaataaataaatattaataaaattcataaaaattcttaaatttttcagcttcatctctttcaattgttggcttttggtgttcaattttcttgcgccttctcagctcggcctcggaattgcactggtcagccgctgctttgactgaatcgtcgacgaagatttcaacacacgcaaatggagattggagaaacaaattgctaattcaatgggaagcaaatgcaaattgtcaaatccgatcgaaatccgttgccaatcccgcaaaatccgttgccaatccctcaaaatccgttgccgaataaagtcatcggattcagaagcacacagacaccgtaaaaattgtttaatttgaaatgtttcttccacattttctactttcagttacattgtcctcacatttcttcgccattttcacgttctttcgccgccgtttgtacagtggctttggacattatcactgaagacattcccattttgaattgtgttttgctcaatatttggtcaatgctcaacaattttgtccatatctttgcgttgtctttttcgatgccgacattctgcccgttttttgtgtcagatgacagtgccaatgcgtcggatggccaaatggctgttcacactttgtccggatggcgtgccgaagtggctcaaatgctttgtgaattcaccggtggctcaatgggctttaacgatggaactgctcaaagcagtgattatcacgcggtgatcattcattttttgtgttttgttttttctttgtccaatttttaggcattttcaattgcttcttctccagttacttttttgcattttgttttcactttcggctgtcttct

SEQ ID NO: 15517 - DNA, 976 bp, Heterodera glycines
agtcggcggggcccagatggcggggcccagtcgacccccaccgtagggaattaggcagcttaaaaaaaaacaaaatacagtatcgttctcccctcgggatttttttcgaaaatttccaaagccatttgagttttcagatcaccatgaaggattggtctgatcatgttggtccaattattgtttgtaaaatttttgttcagacttttgtaccggataaaatgagattattcatatttggtacgggataactttttaaaatttatctaacaataagattgatccatttcatctttttgcgcattaaaaacgcacacataatgaggataatttatgcatttgaatcatttgtctattcttaatccccgaataactgtcaaaatccacgtttttaaaggttcgggattctttataatataaattgggcaagaagtcagaaatttgtgctgcaaattacatagttgccaaattgcaaaaaaacataaacattttcctattttttaattaggaatttacatatttattaatttgtttgtttgtgcataaatcaggggccgtaatttgaccatgatggttggtgggttgcgaaggcgcagcaaaagaacatggttgatggttacttaaccatgttaccatggttaaacttttctaatcatcaaatccactcgaaaacctaggttaattataacactagaaagtgaattttcatagctgctcttttaatcatggacggactgacctccactgagccattgaccctcacaagtttaaaaaataaaaaagatacaaaaaattacaaaaaagatattaaattttacatttttttggccctcagagctcgaaggtcataccccgtaaacctttctcggcgcaatatcgagacttttcggcgccaatccaattagtcgattttagtcctttgttttctctcaaattcaaaggacaaaagtttttttggaatattgaaaaggaaattaaa

SEQ ID NO: 15518 - DNA, 1088 bp, Heterodera glycines
ctcttcctcttccacctccactgggtccaaaacaactccgtccgcctcctctgattgcctatccactcccgagagtttggaaagggattttcacgcttggctaaaggtcagttcttcttcattaaatacatgaatggaatataccacgtttgatcaagcttcattcactcatcagttctttcttcttttcagtcatattcgttcatttcttctcgtccgccactcttcttcctttattcttttttattcttaaattggattgctctctctctctccctctctctctcattatattttcatggcaattctttatacagagagaaagaaattaaaaagtgagagcggaggagagagaagagagtgtgggggaaagtgaagggggaagagagagggaggatgggagggggaagggaggggggcggctgaaagggggcgttaaagacattaattaggcggccttttggggtgcagtaaatgtgcaaaaaactatttttatgcgaagaaactaaaggaaagttttggagtgaatgataaaacacagcacaattggggaaattaaaacggaagattcggaaagaacgattggacaagccaatcatcagtcatcaaatcaaattctttctttccgtcgatgcgatccctccgacccccgggggaggaacgatcggacaaaggaaattcatctcattttagggagagctcagcagaagtgaacggcccttctgtgcccggccttccgactgcttttctgcccaatcgccgcctccgtccgcaatgtttctgactccgttgggcaatgtgaagaacgaattggtcgtctgtcccaccgatttcggcggagatttcgtctttggaatggaactcgaaccatccaacagcgacttttgcgcgtcaactgccgcctttgccccttcgatctcaatgaatggccctttcccgccgatgcaaacacaaatgattagaatgccaatgccatctttatcagcttcaatcacggtaaatcggctcacagtccatgagacggggattgtatttccatggccagcaggaagaccagcagatggcctatttgctgtcctccgccggac

SEQ ID NO: 15519 - DNA, 1503 bp, Heterodera glycines
  misc_feature (1454)..(1454): n is a, c, g, or t
attgaatgattggtagccaattctaagcccggcaccctttgagaagggaccaaccaactcggccgcacttactccccgttacttcccttgtccatggtggaacggcaaaagattgtgcaactgtttcacgaagggtggaagatttgtgatatttccaagtaaatgctcattcgaatcgcatccgatgcatttgcgtttttggcagatatttgtgtgtcacgcacagttgcgtctccaaaattctccagcggttggtcccatttcgcaaacattcagcaaaaaaatgcacagattccgcgcgaccggttcagtccgcccgaaggatgccaaagaaggccgccaggagtcgcctttggtcgcggccattagggactaccggcagagacttggcattatgcggcagtcggagattcgggagcagctgatcagagacggactttgccgtcgcgaaaacgcgccctcccgctcgtccataaatcagtgggagacaaaatcgaactgaaaaacggcaccaatcaaatgctttaagtattttgcggacaaaacttagcggcttagaagcgccaacaattgggaagagaagcagcaatcagacgacagaaaatgccaatgggaaaaggcaaacggatggaaggggcgaaaatgacggaacggcggctaacgcagcgacggcacgcgtttattacgaagaatgaatgaatgatcaccacgtcgttcactcactttgtcagccctttggaaatggccgacttttccttctttttttcattttttgtaaatttccaaattcatttcccttttaattccgtttaatttttattaggtttcttctatttttgttcttgtcaattctgaatttgtttcacttcaacactaaattcaattcactgccaacaaatgaaagcataaataattgtgatatcgatgaatttcaaatcgcataatttatttcatttcacttttcttcgattccctgctgaattaataaattctgtttagttaaaaaaaacgcatttttagcttggtgaagagaacatttttaaaaacttgatataaagcctaaaagcaataactttaaattcaattaaatttgttttttctatttttcctgaactccaagtggcctgaaacgcacgaataacatattatttccgagttattagggcctacttatgtttttatttttggagtctaaaagcctaaaaaaattgaaaaatctatttgtgcctattttggcgtcatgtcataactagggacgtaattttagtgaagaaaaatcccgaaatagttaactaaaatagtgagtaaaaatgccaaaatagtgaagaaatagtgacaaaaagtccgaaatagtgacgaatagtgacataattttcagccaaaaattaagcaaaaataatttttattcactggttgcagttgcaaatgagtaggactgggatttttaagaccanaaaaacccaaataaagtgacctaaaaaaatttttaaaattaaaaatttt

SEQ ID NO: 15520 - DNA, 2909 bp, Heterodera glycines
  misc_feature (5)..(5): n is a, c, g, or t
acccnctctcgtcataacaattggtattcggataatacatattcccttttacaattatgaaataaaaaaacaataaataaacaacaacaaaaaaattaattatttaattaattagatgaaagcatcacgctcttccattgtttcggttttgccaaattgtaatggaactttggcccaaagttcgcctcaatttcttcaccactgcacaacaaagaaaggaatgggaacaattcagcaagaccatcaacaaatggagaatgatcaaccaaatcgtaggaagctgtgatcagaaaattaaggaattacttgtggttttggaataggtcaaagggatttgcagattttttgtgtctttggattaaaaataacaacaaaaattggcatttttgtgtaataatttttatttattattatttacaaacccaaaagccatccatttttggtgaagaaaatctgccgggtggccaaattaatgccacaaccgacagtatcttcactaccaaaggaatagtcctctttttgaattttccattcgccattaacggtaaaatcgcctccgcttaaatatgcataagtgcccaagtcattagcaattgctccttccaatttatcctgctgtttgatggcaaatccgaaggtaagccacccgtaagggttactaaaataaatttaaaaagaatagcaaataaataaattaacaattttaaaaaggtttctttcacgtacaaatttataaaaaaatccccaactttttataaaatttaattttcaagttttataaaaagttgaggttttttttaagtttgttaattaacgagctttttgaaattttgcatacagttaatatataaatctgttacggaatttcaaagtaaaaaatctcagaagaattcttgcacaacaaaattggatgggtagcgaagacagtgcaatctctgcctaaattaaactaatgataataaatttaaattttaaaaaaattcatatttataaattaaaatttaaaaaaaaattacaatctgttccctcataacaataaattgccaactgattgttagtgatgattttgatgttatagtgacaagcgttggcatcccaacgattttggcggaagtttcgaagcgccttaaaattaaaattagtcataatttatattttaaattcgcatttcaaatataataaaaatcattcactaataatttttcttttttcttcccattattcattcaccattttccgctgattcttttccaatgcattggtctttttcttctgttcattttgcaactgttccatttggtcgttataaactaaaaaattcattaattaattgaatatatttaaaatcagtaataataattataataataatgttacggtatgtacagtaatccttatccaattttcccttacccttttgcttttgcttttccatttccattttgctaatcttcgcctgtaatgtctcaatttgctccatgagctttttctcgtgctctgcttggaatgccttctgctggaattaaaggtatttttgccaaatgaaatatgttgactaaactctaaaattagggccaaatatttttcatgaattttcaaaaataatttttgccgtaaataaattaaagagaaaataagaatatttcactctcaccgtgtccaattttttccccaatttctcctccaatttgtcctgcttttccttcatttctttgtgttcatttttcagttttcgattattttcctcttcggaatcgcatttcacttgaagcaccttaaaaaggaatttaaatttagctatttaaatgcataaaatttcaaatcgcttgaattcgcttcacttttaaatgcttcaactcggttctccgtttagggagtccgaaatttcgggttcgaatgcctaagtttcaattctttttttaaattacgtttttctgtaattcctccaacttgtccatgtactgcttctccttcttctccaattgttcctccttcttctccaattgtttctccttctcgtccatttttgcctgcattttctcaatttcatttttcattttcccattctccgcttcgatcttctccagcagtgcattcgtttcctgctgcttcaacttttcttgaagtcccttctaaaaaggatttaataattaaaacatttaattattttttcaatattaattagcaactccatgtaaaaactcacattcttgagctccaaacatctgccgactgctgtggctggtgttaacataccgtaaatccgctatttgaaggcccctctctggtagaaggccccctccaattaaaggcccctttttggaggggttgaacaatagaaggcccgggccttcaaatagcggatttacggtatttattggggtcactcaatatatttacggcaaaatgatactcaaaaattggagaagagcaaaaaatggcatagttgactcatttacccattcattttttgtcatttctagattattgttactttttttattaataatgagcaaaatggtgacctaaaaagaatggctccaagtgagaggttttacataaaaatgcaatagtaaatgattttcaaaatgaaagttccacatccaggtaaagtagcttcaaaaaagaaaatccctttatttgtccaaagtcagcaccaattagtgaaaaggctcgggattttaaatggactgagaaatgagttaaattttaaaaaatgaagcaaaaattgaagcaacgaaaataccgaaaaactaattaaactccattagaaaaattattattttatttttttgacaatttttgttttgcttttggcatttgctttatttttggaacaaaattaagcttttagttaaatataaaattaataaattaatattattttaattgatttatttgttttctat

SEQ ID NO: 15521 - DNA, 3019 bp, Heterodera glycines
  misc_feature (59)..(59): n is a, c, g, or t
  misc_feature (61)..(61): n is a, c, g, or t
  misc_feature (63)..(63): n is a, c, g, or t
  misc_feature (65)..(65): n is a, c, g, or t
  misc_feature (67)..(67): n is a, c, g, or t
  misc_feature (70)..(71): n is a, c, g, or t
  misc_feature (73)..(73): n is a, c, g, or t
tccctccattctctcccactccctccattctctccccccaccaagggactccctcattntntntntntgnnantccctccattctctcccactccctcgacggcactccctccattctctcccactccctccattctctcccaccccctcgacggcactccctccattctctcccactccctccattctctcccactccctcgacggcactccctctattctcccccctttctacggcattccctaccattctctcccactccctcgacggcactccctctattctcccccctttctacggcactccctccattctctcccactccctccattctctcccaccccctcgacggcactccctccattctctcctctctcccactccctccattctctcccactccctcgacggcactccctccattctctcccactccctccattctctcccactccctcgacggcactccctctattctcccccctttctacggcattccctaccattctctcccactccctcgacggcactccctctattctcccccctttctacggcactccctccattctctcccactccctccattctctcccaccccctcgacggcactccctctattctcccccctttctacggcactccctccattctctcccaccccctcgacggcactccctctattctcccccctttctacggcactccctccattctctcccaccccctcgacggcactccatctattctcccccctttctacggcactcactccctctcttcttccccccccccaccgtcgttggggttgccctcccccaattttactaatttctcaaatgtccttcacttttcctctctttggcccatttaagtcttatgcttcacttacgatggtaatcgttgcttttttcttttctttatcatcggctgaatgtgttttatgaatgggaatgtttaaattagcgccacattttccgccttttcccatttgtctgtcactctttccctttctctgtactcctcgttttcctttctctctctctctctctattatgtctctctctctctcttatgtctctctctctccttccctttctttttccctctttttctctttctcctcttttcccattctttctctctgcacccctttccttaagcatttctcgcttttccttttgctttttccctattgttgcagagcaacttaacaagaaaaacaaaaatgcccgcattgaatagagaattttattcgctgccattttctcccacacattcaatgccaacaaatggtggaagaagcgggcaaaggacggcacaacaaacggaccaaccgccgactaattccccccccccccctcccccgcaaatacaaaagttggactgagggcataagccaattttgccaattcccccctcccccgctgttgccgccgtttctctccctccgctcacaatgcgcgtgcgtcccccgcgggtccgtctgtccggccttggcaaagaaagacccgctggacgaatgaatgaatgggaagcattcgtctgccgggcgctgagagaatgggcgggcggcagaagaggcggagggattcactcactcccatttaaatgccccggccgggccgttgtaagcattggctcttgggaatgaggcgaagctgagggggagaggaggggggggggggatagagcctagcggagcaaaggggcggggggggggggagttgctcttcaggcgaagctcctcaacggtcctggcaaaaaaatgggggggaaaactaagaaaagttgcgcattcatttaaaggtcggagcaagaaattccaccccgcgtcattcccaccttgaaaaaaacaataattttttagaaaaaaatctgtttgaaatttttttggctttttttcaaaaatttctctagaaaatcgcatgaaatttaaaattttcggggtgaagagggggtgggaaagaaacgacagaggggagagggagaaggcaaatgaactacgcctttaaatgtttatgaaattgtgcgggctccgttccacgcccgttcccgtgtagattttccaattttcagagggtgcccccgttttccatagataattttttaattttttggattttttccgaggggatataattattctaggggctgaaaatgggttgatcaacagcttttttcaggtttcagtttggtgctgcccattggtgtcccctgctggtccgtccgtccgtctccctaccacgaacgcccgggccgatcggacgggtccaacgcgccgttctttccccaattttcgggacggtcgaagaactcggccagcgcgtacaccttcttcttgcggcgtacttccgcctcaacgtcatccttaatgggcattgagagagagaggatgcgaaaaggacagaaacaaaagcacaaaaatgggtcgaatggacaaattttgaacattttcgagtgggagaatgccaaaggaatggcaagttggcattgccaacttagcagagtcaatggacagagaactgggcaaaaaaaaccaacaactttttagctagtaattttacaccaaaattgtcaatttttagtttttaaaaaaaataaatacaatgcaaaatagtgccacggcatggatgccaaaaaccggcaaatgctgagttttccagtcaatttcaggaaaggattaaaagtggcgccttaacacagattttgatatctttttgcacctttttcttcgtagacacattgtccttgcgcacatccatcgggtccacgattttgatattgtccatcgtggcgaacgaacgccgccgggggaccgcggacagagcgaagagggaaagggcggcagcggaggaggaggggggaacaacaacaacaaatctgagggggaggaaaaggatggcaaaaacggcattttatagggggggggagtcgatgacaaaaaagtcttttaatttgaaaaaattgaagcctgaccgagccaaatttgtaagctaacgcaatgtttattttgta

SEQ ID NO: 15522 - DNA, 665 bp, Heterodera glycines
  misc_feature (44)..(44): n is a, c, g, or t
aacgacaactatcaagtggatggtgcgggggggaaggggggggngggaaatgtgtgtcgcattctcgggatgaatcggtctttcatttgtgcagaccgaggtgcgcaatgggaaggaactcggcttcaccgttttccacgactgcgctttgccgccggacgatttcgtgtcgaactgtcgcatcactttcgatcacctcaaactgatgggtgtcaacgacatttgggccgacttagagccccatggccaactccatctccaaatcgaactgcagggcaaaacggccgaggaagaattcacgggcaaagagccgcgggtgttccaggaacggtcgggcgcttttatggaccgccagaggaggggggccatgcgacggaaaatccacgaagttttggggtagggagaaaaacggaggaggatttgatgaatttgggttggtattcagtcacaagttcatggcactttttctgccacaaccgaccttttgtgcccactgcaaagacttcatttggggcatcgtaggcaagcagggataccagtgccaaatctgtacggttgtcgtgcacaaacggtgccatttgggcgtcgtgtggaaaagtcccggcagcaaaacggacgcttttgacgaagaaacgtgaagaggcggctctgatgtacgctcactg

SEQ ID NO: 15523 - DNA, 2974 bp, Heterodera glycines
ctcgagagccctccgccgctccgcccgcggcgcttcctcccacccggctgactttcttctctttgtttcgcttcggtggcgtcgaccccacgcccaccggatgactttcgtacaaccgacggtaattgtcactgcgaatgtaattccaaaaagactcaacgctaaattttgaatttttcggttgtattttctgtccctgtgccattattcgttcacccgctttgccaatcgccgccttgggcaccgcgagtgagcgcatctttcaatggcacgatccaccttaaattggaaaagataattgggcaaatcaaaaaataatttaatgttccaatgcccgcaaatactgacgggttgttttccactcgaagtgttttggcattttcgtcgttcgggtcaatcagatcaagttggcccagttcgggcggaatcacttgaagccgatttccctataaaaatctgcccagttcggataaaatgatctcggctactccacccccatttttgcctgaatatgcagctctttcagcttttgcaatgtgcccatttgtcgtggcaaatcaatgagatcattttcacgcagtaccaacacttggagattggtctgaagaaggaagggacaaatttttcagagggatgatcagttgaaactttttaccaaatggccaatatcctccgggaacgactcaaagtcattgtcccctgaaatcggatttttttatcgttcattagagattacgccagtccaacccaaataaagtgcccgaagcgttggcatgaagaaaaaatttccaggaagactttgctcgcgtaaattgttgtacgttaagtcgagcaattccaattttgcgaaggagccgaagccgcgggggagtttgtaaagacggttcatcccaaaatcagaaggaaggcaaattaattaatgagggggggggggggagggactgacccgacattgagcaatttgaggtttggaagtgcggaaattgtcactggcaattccttaaaaagcagaaaaatggccataaatatgaaaagggtaaagcgaatgggataaaagacgacctctatgtggttgttccacaggttgagctgctcgagattgaccagatcagaactgagacaaattaaaataattatacggaaaccgccggaggcaaaactcacatatttgcagggatcgaagtcaatttgttgtggctgagagtcaacctcgtcacccgactgttctcaactgaatttacaaaatcattttttaatgaccgttttcggatctcacaattcaaacggagctgtccgaagttgtgaatgcctcggtccacacagtcaatttccgtgttatcctccgcgggcgccgactgcgaatggggcggatgagcggaccgatcgtttttcggcattctgtcgttcgtcgaaatgtccttgcgatttggctgtaatggccacaagcaaatggccaaaggcaattgttgtttatgatgggaagggatgagcagaaaatcgatgaaatgaataagcgaaaagcatcgatcctttcactttctctaaggaaatgcgacagcagcagaaaagggaaccttaaaactgcagaaaaaacaaaggaaaaaacatgcaaaaaaaggaatccctttcgatcgtttatttttgacatttagaaaaaaatatttacaaacaaaattacaataaaattaagataaaatggaacggtagtttttagatttaaagtaatgcatttgtaaaaaacattttcaattttttcaacgtgtaggattttggtggttgaaattcttcaattttgtttccaatgcgcttatgtaagtctccaaagcagtcactgccgattccatccgacgacttgcttcgtctgaaggacaatgaaagtacgggcaaaacccaacaaatgagcaaattaaccgatttcatcaatttgttcgagaaacggacgcaattcttcgtatttaagctggagttgagccagtcgttcagaaatgacactggtcacctgtcccatgtcttaaatagctaattatcatcgtcaattattgttctgttcggaattggtttcgcctgaatatcgttgcgcagtcgcttcgttcatttcctccaacaatttgtagtcatcgattgtgccctgaatttgtccttgtacgtaagaatagagccgatcagaagcaatttgcgcaagacgtttcacttcgtcggtggaggcatcggccgttgtcggatttgtggtcggagaaagagggcactcactgcccgtggaggtacgctcattgatttccattctatgcaaaatgaaatttaatttgtttaaagttcttttaaaatgccagatacagtcttagtgttgccacttaaacattcgagtgtgccaagtcagacgatcaaaatgacaagagataaatttcagtacacgtgattgaaagaacaatcgaatgccaatatccaataaatataaaagcaaaagcataatatatttgccgaataatcaaaacacaaaaagtacgtatgaactcaaaacaaaacaacaaaaggctgatgaaagatgaagtacacgtcaaaaccctgttttggaacaaaaacattgagagatctgagaatgtttggaccgtaagcgtatttaacaacaaaatgataaagatcaattaattatgtttcattcatccgccagcaaactgcgcaccaaatcattgatgaactgagtgcaaatgtgaagcgcaacgcgaaatgcaacgaggcgttcctcaggcgacaatttcattttgtcaccattcgccactccgatgacatcagaaagagcatttttaagaagggctgactcgcgagtactgtaataaaaaacggaagatttataaaagaattaatgtggcgaattgaagcatacgaaagcgggagagactgcggctgagtgagacactcggagacccaatcgtcaatgggcagcaccaaacggcggtacactctgcgaaagatcaaa

SEQ ID NO: 15524 - DNA, 2904 bp, Heterodera glycines
aaaacgcgtctaaattcgttcctttcctccgccgctctagttttaaaaaaggaaaaatggccgtttattccgtccaaatcggtctttcgactcgaaaatgaaagtgttcagtgaaaaagggggtggggggggggggggacgtggcattgaaagtaacggactgaaagaggggagaaacgaagtgatcgaaggttatttgagtcccccttttgcctttctcatttttattttcctcattttttccttttttcccagcaaattcggctttaccatgtcggagtgctcgtcagaggcaaagagttccattacggcatcaaaatcggcgtgttcgcttgcgagccgaaaaacagcggcaagaatttccatgtgcgccatttcaatttgttccgttggggcatcgaatttatgtgcgtttttctctgccttttccgtttcgattcccttaatttgccaaggcgtcacgtggacatcgttctgaagaagtatccgctgtacaccaacatgagcacggagcagctgatcgaagtgatggaggagttgcgaccctgttacaaatgggctgattacaatttgttcaaccacaattgcatggacgtaagcggaagaaaacgctaattaattaattaatggggatacatttaattaaacggttttaagtttgccatggattttatccgacgcatttcggcggtgaatttgccatccggcaaatttttttcttggacccaagaaatccgacagccgctcattttattgccgatcagaaaaatatgcgaaactgagacattcaaacggacagtcaaatcactgaagagaaaagaggagaaagagcagggaaaaggtggagggacagagaaagaaaggaaaagggagcgaaaaaggacaaagaaagcaaagagaaagtcggagaagcagaggaaggagagggacaacgccggggagggagggcagcagacgaaagagcggacggaaagcgcaggcgaaagccccgcggaaaggtgggaaatggggtaattgtgggaatcgaacttaaacgaggtcgaatccatccatatccaaagttcgtttctgttcgaaccctttcttccatttgtttcccccaccaattttgtgccaaattttgttcatttgtcactttttagtgccattgaaaatgcccaaaacatttcgttaaggaagaaaagttctgccgcagaacaacagcaaatacacattgagcaccgcggtgccctgggcttgtatattacaactatcagaatattgccaatgacggaagagatgggacagaaggacgaataacgaaggacgaatgaccaaatgcgaaggacggacaaacgaccaaccccccccccggccgggaaaatgccatttaccattcattggtggcacacttttggccttcggaatggcatctctccccaattggtgctgttttatttgtctcatattttgttccttcaaattattcattcatttcaattaggctcagttttctttttattttccccattttaattaaatttctttcaaatatgtatttctgtgattgccttttttcttttcctttcatttcgcttttcaaattttgccaaattttaatgtttgatttgttgtgcattttgtgctttttctctccgtttttttctcattttgatgggaagtgttaattattagtaataattaacttcttaattaatttgaaagtttggaatgaaaaaaattccgcacataaaacgaacaaataaatgcggagagagaggagaaacattttaaccattccaaaggttgaaacggcggacattcgccgaatgaaaaataaacacgcggcggagaatgagcgatttgttttcttgaaataaatgaaaaaattcagaggcgatagaattctgaggaattaatttggtgaacaaacaatcagacgagcagaagagaaactgggcagaaattagggggacgaaatgggaagaattgggaaggaagggaagggatgaagagggacgaggaggacgaaggaattgggaaggaagggaagggatggaggacggaagaattgggaaggaagggaagggatggaggacggaagaattgggaaggaagggaagattattttaaaggttcatgtacaattacaccggaaggccgacgttcaatggggctttgacagtgcctcggttcgcatcggatgaatggagtgtgcatcaacggacgttggatggaggagacagaaccaacaattacgcagaagcataccatagaaaacttcaacgggcatttgattgtacacatccaactgtcttccgcttcatcaacacaattcgatgtgagcaaaagtctattaatgcagaaatctcacgatgcatcgctggtgaactccctcctcaaaaggcgcccaaatatcgtgccgctgatgcgagaattctcgactcttgcagagctacaatgccatcaacaataaccaggctcaccaaaatgatcacaattaccatgcccttatcaatgttaacccctataacatcatcaattttctccttggtatttctcggaattatgagatgcgcccgtaatatttgcaatgttttgttatttttttgttgttaacacattgataaatctgttatggtgtaattttaaagaattttcgagaaacaaatcagaattggatcaatgtaggacaaaaacgagcttgccagactaaaacgaccctctgactaaaccggccctctgactaaaccggccctctgactaaaccggccctctgactaaaccgaccctctgactaaaccggccctctgactaaaccggccctctgactaaaccgaccctctgactaaaccggccctctgactaaaccgaccctctgactaaaccgaccctctgactaaaccggccggactaaaccgaccc

SEQ ID NO: 15525 - DNA, 1419 bp, Heterodera glycines
aaaaaaaaattcagaaaattcaccactaagaattgaaaatattttcaaaaaatgatcccaaaatttaatatatattttttcttaataaaaatttttggtttaaaatgttgtccttatttaataatttcatttacaattgaaatatttaagtttttacttgttttacacagcggcccaattttgggctctcagtgcaaataggtttattatttatttagtaatcagaacgccaaaactttgcaaaacttaaaatttttttgggattttcccttgtaaaattaggagccgatctcgagttaaaaacttaagttccataaaataaacttggaatcgctagaggaggtcaaaatattggtaaaatttaattctccagaattttcccttcaaaatgagcataaaatggttttatttgctctagtattcaccaagttataagctaaaaaaatttcataaaattgtcgatgctgtacgtaaccaacgctttttgaatatgattttttattgacacgaaaacttttattaataaaaaaataattctgccttctttaaaagaagaaattgaaattaacacacaacataggggaggacttgaacctgggaccccccttttggtgactaactcacagaccactaagacgaaaaatccagcataattgtacttggagcccaaaattgggccgctgtgtttaataccaaaaaagcgttaataaaaaaaaaaaaaattttttttttgcctatttttgtgcctattttaaggtttttgtgcctatttgcgatttttttatgcctttttaggtgtctatttcgcgattttttgtgcctaaaaaggaagccctataaattattaatttaattgcttcggtgggggacggtttagtctggccgttttagtcagagggtcggtttagtcagggggacgttttagtctggcttgctggttttgtcctacacggcttttattgtgattttttttcgaaaaatctttaaatttaatattaaaacatatttaacaattatttccaaaaaaaaactaaccagattaagcgcgcatttcatagttgccagaaatatcacccctaacattgctgtcgctctcactctctccctctgccacacgtccggcttgttaatatgaggcctattctttgtctcagttactggagtttagagcactgtccctgagacagcagaaatatatggcacattattaaagaaagaatccgcttttgttgtcattttgcagcaaattttgttttgtcttatcgtccgtccgcttttctctaatttggcttttgctgctgctttccattttttattttatgcttttaataacaaacaacaaaacaaaaaaaaagtgtgcccgcaaccctccagggcaaaactggcttccgcacgcccaggaacacccagacacgggtg

SEQ ID NO: 15526 - DNA, 1077 bp, Heterodera glycines
catcacggcaccgaagcaaatggttggacagaaaaaacaattggataatcaaacaaattctggcagagttatttctactttttctgttgctgaacatgggaggcacaataacgaatgtggagaagcaatttgttattctgaccaaacgacaacaaaacaaaagtcaagcagtctaatgcaacagcattattttgagaccaatggttccaaggaaatcacaaccaaacaacgactacagaggttgaggagaaaaagcacatcttcacgcaagaacatgtcactgtcgcaccgatacactgcccccttttcatcgagcaaaggatgtgccgggtttattgttccacccgtttttccaaagacgtgttccttgtacgatgaaagtttcagcgggggagtgtttgttgaccatcaagaagacagacttttggttgaggcagttgatcggattcgaaaacggaatttctcatgcaaggagaaagaacacgacggatgcttgcagaaacaacagacatctgctgacgcttcccaaataaacggcgattttattaatgaaaattcggacatcgacagtggaaattcttcgatcacagaaggtcgccaatcgcctatatgttctgaatttactcagaattttggtcgaacagaggcgactcaatttaaaaaggctgcagaaaattcggatgttgccagtgacgccaattggaaagacaccaatcaacgggacggcttcctaagaaaaaactgccgattattgcattttgtcaagaagaaaggcagtgaatcgttggacaacgaacatatgcaaaatgacgaccgagagaacgacaaattgccagcacaaaggcagtgggaaactgacacaacaaaacgaaagtcatggagagccagactcctccggacattgtcagtggggagcccatccgtcggaagagtcatgaaagacaaagaaaagcaaagaggtaattaattaggttcatttctcaatcaacgctcctcaatgaaacgctacgcaatgtgtgcatcaatagaaataaagattttcaacatttagtataaatcgtccaaaaattctctact

SEQ ID NO: 15527 - DNA, 2827 bp, Heterodera glycines
  misc_feature (50)..(50): n is a, c, g, or t
  misc_feature (65)..(65): n is a, c, g, or t
  misc_feature (97)..(97): n is a, c, g, or t
  misc_feature (100)..(100): n is a, c, g, or t
  misc_feature (106)..(106): n is a, c, g, or t
  misc_feature (115)..(115): n is a, c, g, or t
  misc_feature (117)..(117): n is a, c, g, or t
  misc_feature (119)..(119): n is a, c, g, or t
  misc_feature (122)..(122): n is a, c, g, or t
  misc_feature (125)..(125): n is a, c, g, or t
  misc_feature (127)..(129): n is a, c, g, or t
  misc_feature (133)..(133): n is a, c, g, or t
  misc_feature (140)..(141): n is a, c, g, or t
  misc_feature (144)..(145): n is a, c, g, or t
  misc_feature (176)..(176): n is a, c, g, or t
tttgatagtcgtaaatttaactaaaatagatattccatctcccagtgggngaaaagccgactagncacttcgcgaatttctaccgggaacgggaggnggngacggnccgcgaacncngncgncgncnnncgcnggacganncanngcaaccctcggaaatgcctctgcccgaaggngcgctgcactcgcaactgctggacgagtttatgatcagacaggtggccacggaaacgaaattagaaataaaacaatgcatttttactttatatccagataatcgatattctgccgccacgagcagagggttatccttgggttcagatttacaattccgaaaagcacggcttctctttgactacgctttacaggtatagtcaaggacactctcatcagaaatggatatgaggtgacaagtggcggaggggggaattcgtcaaccactttcaaattgctcagggggagagaatcttttcactcccagtgattaattgacaatttgtccatattactattgtattgcttccatataaaaaaatgcgttcaggaggatggcggaatgggatgaggaaatgtcccccgtccttctggtggttagggacgtgaacggacatgtttttggggcggtgtccagcggcgctttgaagccgtgtgaccattactacggcaccggcgactcgtcccttttgtttcggttcaccggcgaattccctcacacgcggtgaggctttctttgcggattcgcttaagactgctcttctctttctcaacagggagttgagaacattcacttggaccggggaaaaccaattcttcgtgaatgccacccgcgaatcgctttcatttggggcgggtggtgggcacttcggcctttggttggacgctgacctgaaccacggccgatcacaaaagtatgtcacaacgaacggctagtgaaattgatctttggaattattcctttctcagatgtgctacctttgacaatgaaccattggctggtggtcaggaggaagacttcgttgtgcagttcgttgaagtgttcggcttttgtatgacataaagccgccatcgacttgttatttgtgtttttttccaatgggtgtgatttttattatttgctttttattctggccgttcatttatgtctattaactctaatgattcttaattagtgagtttctttgaaccatgcctgactgacccgaataaatatttatttttattcttccatccttaatggggaaccattgaattttctttttttctgatgattcacacccaaatgattccgcactccttttcccaaatttcctctaaattgtttctcatttgtcaacatttactatcatttttccattttataccaatggttttatgacaaaacgaaataaacaaatcaaaatcaattaaatattaaaccagcataatcagaagggatgagaataaaacaccgagaaaagtttatgaaagattcaaaaaagattgattggtgctgccagaagttgacagggtcaaaacaaattcgaatttgtcaccaaaatcgatgactgtcattgactaattgatatgtaaaattgtgagtttttgattagacgagaaaaaattaataaaacaaatggaaaagggaaagggcgttttacaatcagagcattgatcacaaattgggacaaattgtccttaccgtcgtttaacagtttaaagttggtatattgcacatgtacagacaacaaatctggacgacgaaattatcatcgaacggagtcaaaacatttgctggaattctctttgctgctgaacggccgtgaaggcggacaaaggcaaagtgagcagcgacgggttgggctcgctgaagtccgtccctgggtttgtgccgttctgttgctgttgcagcagaatcgccgcgagcagagaagggtcggtctgttgccggaggggagcgtcccatcggtcgcttgggctgttgagaagtgccggccccgcgtcgtcgttccctacggttgctcgcagttgcgtttgttggccatgctgtcccaccaacatggcctgttgccggtcgttccgttgttgttcctggaccattttggagatgatttgcaggaggatcgccttttgttgactgtcattctctgacggattcgccatcggaggaaaagtcgtcgcaccatcggtcgcttgtagcaacagaagttgggcgagtatggggtcagccagcagaacattgcgatgccaaggggcgagcgcatctgcggaacaaaacatcggcggaaggaacagatgagccgaaggacggactagcagctcgagaggagtggagagagaagcgaacggagcgcaaggagaagcggagagcagcgaacggccgagcagctgctgcagagagtcgaacgaggagggcatcggtggggaacagctgctgggagaaggggcgaagagttgcggcaccgattgacggggggttggtcgtcaaaattggcgaattgctttctgatgcttggctgggcaacaactgaaaagccgtggagagttaacaaatgcccatctctcccccattttatgagaatgggatgacctgttcactaccgacgggtgtgtcggcatttcgccgcggggttccgcttaactgcgcgctcagcgaatcccgcgacgtcgcccttccctcacggacagcaatctgatgaaaatctgtcttatccaacggattcgtgccttcgtagtcactgcatgtcatcgcttcgatttgggcgggcaaagatgccgttgacttcttccgtggcggctccctctcgtcttcgtcccctccgtcgtccatttcttccagtattttgtcctg

SEQ ID NO: 15528 - DNA, 2077 bp, Heterodera glycines
  misc_feature (32)..(33): n is a, c, g, or t
  misc_feature (100)..(100): n is a, c, g, or t
  misc_feature (163)..(163): n is a, c, g, or t
gccccagcgggggatcatgtgtccattcacannaagtgttatgcacactaatcaccatgtacctcttctaatcactgttgtacctcttttaatcactgtngtacctcttctaatgactgtgtaccctcttctaatcacttttgtacctcttctacaaatttgntacctcttctaatcactgttgtacctcttctaatcactgttttacctcttttaatcactattgcacctcttctaatcacagttgtatctcttctaactcttatggggatagtcccatccccttaaacatttaaaaaaaaagtttcagaatgccaatttattttttatgcaaacaataagattatgtaatataaatctcagatattttttgtgtcaaattgggatatgcttttttctgttacttttagttagttaatcaatagcgttgacaaactacttcgaatattatttaattaatcaaacaaatctttagattttcatgacacctatttttgataaaattattaaaaattttgataagacatgtaagcttattcatttttgtagtttatacatttttacttacagacaaaattcctaaaaaaatgtcaaaatctgcgagttttgaggttatttaatcattcagtagatatatatttaaattataaaatataggaatggtgccatgagcgcagaacattgaatgatgggggcaagtcaaacgtaaagatcccgaatgagaatgcattaagcgaggagatgacaaaaacaaaaaaacattctggcaaattcggcgtttccagcaaaaagatttcagttactgcagaaaaggtgtacttatatgtacacttccttcaaatgatcccccgctggggcaggtccttggcccgtgaaagggatgggtaccatccctatagccgttggtatagggatgggtaccatccctatagccgttggcatacggatgggtaccatcactatagccgttggcatacggatgggtaccatccctatagccgttggcatacggatgggtaccatccctatagccgttggcatacggataggtaccatccctatagccgttagcatagggatgggtaccatcactatagccgttggcatagggatgggtaccatcactggcgtgttattcgcctggtactgaagtgtactttttgagcacacttcagttttgcggatttttgggctatttttattttattaaatatcttttcagaactgagtagtgaatttttttctgaaaattcgaaaatttccagaatttctggaataactttttttatattcttcatagaaataccaaataaagggcaaaaatttctccgcttggggatgttgtccatcctcctagcaaacggtatggggatggtggccatccccctagcaaacggtttggggatggtggccatcctcctagcaaacggtatggggatggtggccatccctctagcaaacggtatggggatggaggacatccccataatttttgaaatgggaatggagaacgtcattagataatctgtctctattatctttcaaataaatccaaaagaacgaattcaaaagaatgaatttttgtgtttaactaattgcaacatttgtaaaaattgtctaaattgcttaattttttgattgtcatgcatttttaaggattatttaatttctttagttaaaaaattacacaataaagtccaaatttcttaattatagaatttatgaaaaaataattatatggtaattatcctttcacaaaaatttatgtatttaatgcgaaaatttttacagaagggatccattttaatagctaaaaaaaatttatgcgtggaaaaaatttaaattatgtaaaaggataaattatttttcaattttttaatgccatttttgtatagccatagcaatttttttgataagattttttggcacaatttttttcaagctttcaactaacccaaattctcagattattattaatagttttttatttacctaaagttaaaaggataaaatatttttttctaatggctttttttctataacagtagacgtttttagacagctttttggtacgaaa

SEQ ID NO: 15529 - DNA, 979 bp, Heterodera glycines
acctaaaagaaagcagattcaagctaacaaattgagaatcaaagcctaataattactgtacatgggtatcactgtacaattggggaaagtgacgacaaagcgtcaaatttcctgattctgttggtcattcattcgttcgttcgttggtcaattaccatcccaaaatgtgctattaatatttggtaattattaggtcaaatttcactcactttcacaaacaaaaacgattaacaaaaaatttattaattcgatttggaaaaataagaaattaaaataacaaaattaaatgccaattttgcagccgaaatattccacacaaatgccgcgcaactgaaaaagtgccgaaaacgatttcaaaaatgaaaaggcaaaagtaaacggacggaccgcgtgcacaaactgtttgctgcccgccttcggccatcgctccgtccgttcgaccgttttaccaatgcatttgctaacagtgacggcggattcttcctcagcgaaaagcaacattttggccacagttttttggtcgatctttgccaaggcaaaattacgactgaaaagggtggaaaatggaagaacggaagaaaacggacaaaacaatgggacgacacagcacgaacggcactcacctgttcctgaagggggggggaagacaattaaaagtgggaaattttaattagcaattaaattcaaatgccaacgacacttttaaatgtgccaaaatgacggacaaaggaatgaatcattttttagtccagaataagcatccaagcatttaaaaatttattttggcgttgctctgaaaatgccattccaatcgatcgttttatggatgcttccattttggcacattaatttgtctgattttggcaaagccgactcactctcgccacagcacaaagtggcagtttttggtcagcttggtgaatccctgtccagtcggacagcacaaatagaggtcatcttcgccgccttgcattgcttt

SEQ ID NO: 15530 - DNA, 3273 bp, Heterodera glycines
ggcggcggcggcggcgtaatttgtccattgccaacgactgaccgaccgccgaaaggccatccgatgagagagcggaacaaatggaaacggaagaggacaaagaaaggcacttgcaaaggacgaatgatggcaaaacgagggagggggaagcgaacgcgagggaatgccattgtggtgcaatgcaaattttggggaggggagggaaggggggggggggggcccccccccactaatccgaacaaagcgaaagatcggcaaattttgcccaatttcaaaaaggaaaaaattcgaggaacagcgaaaaaacctaaaagaaagtagattcaagctaccaaatcgagataaaaagccaaataattactgtaccatgggtattactgtacaattggggaaagtgacgacaaagcgtcaaatttcctgattctgttggtccattcattcgttcgttcgttggtcaattaccatcccaaaatgtgctattaatatttggtaattattaggtcaaatttcactcactttcacacacaaaaacgattaacaaaaaatttattaattcgatttggaaaaataagaaattaaaataacaaaattaaatgccaattttgcagccgaaatattccacacaaatgccgcgcaactgaaaaagtgccgaaaacgatttcaaaaatgaaaaggcaaaaataaacggacggaccgcgtgcacaaactgtttgctgcccgccttcggccatcgctccgtccgttcgaccgttttaccaatgcatttgctaacagtgacggcggattcttcctcagcgaaaagcaacattttggccacagttttttggtcgatctttgccaaggcaaaattacgactgaaaagggtggaaaatggaagaacggaagaaaacggacaaaacaatgggacgacacggcacgaacggcactcacctgttgctgaaggggggggggggaagacaattaaaagtgggaaattttaattagcaattaaatgccaaatgccaacgacacttttaaatgtgtcaaaatgacggacaaaggaatgaatcattttttagtccagaataagcatccaagcatttaaaaatttattttggcgttgctctgaaaatgtcattccaatcgatcgttttatggatgcttccattttggcacattaatttgtctgattttggcaaaagccgactcactctcgccacagcacaagttggcagtttttggccagcttggtgaattcctgttccaagtcggacaacacaaaatagaggtcatcttcgcctcctttgcatttgctttcagcaattttcggcttttcctccttttctctgttcctcaaatttatgtccgtttttcgtgatgccaatttcggtccctccgattttgtgcctatttttcgtattcctttcgtctccgccaagtccttttttggtggtgccaactttccacaattgccaattccgcatgtttttcgtcgtgccaattttggcccatgcagcttcattgtgccaatttcgcctgtttttcgccgtgccaatttcagctcgtcctccaatgggttatgaatgtgttcgtatcgatcaaaaagtgccatcttctctttcaaatataagcccctataagggcactgcttcttctcacatttcaaccatatctttttctctgaagttccgtttcttttcataagcccaaaactcttctgatgttcaatcagacttccctcttttgcaactgtcgccaaaaaatgccaataatttcctgtccgcggctcgacgaatgtttgggcggcattttttgacatctaagactcaaaaatggggagattatttggactagtagaacgttcaaagccattctcggatttagccatggcaagcgttctttgtgtcccaacgagtgccgaaaaacattattagccgtttaatttgcccacctcgccctcctcctgcgccattagttgtcgtgactccttcatagtttccccttccctcttcgttgtcccgtcttccgcgtccccttccgtaatgccttcgtccgcttccgcgtccttctcaattctaccattttccgcttccgtttcatcgctttttatccccttgcctcgtctgttttcgcttccatctcctccttctgtctgcttgttctggtcagccctccgtgcctaaatcggcacaaacaatgccgcaaaagtttgtcggccttcaacagggggacacagatgacaaagttgggcagcgacttttgtccggcacacaacagcaaagattaatccacattgttaaccgaatttcgcatcaattaatggtaattccctctctatcttcccactttctccctttactccaactctcatccccctctatttctctctctctccccccttttctcagccatttctcatttcctcattctctcccaatgtctgtgccgaaagtgtcagaatgccgcatcacctcaccggcgttgtcccttccccgttttccatctctctgcttttacttacagtttttcttttttgtgccaaattcgcctttttctcagtgattgatgccaatgtattcgtctgatcactaagccctcgtcgttgttctgtcttctctgatcgctttctattgctttcttccacgtcgttcgttccgtccgttcgctgggcgttttcgctttttccattttctaagtgattgtcaacattttttgttggtcccttctcttaatgagttaacgcatgcgattgtttaattgtatttccgctcattaatttgctattcattagtactaattgctcccctccacctccattttgtctcattacgcccaatttacggctgttgtgcaccttttccattgccattcccctccggcgttgtgtggttgtgctggttccgctcgtacacttcccccgtggcgatgtccaatttgattttgtatgggcacttttcggcactttcaaaccaataccttcggcacatccttcggcactttcctccgacggcattgtgaagcgattgcccattcagcccattttgccgacaaaattcaatgaatttctctccgttgtccacgcgcatcaaaaaggtccacgtgattcgccgctttttgcggttgttcacttttggcacttccatttcaatggacgacattttgaaaaattgcaataaattataaagtattttgatttttttaaatttttattctttgtattaaatgaaaaattctgatgcaaaattcgcgataaaatgtcaaaaataaaagaggaaaagagagagggaacacaaa

SEQ ID NO: 15531 - DNA, 2205 bp, Heterodera glycines
tggacacaaaaaaaaataattattttttccattaaaaaacctgaagactgaaagggcagaaaaggaaagtgccatttcacgctaatgaattacgcatttaaaataagaaaaaatgaagtaaaaactgtgatttcaattttattttgaatataaaattatttatgaaacaaaaatcaatcagtgcccgcaaaacaaaactttgacgcattggccattctcagagaagggtcaatgaaagaaagtgatggcctttcccatcactttgagcattttgtgtcagtcattcgaagcattttcattcatttccatcgtccaatttgtgatgggagacgaaggaatgacagaaaaaagaacactatgatgagagtgattcatcagagagaggggaggggaggagagattgagcattttatggccaaaatggccaaaaaatgaatgaaacgattgtttgtgcttgaccaaaagcggaaaaggaacgaaacttcgtttagcgttggacggacactttactatgaaaaaatggacaaattaaagcaaaccaaaaaaaaaaattgttgaaaaattggagaaattaaatataaaatttgaaagggttctttatttgaagaaaaaggaaaataatatattttaatatttattaatttttctttgatataataattattctatttgaattttattacgataaaaaaggaattaagaaaattgaaaaaataaaaataaaaaaagtaaaaaggaatgaataagtaagtgaatgtctttcgctggttgctaaatgaatgaataattttggatttggaatttctcgcgttcattcgctgctcatccccaacagagtgaagtgattggcgggcgtttaatggtgatagaagagaaagaggagaaagtccgcaaaaaaagaataatttattcattcattgcataaacaacaaaaaaaaaagatgaagcatccaccaccccatcatcatcatcatcatcagcagcagaagcgaacgaagcaaaagccaaaagcagcaaatggtgcaattttttggtgatttagccaaaaaactgagaatttcgcttttccatttcgaggcaaaaaatggaaataaaataaaaaaaattgaaatttaaaaaaagaacgtttttataaccctaatttgttaaaaataatttgttggtacgatgcaatttgaccgcgacttttgtgtccccaatatataagaaatttaataaaaatctttcttttcaatgatttatgatgggaatgcaatgtcgcgctaaaggtcataaaactcataaattattgaatcattttgcaagaatattttatttacaattgttttaaaaatattcaaaaataggataaaatgaaaaaactatgcataattaattataattaaataataaaaaaatatctttgcatattgcaaatagtcgaaaaaagaaatttacgatgcccaaaagggctgctgatgatgcgcaaatagcggagatgtaattggggaagaaaaagtggtgctaataattgcgcgaactagtttagcatttgtgaagaagtgttatgtgacacgcaaaaagggcaaaatgagtgaataaatcattgagagaaatgggctaatgttctgggaaggtgttccgatcattcttcaaaaattgcttatataaaatggctttagcggcaaaatcacttttgttgagactgatcagtttaatataagcaaaagaaagatagaaacagtcgcaacgccaaaattagacttttttttaaagtattgacaaattaaacccacgcaaatacaaattgcagctctcgccaagggttgaaaaatatttttttgtggcagcaaatccaccggattaatctttcaaaatcccgacgcaatatcttcaaaaatcccataagctaatggagttttttccccgagacagtaaaagtttggagatagcgtgtaaaagtgataggaatagggaaacaaagaaaacaatgagcaaaaatggaggttattttaagattaaattttataattttatttaaattagttttttcccgccggtgcttgatcgacctccgtccggcaaatcgggcggggggggggggggggggaaattgaaagaaagtcgcaagctgaatgaatgaatgggaaaacggcgaatggggggggggggggattgaataaaagttgaacagagcaggatttgacacgacacgacaaagacgcg

SEQ ID NO: 15532 - DNA, 887 bp, Heterodera glycines
ttttaaaaaaattcctaaaaaaagcaaaagggatattatatttttttaatttaaaaggatttttaagaattttgaaaaatcaaaaggtaataggtatggagttgtccttttgtctaccagtggacagattggtgaaagacaccacctgctgtaaaaaatttggagagtgttagcgatatggagaaaattggtcaaaattcgcagaataatatcaattagtagggatgtcaattttatgtaaatacatttttttcctggattctccatgctctaaatagcaggaaaaacacttttttttgtgtttgcgaacaaaagtacatattttggttttttcttacacatttcggggttttttttttacatatttatgcacatattttgactactttttgtatatatttttgacatcccaatcaattaggtatctatgtatgtataaaattttaaaaaaatagaaaatcttttttcgaatccaaaaaatgaataggtaatcaaagaacgttcataatcccttttgaaaattaatttagtctcagtgcttcacaaagaataatataaaggaggttataaacacataaacctacaaaatatgtacaacatttgtctcaaaattgtgaccaaaggctgtaaataaatttttcatgcgtttggcccattttcgccggcacggcactttcatttgcgagccaaaaggtgaatgaaactcacaaaacatgcacaaatggatgggcatgcaaaacacaaactgacaaaacacagcaaagatttgttgtggtagaggatagtttttttatccgtttaaataattaaatcgcaatatttaaagtcatgaatttcgtcaatgttggcactacggacggaccgagcttcttttgaagtccttcggg

SEQ ID NO: 15533 - DNA, 2583 bp, Heterodera glycines
cattctgggaactatttgtttcatttgctgttataaagtcaagcagaagcaaaggcactaaaataaataaaagaaatcacattaattcaatttctcaaaaaagatactttcgcgccaattttaattttaccatcggaattattttgtttatggccggcggattcaacagccaaatcaatcgcgtgaggctcatttccggaggccggagactcgggagagaacggagcggtgaaactctcgtcaaatggacccaaaagagcgacggggacgagtccggaggaaacggcgttgtcacagagactgaagacccattttggtgaaaaagtcgtcgtcgtccttcacctgaaaccgtcctgccggagtgccttcaccaccactgcgtcgccccttctcagaaccatcgacgcgctttcccagtcgctttggacacgtcgcaattgctgcgtcaacttttgagcatggcaaatcttcgtctggtttcaaaatcgtttatgcattattattcgtccaattttcaccagtgcgtcccgctctttcgtcgtttggggtcgtcgtttatgcgtttttggctgtttattttgcgcttccctttcatttgagaaatgagtgcttttcgttcctcggaaagaaagatgaagcgacttttctgcgaaaattaaactcaatcttttcccaatttggcacaatgattgacttttttgcaatggattcgacccggacgaaagatgcgctgcaattttgttcagctcagccaatgtgtggcgatgggacgcggacagatgagcgcggaaaggaagggcggcgctgaaacagtcacgcaccttctgaaatggaaaaaagcacaaaatttcagtgttgaaaatagggcttatatttttcgaaaaggcgaatttacctccggtcgttctctggcaaaccattcgtccatccggcacaaaaaagcctcgtcaagcttattgactcgttggattagctcacgaacacgctaaattcgtatttaatcgcaagttggcctttccgcctgaccgtgttaattgagccgatgacacgtggcagctgcgctttgatttgattgttaagcgcttcgaattcggcacgccgcatttccacctcatcggactgaattaaaaagacgaattttcgatttacgctttttgaagacatttttgtgtgtcgcttttgctgtttcgtaatctgctaatttgtcgaaacgtttgtgcaccaatttggcgaggtcactgcgcacaagtttctttccctctgtgatcacttcttggtcaaatgtctgcaaatggcgtcgacaaagctcatccaaatgccgaaacataacagcaaaagccttcacaacattttcgtcttgcgcatgacaaatccctgcaaaagtaagacgaatgctttttcaaccttgtgatcggaggtcgatgacccaagagcagctctttcctgctaatctcgccgtttcacccccccccccatattttataatgatggcattcgtttacatttaactgtttttttcatttatatgttctcgtttgcctttataagtgtcttcgtgccgtttaacggactgttcgatgtgttttttgtacagttgggcacagtaaaggaatttgcacagtcttcgctccgcttcctccaacagttgcacgaggtagtcgaactccgtgtaccgtgccgtgttcagtccgatggaacggttgatgcgatatttcagccggttgctcttcttcaccagcgagtgcatgttaattcgcaagagacggtcggccaacgacagctgttcttggctgcgatatttgcgaactgaaaagattggcttacacgaagcaaattcgacggaaagcgcttgttaactgagttcctttcgccgtttgcattcattcatacgagacgccaaagtcccaaattgtcggagcgactccatcaatttgggatggtccgggtgatggatgggcgtattctaaaaggcaaactgaggaacggtgactggcggtgcggcacgactttcagcaactcgccaacgtaaagggggtacttcagacaccgttggattggacgtgacactgcggtaggcacgtcgaaaacgctggagcccttttgacgcatggccaacaaacacttttgaagggcattttgtagtgattcatcctcctcctaagagagagagagatgagacaaaaaaagaagggaaaatacattttccacgatgacacttatttgctcaacataacggaaatggtaggcataagcaactgaaggtattcaaaatcagtgtaattttattcactttttacacggaccaaagaagcgttctttcaattccatgaaagcatttccaaaatgttggtcgacagaaggaagttctaacaaaagacaaagaattggatgaaaacaacgagttcttttttcccttacctttctgtgccataattgtcgagattagtgtctgcgagagttgtttgagtggcgcataaccattggtcagcgcttttttgtcctccgcgctcaattcggcactttctttgatggactaataattgaaagtaattcgttaaataacctttgaaaataaaagcaaaa

SEQ ID NO: 15534 - DNA, 2603 bp, Heterodera glycines
ttttaagctaagacgggcgcttcgcgcccatttctaaattttgttgggctgcttcgcgacctcagacgggcgcttcgcgcccgttttttaaattttgaagagttcgacgggcacttaaatttttgtaaagtttgttaggcagtttagcggcctgggtcgggcacttcgcgcccgttttataaattttgttgggcaaccaaggtggaagaggtacaacagttattagaagaggtataacagtgattagaagaggtacaacagtgatttttaagggtgaacatccaaaataagcatttctaagttcgaataagtacgttaaaacgcaaaattttcgaacaaaacataagtttttcgtgcatttctcgtcgagttaaatctgcagaaaacataagcaaaaatttaaaaatccgggccctaatcattactgaccaaaattactatatctatcggaacatataaagcatatagaaatggtaacagaccagatcattacaccaaaacagcagtgaagagccagcaaatgtaggaggagggcggagagccgagtcggttacaggctattcaaacacatcatcataagcatcaccaacaccttgtggctctgctgttcccctgtgctgttccgacccgacaccgtccatcaccaccaccatcagcgacaatcatcaatttaatcgttctgctgtattgtgcttgcttgctagtggtgtaaattgacagggtggtagtgatggagcggggcggggatcataaaaaagccgcgccacctccaatttttttactggagggaaaaagcgccgctaattgaggttgggccctcccccgcagggaggacacccaccgattttggaacagaacaatgattggttgtgaaaagtgcgcaaaaaatgagggtgtgaaataactatgcatcaaaaggtgctaggttcgatccacaaaaaacagcgacccacaaaaaaactcagtgtgggcgatccagaaaaaacttagtgatttgattgttcatattccggaagcctatcgcattactttcggggcaccaaaagtgcctgattcggaacccggaccggcccggttaataacaattttttgtctagtttttcaagtgctatctcccagaccgggtccggttcttaatctgttcacttggagcccatcagggtcggacacatctgtcggaggacctcagcctcgcccccgacccctgtcgatggccaaccaaagctaagcgtgccggtaccagcggtttttttgtacagctcgatgagctctacaaaacggtatcaatggcgtctggctgtgtctattacaaatggagaaaagtggcgagaagcgatgtgaaaaattgaaaaatgacttgcatgccgccgtacattagggttaagcggacggcacaccgtgattttgtgaattgaataattaaatttatttaattaattttatcaatcactgagtttttgtggatcgcccatactgagttttttgtgatcgactcagcacggtatcaaaaaaggaagaagaaaagcaagcaattgaatggaaataaaaaaatattaaatattggcgaatgtgggtatattttctacgaaacgaacactttttgtcatgttaattttttcattttaattgtctctgttagctaataacaaagttttggagaactagaatcgaaattttggggttctaatgcacattatgagtccaatcgacctttatgagtccaatcaattaacaatcccgggtttttatacaataactttgttcatgttcgaacaaatcctatctttttggtatcattcgaaagcacaaagtttaacgaaactaaaatatataaaatcgcagcgttcaggcaattaccaaaaaagatttgattaattaattaattgctgattattttcgtttgtaactttcttgaaatgttaggctgcaccgcgcttacaaaatgtggggtaacaatagagcttccagtgttgctcgagagatttgtctgggtgtttcaccaagtgtcgtatcttcgggtcaagccttggtctcgggaaatttcagtctcgagcatcactaattacttgtcaaagtttttatcatttcatggctcaacaaatttcatgtttattatatttctgttgtttttttgaagtcgaaaaattactgatattcttcaaatttataccaacaacatctattttcatataatttcactttgcatggaaaaaactgcaaaaattaaattaattataaaaagataagcaggattaaattaatttgcttactctatgaaagaaattcacaagaaaaatgactccggcgaagagaaaaggcgtgaaaattttaaaaaaataatgaatgctaaattttatattaacttatgggttgcagaactaatttttcaaaagattggtttggcttggtttcagcctcttaaaaattgtcagaattgcggggttagtgtccgttgcccaatgtattatttatataaaaaccagtgccctatgtgcactgaaagtaactgattttaatttatttttttaattgaaatagcttcgctatttaacactgttctctagagggcgctacgcgccaaaaactttcaatatgaccttata

SEQ ID NO: 15535 - DNA, 2889 bp, Heterodera glycines
  misc_feature (30)..(30): n is a, c, g, or t
  misc_feature (57)..(57): n is a, c, g, or t
attaaaattaaaacgtgttttttgggcatntaagaaaaattccttaaaatcctcaanaattgcgaaatatgtatgaaattatataacataccacctaatattatatgatttcgatggtattatttaaactttatcacgagtagggttgtcaaaataacagggtttggcgtgctgatgcctttttaatatattgttcaaaaaacggaatgtttttttttcgatatatgcaatatgcagcgtttattttgttttattatttggagttgttttcgaattatacgatgtcaaaaattttcacttgcggttgttttaatatttagaaaattattttaattagagatcgacctggacctggatccatgcctggatttttcctggatccaggtccaggtccaggccatttttcggcaacctggatttttcctggacctggattttcctggatttttgtccaggaaatcaaggtccaggtcaaatgtgaaaaaaatccatgtccaggtccaggcaaaacacgaaaaaacctggattttcctggacaaaattttagaatttattttttcaagtggccgatgttttttcaagttttaaaaacagattaaataaatttaaaaacacattattattattaattagatatttttagaggtttataagcaattaattgattttttcaaacctttttttgatttttaaagtgagtttcaaaaaatccaggtccaggtccaggccatttttcggcaacctggatttttcctggacctggattttcctggatttttgtccaggaaatcaaggtccaggtcaaatgtgaaaaaaatccatgtccaggtccaggcaaaacacgaaaaaacctggattttcctggacaaaattttagaatttattttttcaagtggccgatgttttttcaagttttaaaaacagattaaataaatttaaaaacacattattattattaattagatatttttagaggtttataagcaattaattgattttttcaaacctttttttgatttttaaagtgagtttcaaaaaatccaggtccaggtccaggccatttttcggcaacctggatttttcctggacctggattttcctggatttttgtccaggaaatcaaggtccaggtcaaatgtgaaaaaaatccaggtcgaggcaaaacacgaaaaaacctggattttcctggacaaaattttagaatttattttttcaagtgaccgatgttttttcaagtttttaaaacagattaaatagattcaaaactcattattattgtaaattagatatttttagatgttcccaagcaattaattgattttttcaaacctttttttgattttaaaatgagtttcaaaaaatccaggtccaggcttttttcaaaatgtcgatctctagttatcatagcaggtcattttattttgtcgcaccacgaaaaaatttaaattttttttaccaaaatctaaaaaaattaagaatatccatgaaggaagagatagaaagtgcgcagcgtgagttggaagtagcacaagggcgaattcggcgcctggaagatcaaatttacgagctgaatgaggtggtgatgtcatgcggacagctttttccccgaatcatttcttttgaaattttcttaagaaaaagtttttaagaatatgacgctaaagatggcgtcaaaattaaaaaatcttccgatttaaaaaaagacatcttacatacaattgacttaaaaaaaattaatttaatttgttttgcaggcaaagcgattgctggaagaaaaggagcacgagctacaaacattgaacactgaattggcatcagagagagctgtaaaaaacatttttcaatcaaaatacagactttgttggacacggaaaattttccgtgactcgaaatagggaccagattttttttgggccgttaggttttaaaaagagaataggtttctggtattgctagcagacttctccgatggaatttgatttttttttatttatcaagatgagcaaggaggaacgggcaagactgctcactgaaattgcactgcaagaatcgcgcgtttcagaaaagcgattcgaagttaaggtgtggtgttaatttggctaatttgtcaatcattatttgccccatttcgggcatagcataataatcatgaacaaaaccattaaaaaatttctggaggcgcacctgaagtttctttttttttcttccggtccaaaattttttgtcaatcaaggaaattttggcattttggcgccgcagggaaatattttttgaactttaatgctatttgttaagcaaatgtttaaaactcacccattttgcaccccctcccagaaaattgttattattcgaaagagcttaacaaatatttttattagcatgctaagttttaaaaaattggtttcagataaaaaataaaagttgccaaaaacatacgaaaaaatcgatcccaaattttcgcacgcattttttttttttgttccaaaatgttaacccataaaattttatgatttgattctgaaaatttcaaaaaaatgaattttttccaaaaacacagaacaaaacggaggagatgaacaaactgaaggcggaggttgaaagtgggaatggccatttgccgaccgaattcaatgacccggacgatctgacagcccacattggtggggattttttaattaataaatgaatttattaaattttttacattgcttttttataatagtttttattttgttgatcgcgaaaaaatttatgggctctagattgttttattaattttaaaaaatttatccatttttgtcgattttttctgattgattttgggggtcaggataaaaaaaaagccgaattatcgaatagcaaacaaacatgctctacacgaaaaagtaa

SEQ ID NO: 15536 - DNA, 823 bp, Heterodera glycines
gggggggggggggtgatcgatgacaaaatgggagataatcagtgttggttaaattaatgggatgaccaccgtgaagaaagaacagcgtcagggagggcaaatgaccggcacgaaaacagttttgacacttccaaccgcaggaaattcatcgatggaccaaagcaaaacccatggatttcagttttacaaaatatttatgttttacagaattcaaaagaataaaagaatttttgacaaagtttcgtacgaggaaggcgacatgatcccggtcatttccatcacatcactgactaccatataaattaattaattaataataattatataaaaaaattagggaagtgtcatttgtcggatggaggtcatttggttattgtcatcatcagcataatcattgttttgttgtgttcggtcggcccatcaaacgattggcggttggacaatgagcggcggggacgaaacgtttgtcggtcgaagtgcgggcgaatggacgccgagaaagaggggctggtggaggtgcaacggattgtcgaagaactgctggtcgttgctggcgctgtcctcagcgggcgtcgtgatgaccacgtgcgaacgacggggactgaagcgaccgtcgaggagagaacgcgcggagggcacggggaactctttgaatgtttggccgagacgcctaaagaaaaaaagttcggaatttggcgagcaatgccaaaagtaaccaagcaatgactttcccaacttacgaagccgtggcgggaaaacgtcggaagagtagcagaccgacgagcgagaggaggacgagcagaagggtcaggacgagcagaag

SEQ ID NO: 15537 - DNA, 1235 bp, Heterodera glycines
tttattccccccccccccccccccggcattcgtttgtcccatattctcgccccttcccttccgctgcccctcccccatttttcttttgcacttctacggaaaatggattttgcctgggaggaaggaagtgaggagaaagaaaatggcaatgaaaaccgaactttgctactgcggctgctgctaccaccgcactgtgcgttttgcccaatgaattggccgtgggtaatttgtgatgggcgggagggaatgaaaactgaggtaaaagttgcttaaaaagcattaggaattgtcttactcagtttttttcgacgaagaaatgtgccgagaaaaggggcattgctttaactaataaatcatttgctttgttttttgtttggtttatgtggtaacgaattgcgtgtgaataaaaggctaaaaaggggggggggggcaaacactccgcccaattccgaagaatggccgcggctgatcgtcgttcatatttatgcaaatgcccaaaacaccgacaaaaggattaacgggtccaaattggttttcctattttaataacgacgaattcatttccaatggacaagccaaaatatgcagtgaataaattaacataataaatgaattaagggaaaggcaaatcaatggaattaactaatgagagaccgaaattgcaaaaggacaaagcaatgaaaagacacgcccaattaaggaaagtttatttgtgtttgatcagaatttgccattgaattgacggaggaaaaggacagagagagagagagagacatgagaagggaatggaaatgcaattaagcgacgggaattgccgggggcattgggctgggcacggcataagcaatccttcgggcgatgccccccccacttctccctctttcatcaagtgtttgctttgtgtgccgtattcacccctcccccgcagtattacacggcactaaggcagtcaaatctcatgtgttaacaagagggccaaaaatggaaagaacaaactgcttaggcactcatatcaaataattttagagctaataattgctcgagtatataaaacattcaaacataagtaagatggcaaaaaagaaatgagactgaagcttaagttgattattatgtttttgataattaaccaaaaaacagaattagacatccaacattttatttgagactaaccggacagaaatgttacgacaataacagactctattattatagaccgtcaaacaaccattgcc

SEQ ID NO: 15538 - DNA, 1277 bp, Heterodera glycines
  misc_feature (16)..(16): n is a, c, g, or t
ccgttgagagttggcncagtcttcgtagcagtcgaatcaatcaccttaacaaaccaattgacatacagtaacaaaccacatcgctattatacaattcacttacatggcattgcaagcaccgttgcttgaaaatcttctttcctctctcgtaatcgccttccggaattgcctctggcatatttgaccttcgaaagattgatgaagcgtgtataccctgtttcaagttggttaagctgattgaaaaaacaatacgctattaaaaaagctgtcgccgtggtttgtgaaaccgaatataaacattttcaaagaaaacccgggtaacacaacaactttaatcaacaaatcggaaatacaagtcgtctcatttctttctctacacaaaatgagttctcggacgctgtgtcgtgaaaggagtcatctaaatgagaaataaaagtaaaaaataggtgtaatggcattggctaacattgcgtcgcttggaattcacacggtgaggaagcggaaatttgatcttggagttctgaaattgcttcaccccggcacgcttgcagtccgccacactgatggtttgcactttgatgatctgaatgcgatccgcttgagcgcggtgacgagcgcccatgtcgcgatagcactgcgtaacagcacccgcttcacaaacatcgcgatactcgcggtacatgttgtggtgtccagtacgagaatcgtagcggagccaaatgccaaagttcttcacggagccaggctttttctcgaagaccttaattttcgcatttggtttatgttaaacgtaagtgattgcgcggatcaatcattacaacattttcagttatttttaaatatttttcagtcttaaaacggacgacgcccaactcgttttggacgctctctttttttacaattacatcgagaagttagatatctcatacacattaacaagttaaaacaaaaacgaattgacaaacgaattgagtttttatcccttttccttcatacctcttgacatgaaataatttctccgtgtgtttttttaacacgacgcaacatgctagtgaagtaccagaagcgggacttagcaacgacgtggttgctggcaaaaataaccatttcatgcagtgtcggatttgagtcatttgcagttgggagtttacgtccaacaacgatgtactttcttaactgaaaagacaggatttccacaaagaccaaattttaaaaattacagtttctccggatgctttgattggcattgtttaaaacttggctaaattagaaaattg

SEQ ID NO: 15539 - DNA, 2396 bp, Heterodera glycines
  misc_feature (95)..(95): n is a, c, g, or t
ttttctggccatttcgcgcagcacgccatatctttgtttaaaacgaatatatttttctagcatcttgcaggctattagagaacacttagacctanttttgcggcgccacaaatgtcttcgcggccaaaaaagggccccccccccccacaaaatgtggtagaaaaaaatcaaaaacatgcaaaaagtgctatgaaattgagttggactctctgatccgaatttttccggatttagtaatatgtactcaccgatgcacgttcaaatgaacgaaatcattgaatgttactcgtttagcttggattagtacttattggcacctacctatgtactcgaaatcgaccctcatgcaagaaaatttaaaatttgccgattttcaagattaactacatattttcgaaatttttcgtctctaatatcgcaattataacttttttttctttgttgaccaaatccaataaagttggtatcattcgaaagctcttaacaagctctatcggcttcccaaaaaacataaagatttaccgacatgtaaaaaagttataaattaaaatatgcaaattctgactttttttggttttattgttgcaacttttttatacataagttgttcaatcgcttagaaataccttaccaaaagcttctaaacatgtagaacttttgaatgatgccaaatttgaccaacaaagaaaaaatttgtgatattttatgcttgggtcagacgcaactgacccctactggggggaaacaccttaactactttatttccaaattcactagacaatcgttccattgaaataataaattgttcaacaaaaataaccaataaaataattgtgtatacatattatacactggtggaaaaaagtctttgaacaaaaatgcaatttttgtaaattggtttataaattgaaataaatgaaaaatcatggcggaaaaaagtctttgaacacatttaaaaaactatttcaaaaggctcttaaaaatctgaaataattcctgctaagacgcatttttattcggagtaaaaacgaaaaggacgaaggtgtctaaaaaagaaaagaccattgtttttacgggaaccggccattttggcgcaagactctatatcattttgatttcacagcaaaattaaataatcttggtatttttgcaggctaataaagaacatttagacctattgattaatatcaacattattttatttggtcgaattaaaaaaagttatgaatctttaaacttgtctgcgccaaaatgaccccgacccgttttttacaccactgcccagtcccagtattttatttattatataaatgcgaattttggatgaatttctgtttttgcgttctttttgctctctcatttttcccaactctctctttttaagttacataacaacagagttttgcattgccttttgtgacacaccaatcaattggaaaaacggcaaattgagccacaaaaatgaatcgacggtaagaaaggaatttaaaaaattgcaaattttcatttttccctatttcccatgtttcagttggatttgtgcggatgtttggatggacattctcccatcttttaatcgtccccaactcggactcaaaatggcattgctttccgaccgtttcgatgttttggtggacaaacatttcgatggaaaaagcgaattgccaatttggagttacatcataattttcaaggaccaagaatttggaccaaaaccaatgctatttgttgtttcgaaatatgtaatctcattgccggatcatccgttgccaaacaaaatccgctttaaggaccttcggattgagtaatttaaaaaattatacagaaaccaattaatgtggttggtcattttttcccttttcaggtacattgaccattctgtgctcgcatttatccgttccaacaaacaaatttgggacagaatgggcaccaaatttgagttgaaagtgtattcatacgaaacggatcaaatttgggatgttttggcccgagaaatttggccaatttttgcgccaaacattcgccattttggctttcactgtggcgatcatttggacaatttgcttcgtttggtttcaccgacacttctcactgattgcgaccaattgaattcaatcgattccggttatctgtcttccagtgcgatcgctgttgatgggccaaatgcaatttctgcttggcaggcgttggccaaatggttacacacgccgacaaaaaatggacaaccgaaggaattgcgttgcgatgatttttcaaagtccatcaactatttcaaggaggtgaccgaccataatttcattaaactactaattaattgattgccttttgttttgtttaggcatttctccatgccaccacttctgtcagttacaaaattcgatttaatttatttttgg

SEQ ID NO: 15540 - DNA, 1880 bp, Heterodera glycines
agtttagcttagaactgatgcttctaggatattttttctaaaattttcattatattttttccccatttttaatatttttttagataaggctggagaaaacatgaaaaccgaaccaaaatttggtattaaaggaattgtagtctagaaaacgaaaaaaagttagttgtttgataaaatttcaatttattttcaatgggtcaagcccagtgtcagacaaaattgctcataacgccaaatatttaaattggcgtaaatttttgcgtgtttacaccggaacccgtcagttcggccccaacacgtttcgcccccagcgggatttcgcttataacttttttctttgtcatccaaatccaacattgttggtatcattcgaaagcccttcagatgctctattagcctgcaaatttccaaaaaaattcgtcaattttgaacaaatttatggccaaaaaagttggaaaatctggttttttgagttcttcaggccataatttttttgaacctttacaaaatttttcaagattttgcaggctagtagaggacacttaggggtctcgaatgataccaacaatgttggaccgaacaaatttggtatttaaaaaaagtttttggaagggagaatctttttctaagcaattctatatataattttcgtaatgtatgtcacaagaggagagagagagaaagagaagaggagagagagagagagagaaaagaggagagagagagagagaaagaggagagggagaaagaaagagaggaggagagagagagaaaggaggagggagtgaagaggagagagatagaaagaggagagagagagagaaagaaaagaggagggagagaagaggagagagatagaaaagagcgtggtgagtcgaagtgcaaaaagtccgagtgtggcgaagtgcaaaaagtccgagtgtggcgaagtgcaaaaagtccgagtgtggcgaagtgcaaaaagtccgagtgtgggcgaagtgcaaaaagtccgaatgagtgatgatcagaagaggcgggtcatttcagtaccgaagatttattctaatgattaattattatttaaatttataattgaatgataagctaataataaaaaatatatttggctctatttcagtttacaagaccacaaaaaaagacacgatcatgttatattttgataaatttcatgcaccataactttttctagaagcacccaaattaaaccttgctaccatttgatagccctaagaatcttctattttcctgtgaaattcaaaaaatttcgttgagtttcaaagaagttgtggtcaaaaaggtttaccaaatcaatttttgtaatttacaagccacaactttttttgaaacacaaccaaatttattgaaattttaaaggcaaatagaggacactcagggctatcaaaagatgccaagattgtttaatttggatgcttctagaaaaagttatggcgctgatcaaaaattgatcatttttatggtgatcaaatattcaaccaagtatatctttttatgtaaaagccgtagccccattattcaaaagtcaaatcagtagagaattttgtgctcttttcagtgggcttgcccattttttctagaaaagatttcccaaccccctagggatttcgaaaatttccccgattttcagtgtattttgggtgtcccggtcactaggaaggaatgatctgatcaagttggtgtaagagacttttttgatcagcaccaaaagttgtgcgagcatgaattatttcaagtttttaaatgaactataagatagtttttcaggtttgagtcaagacttttttggggcactgtatttctctcgcaaaaatgtaatttgtttgggaaatattaaatataaagctaaattataattaggg

SEQ ID NO: 15541 - DNA, 1201 bp, Heterodera glycines
ttgtagtattttatttttccagaatatcttttcagacccgagttatgaattttttctgaaaatttcgatttttccagaatttctggaataacttttttcatattgatgttagaaaacataaataaatcccataaaattctcctgatttttctctatttttaaagctttatttgctcaaaattggtcaacccttaggctagatatgaatttttcaatattcgcccaaaatcccgagggccaaaaaattgccaaaaaataaagaatttttaaaaaattccaaaaattatgaaacttaaaatagacatcatattcgtactcagcaccttattttaccccagaaaaatatttttcacccccattttcgtcagaaaaaaaatttccgaaaatttctagggggcctagctcgaaaatttttgaaattttccggccatataatacactattcgatagcattttaaaagctctacaattttgctctaaggcaatttttcgctaaaaccaacccctgacgagttatgggcccgggactcaaatgtcccgcttaggccaaaaattttttctatttccggaaaaaaatcgaaattttttcaaaaaaaataccattcgatagagctcgaaaaactatgttttggaagtggtcttcgttttcccgggaaaattcgttaaaaattcttaaaattcaaaaacccaaaaaccgttttttaggcctagctcgaaaaattttgaaaattttcgaaattttaaaacttggttggatagcctttcaaatactacacatttttgctcagaaacaatttttcgttcaaagcaacccctggcgagttattcgcctggtactgaagtgtacacttttgggtaaaaaaaattagccaaggctacagccttgggcgcccaacgtagggcttaggttttgctggcaaagttgtcggggatagtctgacttaaaatcctaccagcaagagctaagcgatcccggtccaaagaaaaaatttcgtagaagaaaaactgcaagaaaaagtgagaaatccgtccctgggactcagtcgtccgcgctaaatttttttctatagttttcccagatgcgcctcaaaaagttgtaagacccttccactactttcagggcgctcccggccttcggccgggagaaaatggttttagcaacgaaactccttgtcaatataacatatatagtaattaaaat

SEQ ID NO: 15542 - DNA, 2718 bp, Heterodera glycines
  misc_feature (49)..(49): n is a, c, g, or t
tcaccaaaataattgaacgcgctggaaagtatttgcctgagttgtgtcntggaagaaatcaaatggcataaaattctcaaccaattgacaaaaatgccaaatttgcagcatatttcattgtgtggcaaaggggatgttatgctggaacttcaacacatcataagcattgctcaatgttttccaaatttgttgtcgttgaacctttggaagtgtttgaaggtgggactgaataaaagaaaataaaattgaattcgccttcaattagcaaagaattttcggcaattctttgaatttaataaacttatttttgtaatattccaacaaaagttttttaattccaaaacttttcagttcgaaaatggcttaaatccttcacagaattcgtcacatgccctttccgaactcctctcaaagtgtgctgcaatcgaatacttgtcactttgtcgtgccacgaacattggcacaattctttttgagccgacgcttttgccctcaaaattggcatttcttgaaacggacgacacttttgaccttcaagcgatgttcaaagttgctaataaaattgaattgttcaattaatgctgttcattttcgcagattgccaatgaacagtgccgtaacattcgctgtctttcactgcaaattttgaagccaacaattccgtcgttggattttgttcacgaagacacattgaaaaggtgcatttggatatctcttaatttacattatttttttatccataatttgattttcacgtttttgctaacatgggatttttttttttgtatccgatttcttttttttcagacttgttcacctcgagcttgactttcataagacaccgcaagcaccttttttcgagaattttgtcaaaacatccttgggttttcttgctaatctgagaatattacgacttgctaaagtcacgggtgaggtaatgaataattaattgtttgggttttataattactattaaatttctgttccgtccacaggctttgctggcggtgattgaccgttgtccaaatcttcaagacctcggatattccgcttataatattgacattttggctgcctttttgtctctttcgcgactgaaaaatttgcgctttttggtcattcgccattatggcaaagttcttcagcaaatttctactcaaaaatgtgttaaatgttccgagaattgcgatgagacatttgttggccgttcgcttaaacaaattgcgcaaaatgagaaattggaggtggaaatattcactcacaatacactaatgagcaattcatttgacatcattaaaaataatttggaataatttcagttcctttctttgaactttcccatttctgttggtttaatgtgcaaattggtgagagagtgcaaggcaagtttttcttcacaaatgttttattttttattaagtgtccattctcaatccgaaattctgggtcttttttttgtttaaacggctctcggacaattcatcataatcgaccaaagcgacaaagaatcttttccataaaaaacaccaccggctctaatgttccgcaaaaaatttttgtcaagtgcacagaattttcagcggagcttcggcaccctcccaaaattaaatcatttcagaaaattaataccaattcgaatctacgcttagaattcatatcctgaatttttctagattaaacatcaaaaatgtttaaattttaagttctataatagaaacgattctttgtattttgttatgtttgctttttggccactcttcaaaatccccatttctttttcagtgtttgaattctttgttctgtccaattgtgcgttaccaaccgttggcttcgctttgccaatgtttgaccgaattgaaccagcagatgaacagcagcagcgaaagagtggacgacgttcagcagcgaaagcgcacattgaatatcagcgtcaactttcaaaaatcccgcacaatgtcccacccgttcatccgttttttgcacacgccagactttggaagcgatgtcgtccgacaaaactttgaacaactgtttaccaaaatgccgtaagttatttttagttggctggtattttatttatttttttacatttctgcattttaatcgacaatttgcatactgttttaagttgcgtttattccatacacattcattcgggatcccgtcggggttttcccgggaacctgatcatgagcctgatttgtttttgtaaatcgggacgtgatcccggtaaagccgggatttgagttccggtaatcctatcctggcctgattcccagtccagaatcccaatttttaaaagtccgggctctaatttgttcggataataaactgctgaatgcttacaactttttcaggagttttctttgcgaacagccggaaacaattgacgattattatgatgaggatgaggatgaggaggaaatggaacaaaatgactgatcccagctttacctcttaactttattcaattttttttctttttgtttttgtttgttgacttttcaatctgcattcctcgctttaataggtatgttatttttgtgtgtttccctcattttcaataaatagcttcctcggcttaatgaatgaattttcagctgaaaagtatagtaaacgccacaaaaaaactgctaatacagaagtcaaacgagcaatttggggcaggaatgcctttcttgtacggtggtaatcgaccaattttggaacggaacatac

SEQ ID NO: 15543 - DNA, 5176 bp, Heterodera glycines
tgttcctacccgtccgtcgtagtttctgatcagcactcgttcaccaattgtgatttgctgtggccttgcctttctgtcatattgttccttcatttttcgctgggcttttgcatattcatcagctgcagcgtgccacgcgtgtcttatggcaacgaccagcttctgtttaaattcattacggtccgaaatcgctatcggatcacgaactttcggatcaatgatctgatcaacacagaaaattgggtcacgcccaaacataagaaaaaatggagtctcacccgttgaagcatgcactgacgtgttgtagcaaaaattggcagcatccaaaaattcatcgaagtcgggctgagtcttcgaaatgtatttggccaagatgttgtgaaatgtccgaaaagtgcgttcagttgacgcattgccttgactccaatgaggacaggcatactttttgtcaatgtaaagcatggagcaaaattccttaaaaaattcggaagtaaaggcagaggcattatcggtgatcaattcaacacaaccgccgtattttaagtaacaattggtgagaaaagcgtgggcaattgtttgtgcttttgtgtcggggaccgggacggaaatcacgtatttggtgaaccaacaaacgatatttaaaatgtgtttgttccctttttgggtgactggaaaggggccggccaagtccagcccaactttggcaaaaagtgtgttggctggcactatgagcatctcttcccggtacgcgggtgttggattgtgtctcaattggcaggtgacacacaatttgacccaagttaaaacgtcagagtacattttgggccaaaaatattttttacatttggcaatcgttttcctgtaattcaaatgaccaccacccaaaagagacgagtgaaatgattcaaaaatgagtccacgtaacgaaattgggacataaattcttgggggggaacccttgtcctcaaaataaagaattcccgaaattaatttgtaattggcagtgcctacagcaaataattctttttctttctcatccaaatcagctggaaattccccatccctgacaaacgaaatgtaggccgcggcttcaggatcagctgcttgttcttccaacaaattaacttcgtaagtgtttccatcctcgtgtcggatggtcaaagtatgcaaaaatgggtccgcgaccaccctggaatgtgctgccaaagcgagacagaccggaaattcgataatgtcctcgagttcatccacattgtatatttccgacaagggcttgtcctcagcggcacgagaaagtgcatcagccaaagtgttggcttttcctgccacgtggacaattttgacctgataattttgtaattcaatgagccatcgtgccaattgctgattggtttcagatttttttagcaaaaacgcgaggggtttgtgatctgtgtgaagttcaatgtccgacatgaaaatgaacggtctaaattcccttaaagcataaataatggcactcatttcaacttgaactgctggccacttcctttcagcagcagagagggttctgctgcaataggaaatggcagaaaatgtgcccgtcacgtcatccttttgcattaaaactcctccctgtccagtcgatgaggcgtcagtgaaaatgtgaaatgctttgtcgtaatctggaaaaattaaactcggggcttgcgtaagtaattcttttatcttgtcgaaagcgttttgctgttccctgccccattcgaatttattgccttgcctcgtaagcttcagcaatggctctacgaccattgcaaagttctcaatgtgccgtctgtaaaagcctgcctgtcctagcactctctttacttccttaacatttaaaggcacaggcatttctttgagaatttcgattcgacttaagcttggcttaaaaccttcagctgttaaaacaaatccaagaaaattcatctcatttgaggcaaaaatgcatttcttcgggctaagtttcagattataaagccgaaaacgctccaaaactttccttaccgccgttaggtgttctgaaaagttcggactttttgtgaaaatgagcacatcatcaacgtaggccaatgaagtatcctccaatccagacaaaacgatagccatggccctcgaaaatgctgcagttgcatttttcagcccaaatggcatcgtaatcatttggtacactttgtcttcagttataattccacattttcttgacgtttcttcactcaatttaatttgaaaatagccactggccaagtctagagagctgtaaaattggcaatttccaaccctttccatgatgctatcaaggcgtgggagagggtacttgtcgggcaccgtaacttcgttaagtttgcgaaagtctaaacaaggacgaattccaccgtccttcttctgtacaatgacaattggagttacccatggggtgtcagactcaaccatgactcctgcttctaaaagctgattaatgtgcttcttcaattcctctttgtatttgtacggcattcgtcttggcgcagatgctattggttcctcagttgtggttgtgatgtgatgttcagcggctgtgaaaagtccaagatcgtacctgaatttgctaaaaacatctgaaaattcttcgattaatgccttcagcttttccaaatctttgtctttgaccatggccctagaaaagtcgactacaaatgttgggtcaatttccattttctttcgttcagaatttaacgtaagaatttcttttgtgctattttccttcaaaaatccatttcggtcacataacaattcattggcaaatgccaaatgtgttcctttccaaatccatttcggttccatggtagggtttaccactgccactttaatttgtttctggcccgcaggcgagacactattaatgactgtcaatcccttcttaataagacttatgtcaggtcgatcaatgcaaaatgaattttttgggtttggggatgattcgattgaagcatcgaccaatatttgggagtcggccggaatgagtgtgtttttctctgccgacacgcgcaaatcgttcagtaaaagaattgaacgatagcacaatttggattcgttgtccccaacaaaaaatttcccgtttaaatgatcgaattttattgggggcaatttttcaaagacatcccaaccaacaattacactgtagtcccgggccacagtaaattcggaatcatccacaaaataaattaatgaacggactgtgtacccagcaatgttcaaattcacctgagcatattccttgaggcgaatgacatggcctgaggcactcattgcctccagatcagatgaaaatgttcgacaattgagttcatccgcaactgatcgtggtgcaacagtcaaactggcgccagtgtccattaagcagcggacgggtgtggaattaatcaatgtctgcaccacggcgtgatgcggcgaaatcgcattcagatttgggagcattggaaggtctgaattccgttttgagcagagcagtactgaaatagtgataaaaatcagaaatggaatgataagcagataaatcattgatggagaagtgaattgaattgaaatttggttattcacatcgggatttgcaaaagcattgggaagaaaaattactaaaagtccaatgagtacttttggcgcccgaaaactgaagcgagtcctttttaccggtctctttcgttttcctgcgattttgtgtgcctgggtttgggcgggttcaatgagcttaacgggactgagctcaatttcgttaccaaattctacagatgcattcagatccatcatgttgaggtgtgctggagatttcacaattttctgcgttttgtttccaccaaaagtcatgcgtcgtgtttttcctctgccaacgtattcatctttaatcattaatccaaaccggatcaaaaagtctgcaaaaacaataattatcatcatggacatgacaatttttccaatttgttcccaattcccaaacattttgttgcgaatggactcactcacctgctcccattgttcagacaaagtctttgtgactatagcgtcctcacttttgatttggaatgtgagttcgctttctcttgccaaattggcgtcgtaaaattggccaataaagtcagacacattcactagggcaaggtgaagaaaggaatggcgagcataagttggtgccaatgacagattaaggctgaaaccgtcaatgcgattggcattcacctgtttgacctgagcatcgatttgatcaacttcataaagagaaccacgcacaaaaatgagctgtttgcggtattctgagcatggtgccagtctcgcgtcggagctcaaaatcattgtccttgggtcaataaatgccattcttttgttgtccttcactcggaatttaattggaattttgtcaaagcattcgaattcggagtccgctgagttcccaattttggcaaattcgtagtcatgtgcttgcaattcgatgcatggccacactttaatcaattcgggcccggccacctttgccaccagtttaccagattggaataattttctggcaaaagttgttggatctgagagaagtgccgtcgctgcccatcttctcgtctccaacatataatcacaaatcgatttaattgtctgagaaaaggaaagagtcagcatttctcttacttgttcatccaaatagcccaatttggagttcatttccgattcggtgacccaactttcaagtgatctcgtctttctgcttctctttgaggattcgttgctatcgtcggaaggcaagtcttgtacagcaaatccttcctccgattttatcaaattcagaccacatgagttgactttctttgtgttgttcaaaaatgtcaaacgaaaactgacttcatcagaaatccaaatattgtcaagttgtagtcctttccatgtgccaattttcgaaaattcacaggcccgggtagtgttggtgtcccacataagcaatgtcttgtcttccatttcacattggcctgccttgaattggcaattgttcactgacccaaggggacttagcataattgtgctaccatgttgtgacatgattttagtcataaaaagataacaatattcagttgagacagtcgaccaactaaatgagacagttaaccacattcggggtgacaaatccaatttctta

SEQ ID NO: 15544 - DNA, 1267 bp, Heterodera glycines
ttccagtacgggtttgtccgtgaaaatttgaaaaatattccaaaatccctatttcttttttctatccttgtggactgagtcggcccttgaaattatatatcagggaacccaacactttcttggaattttccagtacgggtttgtccgtgaaaatttgaaaaatatttccaaaatccctatttcttttttctatccttgtggactgagtcggcccttgaaattatatatcagggaacccaatactttcttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatcccattttcttttttctatccttgtggactgattcggcccttgaaattatatagcagtgaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatcccaatttcttttttctatccttgtggactgagtcggcccttgaaattatatatcagtgaacccaatactttcttggaattttccagtacgggtttgtccgtgaaaatttgaaaaatatttccaaaatccctatttcttttttcgatccttgtggactgagtcggcccttgaaattatatagcagtgaacccaatacttccttggagttttccagaacgggtttgtccgggaaaatttgaaaaatatttccaaaaatcccaattatttttttcgatccttgtagactgagtcgacccttgaaattatatatcagagaacccaatactttcttggaattttccagtacgggtttgtccgtgaaaatttgaaaaatatttccaaaaatccctatttcttttttctatccttgtggactgagtcggcccttgaaattatatatcagggaacccaatactttcttggaattttcagtatgggtttgtccgtgaaaatttgaaaaatattttcaaaaatccaaatctcttttttcgatccttgtggactgagtcggcccttgaaaatatatagcagtgaaccca

SEQ ID NO: 15545 - DNA, 3950 bp, Heterodera glycines
  misc_feature (3918)..(3918): n is a, c, g, or t
cgcttccccctcctccacccctcggggtggggggggggatgaaacggtccaacaaacgctattcgcccgcaggggcacattggcggaacggtcgcgccccattcaacacggcaaacactcgacaaaacagcgcgcggttgccggcactgttggttgttgttgttttgtcggacggtggggagggtatgtatggaaaaaaagaagtgccataacggcgcgcggcagcaacggggacaccaaaccaaaaaatttccttggatttggcgcgcaatttttgaattgttatgtatccagggatagaattccgaggctcgtaaaattttggaccggaatttctaagtcgaaaaagatcgtaaaccggaactaaaaccggttaatccctaagaaattcaaacattttgcacaaatggcagacaacaatttattgtaatatgtgtaaaatagtaaaatgttgtatatattgtagaacaatttaacaaaaacacaaaacaggaggatgacgataattttcaatcaaacactggatggaaattgtgatctgtgtggagcaaaaatggatgaaaatttgttgcgcgcgggcgtaattatcaaaagaatttggaccatttgaaaccagcgccccctttgtcttcgccgccgccaccattagtgcccttcttttttgtgcctgctgctggcatttcttccggctcttccgcttggtcatttgctgctgcgcctcctcctttgccgccaccactgtccaacccgtccacggtgccgcgccgtcccgcttccaacttggcaaactccagcatcagtgtacgttgacgagccgttagatgcctgtggtgttaaggaacatgaggcgccgcaaaaatcagttgacaacggacgatcaaatcaaaccattccatttttataggatggagagtggataggaaggggcatcttttagctggtggtcccgaattttcagccccaggggtcaatgaaaaatagtgaggaaatcaaatatgtccaaatcatcatcaagagccactccaaatttacgcaaaaaaaaaaaaaactcacttcggcacattcactttgatgttgagtatttggtcaccatagcccggctgctccaggcgtttaattcctttgcccttgagcaccatttgcgcatgggaagacgtgccggccggtatgtgcacccgtgttttgccatcgttgttggtggatatgcttggcacgtcaattgtgccgccaagcgttgcctgcacaatgagagaaagtttacacatcataaaaaacgagcaagtgctccccccactaggacttaacttgcaagggaacaacccgaactgtaactccgaaagtttaaaacagggaatggggtcttaagcgtacaaattaccaattttgtgggtacatatttgatttcttgataggagcaatggaaatcgactatgatctctctcccccaccctcctttaccatttgcatgaaaattcgaatacctgtgccaaactaatctccacttcagtgaaaatgtgctccttctcacgccggtgctgagatgaaggtgccacattgaccaccacatacacagttgactgtatgaaacgaaaagttaaaagagaaaaaaatttcccggcatttttgcaaaattgttcgacatttccaccaccccccccccccgaaaaaaacgaactgactcgtgagacttgggtgcgcagcacttggccattgtcaatgccggccggaatgtccaaatggaagttcttgttctgcacactttggccatgtccctcacattccaagcatggatttttgttgtaggcaccttggccaccgcaacgagagctaaaaagaaaaaataaatgcatgaaatgaaagggtatgagtataaagtcgtaaaaaagcgatggcaaaatgtctgacctttatgacaataaataaaaaccccaaatttaaatccgaaatttggacataagcgcaaaggcatggacacgatagaaacatagacaaaacgaaccaagttgtctgtacgaagtagccttgagtgtgctgtgtgatcatacccgtcccattgcagtacggacaagacacctgaacagaatacaaacataaaaaagttttattgaaaagttggcgagataacaaaaccttcttaaaccctggctgaacaccgctgccgttgcatttccaacaggaatccactaaaaaatatcatggttaatattaaaaaaagagagatttatttctgctaattgtgacaccgaccgacggcacattaatttccttaaaacggtgacacaaaaaaatcggtaaagggtgtttgtaagtttacaaaaaaaaatcgtagttttttttgtgggggggggggggtgagtgggaaaacaagctgttgccgttaaacaatgataaacaacaaaacacagtaccaacgttgatgcgcacttccttgcgaacaccgcgtgctgcctcctcgaaggtgacgttgaccaccacttcctgtgctgcgtcaaaaccgtgctgcgtttcgccaaaggaacggcggccggagccaaacgcgccggcattgccgaacgggtcgaagtcgcggaaaatgtcacggaacctgtatagaaaataaaatttagccaaaaaaccaaaattttcggctttttggccaacttttgtaaatatagcaacaaaaaaatttttgtttttgctaatatttatataatgtattcattttcttaaaattttgcttttataatttatattatacaataatataatggtatcactcacacttgctccgccgatttgcccgagtggaactcccagccaaagtcgcgggcactttgtggacctccggggctgccagaggccgcgccgggctgcggaccgccggccccaaaacggtcatattcagcgcgtcgtttcgggtccccaagaacctgaatttctcaagtcatttttgttgattttttttcaacttcaatgccaaacatttttcaattaacctagcattttttttgttgtttattttaccaccgactcccaaaaaaactaaggatttcgatgccatttatcattgtattccaaaatgattacctcatacgcttcagagagttcctggaatttttcactggcgcccttcgctttgttgacgtcagggtggtatttttttgccatctaaaattcttttgtttttatgttgaccaaagccattcatggagtcgaaaaatgcatacctcgtaatatgcttttttgatatccgactccttggccgtcttggataggcccaatattttgtagtaatccttgggcaaaaatgtgctgaaatgaaacgacctccgtggaaaaaggcagacataacggagcattttacgaactaaaagctaaattatgtatggaaatttatcagtgtatcgtttcagtaatcgagataattattatataaatataaaatgtagaatgaaaaccaataaaattgtacgaagcattggtatgaagaaactttaaaagcgttaaaattttgcaattcctttggatgattgatctgatcatacatgtgcaacgggattggacgtagcttggtttcaattacggaaatcctaaactaccacccgtaatgaaaaaaattgtatcaaatttatatggatgcattttccgacttacagtttgggtggttcccttgtgagacaccccttgcacatgtgtatgtaatatatatatatgtatatatgattgacaataaaaaaaagtgcaaatgtgaaatgagatgatcaaattaaaaacaaaattgtcgatgggtcgtccattccgttcacatggcgtcaaagtgaaagcgatgcgtctgtgcttgtcgctcctttttgtcctgttgccgctcccggaaatgcaggaaggtgatcatcaccaacaacaggccacagcaggtggccatcacaaccataaaaaggnggggggggatagaaattagaattggtgataca

SEQ ID NO: 15546 - DNA, 1288 bp, Heterodera glycines
aaattctcaaaattacaaaaaaatatggtatcaaaatcgaaaaaaaataaataaaacataattaacaaaaataaaattgaaataaactgaaaaaaaaaatattaaaaaaaacaaagaaaaaaccaaaactattttaaatttttgttattttttttatcttttatgatatttctttatgggtttctgtcttttaagaaattttgcgtcaaaatcttaattaaaccgaaaatggcaaaaaatagacttccaaataaaaaaaacatgaaaaaaatctcgagattcctctgtaagaaaaattcaagccaacacataaattaattaaaatttcaattaaaatttcaaaaactattgtacaatgtgtgattgattataattgtaaactttttgtcttcaacaaaatttagtaataaataataaacaaacaaataaacagaacgagggcctcctccccccccccgaccacggccattcgccgacgggaaaaaaatttgagaaaatgggaggccgaggggggcgagggggaagaagacccaatgggggactgaagaaatgaaataaaaataaaacgtattttatagggagggggaggaaaaaacaatcaattgatgcgtgggatacaatacgtaaagcaaattgatttagaaaattcgagaaaatcatcggggaaattgaaatttcatagaagagagagagagagagcgcaagagagcgaatgttgtggatttgggctgggagatgagaggaaaagcaatcaatttccgtgttggctatttagaaaatgcgagaaaaatggggaaataaattgattaaataaaattacatgccaaaaaatgtgtcgagatttttgccattgtttgcgtgcccacgaaaccttggcgcgcctggcaaaatcccggtttccattaaaatatgacaaaactcaaaaaagcactgaaaatctaatggaaaatctgtcaaatttaatattttttatgaattttttgtcgaaagtccgaattttaatggattgacctcaagttggttttttttgaatgaatttttgtcgggtcgatttttcccctcaaaaataagggccatttttgtcaaaagaaaagtgattggtagtggtgatctggtgataagtaaccactaattctatttggcgaataaactgaagaagacaaaattaactgaaattttggaatattttaatgctttaaaacttgtccaacaatcacaaataattagtcaaaatttgaacctctcacaaaaaaaaaaaattaatttttcaaaaatggcaaaaaatgat

SEQ ID NO: 15547 - DNA, 2609 bp, Heterodera glycines
ttttgcaggctactagaggacagttagggactatccaatgataccaggattgttgcatttggttgccaatgaaaaaagttatagccaaaaatccgctggggcccaaacgtgccggggcccaactgagcgagtccgtccaaattaataataatttgaattcgatgggtctcgagtcacaaagagagaattctcctctcgagaaagcaaaatttggtctcacggaacactgaaaactcctacacatcctttccctatttttccagaaaatttttagagaaaaaaaactggagttcaattcatacgtgcgagagtctcgggttctctcgtcaactcatgaaatttctcggcaatttgtgtctcggcctcaagagaaatttttgcactgttatggatcaaaatttcattttgttaaaagtttttggaaatttctctcgggtttcttcgctagggtcaaggaatttctctctgctcgacgaattttttgtctaaataatttcggtgaaaaccgaggctcataaatatgaagggatggaccaataacaaaaaaacatcacatgcaaaatgcactttgattttgtgcactttctgctgagttttgttgttgtgtgcgcatgacgcaatgaattggatgaatgaagcgaatgaatggactttttgtgcaaatacaaaaaacaaaaaattgtgtggacggactcctgctgctgctggtgggatatgaaaagggaagaatttgggtatccaaagctcgagatccattaattttctgatcaacaacggtaggaccagcagaagcgaaaaacagtaaaatgaaacatttttggcaaattttttatttccacaaaatgaagcaataagtttcttttgtaaccaatagcactacagtaagtgttctcattagtctgtaaaattccaacaaaaaaacttatgaaccaaaagaagttaaaaacccggttttgggtttcgactatttttggctatatttttattgaaatttaacgaaattttttggggtttttctttggttgcttttgggcaaagttataagcaaattttgggtttttgtgttatattttttgggtttttttttttttacaatttcaatgtgaatttagatacatttaaattacaattccgaaaaattttttcattcattttttgatcggtgatgtgtgaatcttttaaaccccccaaaaaagtatgtaacttttgtgggttttatgtatttgttggaaagtgagtgcccaaatttgggagggaccaaagttcgtgtcacaactcagccatgaaaaatctcgttttattcattggcggaccaataaaataaaaaattgcctttattatttaacatgaacaaaaaggcattaaatggaggaaattagtttctaaatgcgatcaaccgacaataaaaatcatttccaaatttactgatggattaattcttaaaaatattttaatttaaaaaaaaattgttttttgaaaatcgcttttcaaaaatgaaaattaattccataatttcaatacataatattagcaaggggtcaacaattgcgctcttaatccttttttatactatgagaaactcagataaaacgatcaactaatattgatcactcgatttccattccaaaaatgattcccccaatctgatcaatcgatcggtaagcggctccaaattgattggtcccaccgatccttagaagaacagagaaattcattcttcaaccgaaacagaggcatcgttttcctcgtcaacaccaccagcggcatttccgctaaaattttgtgccgccgcgttttgcgacgattgcgcgccgtctccgccgctgctgctgtccacgcggaagcatggcagctggggcaaacggagttggggcgtttggccaatgcttggctaaataaatttaaaaaattgtcaaatccattaatctctctcccccacaatgccaaatccgccgcggaacggtgcctgcaccgcctgtgccatttgctgttggaattcctccgttgcgcgcgcaacctgcgcatgataattgcccatctgttgctcctccgccggtgtcatgcgtcgcgagtggcctttcccgtcactgatgatgccattctttgaatgcgtttaattatgtatggattatcgaattaattccaaacccctcaaggcacggaaaacagcctagcaaattttaagaaaatttggagaccaaaaacaggcaaaatgcaaaaaaaagatgaacaggacatccgatcactgaattcattcagtagtggtgctcaaaagtctcggtatggcccggcaaaagtctcgcattttttgaggggacgagggcattagcatcagtcgtttccgggaaatttctgatagactttatcacgagaactccaccaagctctgcagtatgatatgcacaatttttgtgccagcaacgaccttttttttttttgctattcaaaccacctttttttgcggcgtgttttttccaaaaaaactttgtggaaaggggtgggccggcggtgcgataggcatcgcagggaaaattttttaaaattttctatgggtttcgctacagaaattgctcaaattttaactatttcccccttcgttatgacccccc

SEQ ID NO: 15548 - DNA, 2021 bp, Heterodera glycines
  misc_feature (24)..(24): n is a, c, g, or t
cttccatgttatttctcttttctnctgtcagtctcttttcacattattatttttttctttctttctcttccatcttatttctgttttcctatttctctgccctccctctgtctcttctgtttgcatttgggcgttcgtctgtgttttgaatacagtttgaatgggccaccgccaccgactggtgcaacaaatgtcggcgattgatttgcaaaatgtgctcggctcggatggttctccccgccgccggcgggggataggggcaaaatatgtaatcggctgattgacttttcttttatctttttcgctaattgcacagagcaattaacgcgatattttccatcaaaaagttgctcccatttttgggttttccctttgcacaaaaattttcaataatttgtaatctcaccaatgaaaaataattaattacatggagcaatttgtgactgaccctccaaatttcttacgccacaaaaaatcagaaatatctatataggtatgtatgtgtttggaaaaagttatttgtatgtgtcaaattttgcttaattcccggtcctccggggtactggtcccggtttttgaaaagcctaggtctcggtcccggacgaaaatcgaggtcctcaggtcccggtcccggttttgccaaaaaaaaaattccaggtcccgtgacaccctactagtttaaacttctgctacatacgtctattcaattgtatgttggccagttggaccttgaaattctcaaaaaagtgaaaaaaaataaaaattttgaccaaaaaggggtgaatttaatttaacatacaattaaatacatatatagtacctttttttttagcttttttatacaaattaattatgacagcaaattttttttttgtgaaatttatctgaacaaataataaaaatgtacacataaaatagtgtaattattctaattttggatccattttattcgctgtgctttccttcctttccctttttaattagtatatctaaatggttaacaaaaatagacaagccttccttcatttcaatggatacaaagatgcttatcgatgtggacaaacaattcaaacacaaagcgcttttaaagttggatgaatctttccgcaaatacaaacataaaactaaccgatttattttttgataaaatactatcattatttaaaaaaatatttgaattaattttcattcaattaagaaaagtctttgttaattaatttaatttaaaattaattattaaaaaatttttttaaaaatttgaattaatttgggctaataggtaaattaattttccctttttgcatgtttaggcttttaaaaaaaatatattaaatttctacgacaacataagccgttaaacttgggcaatttgacaaggcaacaaataaaatgacccaatgtaatgaattatgttcggaattgctccaaaatggaagtccaaataattacaacagcagcaacactaccaattgtgacaacgatgccgattcggcaaattcgctagcaacaggcacaaaattagtcgccgcggggcgaaatttttcaaataaaaaagtgcccgtgtcatccccaaaatgtgtgccgaccactgctgaaaatgtcatcaaacgaccgccacttttctacgattcgaaacggcgtcgggttgacaaattctaccaaaaacagagcagcttggtggaatactttgaacaagacagcaaacagattcaggttcagaaatggccaaaacctgtctcactattttacattggctgaataattaatgaattcggacctgaaagcagtgccaatctcataaaaatgagaaaaatatggcaaatgcataaaaacaaaggaattttttttaaactgtttggttttgcggtggccatagacacaatcggggaattttgaaagcgattaataattggacaaatttattaaaattctttatgtaatttgtagaaccacaaaattttgaaaaatcacggaccacacccgggcaggattcatgattaaaaaatactgtttcaatgact

SEQ ID NO: 15549 - DNA, 1995 bp, Heterodera glycines
ccctcccccacgtgaatagtgcccaaattgttttagtgcctattttttttttgtatgctttcacctttttctggtttaagcttgcgtaactgtgctgcacagcactgcccttctctcgcaatgtccgaggcttccagcacttcgtgcaatactgaatcggcacgtgcatcgcgtcgtctcacattactttctttgattgtcaatttgacactaacattggccaaagcattggcctcccatttgtccggttcgctgtccattatgtcttcattggtatgcaaagaaaaaaacgaatccatgtacttttgcagttggtggcacaaatctgtttttttttttttttgcgttttaattgccaaaatttctgtcagggtgtgatttatgtaattttcaaaaaaaaaaacatattttggaatgaatttttgttgtcgatgcttgattagttatcccgaaaaccccgtgaaaaagttttcacgacttaggacaaaaaaaaaaacaaaacaaaagtttcctttctttgggtttttttcgggggcccccaaaacagcaatagtgccaaaaaaaattttaaattctaggttagaaaatatgaaattacaaattttaatggttgattggatgcgttaagttgtagcaaaactaaatgctttgtgctaacaaaaaactacaagagtataaatgaaagtggtcaaaatttgaaaaaggtcccacaggtcgactcgattgtcgacattacatccggattggtcatttggcgtaccggcagagcgatcagaacaccggacccgtacctttacccggttggcagaacacggcttgaaccagcggccttggtaattatgttttttttttgcttcagtgaaatgaatttcggaggggagggggggggggggggtaattgattttttcttgaaaatttacgtaaattagcaattggacctgaattcgaacaaaaagtcaaaccaaaaaaattgtttaaatgattgatggctttttgtttgtctccacgtatttaagccgtttctaaacataaatggctaatttcgaaaatttgaattcgacttttgttcgaaatttttttttatttaatgaataaattttaatattacagttaaattttatttttttcgacatataatctacggcttatttaaaatttaattaaaaatttttttttttttttgaaaaggcataccatcaaatcttacctcctttccaatatattttttccataaaaatttttgtctcacataaaaatgaggtttcttttcagataatcgtcagtgtgatcatggcgttggcgagtcttcaaatgatcctcaaaagtttaaactcaattgtctacaatgacatcaatcccaaggtcgattggccaacaattgcgattatgatggccacagtgattgttaaactgatactgtttctcctctgcagaaggtactcaagtacaaagtattaattgggagcggctcatcccccaatgaaaacccgaagttttttttaaattttagcggaagttttacaaaaatttttgaaaaattggtgaagtataactcctttcattttttcctggatttcctcacattttttttcaattttcagggtaaaaaacagttcttcgctggtgttggcccaagaccatcgcaacgattgtctatccaattcaattgctttgctatgtgcttttggggcacaaaaattttggctttatttggacccaattggcgccattgttgtctcagtgtttgtttttcaatttttctcacagaccttgttaaacctttccctggaggcgtctgatgacaccgattttttttttttaatttgacaaaaccctaaaaaatggccatttttgaacagatttttttaataagtccgctaaaaaaattattatttttttgcgcggctgctatttactagtaaaaaaatatataaattacaaatttttattccactgttcagatacattgctgtcacatggtataatacaggcaa

SEQ ID NO: 15550 - DNA, 2536 bp, Heterodera glycines
  misc_feature (2516)..(2516): n is a, c, g, or t
ccccccccccctccctcccctcaaattttgtggtcccatcgaatggaatgggacgccggaatgaatgggatgggcccgggggggggggctgttgtgctgctgctcttcttccccgcaccgctttccttttactcccctcccccccccccccccggggccttgctgctggtgggaaagcctcgctcccccttcccccgccccttttctgtccgtcaatttgagtgaacccaccccctattccaactctgcttcttctcaaactgcttctttacctgtctgtagggaaaagaatgtcgctatttcttttactcttttgctgtttccctccctttccaatcactcactgatcggtctgatcaattcccatttgctgaccaatgatgagactcactaccaaagggttgcgcattcaaatggcgccaatgcgacgcatccattgctaagggaatgaatgccggccaagttgaaaagtcaaagcagagatagaaaagaacaaagtccagattggaaaaatggccgtggcgataaatgataatggtgtagctaattactcaatcaaaaaatcggcgaagccttttgccggaaaggggggggggggggagaatcgcccgaatcggccgctgctgtcgaggcggattcccgtggtttttctgtctgtctgtcgatcgttcactcgtttctctttttctgctgtggccacaaaacaacatcagagccaattctctgctaataactttatttttacatttttttgattcatttaaaattaaaatttttgaaaattttctttatttttaagcacatcagaacttttcccctcccaatctttgctttttctcttccgttagcatcgtaaaccattcccattttccgcttaatacccttacccaagtcaataatttcaattgaaaaaagtaagtacaccaaccgccagcggcgccttttgcctcgggccaaatgattggggggaattagcggtgcaaaggccccgaggggtaattttgatgatgccaaaggacaacacccaccggaaaaggaaaagccaaaagccatttttggcatcttagaggcaagcaaagccactgggaaagctcattcgcgtcagcagttgtttttggcaaatttaattgccgggacaaaaaaataaacaaagcttcttcggggcacagtttttgctttgatcagtccgtcgccggaggcacaaaaagcggtggcggatgggcgatgctttttatgtgctaatcggcagcggaatgtgtggtgttcttctcacccattgtcagcaacgacattcgccgcccgcccatccgccgccaccgccgaatcatcggccgtcaaaccgtccgtccgccgtccgtcactttcaaacgccacgtttcgctatttattataaaaatcgatcaatcatcggcccatttgtcctcatttttcacccgttggccaaatgttttttttgtacaaaagtaaaagcgttttttttttgaaaatgtttccgaaggccaaacaattttgaagcgtcgcgcagtcctcaaattaaattttgataaaaaatttttttttaaattaattatttttatttaaatcattaaaaatggaattcttttcgttgagattgtgccaacggtgtctattgtttgtctctttgcattaattattgttttgttgccctccatttgcttgctaattgcctctcctccatccttcacttgcaaatgccaaattcgaccgtcaaaaatgtcgctttgatgaacggcacttcccccgccccctctgccgatcttccgcgtttcaatcatccaactccgtccgcttctttctccttccccaagggcagctttttctcctccgcttctgcttccgttgagtcgccaatgacggcaactaaaaatcatcggccaacagagccattggcaacggcatttttgggggccagcagcagcagcagcaacggcacaattgaacatgccgaaaacggtggcaatggccatcaaccgatgacagtcattctgacagtgcgaatgctaatgcagggaaaggtggacaatttgggcatattagatttgttggctagagcgataagtgggcacggataggctgatcaaggacagatcggcaagaatgctagaatgatcaattattgatcaataattcgaaggttgatcaatagtaatactatgagaaatttgctcagattatgcatggacataagaaaataattgaactcattaaactcacgggcggaaggaagggggaggagggggattaatccccaaaataaaaataattattaaataaaatgttatctaattaacctaccttttttgttagtaaaataattgcaggaagtcggcagtatcatcggcaaacgtggcgattatgtgagacaaattcgggagcaaagcggcgccaaagtgaacatttcggacggttcgtgcccggaaaggtgtgccgatggacaacaaattatattttactttttgctgaacccttttttaagagattgtgacccatttcgnggttcttcttcctcaattaa

SEQ ID NO: 15551 - DNA, 955 bp, Heterodera glycines
gtgtgccaaattcttctgaacgcaccggcaaaaggaccgaccatccaatacaaaccggcaagtaaaatttgttaataatttataattatttctttttgttttaaataattatttgaaatattttaattaattctaagttataattgaatttttttttgccctagcagaatattttaacataaccttttaattcgaaaattaatggaccaggatgaatcctaatataatatataataagtaagcctaggcgtatgccacgacacccaaaatgcatgtgggaacggaagcgacatttccgtaggtacgagatacgaactgactaaaagtacggtattcgactggatacggtcaccatcctacccagcagacataaaccatttgtctttcgagaccaaacattcgaagccaaagcttgctaatctgcgatacaatttacgcatgctctctcaggttaaccaagcgtacaatccactggccgtggccaattccgcggccgcaattgccgcagccgctgccgcagtgaccgcggcacatcaacagcacaagacgatgccctgcggcatcggcacaaccgccgtccccggcgcggggaccgccgccgcggcacaattgtccgcgcttctgtcccacgcgaatccgtcgctgctttccgtgcacgaggtgaacggatggaacagcaatttgatcagatttgcacaacaaatgttggcacaaccacagagatatgcccacaggggctaaagcatttatttactcgtcgtttttaggcatgaaaatggttataaatggcactaaaacccaagaagaagaaatatccattggcatgccattagttaatagtcgtgccgtgccgaatttgttggccaatttatttgctgaaaattttaaaatttttaatcccattgtttttgtcatcgtcaaatgctaaccacaaaattttttactcatttaaact

SEQ ID NO: 15552 - DNA, 915 bp, Heterodera glycines
tccctctgaagttgccgtatgatttgtgtcaatgccagcggaatgtaacttttcatcacacttttgcagatggcctcgtcctccggtggaattcgatcacacaaaagcttttccaatttcgctatcagtgacttttgaaccttcgcttttcccaattccatttccaatagttttgtaactgcgcgacagataatgcaacggcgtgtcgagagaacatggacagttttctatgggataaaagttaatatttcatttgatgacagcccatggcatttgttcggaagccatcggttcgggtaaattagaacccaaaggtaaattgaacagagcgcggcgcgttttccgaaaaaaattttggaacaaaggggcagcgacacggatgggaaaattttgttctgatttgttaactaacagattttcaccagaggctggtttttgactgacacgaatcgattggtatatcatttatgccattttttttccgggggtgttgactatagtatatccgttgcacgaattaatgcaatgaatcgtcccaatgagtgatcgatcagcaatttccattattattcgtttgtgtatcatttttattaatttttggaaacaaaaacgataaatcaaattgaaacatcgccaaaataagcatttaaagtaagtattctctgctgttagtgagagattgcactgttcggtcggacttctctctttctctgctcctttgatcgatcactcgccgcgcggggccaacaaatggcgactgaccttgcgggcctttgattgggccgtggggcgtcgggccgaactcggcgaggaaatgcccgcggggcaaagctccaaatcctggcagaactgaaatggcgttcaatttggaggcgttttcgccgaccgaataacctttttctggtccgaaagaat

SEQ ID NO: 15553 - DNA, 3858 bp, Heterodera glycines
  misc_feature (3621)..(3621): n is a, c, g, or t
agtgccgacagaaggatcttcaactcggcaactttttccgggtcggtggcgacattgacaacgcgtttgatgatctgagaagggcatggaaaggcaatgtccgcttttggccttcccccaccaattggcactcgtcgcacgcgtcttcccaatggacagtctttggcgttttgttcagatttgagaacgcaaaagcagtggcggacagcagaacgagaaacacaaaagggcaaaagagcttcatttgcagaattattagctaaatacgatggaccgaccgattggcaaagaatgaaatgagaaaacaaaaacagtgggaaatggaaaaatgagaaaggacggaggaaaagagaacggagagaggagaaaggagcatccagaaggaggaggaggaggaggaggaggaggagggcatcgatttgcaatgagaagtgatgatgaaaagtgatgaccctttctctctctttctgttcgattcgccctatggcaatgatggccaaagggaggggggggggagataaacgacacgaagcggagaaagagcacgacgaaagataaagcgaatcgatggaccaaaaaacggaggggggggggaggaaaggggcgacaagcaaagcgatttttaatttatcatgtgatgatatgatactctatgaacttatgcaaaaaaaaagataatggacacacgaagaaaaattggatgacactgataaaatgataacttttcaatgagttaaacgaattgattagaattcggacattaagccattctccgctggccaacccatccaaaagcaccactttttgtcaaatggtgccaaagaaaaagcattccgtttatttatcgcatgttttgaaatggaccatttgcttgctgatcagtcaatccgatcactctttgatcgtttcttccttcctcccttcttcagaatctgaacatcgcgtgccctccgccggccgcgggcccttcggcgtttccgttggcattgccctggggggcgaacccggcctcgcgtttgccgtagtacgggtagtagtagccccacttaagggaaaagacatgtcacgcacagtgttcttcaaacagagcttttattttacctgtgccgtggcttgttcgacgagtaaagcgaccgtaagaaggacgaagaggagaacaaaactagacggggtatggtacttacaaagcagaagagatacggtaggggatcgaagtggaagagatacagtatgagacagaagcagaggatatgagatccggtagaaatagaagcagaaaagatacggtaggagtgagaagcaaaagggatatggtaggagatagaagtagaggatatgagatggtatgaaatagaagcaaaaaagttcggtaggagtgagaagcaaaagggatatggtaggagatagaagtagaggatatgagatacggtagaagataaaagcgtaaaagatacggtaggagtgagaagcaaaagggatatggtaggagatagaagtagagaatatgagatacggtagaagataaaagcataaaatatacggtaggagtgagaagcaaaagggatatggtaggagatagaagtagaagatatgagatacggtagaagataaaagcgtaaaatatacggtaggagtgagaagcaaaagggatatggtaggagatagaagtagaagatattgagatacggtagaagacaaaagcggaagagagaaaatgcggtaaacacaatattgaaaacagctgttggatgcacaaatgaccaaaaagcttacatttttgcggaggttgccatttttgacgagaatgaactgagaagtgagtgaatgagtggcgggagaaaaggcgaatgaatgagtggtgggtgagaaggcccattggcagtccttttatattcgccgtttttggcgcaatgtttgccattcgaaggccgcgcgactttctcggaatttcgcttcttttcagtgatccgtccgccgttcttttgacaccgccgattcttttgtcaatttgtggtaaataaaacgaaaactaaaagcacaacaaaagaaagtgaaacgataaacatttattttttgttgataaaaacggagaaatttgtgaaaatcgaaaagagaaaataaattgaggaaaacagtcaaagaatgccaactcacaacaatcaacgggaaaagtgatttgtttacgttagaaatttaaatgcacattctgtgacaattgaaagttgaaagtttaaaataaattgttaaattgggattaataaaatgcaacttttggaatgaccgacacaaaaatcacgggcaatttgtcaaattgggcaattgtcttagcgcacaaatgcccccacccccgtcgaatttcgtgttcggttttgtttctgtctttgctttgtccgaaaaatgttaaacccttcccaaatttgcgaatgtttgccatggtctgtcacttctcttcggttgcttttcgctgctttctttcccttcgctttcgcttctctcttttctctgccggtgtttcccctgggactgattttcgctttcttcgctttccccccccccctcccccctctttttttgcccctttcatttgccattccctccgccgtctttccgttttaccaaaaagggcacttcgttttgttatttcatttttattaaaatattttcactgtctgagattggctaattactcaaaatgccatcgaaactcatttttttcaccctccactcaatcgcatcaattgaataaaaatggaaaactttgaattatttttggagaaatcgcacactcaacgcgattattactcggccggagaagaaataaaagtgagaaaatggaaaggcaccaggaaaaaaaaagagagaaatattttggtaatgaaattttaaaattattggaaacttttgaattatttttggtaattgttttacacagcggcccaattttgggctccaagtacaattatgctggatttttcgtcttagtggtctgtgagttagtcaccaaaaggggggtcccaggttcaagtcctccctatgttgtgtgttaatttcaatttcttcttttaaagaaggcaaaattattttttcattaataaaagttttcgtgtcaataaaaaatcatattcgaaaagcgttggttacgtacaacatcgacaattttatgaatttttttagcttataacttggtgaatactagagcaaataaaaccattttatgctcattttgaagggaaaattctggagaatattgtaaatttatttggtttggccttaaattgtggacttggctaaaaaagaattaaaattattgaaatgtttgccctgggaaaaaattttttaattttgtataggcccatattttgtccccctctatcgaatcacagtttattttttagccgtctagtttttaactcgagatcggctcttctatttttacaagggaaaatccccaaaaaatttttaagttttgcaaagttttggcgttctgattactaaataaataataaacctatttgcactgagagcacaaaattgggccgctgtgtataatattcgatacattttggatcgaataaattgtaaaaaacaagtgatttgtagcaattttgcaaaatgtcccgnattttcggtcccaaaatctgattttttgggcccatgtcctggtcttgaaaatttttcgatagaaaccctgctttaaacggagattctgctgaaacacaaggaaaagtgaaacgaattttttccatatgtgttgtgcataatacttccactaacacattatttcaatttttgtttattcgtacacaaaataaagtgagttcgaacttcccacaacatgattgtttggttaccatcatc

SEQ ID NO: 15554 - DNA, 1747 bp, Heterodera glycines
ccatgtcccccgttgttgttctcctcccgctcctcctttattccgtcattattattattatcattttgatgaataatttgtttcgatcggccaaatttgttggccccaatttggggaccaccaccaccgcttttttggtacaacaaatcggcctcaaatggtgtcgctgtccaccggttgacgcgtctgatcagcttgtgcaaactgttgtacagggtggacctgggaacaatgaacaaattaattttcaaccaaaaaaaaatcgttcaagtatttctcgaaaaatatttttagaaaattttttgatttttttaaaaattttgaaaataattcaaaatatgtcaataagagggagtatatcaaatccccatcgaaattttctcaaattcgttaaactgaccaaacaaattcctctttcgttagaaaaatttaaaaaaaaactaatcattttcagtggaaaattgaaacgatgcaaaccgaaatgggataaaaaaaacgccaatttttaccggtcaaatttgtagccacagtaatgcaaaatttcggcgaacaaattgtcgagcagcgaatttggcgggcatactgaaacggacggacaaatgttggaaaaatttgaaatttaataatattcagtaatttgctattttttgatttatgtaaaaaaaagaatatttcaaatgtagatttgtttacctattttattaatataaggagccttatgtacccactggtataacttttacatgtatttgttgactctcggaaattaaaatttttttacctattacgcaaaaaaactaaatttttcaaaaatgcattccgccaaaaaaccttttgctctgttggagggtgaagctgttgcagtgcctgggcgagatcgtcaaagctgaacgggctgagctcgaacagtgggccaaattggtgcacaaatgccaccgtttcggcaaaatcgggcaaactttggaaggcggtgccgtcgtcgccggcatcgtgcccattgccattggtggcggtgcaacacttaaaaaatggggcacatttatgttttgccggcttgaaaaatgccatcatgaattaaataaagaaattctgtgaggctgtgaaaattctgaaatagatttgaccagcgagaacgttggtccagtggttaaattttgttttctggagtcaaggttcgaagttcaaacccattagactgcaaaatttttttttttaaatttcggcgtgaatggacttggaacagattggcaaaacacccaaaattgaaccgtcaggtttcaagtgccgttccctgttgtttggaaatccgaaaacttttgagagccaaaaaagtgaaaaataaaaaagattccagcaagaaatacggtaaaattatgctatttttagggctaaaagcaaactaaaaactcaatttaaaaaaaatgaaagcaatgatggggtgaaagaattgtgcctcccgacggaaaaaaaatagtaaaaatttcaaaaagcattttttcgtaaaaaactcatatacagatgttatagagctttaaaagttttcgaatgagctattgaatgtatggaaaagtcaagttttaattttttacgattttttgaaatttaataattcatccgttaatgggtcatatgagatggggtgtgggttcgagcccgattggctgcggtttatttttttatgtcgattgttgaaaaatcatagataaaatgatggattttgcaaaatctgacttcagattcatgatca

SEQ ID NO: 15555 - DNA, 1361 bp, Heterodera glycines
  misc_feature (18)..(18): n is a, c, g, or t
gattcagtaaaaaaaacntccatggccctcaggcgttttaagcaaaaaaaaaaaaaaaaattggtaaatatacctttatctctgataaaaatttgatttaaaatgacaaaaataacaaccttatccttcaaacattcgtcgagttcctgttccgccgcttgagaagtcatttgagaaattaattaacccgttttctttaaaaaaataataatttaatcgctgaggaatgattaggaaaattggttcacaaaagcataaagatagccgctaaaaatgaagaaaagatttcgacgatgatgtcaattttgttttggttccacttaattacctagctgtgaaaaatttttagggctaacggcaaaaaaaaatttactccaaaatttggattgaatttttatggcataatgttttttgccaaattttaaattttcatactgttaaagctgtacaaagagacaaaagattttgccaatttctcttatgtatgtctttccctcaccaaaaaaggcatttttcatttcatctaattgattgttgttttggagtgtttcttcgctttcgtgtcttcaaatattttttgttaaaaatgatgaacattcggtccaacggcaaaattcggtttgctgtcagttgctcgtcaaacatgaaccgcagcatggaggcacactttttcttgcagtgagaaaatttaaaagaagaaaaagcaaattttgaattcttggaaaactattcaaaattgggaagtgttttttgattggtttagcccctgaatttcggcataaaataatgaaaaaaacaagttaattgtaagtcgaagaaataaaaaaatgggattttatttggcctagatctgttttctggacaaaaatacagggaagtccaggtggccaaatattgcctggaataatatgttgatggtaccaatctgtttttttaagccaaaaaagtatttattggttttgggtcgctgggatcgaaaagatcattcgcaatttgtttaagttttgggccgggattgaaaattggctattcaaaaaaaaaaaaaaaattcatacctaaacctggtttgagccaaggaaaatccaagcctgggtccagctcctccacaagtcctccttcctcaaaagtaaactatcgtcctaactttgttgattaaaaaaataaaaatgaattctgcgaacccagaaatgggaaaataccctaatttcggtatcaaaatcaaagtcctgctcttcaaaaaatttgcgacaaatttctatatttaatttataaattttattaaatttcaattttatgtgcatattttctgtaccccccccccccctcccccattagaaacgtggcttcacgtgcaaagcttt

SEQ ID NO: 15556 - DNA, 841 bp, Heterodera glycines
gaaaaaatggaaaattttttctttaggggggtggagggggggggggggggtggaaaaattggaaatcccttttttagcaagtatttcccataaaatgtatttatttttcgcaatttttttggcactttacagagggctggctttctcttattatggcactttagacgtccaagcgatttttaggcattcaatcaatgaccgtcctcagtttcttaggccataacttttttttgcttgatcaaggcctacatttttggtatcaaacgaaagcctaaagtcttggaaatttagaaatataagaaaagagcaaatactgacattaagaaaaaaaattacaaagaggaaacaagaaatcccgcctttttcaagtataattaagaataattttttgtttattgccttaagccccaaatttacttttaaataaaaacttctctagacttcaagcttttgtttgataccaagaatgttggcattgactaagtaagaaaaaaaagaattatgctctaggaaactaaagaggggacgggacaaaatctcgcctcagaaatttcaaaaaatttttttttaaattttcttataaaaaattttctaagaattttttccttgaaaaatttctaagtttgaaaaaaaaatttttgaaattttgggcggcgagattttggggtgtacccactaaagatggtcactgattggaagcctataaccaaagggggcagaggaggtcccaatttgtttgccaaaaaaaaaaatttttttttttcaaatttatcaacgaaaaatcacaaatgtctaaaaaatacttgttgaaaaaaagcatttggacccctctctaacgaaa

SEQ ID NO: 15557 - DNA, 1753 bp, Heterodera glycines
  misc_feature (1645)..(1645): n is a, c, g, or t
  misc_feature (1720)..(1720): n is a, c, g, or t
ttttccacttttttggctagaactttttttaaaactgtctaaattttttggaattttgcaggctaatagagcatctgaaggggtctcgaatgatataaagaaagttggatttggatagcaaataaaaaagttatagtggaaaaatgtgcgctcgtactaaaacggcccgtactaaactgacccggtccgcaaaaatgggtagagccaataacttagttggaagctaaaattggggctaacatgtgatattgtattgacaaaatgcaaatgttattattcagattaagcaaactaaaaagttcaaaaatcatggtaaatatagaagtaaactaataaaattttattaatcaataaaaaaaaataaaaccctaattgacaaagtttagtataatattattttcattaaaaagaaaaaaacgcattcagaaaaaatttttcaaatccttaagcaggaactacgcaacaagaagattcactgataatatttaaataaaaaacaaaaaaatattgtatattttacaaagataaaaaatccaatgcaacttgaaaggcttatcactgaaattgcggcgtgaattaccccccaaaaaaagtctagatagataaaaaaaatgaaaaaattaatggatatgcaatctaaataaaattgctttcaaaaatgaaatgaaatgcggcgaaattaaaactataattaaacaaacgaaaaaagagagtcataaaatattctttattttgttattattaaaaatgtcaaaatttttattttttattaaggaaaaaatagaaaataaaagcgaagaaaaaactaaaaataaaacttgaaagaaatctttaattttaatttattatataagcgataagcgataaataatcaaagaaattataatcttaattctccaaatataattttattaaaaaaactaatgaatgatagtgattatcaatatgcgaaataaaaaaattctattatttttaattacctaataaaacactatcatataaagtaataaattatagaaaatagaaataagctggtttagtatacactgaatatatatatgtaatacaattatcaaaacatgaacataaattatcggaagaaaaattttatcgatattctaccaattgacttaattactaattcataatcaagaaaataattgaaaatgtaaaatggaatgctatttattgtaaatttaattttgtaaaattatttttggcagtcaaaccacatctcaaaaaagggatattgattattccttcacctataatccctaattctaagtaatctccatattttcgaagcagacttataattgggacaaatcatgccaaaaaataaaaataaatttttataaaaattaataaaattgcaataacaaaaatgcgtaaaatttgcacatatggattaaagaaaataaagaagaaaatgacaaaagcggttttaaaatatctatataaaacatatattcgattttaaataaataaacccgaaaaaagtaaaaaaaaaattgaatataaataagcaaaaataaataaaaatttaaaattgtataattaaaaacgcattttccgcttggtttgagccttctacgctgactttattatgcctttttttgcctttttcgggattttcgtgccttanatgctttttttggcattttgccgttttggtgccttttttggagttttttcccgaaaaatccataaaaatgcaatnaatcgggaaatacacccctagaaatgaaaattt

SEQ ID NO: 15558 - DNA, 2554 bp, Heterodera glycines
  misc_feature (2528)..(2528): n is a, c, g, or t
attccatattttagaaattaatttaaaaattaatatttcgccgtcaacggcattggtgcctaaaacaataaatggaatggcggaatgagtaaacttccatcgttaaataaataaatttacaataaatattttccaaaacacaaataaaaattaaaagacaattaaattcttgaataaaaccaaattattatttattggatcttttttaataaaaaacataagtcatttaaaaatagataattacatagtttataaaatttggaaataagtaattaaaatatgttggtgctttaaaattttatcatgaaactttaaataaataaagtgacgaaccaatcaatgtaagccatcaataaaacattaaaagacacacatgaaaaggacaaatcgaaattttgttgtaatacgagacaaaaaagacgactttaatcgaacattcaattccaagaaattaacattaacagtaaacataagtgtttaatcttacatataaaagccaaaactatatgaataatttaagcttttaaaatcaaatatgaccgaattccataaaattattagccaaaatactcacaaaatttctatataatatgtagacaaaagtctcttttaaattaaagaccgaacttttgagaatttgggattgggatcatgcagtcttaaaagtgaaaaagtcaacgctaatgatgggttcatttttaagactcgaaaaaatgataaaacctaaaaacaaagccaataaagaagttagataaattaaaaaaatataatgtgattatctggaaatacgaagaagcactcgctgctttaaagtttaaacaattatgtttaaccaatcttcttgaaaaaaatctatattatatttaccctttttatatacagggtaacaaataaaacttcctataatttaattactaaatatagtcaaattttaaaaataattataaatatatgataacaaaaaaatgaaatctactaattcgaaaaaacttaaacaaattaaaaagtttaaaaatgaatttgtgataagaatatgctcaaaaatattatatattacataaaaattaaattcacaaagattaacatattcaacatgtaaaatctcaataaatatttatccggatgaaatggtaaactcccatgaatttctaagtcgaacaaaaattccaatggagagtgtctttcttgtcttccaagggaaaagtgaaataaagtcactttgggtacaattatttattgtgaggcacagagacggaacatgattataagcgatcatcgatcactttgtgttatctttttcccgcccctttcgcttcctttttcccgttcccccgttctcgaaaaagtcagttgagtggggataggcagtcgagagcgatggagcgagatgggctttttgcgattggatttcaactgtttttatcggctaataaatgatgttgtgttttactctttctcagcatttttccatgcgcattcaatcagtcgcgcgaaccggggatcccaatttggggaggtcattaatccagggcccggatcattggctcattcaccctttcccccgaatacgaattccccttttcctctcattctcgttcgtcagctgggttaggacatcagcaccttcactggtagcaccggaggtttgctggcacgccgctggctgtccatccctcccggagaatgagatggagatacgcgtggagaaagaagagaatggaatgaggtgcgcaccgctctctcgggagtcttgtcaaggaccggtccacatttgaatggccaaaacactttcttgaaaagccaaattgcagcccaaattattttcgttatttcatcaaatgccgccactcgctcacatggtcaaattaatgacgaacatttaagggagggcattcgagccatcaaaccataattttgtttattttcgcagatcaattaattttgtttgacatcatatttgagggctaagattcttatgtaaaaacatcatttaattatatatatatatatatatatttcctctttttctctttttcttcctctttctctcgttagaacgatttaacagcttagtacttctgcataaaagtcttagccctaattacgcaaatttttttttctttggggatgaaattttccctatacaaaagaattttttttttctctttctcagcgctctcgccgattcaccggaagtacattacagctgccgcctgagaatcagagcccatcggccgagaattgcgataaacacgtatcatgtgaatactacgccgctgtcaacagttctcataatcgctcgagtaatcgtagattaaatgtcgtagaattactgttaatttataaggagatgccccgcaaaatataagcatttattttccctttgtttatgggcactcactttcagaaaattcaatattttcaattttaaccgcactatttaattaaattttttttagctcataaaatcggaaccaaattttaatattcctcgactcatttcacactttcatcccggtacactactnaaattttggatttgcattgtgtcggc

SEQ ID NO: 15559 - DNA, 3034 bp, Heterodera glycines
aaaaaggaaaaaatttaaaatttttcaatttaattttcccaataaattgtagacaaaattttcttaaaaggggttaaggtacaataattaacaactttttaaatattcataacaaagtggctttgaactttttgtcgtcgagcatttgagttggggttagtgcccagcacatccacgggtggcaagctgtgctccatttcaaagcatttgcttcaaatagggaaataatttttatagaacaattatatcttgacaaaaaataattatcgttataatctttggttaatcccccgaactattacttaaatcactccactaccatacattagggattgcgaagcgcttgcggactgttcaagaaatcagacttcccgaaaagcattcactgcgaaggcttccagttttcctcgcggtgttcagtagtttaatactccaattcaccgcttcacctagtgattaccaatgcctcgcattccttggccacgtggactgatgtggcggtatagccttcaatataaggcgttaaattttaaacaaagttttccattttcaataacttctgttttcaatgcaacgctttttactgattgcctttatcatcggcttttgttcggcaacggactgggaattggtcgacaatcagcgatgctcgacgaattgtacctcgtcgtttacatgtttcaaattggtcggctatgtagggccatttatatgccttaaaaaaggctacattctcaatcgggcagagatgtggcccgattggccagagacgggagttggaaaaaataggtcttaaattctatatatataatttattttcccctaggtctaattcattttaaaatctaaattaatgtcaatttattattattatgtatcaatttgtagtgatggcttttggcgctgggcattatctggagcggccgttgtttccattatttggcttggaattttgactgctctaatggtcgccggtaagaaaagtttatatatttctttataatgaaggggtaaaatttttgaaatctaaaattatttttttcaagccctattgttaattttccttcaagtttttaattaaccaattattttgaaaattttctaaacaggaattaaattgtccattgggccaaaactgttttcaaatttgccataaagtttcagggaaaatttaggaagcgcatggccaaacattttcaaaatattcaaaaatatttctcttcctattactcaaaaagacaatgaaaaaatagtgtattttatgctcaatacatgacaaatttgatgaaatagtgccgacaatcagttttgactattgttttttgacccaaaagctttttttacagtttctgtttctatttgaaaatgtcagattggagtcctcataaatttgaacctaaggataattaaatatttttaagcgttcataagaatgaagaccatcgctaccgcgaggaccgtcgatcgaatcccaatgccgacgttttaattgatcgggaaatcaatggccaaatgcttttttgaaaattacaatttaaacacataaaaacgaatattttcaaaaaaatggtaatttaaaaaattaaaaaattcaatgaattaagcaccaaattttatttatcccttaacaaatatttgcgtattaattcgtatttcatatctattgataaaacgcaagcaaaattaaaaaataattgcattaaactaaaataatatcaccaattaaagaccatcacatttgtagtgcatcgctacattaaagtagctgcataatccggcgagattggcacgtagttgtgctcccaagctgcacttgtggatggcacttttgggtcaggatcaggcgaagaccaaacattttcttgtggtcccaagatcgctgaaaaataagtgattaaaatcaaaatttaaaaaaaaaactaaatttaattgacctatagccgcggtgtattcctcaaccacttttgcccgctccgatctatactgcttccataatgctccaatctttagacgtaatgcttttttaaggaaagcactttgttttttgcgtttttgctcctattaattcaatgttaattatttatggaaaatggcaaaaaaaacctccaattttggtgcgaaaaaccctttttccattacggaagaattattttgttgggtaataaaatctgaaatactatttatttagaaggtttggaaatcgggaaggtaacctaaggggttaaagggtgcatcatcaaatatattaggatggggagttgaagcctttcgacgattcccggcgtttccgttaagggcatcataaagccgactgtaaagccgtgccgtttttacaggcaatacagctccaatccggtcaaaggatgaacaacgttgccgtaaaaacggcacacttttaaaagaaggagacaggcttttggccaaccgatgatatggaggcatttgttggatgcgctattggaataggcacgctttatataagcactcccccctacctctcccccttattccagtctttttttggcaccgacaacaattattcaggcccaaaattataataaagcaggttttttgcattttcagctgtttttgagggattagcaacctataagcaacttattatctattacctcggccacttttgttgcatttcagccgttttacggatgaataattttgcatttcgcccattttagggattaacaactttgttcactcatttttggattaaatatttttcgtttcacccatttttagggattaacgcaaccgtaagcagacaacacaattttccttttcatttctggtatatacatagccatcatttactgattaattaaacataaccatcaagaaatatcggtaaatattttctttatgatagtaatttcctaatcttttttttgtttggccaagaatatatgttaaggacaagtataaaaggggtacttggtcccccctccctctcattcattttttcggtcttctttctgccatattttcaagcctatggacatttttgcatattttaatg

SEQ ID NO: 15560 - DNA, 1332 bp, Heterodera glycines
  misc_feature (1271)..(1272): n is a, c, g, or t
tgcactacaaccccgaatggtccaagggcaaaaaagaggacgataatcctcggcgaaattcgcctctcagaatcaacgaagcttttctgttactacttgcttcgtttaattatgcaggtttcgccattaggctattcgctcgcgatacaattagccctatagaatcttggagcaaaaactagtaatattttatcctttagaaagcatgcaaaatagtttgttatagacttgtgcaacaactatgaaataattcgctgaaattagtgttctttcgacaatatgaaattaatttcgtttattttagaaccttaggttctgatgaattaggtaaaattaagttctaatttattattaaaattattaataagggtcaaaaagcaattaacaggtggtaaatcgcaattgtttctttctgcactacaaccccgaatggtccaagggcaaaaaagaggacgataatccttggcgaaattcgcctctcagaatcaacgaagcttttctgttactacttgcttcgtttaattatgcaggtttcgccattaggctattcgctcgcgatacaattagccctatagaatcttggagcaaaaactagtaatattttatcctttagaaagcatgcaaaatagtttgttatagacttgtgcaacaactatgaaataattcgctgaaattagtgtcctttcgacaatatgaaattaatttcgtttattttagaaccttaggttctgatgaattaggtaaaattaagttctaatttattattaaaattattaataagggtcaaaaagcaattaacaggtggtaaatcgcaattgtttctttctgcactacaaccccgaatggtccaagggcaaaaaagaggacgataatccttggcgaaattcgcctctcagaatcaacgaagcttttctgttactacttgcttcgtttaattatgcaggtttcgccattaggctattcgctcgcgatacaattagccctatagaatcttggagcaaaaactagtaatattttatcctttagaaagcatgcaaaatagtttgttatagacttgtgcaacaactatgaaataattcgctgaaattaatgtcctttcgacaatataaaattaatttcgtttattttagaaccttaggttctgatgaattaggtaaaattaagttctaatttattattaaaattatgaataagggtcaaaaagcaattaacaagtggtaaatcgcaattgtttctttctgcactacaaccccgaatggtccaagggcaannaaagagacgataatcctttggcgaatcgcctctcagaatcacgaaagctttctggtacta

SEQ ID NO: 15561 - DNA, 1130 bp, Heterodera glycines
  misc_feature (19)..(20): n is a, c, g, or t
  misc_feature (36)..(36): n is a, c, g, or t
  misc_feature (59)..(60): n is a, c, g, or t
  misc_feature (70)..(70): n is a, c, g, or t
  misc_feature (152)..(152): n is a, c, g, or t
agggtcaaaaagcaattanncaagtggtaaatcgcnaatgtttctttctgcactacacnnccgaatggtncagggcaaaaaagaggacgatatccttggcgaaattcgcctctcagaatcaacgaagcttttctgttactacttgcttcgtntaattatgcaggtttcgccattaggctattcgctcgcgatacaattagccctatagaatcttggagcaaaaactagtaatattttatcctttagaaagcatgcaaaatagtttgttatagacttgtgcaacaactatgaaataattcgctgaaattagtgtcctttcgacaatatgaaattaatttcgtttaggtaaaattaagttctaatttattattaaaattattaataagggtcaaaaagcaattaacaggtggtaaatcgcaaattgtttctttctgcactacaaccccgtatggtccaagggcaaaaaagaggactataatctttggcaaaattcgcctctcagaatcaacgaagcttttctgttactacttgcttcgtttaattatgcaggtttcgccattaggctattcgctcgcgatacaattagtcctatagaatcttggagcaaaaactagtaatattttatcctttagaaagcatgcaaaatagtttgttatagacttgtgcaacaactatgaaataattcgctgaaattagtgtcctttcgacaatatgaaattaatttcgtttattttaggaccttaggttctgatgaattaggtaaaattaagttctaatttattattaaaattattaataagggtcaaaaagcaattaacaggtggtaaatcgcaaattgtttctttctgcactacaaccccgtatggtccaagggcaaaaaagaggacgataatccttggcgagattcgcctctcagaatcaacgaagcttttctgttactacttgcttcgtttaattatgcaggtttcgccattaggctattcgcttgcgatacaattagccctatagaatcttggagcaaaaactagtaatattttatcctttagaaagcatgcaaaatagtttgttatagacttgtgcaacaactatgaaatgattcgctgaaattagtgttctttcgacaatagaaa

SEQ ID NO: 15562 - DNA, 2987 bp, Heterodera glycines
aggtgctcccttttttcgtttaattttttcgcattgcttcccttgcggattcggttttcagaagttgaatgacctgtttctccagtacatcgactactttttggatgcggacattgcacgtaaatgctccattcgtgagtggtggtccgttttcccctcccccaatttttagctgattttggaattttcaaaggtattcatgtgccgcgcagctgggcataaatccgaaagtctacccggacattgagctgttcaatgtgcccaatgaggtgattgatgatgcagggacaggccatcccaggatcttcggaatgctagatgcaattcaattttaaaaatcccaaatttttaaaactttttgggaggggttgaggactttccctcctccttgggctgtcctgtccctctgctggcgatggcatggcacttttctctttacgcaatccgttaattttttgatcccaactctgctcctcatggtgttgctcaattcctgctcattcaaaccgccgacgcggcgaaggtccgaccgactgaaagagggcgtcgacaaacagtcgttggcgtcgtcgaagccggcaaagcccagcaaaagggcaaagaattggccacacgcttttttcatccgcgacttggccatttgtgagtttcttttcgggatattgcgtcttcgaatttcgaaaaatctaattgctattcatagctcggcttcaccgaacaattttgacccggttttttggttttttatagattcccagaaaaatttcaataattgtgaaaaaaacatacctttttaaactgatttcgaaatttgacagagttatgataaaacttagggcgacactatttttttgggttgccgtgtttcatttgctccaattttaattttcgctttgccactttagcgcatttgtcgccgcatgggttcgaaggtgagaagacggggctgtgcaaaatgctgtgtgtccacgagcagctgctccaatatttcgacttgcacgagttcgaatgtcttcattttccgacctatgagttgcctttgaaggtgggcgctatttacttttccattttttttgcctccaatttgacgcaatccctctgaaaacccgaaatgccttttgccttcgtccgcttttccataagttgtttctgtccgtttcagctccctcccaggccttggctggacacgggccactgcggccccgcgtacacttacgcccagaatgttgtgcgcaaattggagccctacccggacatggaccccacagaaatgatgcgtctccgtgtcggtgaccgccactcgcgggcgcggccggtgttcgacgcgctcaatttgctcggggcaacgccgtggatcatcaacaaagtgagtgtttctgtgttatgtctttgcttcatgactacaacacatttgttttcattgtttcgcccgaccacaaataaaattttgaaaaatcgctaaaaattacaaattttttaatttataaaaaattccaatgtttttaaaaaacacaattttttaaatttttcagggggagtaataaaacttgttaaggatgtgatcactttttcccgcaggaaatgctctgtcacatgcgccgtacgttggaaatgtcttacgacggtcggcacagagaatacctccgcccgttggctgtgccggtccatccggccacgttcgacgtgccgtacaaaccgaaggacgcgtgggaacgcggggtgctgacggaggcggcgtgggacggagtgattgtggacgaacgggcggacgagcgacagaaccgccagatggtgttggaactgttgaaggagagcccattttggaacagtggcaaatggaggcggaaacggaagaagaagaaaagcgaggaaaatgccgaagaaccaacgacgacggaaaggggggagacgaagttggacgggacgaacggaggacggggggactcaaaatgggacagattaagcggaaaaacaaatgccaaaattgaaaataacgggggatgattttattttgctttgattttatttgtcgaacactctgccaaattggttcatttgtttggcactcttttctgccaaattggttcatttgtttggcactcttttctcgatcgctttaatttttgattttgcatttttttcctatttttgtttaattttgcacattcactatcattactttttcttcagtctcctctctcttcccgccgaacgcgctgaacttgaaaggcttccgccgtctctgacggatgaccagggctatctgatcgcgaggcgtttcctgaagaaagtgaacgccattttcagggacaagtaaggcattattgataatttacaatttttatttcccattacacagtattgcgagtactgtagtgtacttgtacagtaccccatttcaatttcatccgcacttttcagatgtgaacagaactcgctgcactgttggttggtctatcggctgactttggcacaacattttgccaactccgttctctactttccgcataacatcgatttccgtggccgtgcctacccaatctctccgcagatcaaccacatgggagacgacctcaaccggggccttctcaaatttgccgcaggcaaaaaatcctcactgatttatggcccctgaaaggcgttgcaatggcaaaaaaaaactctctcaggcaaacccttgggcgagcggggcttggaatggctgaaactgcactgcgtcaacatcaccgggcgcaaaaagcgcagctctctgagggagcggctgaaattcgccgaggaaaacctttcccttttgacttcggtggccaacgacccattcgaccgtaacggaagaaaacaatattaattaattaatcatccgccgttttagccaaatttgccttttggtggcgcgactcggaagagccgtggcaaacgttggccgcgtgcatcgaactgcgagacgcactcagccgcgaccgacccgaagactttgtcagccatttgcc

SEQ ID NO: 15563 - DNA, 2738 bp, Heterodera glycines
tttccaaaaagtcattcttaagggtgtaaatattttcgtcttttttgaaaatattgctctgacgaaaacgaaaacgaaacgaaaatcctaaattttaaaaaccgaaaacgaaacacgaaacgaaaaataaaattttgaaaaccgaaaccgaaaacgaaacgaaaaaactttagcggacgaaaacgaaactcaaaaagtgccgaaaatgtaggacgaaacgaaaacgacacgaaatttcgtccagccctgactgcaatagagcccaaaaaatttaggggatggttaatggttggactcatagaatgccattggacccttaaaaattgaatgtgcttaaagttcaattaaatcatcgttttttagtcttctcgacgacgcttttcccgagccgagtggtcagcaacaataaatgaatgaattaattaattggttgattgctgtgattatgtcacccaaatgatgttggcattttgccatttcaatattatgtgtaatttgtttgtatatgtacctatttgacctttgcttgccgcaaaattcgtccatttccattgtatttgatgtgcatgtgtaaaatgcattgtgataatgataatcattgttaaaattttcggtcgactcttagtggtgtttttttgaaaattttggggtcgattcttagggggtgtattttttggttttattgcatttttgttaaggaattttccaaaaaatgtcgaaatagtgaaaaaatagtggcaaaaacgccaaaatagtgatttctagtgaccgataatgacatcagaatcgaacatttttaatgcagaaatgcgtttttgagctcctctcttcaaaacaattgagcaaaaaaaaaaagaagttaaaacctaaaaattgcatccctagtgattaaatgggtttgatttctgagttttacaacaataaaaaaagcaggatgttcacaaattgtgttccttctattgggcttaatgcagggcttcgctttccaagcacgggtatactgattcctttttaaacattggacggatgcgggtcaaaatttttgagccggataagttgtgaaaaaaggatttgtttaatcccgaaaatcgttccagttaaaattctcttatcctttccataattttttaactcattttttaatttaacacagggctcccaagttttttttttcaaattcaggacaaaaaacattaaaattcagatttagaccccaaaattcaggtttttttaaaatatgtagtagcgttaagaaaacgcattaaaaacataaaaaaacttaaaaattttttgcttaaaggttattttttggaaaaaattcctcgtaaatggtgaaataggcacaaaatgttataaaaaatacccaaataggcttagaatcatatttagtatttaaaaattaatttttgatatatcatttttagaaaaaaaaatcgattttttagggatactttttcacaaagaattttaaatttttcacaaaaaatttctataaattctcaaaaagcatcaaaatatgtaaaaaaaaaaaaaaatgaaaatatgtacaaaaaattgcgaaatatgtatgaaaaagtccaaactatgtataaaaatatgtaaataagagtcccaacttcttttgttcgcaaacacaaaaaagaatcaactaaacatttggcaaacgttcagcgatttgagcagcaataaaggagcaaaccagactagagaccggcgcaggacaggatcctgcgcaggattttgcaggatcccagtccgcaatcctgcatattttggaaaatacaggatttacaggatttgcaggattaatcctgccggatcctgttctgtaaaaaattttgaattccaatcctgcaacaggacccgcaaatttgattttttgcaggattcagcaggatcctgcattgattttttgaaaatttttaaaaatagaatgccaaatattcagaaactttcttttttcaaaattttttttcttaataaaaatttttcgtttaaaaacttatccttattcgaaaaaagtttatactagagtgccacgggaccgggaatttttgccaaaaccgggaccgggacttgccgggacctgagaagccgggaccgggacctcgatttttttcgggaccgggaccgggaccgcaagaaaaaccgggaaccgggaccaaccgggaaattttaaaaattcaaaaaaattttaaaaattaaaaaaaaaattcaaattttaatttatatcaagtgaaaataatacaaaattatttggttttttatttaataaattaaattaatgaaaattttcaaacaaatattcttcaattatttcaaacaattaatcatttttggactaaatcatcgaatattaatagaaattcagatttgattttcacatcactttttttcggagcgctttttcaaaaaacttttgagaaagaaggggtccggcggtgcctataggcgccgccgggggaaattttaaaaatttgggtgcaatttgttaacagattttcaacaaaaaaaggttggtttttgcgattattaagctcaattggtaggattttcatttaaaaaatgataaaatatgtatcaatttaaaaaaaactatgaggaatcatattttctttataggaaacccacgagtatacaaaaaaaaaattgaaaataatctaatttctatagagggattgaaccagaggaaagaagaagggaaagtcaaggagactagccattaggccatttgcaca

SEQ ID NO: 15564 - DNA, 1205 bp, Heterodera glycines
  misc_feature (101)..(102): n is a, c, g, or t
cccgatgcttatccgttcccgcagagcttcttcaaaattttttccattacgcaaagagctgcgaaaatgtgaataattctcagaaaaatggctatctcttnntaggacaatattctatctcgtaaccccgatgctaatccgttccgcagagcctctccaaaattttttccattaccgcaagagctgcggaaatgtgaataattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaa

SEQ ID NO: 15565 - DNA, 3446 bp, Heterodera glycines
tgcttaccctagaatttttgatgcgccattaatccatttctaataatttgacaacatctgaaactgaaattggacattgagtctgaaacggaatgaattgctaactaagaaatttttgaagcgccttttttcatttccaacaatttgacaaaaactgaaactgaaataggataatgaaattactgatgtctgaaaggaatgaattgcttacaataagaaatttctgatgcgccattaattcatttccaacaatatgcaacacttgaagcgcctttaatccatttccgaggatatgcaaacaactgaaactgaaaaggaacagataattgtgggtgtccaaaaataaaacaattgattacaaaaaggaatttttgaagcgcctttattccatttccgacgatatgcaaacaactgaaactggaaaggaacagataaattgttggtgtccaaaaaaaaatcaattgcttacaaaaaggattttttgaagcgtccttaatccaatttcaataatatggcaaaataaaggactttacagcacctgtttcaaaacaaattcgcaaacaatttagtaaatgacaaaacattaataatttacaaagataattttgaatacgcaacagtaattaaaaattcgagaccacggcaatcaaagaacaagaaatcaccattaatagaaatacaaaacaattgaagaaaagagataacaaaaacatgaacaaaaaattaacaatattttggtccgaaaaaaggaacgccagaacgtcaataaataaattatgatttaaaacatatattccattcctttaaccaaagagcttttcttcaagatggtgcccactcattttgaagagcaaggcaattcttcaaaaaattagaataaaatccattgttcgatttatcaacttaccatcttcattcacaattatgttgagaagaaaattttgcattgggttctcatttctagctgaaattaaaaataaatacttgagtttaaatataatcggatttttaagtaccgaaaccgttttcctctgacaaaatggtgtacgcattgatgtaatcaacgtatttcaattggtctgcaggaatcagcaaaattgccttgcgctaaaatgaaagataaatttttggaaatagttattattatctgagctaaatttaagttgatcattaggtattaccccccttctttccagtagcaaattaagaaataatctgctcgcccggccatttccatcatcaaaaggatggattcggagctgcaaaaggggttttaaaaatatatttgttatttatattttaaaaaatatttttttttctgtctttgataatttctcaatttagttaaattatctcactatctcaagatgcgcacgaattgcaacttgaaagtattgataatcatctggcattggctgattgacttgttcaatgacatttttcatctctgatggcacgtcttgcggttgagatccccaatggtctccaaccgacacaaatcctgtgcgatagtcaccggagtcacttgttccagacaaggcaatactattaagctctttgattgtcttaaagaattaatataaaataataccagccaaaaaatgcagtttttgcacatttttaaaatttttgccatcaataaaacactaacccattaagaattcatgcctttaccttttcagttatcttttgagaataaaggtatccccgtgatcgcataattttcagaagatttgcatcatcagcaaacatcgatggggtgggtgtctgattggccatcctttcgatcttctccaacatgctctcattatcgcgagaaaatttatttgctggttccatcttaaaaaagcaaaaagcaacaataaaaagttattatttatttattcttaaagaaaataagccctctgaagggttaaccacttactctgacggctattcagaatattatgcgtcaaacagtcaattttcaaaggcaggaaactccaaataatgataagaattaatataatagtggctaaaaaattcattataattaaattaattttaaattaattgtattgtttaaataattcttttattggcatccaccggccactatatactttcttttactggcatccaccggccattggataattttctgttatttgcattcacctacatagacaattaggcttaataaattgactgacagtcaagaaaagttgggagtaaaggaataaattgattaatatgtttggaaaggtataggtaattgaattaatattgaaatgagtctgaaaatgataattaaaacatttccagcaataagcaaagacctgaaacttaaaaagggacgtaaaaatgcccgtgacaaaaaaggagttgcttactaaaaaataatttgtgaagcgcccttaaacatttccaacaataagtcacacttgtttgtacctggtaatctatttaaaaaaatttatgtgtgcatgtatatgtatgtggggggaatttgaaaattattgttttttaacccatcgaaaacttaacaattcgttaagtaaaaaaaaattttgaagccattttttggctttgtaaatcatcccacatagtatgccgcagcacttggcagatttttagaccaaggatggaagagtgtttaaaatttgtttttattgttttccttttttgaaaacgaatgtttttaaattgaattttttttcgtttttgaaaaaaatttttttttaatttttttgttgctcttccactccaaggtctgacaggttacgcttgggaagtgcgacgcaactgcgcagactgcccccagtgaaccggaaatttgccggtctgacctctaaggtcaactgtacgcacactatgtgggtaccaggtaccgctgtattgcttttgcaaaaaaaaaagcaaaaatttggttctcaacagcacacacgagaaccccgatcccgggtaagcacggcgatccttcagcgccgggccagaatgaccttagcccggcgctgggcgagacttacaacattctataaaagaaagtgctcgattaaagtcataaaaatggtgcctgatatatgcaattggctaaggaaaagagagatgggaagcaaacgacttgtcacttatcgcacactatttctcaggcgtacgataaattctctgcacgtaacacactatttttttgcagacgacaagagacaacaaagggaaaaggtaaaaattccacttttttcgagatttacaggggtataactttgttcgaattagttgtagagctacaaattttttttctcgcccttcgtctcgacgagctctacaaattgtttgcttaccgcaaaagcgtagcacttatggttcccgagaaataagagtaaaactgagttgttaccattcattttacaaaaatgtgagtaacaaaaaaaaatcataaacatttttcaaaatcaacatttttcaaa

SEQ ID NO: 15566 - DNA, 2270 bp, Heterodera glycines
  misc_feature (2117)..(2117): n is a, c, g, or t
  misc_feature (2191)..(2191): n is a, c, g, or t
ttgcagaattaattttttattattttttgtgatttttatcagaagcgccccaaactttgcagggatactgaaaggaaataattaacctgttttatcacattagcttgtcatcagtttttataaaaaattttcaaaattctgagtcttctattattttatttttttttcaaaattttgaagggcggggggggtattgcaatacctagaagcatgaactcaatgttgccaaactagatcggaggaagcctcgcaatcttctgaaaatagttgatttctacattttctagtatgtcatcgtaacaaatagaaatactgatgcattgtagacgcattcgatgccaaaattcagcccatctacgtgtgcagaatgtcaaccttcctttctgtaccatgtttttgtttcgaaaatatttccaattttgtttatgatgaaatagcaatttacaaaattatagaaatatattagcaccactacagtaccacaaaattctttcgtaaaacacccgatcaactgaaaagtctgatcgctagaatatgtagctttctgccatatgagagaaatatgaaataatggtaggagggatgttccaataacatgcttatgctgttactaaggctacttttagcggcacatctgtaatttgtgcaacccttattatcagtgagattaaacacaggattagagaaatgccaacctagcaaacgaagcatagcatagctgaagcccctgtggaaatcgctgttttgcaatttggattggtgacaacctttgtagatatttttatccgtttacactaatatagcctttcttggcaaattctaaatgctgtgggtattgcaatacctagaagcatgaactcaatgttgccaaactagatcggaggaagcctcgcaatcttctgaaaatagttgatttctacattttctagtatgtcatcgtaacaaatagaaatactgatgcattgtagacgcattcgatgccaaaattcagcccatctacgtgtgcagaaagtcaaccttcctttctgtaccatgtttttgtttcgaaaatatttccaattttgtttatgatgaaatagacaatttacaaaattatagaaatatattagcaccactacagtaccacaaaattctttcgtaaaacacccgatcaactgaaaagtctgatcgctagaatatgtagctttctgccatatgagagaaatatgaaataatggtaggagggatgttccaataacatgcttatgctgttactaaggctacttttagcggcacatctgtaatttgtgcaacccttattatcagtgagattaaacacaggattagagaaatgccaacctagcaaacgaagcatagcatagctgaagcccctgtggaaatcgctgttttgcaatttggattggtgacaacctttgtagatatttttatccgtttacactaatatagcctttcttggcaaattctaaatgctgtgggtattgcaatacctataagcatgaactcaatgttgccaaactagatcggaggaagcctcgcaatcttctgaaattagttgatttctacattttctagtatgtcatcgtaacaattagaaatactgatgcattgtagacgcattcgatgcaaaaattcagcccatctacgtgtgcagaaagtcaaccttcctttctgtaccatgtttttgtttcgaaatatttccaattttgtttatgatgaaatagacaatttacaaaattatagaaatatattagcaccactacagtaccacaaaattctttcgtaaaacacccgatcaactgaaaagtctgatcgctagaatatgtagctttctgccatatgagagaaatatgaaataatggtaggagggatgttccaataacatgcttatgctgttactaaggctacttttagcggcacatctgtaatttgtgcaacccttattatcagtgagattaaacacaggattagagaaatgccaacctagcaaacgaagcatagcatagctgaagcccctgtggaaatcgctgttttgcaatttggattggtgacaacctttgtagatatttttatccgtttacactaatatagcctttcttggcaaattctaaatgctgtgngtattgcaatacctataagcatgaactcaatgttgccaaactagatcggaggaagcctcgcaatcttctgaaanttagtgatttctacattttctagtatgtcatcgtaacatttagaatactgatgcattgtagacgcattcgatgcaaaaa

SEQ ID NO: 15567 - DNA, 3131 bp, Heterodera glycines
ttttattgaattctgagccgttttgagtagattagacttgaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggagtagtgtaaggtcaggtaactggggccatctgagcgccgggacatttcagtaccgcggctcagcgcggcccatttggagcgccttgttggcgctcaaaatggctacgctcaattcaccccctatctgtcgaccatttgtcctagaccatttgtcctattgtcgaccatttgtcccaaacatattatattgtcttttaattcatcagcgatctaggggatccgaactttgacaagtcatcccatcacactaaccattaggccatccagacaaacataatttattttattattttgtgctaaaattaattctagaaaaatcatcaatcaacaatgtgtgtgtgtgttcggtcacaaaaaaaattagggactgaatattttaaacaccccaataagttcttcacggcaaaaggggcaacgcccatcaattgaaacagtttcggcgcatcggttgcagagggcacgatgaccacatggaatgcatgcataatttctctaaaatatccaaaattagttttgcattaaacgctgacgacttttctggtatagcaaacggcgcaaagtgggtcgtcgtctttggaaccatccatatctcgtaattccaatatttcttctctcaaatctttcgtctcgttgaccagagttgcctttgtctctctcaacacacttatttctcttattaattgttccttttgttgtagcaattcgatttttttgttatggatttgtgttttcctatttttaagatgataaacatctcgttgcagttggtccttgtcgatttctaacccaatgatcatcgcttcaagccgtacaatttcgaaattagcaaatggttggtgggacattgattatttttccgtgctaaaaaaaaagaaaattatatgattaaatcggggagggataaaatgggtcaaatgtgtgcaacatctctatataaataaacaggaagttgcattaacatatgcataaaaatgtttattgcaccattcactctaattttgtcgggggccactggtagtggcaaaacgcaatggttgatgaaattgttgagaaattacaaggaactaatagacccgccgcctgcaaaaattctgtattgctattcagagatgaatgagtcggttcttgatctgatgaagcggggaattgagacgcacaacggtttgccggatcaagcgttgatccagagccagccgaaaccactgctcctcgtgcttgatgatttaatgttgaatgtgggagcgattttctggatctactgttcacacgtggttcacataactggaatgtcagcgttatttttgtcacccaaagcctatacgggcgtaacattagaacagcgcgagctaacagccattatttggtgctgacaaggaacccgtctggtcaactccaggtcagaacggttgggtcacaacttttcccaaaacgactcaattactttatggaggcgtacaatgaagcgactagtcaaccgttcagttacttggttataaacatgcacccaaatgctccggaaaatgagcggttgacaagcaaaatattccctggggagagccgtgaggtatatttacctgtagaataagcgtaatgaacgaaacaagtgcgcttaaaaactatttaaggaagggaaatttttttggttcgcaaaatgtacgagttcagtccgtccatacattcgcgcaaattctgatttcttcaaaaaattagcctcaacaaaatcggataaaaggaaaaacgatttgctgaaaggcgcatccgtagaacaaattctcggattggttgagatttgtgcaaatattttaaaatttaactttcgcctcaaccggcgacagaggagacgattggccgtgtacgcagactattaccgagcaattgcacgttcacgtagtgagcgcacagccaggcagaggctacaacagggcagcggaatagctttaggagctattttggcgccaattttgagcgttttggctgaacagctggtccagaaaattgttgcaactccatcggcacaacaacaacaaaatgaagcacactaaaaagatgctacttgtaccggagagtgaatatttggcgcttatcaacctgctgaaagggggcgcaggtggaacggactcacttcaagccgaaaaagcagcgatcgatgccagcatccaaaaaaatctaaatgacaataaaacgggtgcggacgtgaaaatgaagcgccactcgtggttgtacaaacagaggcatcagctcaaggacatgattgagaacaaaccacaaaaggtgattgtggaaaacgctacaggcacagcgccaaaaacattgccccgtatatgggcatacagaaaccaaacctcaacaagcttgaagaattgaacgggcaggatggcaaaaaaataaataaaaaaatagga

SEQ ID NO: 15568 - DNA, 1134 bp, Heterodera glycines
ccgaatttgccggcatgggcatgacggagatgaacgagagtgtgttcggcgtgcgcaccaagaagggcatgttccgcactgttgggcacatgcacaaggagcagttgacccgactgatgcaaacgttgcgcaacacgttcccccactttgtgcgttgcatcgtccccaaccacgagaagaagccgcgcaaaatccaatccatgctggtcagtttttcagttttattgcatgcgcagtgccgtaacatggtgcggagagagaccatttttatggcattgaataatgaatggtacatctatcaacaaatttgtaagggattgaaccgaactccggatttggtttgggatggggatattaggtagaatggaacaattttgcatttttttcgcacatttcgttttccctcatgttgtcccctgagtttttaaaacatatttactaattaatataaaccaagaaattttcatgaaacccgatttggatgaaaatcttggaaactaataatcgttgaaaaatcctaaattttgataaattatttctgccctactaaaatgttcggccactttatggcccttcaaataataattattaaatggttgtacgtccatcaacagttcgtatcactttcgcttcaggtgcttgagcagttacgctgcaacggtgtgctggagggcattcgcatttgtcgtcagggcttccccaaccgaattccgttccaagagttccgacatcgctacgaaattctgacgcccaacctcatccccaaggggttcatggacggcaaagaggcggccaagtaatcattttacaattgtcacatgaaaagtgccattttgcaacacgtttttatactattggtttttgtatttctttggatgcgtttgaaaattcggaaaaaatgtgacaaaaattagaatttttaaaatcattcgtatccattccattcaaaccagacgcatcattggaactctcgacttggacccgactcggtatcgcattggccagtccaaagtgttcttccgggccggcatgcttgctcacttggaggaacaacgggacctgaagatcaccgacctgatcgtctgcttccaggttggcttattcaatttttgggtccctttacgggtcaataaa

SEQ ID NO: 15569 - DNA, 3803 bp, Heterodera glycines
atccgcattttgcaacgcaacggtgtggcgtggtggaagctgcgcgactggcaatggtggcgcctgtacaccaaagtgaagccgttgttgaaggtgcgccggatgtcattctgatcagcattaaaagcattattggcacatgcaaaacaactagggattagacacgattgcccatggttcttgtcggtattttcttgaaaaatgcaacaggacctggagtcttgttagaataggcatttttagtccggaaatcctgtccaggtccaacccggaactccgggtccgatttttccataattctggctgctacatataaaaagtcttcgtcatgttagccctttgacatgtgttttgttgtataggtgaccaaccaggaagcggcaatttcacagcgggaggaggagttgcgagtgctgcgcgaacggttggccaccaacgagaaggagacgctggaaatccgaatgctgatggagaagtccaacgaggaacgagccgcagtgcaagcacagcttcaggtcggtgggcgaggggacgggacgccaaaccgcttatttttcaacaaatttatttatatttactgcgtgctttttttgttgctctcttttatcttacgaatttgttggtttactactataattctggatccatcatccgcacatttcacagtgtcacttatttatctctgactctttttggttgcattctttcccggctttaaccattttttataattatatataatttagtaaaattggttttattcgagtttggtttcgggggtttgaattggcgaaatgaatgtcagatttttgattggcggtcccaaaaaccccgagaagcattttaaagttgcaggcgcccacccatggaattgtccccgtacccgtttaatccaaattctggtgccctcccccttccttttctgtaaatattctattctgctcttcaatttacctttagtggtggccatttgccgagacatttatgatgataatgtcccgtctttggcactttctttgtgctctcttcgcctccgtcttcttcacctcttccccccttcagacggagtcggaggagcgcgcggacgcggaagaaatggccagcgatttgaagcagaagaacgtgaacatgcaggagatgctcaacgactattggatgcgcattgaggagaatgaggacacgcagacgaagctggtggaggagaacaagaagctcaacgagaccaacaaggacctggaggaacagctggagcaggaggagcaggcacgccagaagttgcagttggacaagaagaatgtggacctgaagctgaaggagttgcaggcaatgaatacatttcgaaatttaaaaaaaataagaaaatttcattaaaaaaaagttttggaaacttttttgaaaagacattaattcatcataaaaaaaatttaaaactaaaatcatacttcttataattaatgctgttttccaggacttgtacgcccagttgcaggacgcatttgcgaagctgcaagcggaaaagcaaagtttggaggcgcgcatcggactgttgtccaaccaactgcaggaagaggaggacaagaacaagcaaagcgtcaagtaccggcacaaggtaaaaaattgtaaaatctaataaaataattacacatccatcgccaccacataacagttggaggcccagttgaacgagctgacggagaagtaccagtttgagcggaaactgcgcgaggagttggaccggaacaagcgccggctggagttggacatgggcgagcagaagacgcaggagcaggagaagcacaacaaaatggagagcatgagccgggagatggccaagctggaggcggagctgagccaactgcgcaacaagtgcggcacatttgaattacagtggaaagaaacactatttgtagaatgattggactctgtattttcaggatgaggttacccgtgacatttgtgtctattgccgaaatcggacattttgcgcccggacttatgcgccccatttcttaaagggcattcattcttttagacatttgtatagaatccaggattggtaggaacactttttcttacgaagcattttttgcgcatccacatttgttcggtggcttaaatgttgctgtccacagtatatttatgtgcagtttttccagtcagaaaatttaaaagtgcttggtccagagaattaaaaaatcgaacaacgaaacagtagtaaaagaagtttaatttgttaacagctttttccaattttgcgattgaccctttgagaaaattaactcaataaatgtccgaaagtccttttgaaatgggttgcacaatgccggagctcaaatgtctgtatatgttttaagaggggggggggggggggaggcgggcatggcattagtggccaaataaatatgcatggaataattgagtgtcactccataaacaaaattccagcgccgacgacgatgccgccacaattgccgccctgcaaaagcaggcccggaagttggagtcccagttggaagaagtgcgcgaggactcggagaacgagaagaagcagaagcttggcttgcagagcaaagtccgccagctcgaacaggaactgtccggttagttgggcgttggctggtggattggctgggtccccattacattcatcggtcactttggaattccattgatcacgcactattttcctattatgcaattttttcattagtttttctatggctcactttttatgtcattttagtgccccttttttaatttaaattcttttttctgactctttctttgcttgccttttcacctttttcttcgtttagttttttctttcttagttatttccacaacagctctaaatttctagtttcttactttgtttcaatttttctttctattttaccctattttttctttctaatctcttttcctttctttatctctcattcccgctccattttactctgtcctgtctttctttctattctctcttcctcctctctttctcatgtatctctcatatctccaactctctgtctctctctctctcatccattttttactatattctatcccttcctcctttgattaggcttgctggaacagcaggacgagcaggaagcagaacatcgccaattgctcaacgccaacgcgctgctcaagcagcaattgaaggaggcgcagaagaagacggacgatgacattgttgcccaattggaggagcagcggaagcgttcgcagaaagagttggccgaagcgatgcaggcattggccgactcggagcaggcacagaagcgggcggagcagtccaagaagaaagtccaacaggaggtgagagcagcagacgacgtgcaatttgaaggaccaatcgggggggggggggataattcaaggaagtggcaaaagaatttcaaaaaaggaatggatagcgggcacgcgtgcctctcccccaccccaccaataaaattaaaatttccagtaaaatgtgaatttgtttaaatttaacccttaaattttctcggcggcgcctaatgactctgcgggacccctattttcatgttttttaaatagttttttggctgtaatttgtacttgaaaataaattatttttaatttttcaatccaaacctggttgaattagtttgtcatgctttcgaataatacataggtttatttttaaagaattcaaataacaaacatgaattattcgcaaaaaagccaacgaatttgcaaattttcttttttgtccacgatggatgacctgcaaattgaacttgagacgatgcgcaaaaaccagcaggaccgggaga

SEQ ID NO: 15570 - DNA, 2347 bp, Heterodera glycines
  misc_feature (841)..(841): n is a, c, g, or t
cttatgaaaaaacttccttacatttttttcttgaaaactttctgttatcaaaatagtctctcaaatacggtacgacaaacgaataccgaaggactattttttagcatttaccgtatatcccccatcatttgtctgcccgaccaggtacggagcgcagttcttgcgcaagcgcgtgctccagttcatcatgcagcatccgaagaagatcacgcagacagttggctgggagagcatcatcggcgacagtcggcaccgtcggcttgcaacggacattgtggcatcgtttgagaagccgtgctaatgactactggcaatgtgaagaattcaattcaaatcaatttaaatttgccacaaatgtgccaatgctgtgccacccgggaacagcccactcccctccccccccccctctcgcgacagaaaagcttattgttaaaaatttagaaaaagtatatttttaaagttttttgccgtttggtatgccccgacacacccatccccatgctcaagcccaggcacgatttgttatgcgggatgagttttatgatgagatgcatttttccggcagggaatatcgcacaggtcgcccaggaggccctcgaacataaaaatttctcgagaatgacttaaatatttttagaaattcgaaatttgtgctagttgtaagattacgacaataggcaaaatttgggagaagaaaacattgaattaaccggatagatttgagtgccgggtcagcccgggtttggattcgaatctctttttttatcccttttttggtaacataaatttgccattttgttcagatccgtcaccaccaccgtcttcttcttcttcttctccnacatttgtttcgtcgtcatttttttgtccatttgtttctgtgctgctgtggaccaaaagcaacaaaaataaggccaattattctctcctttctccttttcgctgtttttctctcttttctttttcttttgcttttttcaaaattatttttgcccactaattaagcgagcaaaagtgttgtcctattacaaatttacattttgcacttttttcggtgactttgtggaaaattcaacatcacatttcctataaatacactaagattttaacgtgctttctggagaattgacgaattttccacttcatttctgttcatacttttttgtgcaacaatttcgttcgtgtgatgtgttttggtggtgcgcaattaaatgaattgtttccatttttcgtcttttaatttcggatgagtaaaacaaaaaaaaatatattttttaatttatttcaattaaactacattttttgaaaccttggcatagttttcgcgcctaaagcactgttcaaaaattgcctaaaaatgatcaatcagtgtttctgaccttttatcaaattgcgcgcatcgtttcgctctgatgctttttttgacccgggcaatgattcgatagtaaatgatgatatcagtaaatatattaatgtatatggggagcattgtgcaatatgctctgatcgatcagtggtcgcccgatgggcaaatctgatcaatcaataatgacagtgctcataaggttacaaaattcagtttggtctcagaaaattggagcctccctcgtgatcactgatcagatcagcgggcagatgataattttgtgacaacaatcggtcaatcaatcaatcagtgttgtgtgtataattttaatttaatgcctaatttctctcaataaaaaattctgcatttttctgttgttttttttactgttaacttttcctttctctctcacaaagagtgtactgtatgtacagtaagaaatgtgtaatttgttataaaaaaaagccaaaaattcattcattggtgcaacaacaaacatcaaaaattgagttaaaattgttaattttttttcctcttctaatttatatgcgaatttaggcaatggtaaagaattgtggttcctattttaacttttttattttggactaaaattcagtttccgtgggtttttgagggtgctgattgaatctacctaaccagagaggcaatatccagaatacattattaaataagtaaacttggaatttaatcgaataaactattaaaattgaataaattaaacgaagtttttaaatgaaaatcattatttatctatatttataaacaaacaaatcaaaaaagtgaatttaacacaattttaattaaaaatataaatgaaaaaaacagctattaacaaaaaataaatattttaaagccccaaattaattatttttgattccagctaaattaaaattttaaaaaaccccaaacattttttaaaattaaactaattaaaaatgaaaaaaaactttattaaatttc

SEQ ID NO: 15571 - DNA, 2246 bp, Heterodera glycines
  misc_feature (151)..(151): n is a, c, g, or t
  misc_feature (2172)..(2173): n is a, c, g, or t
  misc_feature (2192)..(2192): n is a, c, g, or t
  misc_feature (2220)..(2221): n is a, c, g, or t
aaatagttgttcaataaatttgaagcatttacttcaagaaaaatgtaatccttggaaaaaatttcaactttttgttagaattcgggtccggggttcggaattgggtaaatccgagttgagattcgtaatcagcacctcgaaaacctcttanaagttggtttcgaactcaaaataaaaaataaatttttttttttaaataatccgggaccacaattctttaccattgcccgaatttatttttatggcccaaaatggactttaaaaattgaaattggttttttttctccttttaattgtccattttcggctgccattgtttttgtcattaattcgttttctccatttttgttttgcttattttctcgccggttagtgggtgtgtaattaattaactgtaacttgttaattatgtaattagcgtgtaattataattgattgtctaattgacctaaactcattagcaacatttgttgttaaactgttgttttgtttttcctaacttgtcaaaatcaatttttgcccagcagtcagttccttcttcgtttgttcttcattcatccgccaatttgtactcattaattaatgtccattagaaatgcttcctcccctgataatgatgatcattaaaatggtgctcttttaaatgttttttaatatttttttctcaaaattttcgtttaaaaattcaatttatttttcaagtttagttttttgtatttattttaaatttaattcccacagttttttgttttgatgtaaatttttaatggctggcaaattgcggcagcattccctgtccagtgttcggaagctgcaagaagttagtaatggaaatttttcaacaattcttttcaattttggaaaatttgcgttcctaccgtaatcctaccgtaaaattccaatgaaactaattaaattgacaattattggctcaaaaatagaaattttgtccaattgttgttttacagctgctccatgactgcaacgtgcagttggctacagtccgtagccaaacgcagcaaattggcaccgcggcggacagtgcgcaactgcggcgagagttggacaacaatgccaaggtgggcttgccaattgccaccgagactctcgaagaaaacagcaagggcacaatttggcatttctatcgaagtgccaatgcttcccgattcggatttgtcatcatgaattgcataaaacggcaattcgttctttgctctcaacaattactgatcagttatcattttcggttccgatcgtcacccaattttacgcctgatcggcagacaaaaaaatgcatttgcatttgttggcattaataagctaatgaattttgtgcatctcagagttttgggttttggcatttccgaaaacttcggaatttctggcattttattgccacaaatccggtcactaattgtcagtcttccgccttctgctaattggtccttaaatttcccatttaagggctgttttcgtgcttatgaaaccacaaagaacagtgtgttgccgcagcttaagcgcgaaggtgcgttcactgatcaaatttttgattctatattttttagtagcactttgttttttatttctcattgatgacgttttttcatgatatttttgatcactttttttaaattgggtcctttttgaaattgaaatccctcgttattccctgattttatctgatctgatttgggttgatcaacgcattttaaatataatcaattcctccagagagactcttctaattcaatcgctgctgctttgatcacaattgttgaccaaaaatcctaagggggcttccttatcactcccactcatcagtttaataatttggactttcattctgatcagctcggttcgagtcggggttctgatcactttatcaatcactttgatcagctcattgatcagtgatcactcgtcctccttttcattgtcacagggaatgcgttcagtcaatgtgtgatcggcttcatcggatgcgtgagcgcctttttgctggagatcaaacggtgcggcgcgttggaaaaaacttttcgcatggacgaggcgccaacaatgtaaaaaaagcaatgcaaatttaaaagcgccgaattttttaatttaaattttaattgggtaaaaaataaattatttcaaagtcgatgaaatataattaacaatttcatattnntatattttttattgacaanaatatttaaaaatgttttaaatatttannaatgcaaaaattcatttttaattgc

SEQ ID NO: 15572 - DNA, 1421 bp, Heterodera glycines
aaaaagttatagtcaaacaatcatgctggggcccaaatgtgtgaggcccaaatgacgggttccgccgtttcccattttttttcatgcacagcattttagggaacgggaaacatacgggattctcgtcttttttttgaattcctgtttcccgtaaattttttattttataccaacttaataatatacctcctttatggtgacatgaaaatggcttaaaatcgcgaaattcttataaatcatagtaattaaggaaattcttgcaaaaaatgagtaggcatataatgacgatattttttcaagatcatattgggtatttattatttgtcctccgtttttgcttctttcactgtgacatcaatggccaaggtcactttgtcctcgcttttattgtaaaagcctttgctcgggtccatcagttccttaattgtccataattgggtcaattcagggaaagtttaattgtgacacacagcaaatgaaatgaaatcagggaatccgctggccttcgattcgctgttaaaagttctttcttcgctgaattccctcttgatatcagtcacgccgctcttttgcgacacaattctaaatgttgccgtacatttgcaattccaatttgtgtctaaaaataaattaattaatactattaattaattagcattttatttgcaccttcttcttttgcatgacacaaaagggaaaagcccaagcatttctcattgccagtgctttcatttttcttttctatttctgccaatattttccattgcaatcctttgatgtgcatagtttcgcttttacgttcactcaaaaagatttctcgtgcaaattccgacactttttcaatttccatttcaattgttccattggatttgctttgatccaaaattaatttctcccttttttcatattccactgtaacatcaatggtcaatgtcaatttgtcctcttttctgttgtagaatccattgttcggatccatcaattccttaattgcccataattatgtcaattaaaattttcaattgtcactcaccgcaaaagtaatgaaatttttgaatccacagccgacacatggtctattaataacatagtcacaaagtttcccaatagaattctccgcttcggtctttcctgacacaattcgaaaggttgccgaaaaaacgcagttccatggtccacctattttaataatgattatatttttaaaatagtaattaaaattggaccttcttttgcatcgcaccataagtaaaatcccaaatatttcttctcatcagtgccttccgtaatttttcttatttttgcttcaattttccattgagatccagttatatacacggcatcactgaatctgcttctcccgtcagactctcccgcaaattccgacattttttcaattttcatcgaaagtgtccctcttc

SEQ ID NO: 15573 - DNA, 1845 bp, Heterodera glycines
  misc_feature (1829)..(1830): n is a, c, g, or t
taaatgaaaattacagttttccaaattcaaattcatcgttgagtaacaaacgatcactctagagaagattgcaaaacacattctggtgatctgcaaaaattgatctgatccgaacaagtgagccgcattttgacaaatgtaacgcaaacatttgcaggcaaaatccttaaaaattatcaaattataaaattattccaaaaagggataatcaaaataaaagaattaaaaataaatttgtctttctcacctccaattcgaaaatgagagcctggttatatgccaagaaaatattgcgcaattcagagattggaatttgcacagatggacggacaaggccagggatattgaactttttggctaattagggaattgaataattaataaattaaatttaaaaataaaatcaccggcgtaaagcactgccattgcattgtctccgttcaattcgctcaaatcatccgtgtaaatgaagctcaacattattttgaacgctgctggttcaaagtcggggagctcctccaccacagagcaattagcagagactaattgaaaataattagggcaattagcagagacgaagtgaaaattttaaatagggtagtagagactaattgaaattaacagactttatcacaggcgtatttagggatggggggggggggaaggtgggaaggcaaaaatgaaaaatttttaaatgagaaaaatttgaaaaatagaaaaaacaaaaggagtggggctagtcccttatgtattaatttgcttatgttttcataattaggtaatcccttttgcttactctttcctgcattggtgtcatttgcattttcttgctccgtttggaacatcgcctcaaaaacattggaagaagcaatcagaatggttttgtgcgcatgcacaagcttaaaatttaattttaccctaattaattgtctaaaaatgtaattcgctaattataccgtaattaattaattgtttattaatttcacttgcctctttattgtcactttgcccaaccaaaaaatgtgcatcggcacctttggccgtgctcagcaacaatttcattcgatccgtcaaaatctccggcttagccatgcccattttgtggccattgtctacggcgaaaaatttaaataaatttaaaaatatgctaataataataaattgtgaaggttctaataataatctcaaaatgtacagcaaagaattttctaccgtatctgcccggcgacgaaattttttgcatccgttccatttctgtgattcgcattcgtcgcaattcatcggttggcgtcagacattcattttgatacgaagcttaatttaaaacataaattttaagttctgagcaaccttttaactataattattaatccaattaattgagtaattaccctgatcagctgtaaattcagtaattgttgggtcaggagaaaaagacctttgtcgattatctgaaagtatgaagattagacaattcgaaaacaaaaattttggaataaaatatttattaatggttcaaatcaactcagctaaaagcacggtatacttgaaaaagtcatgaaaacttgattttgtgatcgaaatctaatatctatttacaccaattccgaatcgctaacaaaaatcaaaaaattgatttttgaatttttattcgaatttgggttagggattgggaatcggtagaaaatgaatatcatcatgatcaatgaattcatttagtatttttatataatgccaaaatttataccgttttcattttccaaattcattctctgcatccgttccagttcagtcattctcgcaagcagcagattttcaaattgtgctannatattgacattttga

SEQ ID NO: 15574 - DNA, 3582 bp, Heterodera glycines
taccaagaatgtttaatttagttgagaaagaaaagagttatggtccaaaaattcgtccgacgacgttttgtcctgctccgcctgttggcacctcggctggcatcaatttgaaaacaaacaggacggaaaaaagttttttggcttctcgaaaagaaaagtcgtccggagacggtgccaccccataaattatttttaaaatatgaattaaacgtaaaaagataatttctggctttttgtagaaaaatcagtctttccgaggggtattttttgaaaatttttgtgtacaattgtatacgaaattcttcaccacaacagcacgcactgttgcgcaacataatggtggacaaacggttcgaaagtctgttcatggacccggacatgcaaattgacgaggacagcgaccagtacaaacacttggagccgttgatgaaaaagatggaggcgaagaggcaacgacgaacaacaacaacaacaacaacaatagacaacagaaggggaaagaatcggaatcggacggacaaatgaccaaccaatacggacaattggccaatcagtacggacaattggcaaccaaatgataatggaataacaaacaatgaccataaattcaaatgttgaagattattatgattttatgactatgaatttgtcaatttaatgcatggatttctcacaggtgtcctttgtagccaatatagggagcggatttttaagggcgaaattccaatttagagacctaaataggggcagaaaatcgcgaaaaatcgtaaaagaggggcgaaaatctgtgctttttctcaatgatagagacatgaaaatacctacataggtagtacgccaaaatagggttgcgaccccgacgtgaagaggaaaactatagagagagagagatgagaaaggaagcgagaaagtaaaccgaattgatatattcagaaagaaaggaggaatgggagatagtgaaagaaaaagagagataagatgagtgagagcgcagagagagagagagagaggagaaagagagtgaaaaaagagcagagagagagagagggccgccgagagaaagagggagagagaacagtgagagagagagagagagaatagtaagtcaattgagggtaaaagagagagagattagagagagaacagtaagagagagagagagagagagcaaagaagagagagagaaagcagagaagatagagagaacagtaagagagagagagaaagcagagaagagagagtgaaaaagagagagagacagagagcagagaagagagagcaaagcagagaagagagagtgaaagattattaaaataaaatggcagccataatcaagaatacagcaacaaagttaaaaattgcgaaaatggatgtaaattttataatgaaaatatatttcactattttttacagctttattgtacttaaattgaccttaaccggccgcaactattattttttcaaaatttcgggtcctcaaaagtcgggtcctcaaatgtcgggaatatccgcaaatgtcgggtcctcaaatatcaaatcctcaaatgtcgggtcctcaaaagtcgggtcctcaaatgtcgcaccacgatatttattttacccagtgcagcagttatgtactggttgttgttttgtttttttattcgttaattaacgcctcccctcgattcgtcaactcaacgattcgtcaactcaacgattcgtcaactcgacgattcgtcaactcagccaaaatgcgacgattcgtcaactcagccaaatgtcaacgattcgtcaactcaacgattcgtcaactcgacgattcgtcaacccagccaaaatgtgacgattcgtcaactcagccaaatgtcaacgattcgtcaactcaacgattcgtcaactcgacgattcgtcaacccagccaaaatgtgacgattcgtcaactcaatcaatattacttaaaaaatggaacttaaagcaattgacaagaatttcgagggatgcttaatttttagtctttatgtaatgctttaccaggcgaattgtaggcgcatttgacattgcatcaatttcaattttgtttttcagttttagcaaatcaatcgaatttcaacaaggaaaaacggagaggggatcattatgcatttggcatcaaggtcgggtggttaaatttttcaatggcttcgattttttgcagggttccgtttcactcgcatcagagggcggtggtaccgctgttccaaccgggactgtgaggtaactgcagcattgagtaaagaaggcggaactaatggtgtgctcggaagaaaagagcacaaccatctgccggacccagcgtgtttccacgcggaggtaaaacgcaacggaattaagacgacaacgatggaaaacccgcgccaaaagccatcaaaagtattggcagaagtccgtgcaaacgccaagtgttagagaaggaagtaattattgattaggtgtatgaccccacgccacttcgccatcttccccctcccattcccctcattcagtttgttattgtgcccaccaattttgacctcccaatttattctctgcatttatttattattttattttcttcggcaaataaacttatttaatttgttatcttcggacataacaaattttggcgcagtcagcaactcaacgacagcgtttattttccaagctttatctcgtgctgatattgcttgtgttgattcatcataaaccgatctttgccatattttacggcacggtttatcaacaatctgtgcaactaaaccgcatctttgccatatcttacggcacggtttatcaacaatttgtgcgacataaaccgaatctttgccgtatctcaaggcacggtttcatcttcgacaagaaccgatttttgccaaatctcgaggcacggttatcgtctatttcaagccaattttacggcacatcatttctccgatttcggcaaattaaagggatttataagccattggaccatggacgcgcaacagcttcaacaattgctaaatgctctccagcaaatggtcacaaatgccgcaccgcaaaacgccacaccggcaaatttgagcaatgccaatttggcaagctccatcgatgctcgcctttcaacgttccattacaatccggaggtcggcacaacttttgaatgctggttcaaacggtacggaaaattgatcgaggacgacggaagcacactgccggaggcctcaaaagtgcgacttctcctcggcaaactcggagaggaggagtacagcaaatatcgggacacgatcagtccaacccagccggaccaagtgaattggaatgacaccatttcgcacctcaaacagctttttgccgagacacgttcgctgtttgtccgccgctacgaatgcttcaaaattcgacagcaaccaggacaggacgtgtcgtcacttattgcgcagatcaacgcgtcatgtgaaaacgcagatttgagcctgacaaaggaacaactcaagtgtattattttggtcatcgcgctcagcgatgaacaccatgatttgcgacaaaaggcattgaaaatgttggaggacgctcagaaaaatggcaccaacattcgctcaagaa

SEQ ID NO: 15575 - DNA, 2924 bp, Heterodera glycines
  misc_feature (47)..(47): n is a, c, g, or t
  misc_feature (50)..(50): n is a, c, g, or t
  misc_feature (56)..(56): n is a, c, g, or t
  misc_feature (2880)..(2880): n is a, c, g, or t
aaaaatgaaatgaaaattcgaaaatgtttttggggaaaaaaggaaanaanctcttngatgaaataaaattaggtaaatgaggaagaattaaattttgaaattaaagagcagaaaaattggtcccataaaattaaacaaaagagaaaacaaattttaaaaggacaaacggacactgaaagaattcgggaagaatttgagcaacaaatggaaaaaatgtgtgaaattgctgaagaaaatgccaaagaagaaaaggcaaaattggaaaaagcaattgaaaatgcgacaaatagtgaagaaaaggaagttctgggacaaagaatacaatgacaaatttggcactttcaattcatcgccatttattgacgaaatttgacaaatttggcactttcatttcgtcgctctttcataaatcgttccttctttcccatcagatccatggcatttctgatgatgtgtactattttttcttgtaactttcattcatagtattatttttagtgtttgatttactgttttatttctcttatacttttgtctttatacggtgtaaatttaactatttccactgtagtggaaatataaaagtgtcaattaattgtttatttcttaaaatcatttaattccattgtttttctgattatttctttctttttcttttcatttaaattgtatttgagaaagaaccatattttccagttttttgaaaaatattagttttagcatttttgaaaatttcagttcaatcctgagttggaggtgggcaatctcaaaaatagaaaaggtcctgatttttacgatttgtcctgactttttatcattttgatattaaaatcagagagaacctcacttggaatcaaatgccggcttattttcttaatatttaaaccctcttccgggagcttggcttgtcatcgttaatttgatgcgatagttgaccaaaggtaggggggggggtcaaagtgacagatgacaaattaaaaccaaaacatttagggttgttgatgatcaatcactattataaataattgcataataattacataataatatatatatataattttattaagtaaaaaatagatttggttaatcctacttatggtcaatcaccattttcaaaaattgcatcataattaaataatatataaattctattaagtaaaaaatagattcagataatcctactaatgatcaatcccaatttttaaatattgcatcattatttaatataataaacaaattatattaagtaaaatatagatttggataatcctactaatgatcactcccaatttttaaaattttcaccatttataaggcgatgagatattctttttttatttttaataattactttgctttttctcatatatgaaatagtgtaaacttaattttctttaaattttcaaattttaccaaaacccttaattcaaaaaagtattttatttttttatatcccttttttaaacactttttagatataagaaattttatttttaagcattaaaaattaaatggttacattacaaagatttttgcagaaaatggaaatatttcaaaaatgcgaaataaaattgtattaatgaatttcagtctttttttaaaattcatataatatgtagtttttattataaataagctttaaatagagatgcaaattccaataagttcatatttctttccctgtttaaacgtgttcaaaaagtagaaaaaaatttcgtgtttcagaatgaaagttgtgatttctatttttttaaattttttggtttttctgcatattaattatttacgtatttttctaaataaattcaagtaaaaatgtcactatttaatataaaaataaattaaaaaataaatagaaatttggatgattcttctaaaagcaatctatttaataataaatgcatcaatatttaatgtaaatcttaaagaaagaaggaatttaattatttaacgcattttcattttcattttttgtatggtaatttatatttcagaaagaaagacataatgttgattaattccgtttttatgattcctttttttattagtatttttcaacaatttttaattacattttcaattgcaaattcatcggtgagttaattataattttactaatttatttcattaattaggttgaggacaatatgctatttgcatttttgaaaggacagaaagaaattcaattcagtgagtattcaagacaaaaatatgaggcacaccttggcattatgcattttatgagaatgaattggcaatgtgacaaaattgcggtgaagtttgaagaatatgaacggacaaaatgcccaaaatatcgcaaatatttggacattttgcacgaatatttgtacagagaatacatcggaatccccacagtgaagccaaaatttgtgtttaaaaaacgaattgaaattaatggaccactgatttatgcggtgaattgtctcgtcgaaatttggctattttattttaaatactattggttaaacacaaatttcagaattttcatttttaatcgttttgaactaaaattgttgaatgagaagagattaaattataaacaaaaattgtcaattaatgaaatgattttggaattggcaattgacacagcgaatgaatggcaaacaaatgaaagtttagacggaataatccaacaaaattgtggagaaaaatttgaagaatatttaaaggaaatgttcaaaaaatcggaagaaaaggcaaaaaaagataaacaatggaaagccaatgaaataaataatggcaaacatttaataattaagcattcgaaatttgatgatcaagggacatgggtgaggagacttaacatcaatgaaagtatataaatccaaattttagactgcagatgctctattttcngaatttgtcaaaggtttagcgacaaatcagaagaattttttaaa

SEQ ID NO: 15576 - DNA, 2979 bp, Heterodera glycines
  misc_feature (9)..(9): n is a, c, g, or t
tctttgcanaacaatcgctttcggtttcccgtcttttctcggagtgtgcaaccattcggacaacacttgctcaacagaagttccattctgtccatcatcagcaatcacatcaagcatcagctgatcgaaatggattgaaaccaattgatcaagatcagtgagaattgtcggtaaaatgcgacggcacaaagcgtcaaattgtccgtcatcgaaaaagcccaagtggcgaatgcttggtgcaaaaattggccaaatttcgcgcgccaaaacatcccaaatcggctcttcatcattggtttgaaacaattccaaattggtgccacttctgtcccaaatgtgcttgttggcatggagaaatgtgagcacagagtggtcaatgtatctgaaaaaataaaaaatgctttaacataaacaacaattttgaaaaaaattactcaatctgaaggcactgaaatcgaacattgttgggcagcggacgatccggcaacggaaaatcgcacaaatttgccatcaattagaacagatagttgcggctttggtccactgtctttgttaattttcatccatttccaaagcgtcaattcgcttttgccatcgaaatgcgtgtccaccagcgcattgaaacggggcgaaagcaatgccaatttgaggccgagttgagggcggtcaaaaaacggaagaatgtccatcaaaacctcgctacaaatccatctgaaagagtgttgagtttaacataaatttttggggatcattaatcatgaatccggcattaatttcgaccaatttcgaacccctgtaccgaattcgaacaaaaagtcgaaaattcacttccctgtttagatttaatgcggaaattggtcgaaattccccaaaaaaacaaagattgtcaatgccattgtttggctcacattttcttcaaagttcgcttgttcattttcttcatttgttctccaaatgctgtcaccgtaaatgaacccggcaattgctgctgattttcactaactgtggcagaagaaattaagcaattgtcggcggaggaaatttttttctttttttcaacgggcgattccattaagaattaaattcgcttcaaattttgtgtgaattaggctaaaatatttcatatcaagtatgtaaaagaatttggagtcgaatttttgagaaaatttttcatttattaggggggggggtgtattttcagaaattttaggttcgattcttagacgagtatttttgctttttattacatttttgttaaatgacaaaacgccaaaatttgttaaaatatgtttatttcaaaatttttttggtttacagatatttgtaaggtggaaaaaaccggggccaggacgttttcgcgtgagtgcctattaggactgaaattggtcggatgtgtgccgaacatacatttcagacctatttcgaatcccaaaccgatttcaaacaattttttgcttttatttactcaaaagcgtcctcatttttatgcttgtaaagattaacaacttcaaatattgacaacgtgaatgagagacacagaatccgaccatcggcatcacgacatttctttaatttttttctttttccggggcggatgacttcttttcacatacatattgacccattgctgaccccccccccatttttgttgtttatctttagtaaaaatttgcccatgggttgatttggtccgatctggcgaaaacaatcaccggcgaattcacttactggcgaaatcaaatacagacgccgagaaaaagagaaatagttcactggcgaaatcactcactggcgaattcactcactggcgaattcactcactggcgaattcactcactggcgaaatcactcactggcaaattcactcactggcgaaatcactcactggcgaaatcactcactggcgaattcactcactggcgaattcactcactggcgaattcactcactggcgaattcactcactggcgaattcactcactggcgaattcactcactggcgaattcactcactggcgaattcactcactggcgaattcactcactggcgaaatcactcactggcgaaatcactcactggcgaaatcactcactggcgaaatcactcactggcgaaatctaacagcgccgttatgtcgtcataaaaaagccaacaaaatgggtataaaaaaccatcaaatgaaaattttatgataaaaaacttcccttaacattggttaaaccaaactaaattttaatttttggtttaatttggtagccctatttctctctattagcaaagttatggccaaaattacacaagcaaccaacctttcatacattcttggccataacttttttgagctgaaccagatagaaaacacttacaaattagggctaccgaatgatatcaagaattaaaaattaaatttgagctaagttatggagagcttgtgcgctgattgaatgagccatttttgaggcattacttttttcttgtcttgccaaattttgttaagttccactggaacctccaaaattaaaccatgacaatccttacaaaaattcaaaatagaaaagttgtaacattttgttataagtaaaatatttctgttttgataaaaattaatttaaaattttttaaaattaactaagaagtcagttttctttcatttatttttcttcccacgacgcctaacggcactccaaaatcaacattattgatatcagtcgagagattaacatgttttttccaggctttaaaatctttttattttttgttaggctaatagaacacattaggctaatagaacacattaagagctttcgaatgataccaagactgttggatttggatgccaaagaaaaaagtatactggaaaaaccttcgggcgcccaaacgccagcgcaaaaacgcgtgggtcccacagtatgtttttataatatgtaaaaacaaaaacatataaatcccgtccctgtttattgtgtgttagaaaggtt

SEQ ID NO: 15577 - DNA, 3735 bp, Heterodera glycines
tctttcatcagtaattagtctcattttgattatgtcctccctgtatgctgcattatgcactaaacgcaccgatcttctgtttgtttcgcaccagaattcggcccgttcgccctccaccacggaaaggtcttgcagcggtcggataaactccgagaacggctccactgtttggcgcgcctcgcagcgcgccagtcccgcgtcgttggcaatttcgcacgcgtagtcgcccgtgtcgtcctgcagtgcgcttggcaccaccagccggaagcggtccgggccgagcttttccatgcgcgaccgatccgacggggacaactgctggccgttcttgtacctgcagcggcgggggtgggccatgttaattaatggtcagtggattggctgctgtacccaccatcggacggtgtgcggctttccctgcgtttccacttccaacaccaactcgtcctcttccggaatggtctgttcgcgcaacggtcgctcaaaccgcggcggttccgccggcatttcctctggcaacagcacggtcagtgcgcagctgcactccacgccgggctcgtcctcgcggtcaaacactttgatctgtggtcagcaggacaattaattattgctttaattgctgctccctacggagtattgggcggtgtcgtccgcgtccgtgtccggcacttcaagccgaaactttgtatccgacacgcgctttggttgtgctttggtttccgcctcgcccggcaccagctccttgccctccttgaaccatttgacagcgagcgctggtgagcggtccgtctccgccactaattttaatttaattgttttgccttaattatttgtccgcctcacttagcactgcccgatgaccctttggcacagttacatcctcaagcggacgtacaaagcgtaacgatttgatcagcttcagcggtgcttcggactgtgcttcgccgcccaaattggacagcaccacctgtgccatttcgtgcgaattaatatagtaaagggtaattaaatattcaataatgccagttttcgttatcctctaatccatgccatccctgcttagtgccattgtcccaattgtgtgccatccccgtctttcctccctcccttgcctccggccaccttataatccgcttcatcgtcaggaccagccgagtggatgatcagtcggtaacagttcccgtcctgctccgtctccggctgttccatctcccgtccgtttttgtaccatttcaccgatcgcaccggtcccttcacctccacttcaaatttggtcggctctcctggccgaacgctgaccggcaccaaaccacgcacaatttccggcttttgctcttccggcgctaaaatttattcggaaattgcattattttgaaattcgattcgatgactcaattgctaagaagaacatttttgatcaacaattgaaggggaatgattggcataatgtcagtcagtcattcattctgtcggggtacgctttggtttggcggctttgacaattatcgcattaattgcgcaattattggcacttttcggagcgaatattgggcaaagcaattacattgttgtgcaataggctaatcacagcaaaatacacacaattatcatgttcgatatccaccgcttctcccccccccccctttagcgaaaattgcggggaatggaaaaaacggcgcattttgccaaaggcggcggaacgagtttagcagaaagggaggacagaacacagtataaaagcggcactccgaagcctgacaaatgcagaaacattcacctctcaaaccaaatattttattttttttatatttttaaaattaatttccgcggattttttaacataaaaaccctttcactttcaaataaaagctcgtgaaaaatgaattttgctctgatcactttgccctttgtactgatcggagttgcttctgtgtgtcttggctcgggtaataattttttaattctgtcccaatttccctggggtttttttcaactatagtaattaaagggctctacggtgacgactacggtggctacggtcaccatgacccgcaccacgacggacaccatgacggaggctatggttatgggcacgaagcaccccattacggtggcgactatggctacggtctgcacgacagacactacggcggttatggctacggttacggtggcccacaccatgacgatgggtacggtggctaccgctacggatacggtcacccaggatcgcacggatacggtcacggatttgcggggttcgcactgtaagagacggaaacggaaagcagcgaaaggagagggaagaagctgtggggagagaaagaggagaaaaagcagtgatcgtacaggatcagcagcatgttaccgtattagcaaatgtccaccatcattacagtaatcagcattttcactttcatttcccaacgaaataaacggctgataggcataacaaaacagaggtacaatattaaaacacaccaagcaaattaattagtagaaagaatactgaagcaaagccaattaatgaaaatggaaagggacggcacgcaaatgattaaagggtcaatcaacaaaaaacaactgggcaaataattcattcaaagattgattagtcacaaaaatcacctgccaaacaaaactgatcagaatatcattgcgaaaccgatcagaacatcattgagaactgattaaatggcattgagaaagtgatcagaatagctgatcaaatgccattgacagaatatcattgagaaactgatcaaatgccattgagaaagtgatcagaatagctgatcaaatgccattgacagaatatcattgagaaactgatcaaatgccattgagaaactgatcaaagccattgataaattaatcagaatatcattgagaaactgattaaatggcattgagaaagtgatcagaatagctgatcaaatgccattgacagaatatcattgagaaactaatcaaatgccattgagaaagtgatcagaatagctgatcaaatgccattgacagaatatcattgagaaactgatcaaatgccattgagaaagtgatcagaatagctgatcaaatgccattgacagaatatcattgagaaactaatcaaatgccattgagaaactgatcaaagccattgataaattaatcagaatatcattgagaaactgatcaaatgccattgagaaactgatcaaaataccactgacaaactgatcaaatgatggaagggatgagcagaagaatcttttttcattgtaccataaacctggcaatcctactatataaacgtgcttttggtccacctttctccgtgatgttggccaccgattccgcgtcgcccgcttcgttgctcactttgacagcgtagcgtccaaaatcgccgtcattggccaattccggcacggtcaaacggaagtgaccatcgcccaaatcctccgcaataactcccgacgcctcgtcaagcggacgtccgtcgcggaaccattgcacgtcggtcggagttccgcccacttgaatgtccagcacaagcggagagccctgtgccgaaattaaatctttttaaagttatttatgtcctccctataccttcggcaggctttgatcctgcatgccttgtctgatggtcggcttttccacttcaattgcttttggcttttccgcttcttcctccaccttggcttcttcttccttcggctattcctcctccatcggtttcgcttcttcttc

SEQ ID NO: 15578 - DNA, 1967 bp, Heterodera glycines
ataggacttttttgcttacatacttcgaatgggtaaccccccctagtcataactcgctttaattcgaaaatttggtagtcataatctatctatctattttatgcttcgtgcataagatgcttgctatacgcataaaaaataaatttttaaaaaacttagaaatccgttcgcccctgttcatgaactcaaaactaaaaataataacatatattaaaataaaaataagataaaaatatttaggagttgaaacttgtttctcatacccttcccattgttcgtcttcattgtcggttccaaatgttccgccaataatgcttccgaaaatgacgagaatgaaataagctttggagaacatggaaaatttgggaataatttttaaatcaaatctgtaaaataattttcattcatttttatatttaatatcaaacattttatataatttagagagttaaatgccaatataaaattgtaaaatgactataaaattatataattcatttttattaaagcgtttttcagcgttttaatgcccaattttgcttttcgcgtttatatgcacacgttttaattttcattttcatcatgcttaacctacgacagcgaaatcatatgaaaaaatcaattatgcaattaattggccatgaaattcacattaatattaaatatttttgccaaaccatgatattacttatgataaagttgcagaatgtatgaggaaattattaaaaaaaaaaacaacatccgacgaagaatttccggctgtcaatttttcaatgttaaaatttccggcgcaagcgcaatttttttaaacccaaaaatggggcaaaaatttgaaaagttgcaacagctcatgaaaaaggccaaaaatccgagcctcaaaaatagaaaaaatataattatatttttttcctcaattttacatttttccttggggtatccgccatgcatttcttctttaaaaagcaacactttattgatgtttcgccaatttatgcaattgtctcgttcaatacaacacaattaatcgacaaggggacaatttctaaattactattttatttttccaaatttcattttcaatttttcttcccctttgtttttgctccattctttcgcctcacaaatcagcttcttattattctctggctgatttgatcacattaaagcaatcattgtggatcagccatgcgccgttgatttttttccacacctgcaaatatgctcccgactcggtgccacgagcactaaaagtttaaaaaaaaattaatatttaaattttcataatttgggatttttaattaaaaaataattatctttttatcagaaaatgctcaaatttttaattaccattccaagtgatagctgccacgctcgaaggcccagtcgccggagccatttacctcctcagtgattatctatatttatatttttatttaataatttcaatttaaaagtaaatattcttacgttaattgacattattaaaagggaattagttaattagtttatgtttatttttacctgagcactgctcacgccatcggccatgtctttctgaaagaacttctcaattccgctacgtcccttcactgggctatgaccgttcggcataaaataacctaatgaaaaggattaatattttaattaacaattttaatatttttttatttcctttgcttaccatcggggtcataaatttcggccgcccctttggcattgccggcgttaaacacgcgcatgaactcctcctggcgtcctttgatctcttggaagagcgcttaaattttaaatatttttattttaaaaaaaccatattaattatattttttgaaatcctttaccccggttcatattttcaagaagtgccgaattaagtggaatatggtggaaaaggttgcgttccttttctgcaccggagtgcgaaatgccattctctctttgcatcatttctgcgatataattaatga

SEQ ID NO: 15579 - DNA, 2779 bp, Heterodera glycines
aaaaagaatttaaaatcaaaaaaaaatctttgtgcatgagctaataatgctgagaaacttttataattttacaccataaaaaataaattttaagcgaatgcgacgcaatttatattaaatttatttccggtaaattcgtcatatatttttctggaattaaaaaaaatgtttgttgcgtaggcgagccaaataaaaggttttttcaaaaaggcattcccaaatatgtcagtgccatccaatcatcggtgccgtaccgacagcttttacaaccccgcgaagaaggggctaagcaccacttttcctcccctctcttctcaacacattttgatgagaaaatggcatggcgcgcaaatggcataaaaaagaaggaaattggaaatattccacggaaaaacttacacatcgttttgcggatttggagttcaaatttcacttcagctggcgctgaaatattcgacggtttgagtaaaatgcaaaaaaaaagtgggggaggagggcacttaaaagagaagggaagagctgctgaaatgagatgaaaattgtgccattttcacataataatggcgaaatataatgatattaaatctgcgtacccttcagacatgagctcacttaaatatgtcatttaagaaataacaaattttaggagtttttatgtggaaaaatatttaaataaaaatcttttacgaatcttaattagtgttaaaaaatattttatcgcaaaaattattgtatatagaaataattttaaaaaaatttgtcttcaaaagcaattttcttacgaaaatgaaacgcttaagaggttccaaaatctcatgaaaaatgagcgttttccgtcttacaatgaataagcccggaaaggaacggcccggcccaatataaagggccaattttggcactaggaaacataaaacggcacggacaaattggggtaacatttctaccgaaaacatggtgtgatggaagagaatgtttatgccaagattggttcccaaattggcagcaccccaaaagccttattattttcgctgtttgccgaatattatgtgtccggttgggcttggattttggtggcatctttttcaaatgcttcggcacctctcattattattattatctttttggccaaaaatgttcccacatttgtgacgaagaatggatggacgattcattatgcatcacaaaatccattgaaaacaaaattcattttttgtggatttcaaataggaaagtgcacagctttctcaaaaatagaagggagtaaaaaaaaatatgaaaaacaggaaataaagctattcgaaaatttggtttattgaattagttaaaaaggataaaatagttattggttaatttttataaaaattaattttcacacaaattgcttttcaaaattttagcaatcaatacttaaaaaaagatttatgatttgagagcggacttatttatttatttcaataaaagaaaaagccaacaaaatggaaaaatgcgtttacatttagtttgaacataaaggacgggggcggaggttggcgattagtaggagcgacttggccacgcaaaaactgccgtttacgggggtccaattcctgctattttggccaaaaatacgggtgagcggccgcaaaatccccgcaggggcccttctctctcgagttaacactaaataataacccagtgtattttaaatgaatattatatttttcaactaaaaatggggatatagttgaaaatatgaaaagttttaaaaaattaaaatttttttaaaaaaatacattgttttactaggaataatttaaaatttttttcataaacgctaatcttgttgaccatgcatttccaaacccctatgttgggatttcaccccttctaccggtatttaaaagcaaaattttagagaattttcagtcaaatttgattttataatttaatgataactggccattttccttaaccttgtaacaaatttttgtcacacatatctaaagaaagtccaagacacgtcaaaaaaaaaagaattcaaaagcaaacactatttactatgataagattgcgttaataaaaacgatgataataaagaaaggaaaataatgatctattaatagttaaaaatcctctataaattcaattatgccgttgaataacatacaattttcatggcatttcatcaaagttattgggcgcagcattggtaaacaacaggggtggggcgcgcacagaaaaatcccgcggtcgcggatcgctcatcgcggattcaatttgccgcggtcgcggatcgcgcaaaaaaaatcccgcggtcgcggatcgcgcatcgcggattcaatttgccgcggtcgcggatcgcgcaaaaaacgccgcggatcgcgcaaaaaatgccgcggatcgcacatttgtaaaagcataattagaaaattcccatattatcaataatcaaaattgtaaaggataatattatgatgaagaaaaataagccgttcgagattttcatgcgagatactttttcggaggtcattcaaaataaatcctgcatacaaagtagagttccacgggaccgggaatttttgccaaaaccgggaccgggacttgccgggacctgagaagccgggaccgggacctcgattttttttcgggaccgggaccgcaagaaaaaccgggaaccgggaccaaccgggaaattttaaaaattcaaaaaaattttaaaaattaaaaaaaaaaattcaaattttaatttatatcaagtgaaaataatacaaaattatttggttttttatttaataaatta

SEQ ID NO: 15580 - DNA, 1653 bp, Heterodera glycines
cattgatcgaaatatcagtgctttgatcaaatcagaaccctttttgcaaattgatcaaaatttgttgtgtgaaattctcggaagagatgagctgagaagcagtgaaatcgaaatttggaatgcggtaaattaaatattataaattagaattatttattttctaaaattaaggcactccgttggtccgacgaacagtgccgtcaaaatgacattgaatgttccgctgaaaatcgacgcgaaatacttggcccggcattgttaaacattcattttccactaatgccaaaagaggattttacaaaaagcgttggtaataaataatattttgatgattagagagtttgctatcttgaaaatgcttgaacctggcttggattccttgttggacctggacctgtaatggttccaagtctggattaagggcttttcataattataccgtatttcatcggataaaacccccttcaaaatggggttatactcgagggtggggctttaatgttcaacccttttttacaaaatttcaatgtttttatgcaaatttttccaatagcaaatttttattagtttttgaaataggtcaaaattattgctacaatttaaatcttaacctgaaatttttaaattaaaaagatttttcattttttggaaccttggaaatttaggcgaatgcttgaaaattcataattcacttcgaaatggatcaattaaagtgcaaaaaagcactaaaaatagagaaaaatctggagaatttatactttttttaaggattttctagcttaaaatgaagaagttagctgataataaattttggaaaaattcgtttttcggaaaataattaaatcactgttatgaaaaggtatttttgaaagaaatatacgaaaaaaaatctgcaattttttccactataagattgtctttatttcttatcgaatcggaatcaaatttttattttgcactaattataattctaataacctaattccatagacttaaaatttaaaagaccgtatgtcgtttttttaatattacaatgcaccaggtcaaggccaaacttaattgatgactcattttatgaatgaattaattgtctaattaattatccatttcaatcaaatttcagttccaactggtgtgttaacaattgaagaagtgaacagcgtgtatcagcattattcccatcaaaatttaagtgatgccactgggcttttcccattgaaatttccaacgcaccgacggaacaaaaacgaaggcacaattgagatggaaattgaaaaagtgtccgaatttgcgctggagccggtgggaagtggccgatttagcgatgccatggacattgggggatttccatggaaaataagggcacaaatcaaaacgaaaaacgaaagcaatgagaaatggttgggcttttacctttgctacgatggccctaaaaaaggtaaaaacaaaagtcattttcgtaaatctgtcagggaaaaacaaaaaaaatattatttcttacttgttttaagcggaggaatacatttactaaattcttttttccagaggtttttaaatattatttaaatcattcgaactaaataaacgattatgtagacaattttctacaaaaatagaaattcaaaaattaaaaatgcatgtgaaaaggactag

SEQ ID NO: 15581 - DNA, 2074 bp, Heterodera glycines
  misc_feature (34)..(34): n is a, c, g, or t
  misc_feature (62)..(62): n is a, c, g, or t
  misc_feature (65)..(65): n is a, c, g, or t
  misc_feature (94)..(94): n is a, c, g, or t
  misc_feature (149)..(149): n is a, c, g, or t
caaaaaagcactaaaatagagaaaaatctggagnaattatacttttttagaattttctagcntanaatgaagaagttagctgataataaatttnggaaaattcgtttttcggaaaataattaaatcactgctatgaaaaggtattttgnaaagaaatatacgaaaaaaaatccgcaattttttccactataagattgcctttatttcttatcgaatcggaatcaaatttttattttgcactaattataattctaataacctaattccatagacttaaaatttaaaagaccatatgtcgtttttttaatattacaatgccccaggtcaaggccaaacttaattgatgactcattttatgaatgaattaattgtctaattaattctctattccaattaaactttagtttcaactggtgtgttaacaattgaagaagtgaacagcgtgtatcagcattattcccatcaaaatttaagtgatgccactgggcttttcccattgaaatttccaacgcaccgacggaacaaaaacaaaggcacaattgagatggaaattgaaaaagtgtccgaatttgcgctggagccggtgggaagtcgccgatttagcgatgccatggacattgggggatttccatggaaaataagggcacaaatcaaaacgaaaaacgaaagcaatgagaaatggttgggcttttacctttgcaacgatggccctaaaaaaggtaaaaacaaagtcattttcgtaaatctgtcagggaaaaacaaaaaaatattatttcttactcattgttttaagcggaggaatacatttactaaattcttttttccagaggtttttaaatattatttaaatcattcgaactaaataaacgattatgtaaagaattttctacaaaaatagaaattcaaaaattaaaaatgcatgtgaaaagtacccgttcaacttaataagtaccggatttaatgataatggtaattttattgaatatttatttattgtgcagaaaattggtcttgtaaaagttcggcaacacttcgaattgtttctcaaaagaatggcacggaggatttaattggaagaattggtgatcgcatttttaataaggaatggaacaattatggatttaattatttcattagttttgcggtgagtgggattcaaataaatttaataaacttcatattttgaaattaaaatttttaaaattttaaaaaagaaagtgacaaaaaattgaatagaattttttgaaattttttggttataactctttgtaattttttttctagattttaaaaaattaaataagataggatttgataggatatgtaatgcatcgcgtaataccaatttttattaatttaactaaattcaagctaagttatgctttcttattagcaataaaattaaaactaataataaatttaaatgtttctatcattgacacttttgtaactttggctcaccatgattttatattacataattgatttaaaattaaagttataatcggaaacattgctgattttcatgttaaaaaaaattaattacaatatttgtcaaatttttgtattgcaaaataaatcactaaaaattaaggaattgttgaatccgggcaaaggattttacgacaaagatgaggacaaagtcacattggccattgatgtcattgtggatgagccaaaaactgagaaaattatttccgatccaaacaaatccaacggcacactttctatggaaattgaaaaactatcggaatttgcacgagaagtcattagaagtgaccgtataagcgaaactgctgtgtacataaagggaatgccatggaaaatatcagcacaaatcaaaacgaaaagcaatgagaaatgtttgggctttttccttttgtgcgatgcttctaaaaaaggtttggttataaaattattaatagaaatataattattttttttataaaattggtgtaattaattattgaaaagacttatttaaacagtaattttttaacataaaattagaagtgattttttaaagcctaaggaaggtaaaatataaatttgattattatttaatttgctttaa

SEQ ID NO: 15582 - DNA, 1630 bp, Heterodera glycines
  misc_feature (1084)..(1087): n is a, c, g, or t
  misc_feature (1556)..(1557): n is a, c, g, or t
gtcaatgtcagcttctcattggtccgttcgttcaccaattcaaacagttcaattggtgttgtctcgtcaactccgcaataaatttgtcactggcgaaatcaatcactggcgaattcactcactggcgaaatcactcactggcgaaatcaatcactggcgaattcactcactggcgaaatcactcactggcgaaatcactcactggcgaattcactcactggcgaattcactcactggcgaaatcactcactggcgaaatcactcactggcgaaatcaatcactggcgaattcactcactggcgaaatcactcactggcgaattcacctgccaccttttattttcagtggcatcaataaagaaagcaaacaacaatttgtgctatttgtagcagtgaaaaatatggaaaacattttaaaattgttagatagatgacaattaagtgcctgctatacacagacaggcctgtagccagcgaaatgaaaaaaaaaaataaaaaattttcaagaaaaaatgggcaaatgttttaaaaggaagaaaatcaagcatgaaacattcgcaaattctttgtttgccttgtttttcatgacaggatcaggcacgtattcagctgaagacaaaatattacaccaccatttgaagaactgtgccaaaacggcaaaaaaataaaaaattttttttttttgaatgttttgtgtatttcaacaaaagcatctctgatgagagaaaatcaaatcaaatgccaattggagagatcgtcgaccagttctcaaatttatgtaattaataattcacttccgcgcagtcatagacggcattttcaaaaagaatcactcattcattccgctgatcactgctgggcccagccgcttggaccttccgccggtggagacaacggcctaaaattaagaaacgcgatttgatttgggtgaattttgcacatgtttttcgacaaaatcaaatgcttttgttctgctgctcacttagccaatggaatttttgccagcaaacctattaatttgacccaggttcagtttttcgacccactcttcggaatttcccattgaaccgccccgggggattgnnnntcaatggggaaaggtttttaaggccatttaccctctctctcctcggtctagggcggctttccattgggtcgttcggttcccaattaaaaaatataaatgggggttcgccggaaaccccgcataattttgtaaatgggagaagggcgggaaagaaaattggttaacgatggacgccttctcccaagaaaaatttttataggggagggataatattccctctaaataaaaaaaaaatttttttaaactaaaaatttaaaaaaaatttttttttaaaaaacataaattttataaaaatgttcccggtttttctcaatttttgggagaaaggggctcaccaaaaaaattatggggaggggcacaccccaagaccaccctcctcatatagggggcccccttctttttttttacaaaaaaaattaaaaaaaaacccctgggcggcggccgcgtccccccgcggaacccccccccnngccctactttttttttttttttttttttttttttttttttttttatttttttttttttatttttttttttttt

SEQ ID NO: 15583 - DNA, 1174 bp, Heterodera glycines
taaggggggacccttttgttttgcaaaattttttttgtgagtcataaaaatttattctctggggtttttggggtccccgatcacgaatccttcaattattttgatcaattccgatttcctaatctaaatttgaacaaaaaatcataattttaaaaatgcaaaatttcgatttttattcgagttcgggtaagggattagaaattagtcaaaatacttgtcagattcgtccaaaaaattgccatcaatccgtacagaaagtctcggctttggtcctttgtccttgcgaactctaatttccctccaaattgttaatcccgtcgttttgccatcgaaatgcgtgtccaccagcgcattgaaacggggcgaaagtaatgccaatttgaggccgagttgagggcggtcaaaaaagggcagaatgtccatcaaaacctcgctacaaatccagctgaaagagtgtgaaacatttgttttgtttctaaatgccaaatttgaggccgagttggggacggtcaaaaaagcggaaaatatccatccaaatgtcgttgcaaacccaactaaaatgcggaaaattgctttacctaattggggaagcccaaattcagaattcggaaacgaaaaattgccaattttgaatgaccgtttcaaatttgtccccaaccgtcgattcattttcttggccattcgaacacttcgccgttttccaaatgctgtcacagtgaacccatcggttgctgttgttcatgttcactaatttcggttgaagaaatgaggcggcggttgtcggagaaaaaatttttcctttttctgatgggcggtgccattaaaaataatttcgctaaataattgaatttttatcaaatttatgctgttttcgacacaggcgagtccgtttttggctccaagcgcaaataagttcactatgggcactatgggtgggaccaggtcgtttcggcgctcagccataactcgcttcattcccaattaaaccgaacaaatttgagatcaaaacattgcaaatccagctgaatgtctgcgaaaaaaaattactcaatgagaaattcatttttctgtaaataaaccatggtgagcttttatgcacggcgagtcaattttgggctccaagtacaaacaaatttattatttatttagtaatcagaacgccaaaactttgcaa

SEQ ID NO: 15584 - DNA, 3752 bp, Heterodera glycines
aaaaatgaattcaaattttgaaatgcttttattttaaattacaaatttggttaatcgttcaggtctcgtggtacggtcaattcgaacgctcggattagcggccctttacccggtttacaatctttggacctcaaccgggacgaaacgtcatatgagtttttttattaaggcaggcatatttaattcgttttttaattacattgtttcttattttgatgtgataattatgagtcatttttcaggttaacagtctattgcagaaggctttggtgggaatggcaaatataaaaactggcaagtgtctgggttgggcgagaaataatttttaatttcaaattaagctgggaccatcgcgcaaatcgtggcccttcagaacaagctctacgacgaccataccaacaaaatgcgtgacagccaagccaaattcgacgccctaatggaagagccgcgcctagttcacggcactaatggagcaaagccgagtcacccattttgcggtgcagaaccaaatgattgaggccatattgaaggtgagcaaaatgagaaaagcagaccaaaaacaatttttctttttttagaattaaaaaaatttggtttttctaattatttttgacggcttttgaacgaaatttttaaagaaaaatcgaatgaaatattttgttttggaaaagtcccttttcatgggtattttaagaaatttggagggccaattcttagtgttttatgtttaattaacatgataaatcataaaacaatttccatctgatcaatcattcattgtcatttttagatcttcgaccgcaacgatggcaaatgaatgtgcttccgcgggggcggatttgttattattaagtgccggccttttaattgccagccattgtttgttgcctaattaaggcgatgttcttaactaattaattttatcacttattatttaactttttgttgtcttttttaaatatttaatctcatttcgggcaagccataagctgcttaacaatcttttattcttttctcatcataatatcgctttttgttttttttccattttgtttcatgttggataatcaaaattttattcatttttgatttggtatcataaatttaaaattcaaaatgcgcggggtggtaattagagaaaatacggtatgtgtttttgtttatttagagtcccggagaatgaatggattatcattcttttttaaacccattgccgcttaatgtgatggtcagaagttttttgctgttctacagtagaatttaaaaataataaagtttaatattattttttgtatattcaaattgcaaaaatttattttatttcactaaactttttttaatttgaaatttaatttgaatttccccaatttcattctgctcgagaaattcagctcaaaattcgatttgtgagctttcgattgatactatatgtattgggttgagcagcataacaaattaatgaccaatcaaatcaaatgatgaggtgaataaccactgaaaatattttattaaactgagaaacatacagaaaataaatgagccgacttggtgacacaattttgacattttttcaattcgccattttacaaaattaccatattttggataattaaggttgggtaattaacactaattaaattttttttttgtctcaataattcgcctgtttagtctcatttatatctattgtaatccataagctaattgaccattaaagcttcccgtacatttgtccgatttataacggattaatttcgtttttaaaataccaaattcaattatttaagactgaaattgtttcaatcaaatggtgccgacaatatttaatccctttcaaaatgtgaaccccaaaataatttagccctattaataattcatttaccaaatttatatatttaattcgcgttccctcttctgagtttatccatctgtcatctgtgttttgcttgaagccaatcagaaattgtctatttaaagagacaaaatttaattaaatattcatttttatttataaattgcaaaaagaaattacaaagcagtgaccgtatgatgctccgttcaatcataccgtacacccagaactgtttccaattatatgtccttttgccataaatgcaaccgctttttttgattttatatttaaaaaattattatttattccttaacacaaaaacccaattatttccaatatttttaaaattaaatatttacattaaactattaattaattaagccgaaataatttcaattgaatttgctactaaatatttcgcagcagagatggaaaagcagcagcagtcaaaaagtgatgatcaccagcaaagtgatcagaagcagcagcagcagaaaaaggccgtcgctgttgtggtgccgcgaatcgtgcggaaggaaaacggtgggaattttgtaattatgtacagtaccatttgggcattttctaagacataaaaaatataaataattcaaattaattgctaagggaattcaactgccaaatatttttttactaaatagcatttaaaaaacaaaatgaaaagaaataattttggaaaaagcaattagcagaaaagaaagaattttgtttttgtttataacagactttattaaacatcattttgctgtttttacaaaaataattaatttgaaaaaattttcggcatttgacttattttacaaatccatgtttttttgaaaaataaatgataaaaatggaaaattgggggattttgaaaatgcttcttctcctcggacaatccctcagaaaaaaaatttaaccatttaataaataagaatctaattaatgaagggccttaattacggcaaagttaattaatggaatttgaatattcaaaccagccttaattgttcgtttgtttgtgttattttgacttattgtggtcatttactgtgcgtgcgtgcgtacgtctgacccccctcactctctctctctctccgtcccgctctctctctgcccaattaatgatctaattgaacgcccgcccattggacgttctttgatactctccctccagctagacacggcacacagtccaattcctagcaaaatgtacccaaaagataatccccacctgctgaactgtgatgagagaaaaacaaaaaatgaatggaatgagttgagcggggcggggcggggtcaacgccctcacttcactttttaccgcacaatcatcattatttagaacatgttaagatgcatgttcccacaaaataattattttctttagttccatacaattgaattgttttccatttaaatttaaattaaatttattaatgctttttaaaaatcatttagtcctcccccgcccgtcctttccaattcttccgatgtttggccaacagcccatggaaattgacgccgagtcaccgaagggcattcggccaacaggaccaggttggatggcatatatatatatatagatatatataaatctgagagtatctgggttgggcgggaaataaattttcaaattaagctgggatagtcgtgcaaatcgtgaccctccaaaacaaactgtatgacgaccacacgaacaagatgcgtgccagtcaagacaaattcgactccttgatggcggagagtcgcgcaaatttcgtctcacagatggaagaaagccgggcgaatttcgtctcacagatggaacaaagccgggcgaatttcgtctcacagatggaagaaggacgtccaccacagttcgcggtgcaaaaccaattcgttgaggccattctaa

SEQ ID NO: 15585 - DNA, 1375 bp, Heterodera glycines
caaaatttaagggtatttaaaataatttttttaatacaactataaaaaatttgaaaaaaaactagaaattgtcatagtttttctgataattttttcggcaaatttatccaatttttcttataatcatcctttcaatcttcaatgattcttttatccaaacagtttcttccattttgaaatgttcgttctatcaattttcatcatttttgcaattgcccgttcactcatttttgggttttctttttttatttcccaataaatttttattttttccattttttcttccttcgttattattttcttgctaatgccaaattgtttcttccatttgataattgtccctttgcttactccaattttcttgcaaatttcggcataatttttgttccattcttttaaagaatattttcctttttgtttaaattcatttgtcatttcaatgaatttttgaataatttgacgtttttcttcatcagtttttgatttgtaagatttgcgtttttgaagaccaaattctttgatccatttataaattttgtttcgatttgtccccaatttcttagctatttttctttcaatttttttccattcttttcttgggtattttcttcctttttgcttgattttctcttttattttataaaattttgcaattatttctctttttttgagttcatttcgcctttcttcttccttttcttcccatttttctccaaaaatttcgtcaaatgacttttgtttcaattttttcttctctgctccaaattggtcaattttgataattaaaattacaattaaaaagaatagtggtaataatttcatctctttaaaaatattctcaaattggatatttttttaaaaagaatgatttttattattgatgggtatttatttatgcaaaaattttctgtttaaacaaactacaaaacattaaaataatcttagagctctgaaaaaatatttttaaaaataaaaaattgtgatttatattatttattttttattctaatgcagggcttccatcgaaaaaatttcaaaataagaacatccaggccataaaataagattttagggtcaaaaataagaacatttaacaaaaaatacttaaatcgcttgtataacactttatacaattaatatagcatcaacttttgtatttttcgcctccaattatcatatttaacgattttgggaagtaaattagcaaattcagtgcatttttaatctaaaaaaacaaatttttgcggcgcatttttccaaggaattttggagaacgggggatgggagtgggtccggcggtgccgataggcgccgccggaaaaattttgtaatttttaatgcgatttgttaacagattttgtctaaaaattgcccc

SEQ ID NO: 15586 - DNA, 1129 bp, Heterodera glycines
tttatctgctccatctccgcttaaactccgcctaacgagagcaattaaacttctcaggccgcgcaaaaatgaaataatctcgctgacgaaagtgcggcggcacgtgatcacgtgaatatttttatggcgtgagaaacgaaagaaaaatgaatgaagtgaactttggaactctgaaaattgtaactcatacggtaaacaaaataattgggcataattttcatttttcaattggttctctattttcagccagttaaaatcgcacccctttgattggttatcagcccgggcctttttgctttaccgcaatttatttctcttttttttgtctcactttttctctctctttttttgtttttggcctctttctctcttgtttctggcctctcattcgttcaaaaagtttttaaattggtcagttattcggctgctactaggcctttttttggttatttttggcttctttaattcctctcttttctctcatccttacaaatacgcccctttagcgtttagactagactgggcaaatttttgtgtacctctttctcttcgtttttcagtgtccctttagttttcaactagcccggacagattttctcaattcttttctttaaaagtccctttagtcttcgactagcccggacaacattaaatctcagacttctttgtttctagccctcaggccagggagatctcccacaaacttctgccggcttacccaattctcagcttcgtcgtcaatgatgggtcgtttctcaaaatgggaaccatccggtgctaccagtgagggaagcgcactgtgccctaagaccaactatgcaccgtttatcccggatggaatttgggaggaaatgaggaaaagccaaagcgcctttgaccaagccccgaacccccaaacgactcattgactgttaaagatgtgtttattcattcgttgttggatttacagaagcgagaaattggaataataattgaagtctgttccataactaactgactaaatgatcactggggaaggagaaaatgcgaagagaatgggcggagaaacattacaatgagaaaaggaaaaacgtgtgaaatggataaatgtgatgaatgataatggccactagtgaaatgagggaaatgc

SEQ ID NO: 15587 - DNA, 2433 bp, Heterodera glycines
  misc_feature (2263)..(2263): n is a, c, g, or t
  misc_feature (2265)..(2266): n is a, c, g, or t
  misc_feature (2269)..(2269): n is a, c, g, or t
  misc_feature (2322)..(2322): n is a, c, g, or t
  misc_feature (2379)..(2379): n is a, c, g, or t
gagaccggacagctggggtcggattgatcccaagtcgggatcccgaatttaatcccgcgggatcccggccggtgtttaataatcagggaacccaacccgcccccccccccctcaacctttagaaatttctgcatattcaattattaatgtgcaaacatttatttattttgttatattgtatttgtatgctttgtgtataattctagaactaattaattccattgacaatgtgcgctcaaagttgatctcggatggagtgttcaaaaacacgtttaatcgcaatgccaaagcatcaaatgaatttcaacaactcattaacacgttggagcacaaatttgtggaacaaattggccaacaaaatgaggaggatggccaagaaaacaaacgctacagcctcgtggacaaagtcactttttggcaaaacagtgtccgggtttcggagaaagccggcaccgaagtgctggatgaattggaggaaatgcgtgctaaatttgtacagaatgcggacgaatttgatcagcaggaatggatttttaacagcaaaaaaggcttttggctgatctgagtgttctcccggaaaatgcgtcagtgaaaaaagcatcttagaaatttttaagaaaaatttcagaccttttcctagcgtatttttccagatttttgaaaaaaaaagaattcttcatacaagttcgaaaaaggttttaaaaacttttcacttgaaattttcatataaaaaattttttcgaggcggggggggggggaacagtaaatttttcaaagtctaataaatttttcaatctaagtcaaacaaactaagaatttttttaaaaagaaaaaaacagaaattctttaaatccagaatttatgtttttgttgttttggtaaatctagagcttagatgaataatgtgaaaacatgaaaactaatttcattatatagaggccaatatttggtaaaatttttcactttctccaccaaaaattaatttcttctgactagagttgagcgggaccgggaaatttgacaaaaaccgggaccgggacttaccgggaccagaaaagtcgggaccgggaccaggtttttcgaccgggaccgcgaaaaaacccgggaccgggaccaaccgggacttttcccaagtgaaaattttttttgaaaaaaattgaaaatttaagtgcactttgttacgaaaattgccaatattcaaaaatgtacccataaaattttgtatttacgttttgggggacgagttcgaggaaaatttttaaaaattttgttttcagggggggttcatggaattttctgagtaccaaaattatgtatttttttaaaataaatttacaatcttttaaattttttgcttttaaatcgctgtttttgtggcaatgttttttcaaaaaacttttttggaacagtgggagagggggcggggtccggcggtgccgataggcgccgctggaaaaattttgaaatcttgagcgagatttggtaacagaatttgtcaaaaaatgaccaaatatttggttaatttatgggtttttaggctattaaaaatgaaaaaaataataatttaacttaaaatattttttattaattaaattcaattaaaataatggtaaagaaaatataaaaaaattttctgttccatcagggaattgaaccgaagagacaaataatgcaagtaaaaaggtttagccacttgaccacttatgcagatggacatatgctataaatgaaaataaataatttaatttatttttatcaaaaatttctgatccctcaccaattcccttctcttttctcacccagacccccattcttaccagtccttatttagtcccgccgggaccgggactggcaaaaccgggaccggatttatctttttccaaaaaccgggaccgggacctgaaaaaaaccgggttttcccgccccggcccggtcccgctcaactctagccaaaactgatgaatgctaaatattaaaacaataattttataaattattcttcattatactcgaaaaatgaaatgatttttattaataaaaataaaatttatattttaaaggcttggaaaacaataacaataataaaatataaaatagaatccattccgccaaaaccatacaaaaacataagtatcagtaacaacacgaaaaaaaatatacaaaagtaaagcagttttaatcgtgagaaactcatatttttcttttattattttcaaaaatgtttaaaaataaatagcgtaaaggtaaagaaagaagaatattngnntgnggtccaacatgggggaattccgacctaatgcagcttttggggattaatactgnggtcagaaatacgatttttggaaatatcgggaatgcaaaagatcaacaaaggacaanagagtcgaagtgggcacgagggaattcgaaagtcccaatgttgtgtcgaatgtg

SEQ ID NO: 15588 - DNA, 1499 bp, Heterodera glycines
ccccccaaggcccctccgcacgcgaaatttttatggaaaaaatagtatttttgctgaaaattttatattttccttttttgatgaaaatctgctaaaaatggctcaaaatcacaaaatttttttcggacaaaattcgttaacaaatcgcattataaaatgcaaacattttcccggcggcgcctatcggcaccgccgcggacccctgttccccaaaagtttttggaaaaactgccgcaaaaaaaagtggtgtgaaaagcaaaaaaaaaaaaaaagaaggtcgtcgcccggaggtacgccctccaagcagccgaaatcctgggaccgtccctggacccctcccaatctcttttttgtatgttttatttaaaaatatttaaattcatccgtacattccttgaatttgtcactgttgcgtagtttttttgctatatgttccggcactgattgttcacctaacaatgctttcagtacgcaatcgatcgttgaacgttcgacaaattccgccaccatttcaagcgcattaatataactcaaaggctcccaactttcctggccgacatattctataaaaaaaaggatttttcaagtacaattgtcctgggaattaggggtgttttgtaatacttcaataaaaccgttttataaaaataaacgcgttttcatatgaactttatgtaaaagcaacaaaaatttgttttttttgtttacaaatttattattttaaaaaatggggtagccctaagttttctctatttgcttgtaaaatttctaaaaaaaaatatttttgtttcaaaaagtaatgccaaaatgttcgaaaacctaggggtttttaggagtgttttttttttcacaatttacaaatttttttaaatttaatttttctaattattaccaattatcagcacacaaatttgtttttaaaatattaaaaattactaattaaattaccttctccccaatcaatatagtaaaattgacttttgtcccggccgacgaacattgccaaaatttttgaaacagtaaaacattgcgcagctttcttttcatcaatgccttctttttttgcctccaccatttttctttttctgccttttgattgacacattttgttttcttaaaaatatgaattaataaattaatttagtttcttcttttacagtttaagtcccatattttttttttcacatttcaaaataaaaaagccaaattaataagctttcgggatcatttatcaagatccggcaagcaacggttttcgaccctatttgaacatcgggcccaaattcgaacaaaatccaaaaaaatttggctgaacattcgtcaaacccccagaaaaaatggcgcaactgatatagttatggtcgaaaattttttctatgggttgacacagcggcccaattttgggctctcagtgcaaataggtttattatttatttagtaatcagaacgccaacactttgcaaaacttaaaattttttttgggattttcccttgtaaaa

SEQ ID NO: 15589 - DNA, 2552 bp, Heterodera glycines
ccgaacatttacaaaaaaaaaaaaaaattatttttattttttaatttcaccaaaattttatcttttcgtattagaaattttccgcgatggagaacaaaaaaatttattgtaattggttttcttctaacgaaatgtttgtccataacacaaattgatcgcttaaaatatatagggaataaaatggcgaattttcaaggctctaatgataaactttatcaaaaataagacccaaactatcggtaaatttatttaattttgaataaatttttttaaatatttttttgtggctaaagtgttttcgtataaaagccaatccatctccatcattttttcccgcaggattattctcattggctttcgttttgttgtaactgatcattgaattctttttttcaaaaataaggtactaaaaaaaggtaatgagcgcatacagtaaatatacggtgcctgttactaggtgtatttcattcttctccatatcaagtttaagcaaaaaattaataaatcaacgaatacagtaaaacataaacagataatttaagtcaaagtaagaatcaatttaaaaataaacagaaagtcaaattgagaatcaattaaagtgggatggtatagatgactcaaccattctcgccctttcactgacaaagcgacggatgaacgtcgagcagtgcagcaagacgcatggcggcacgcaacgtggagaaaacggagccgatattgtacgcctcgagaatggactttccaagcccggtggccggatcaatgacttctccattgacatcgtccacgcgaccctttagtgtaaataagcaacatcatcaaatttgacagtattttcggaacgaatttcgggacgcataaaaagaccgtcacttgtcacagaattttgccagttacctaaccttgactgactgatctcgtaaggtggaatcacccaaataaactaaattttatttcgctgggacggggagttctcacctggtactgaaaatgatgaaaaaaatgtgtttaaaccatttatattattacaggcacagcaaacaaaacgtactttgagaaacgcgcggaccaatgacaatggcagaccattgttggacaagccgcatggagcgacgagaatttcggcgagtcccgaattgatctctccccgggccgatgcttcgttcagtctggtttccagcccatcgaattgaagctgcagaagaaaacgaacaaatgaaatatcaacaaaaaactcatcgattgcatcggcccatccgtctctctctgttgaccttcgccccttcacccacaaaaattaccaaaatcaaaaactaaacttgtccacttttgtaagttttttaaatttcaaccatcgactggcattactaagtgccccgtaaaccaccaccacacctgaaggattcccgcatcacgagcttccttgaagctcataattgaaccatccgcagcatttctcactccttttacatcgaagatggtgtgtcgaacacggctggtcaaaaggccccgttcgtgcgccatgaacaaattaattttctctcctctgtgtatgccaacttcacccagagtcaacacaatttctcctttcggcgtcaatcggcctcgcttcagcgcctctccgatggaaatcagctcatcgcctggtcccgctttgatgtgcgccacatccgggtcgagcattcccgaacaaatcgcctcgagcagagtgcgaggtttaacaccatcgatgaaacgaccatcgttgtccagcgagccactatcaatgacctcggccaaagtctgcggcttttgaaccaatttgagttggtacgcatcatgcagagacatttcggtgcgtccgttcaaatcgatgaatcttcccacccgcatacgcaaaatgttcgcatcctccgcctccacaacagtaagccgtcgattgtttgccatgtcaatgatttctcgtacgttgtttttgaccagcggacgaggttgatggatcgcatcgaacaatgagaactgatcatcggaaaaacggtcactgaatttgccggtgttttcgtcgatgaaccacataacgcaatcggtaagtgtcagtgcgattcccgttgccatgctcggcaatttgatgaaaccgcgccgcagcgcttcgtccaacgaaattggatgctcaacgcatgcacaatgataaaaaattccatttgatggatgaagaaagtctaaaaggaaaagccattgcaacatgaaattatgtgggcgcctgtcggtagctatgcatttttctaaactaactaaaggaaccatagagccaaaacaggaacaaagcccagaatttaagggatcatttatagaatcacctaaattaaacattcttggtgtcattcgatagctgtaagagtcctcttttagtctatcaaaaaagttaaggcttgtaaacttcaaaaaactcgtttcccggacatttttgaccgtaaattttttgaaacaaacaactatttttttaattttacaaactaattgaggactcttagggctattgatgattccaagaatgtttaatttggaagattcta

SEQ ID NO: 15590 - DNA, 1076 bp, Heterodera glycines
ttccatgtttcagttggctttgtagcgacgtttggatggtattctcccatcatttgaccatgctcaactcggcctcaaaatggcattgctttccgaccgtttcgatgttttggtggacgcgcatttcgatggaaaaagcgaattcacaatttggagaacaatcagaattgtaaaggacgaaggaccaaaagcgaaactgtctgtatggaccgatggcaatgtatcgatcgatggcaaaagggtggaatttccattgccggaccattcgctgcccaacaaaatttgctttaagaaccttcagattcagtcagtcttaacttttgtgtacgctaaagcatttttatctttcttcagttacattgaccattccgtgatcaaatttctccgttccaagaagccaatttgggacagaagaggcaccaatttggaagtgcttgtggatgcatttgatacggatgtccaaccgatttgggatgtttttgtcagtcaaatttggcctatttttgcgacaaacattcgccatttatgcattcctaatggtgctcatttggacaatttgcgtcgtctgatttcaccgacatttctcactgatcttgatcaattgatttcaatcgattctggtgctctgttacgcgatggaattgctgacgatggaccaaatgcaactgctggccaagcgttggccaaatggcttcacactccgacaaaaaatgggcaaccgaagcaattacgtttccttgcttatgtgagtccaccaaatctcgaatggctcaacaacttcaaagaggtggaccgccatattttcgtttttttttaccaatttttgtgtttagacatttcgccatgccaccacttctgtcagttacaatattcaactttattttcgtatggaaccaacaccaattgaatcatttgaattgttgaatggacggacgaaagaaaagctgacactgaaacaggagatcgaagcattatccaacggaataatttataattggctgttgcaacggtgcccaattggggagacggcgatggcgccagttaaatggaaaaaccgtgaaaattcggatgccaat

SEQ ID NO: 15591 - DNA, 2408 bp, Heterodera glycines
ttaatgcttccgcagaatccgagcactttgtttggcttccaccttttcggaattggcaaaggtttcacattggatttgactatttgcattttgttcgtgccattcttgttaatgtgccattgaataatgaatcttttggtcaatgcccatttgcgtgtcttgaaatgttcgtccacgtagaagtcaaatcgatgactgatcattgcaattttgaggcccagcttaaaaggcgaaagaaaatggaacacttcgagccaacaatcggcagagataaagctaaaaaatgaagaattttatgaaatatttaaatttttttgtttaatttttacatttttttgcgagttcgaagccttttgacatgatcagaaaataaccaaagaatgcttccacagccgaccaacagaacagtcacggcaaacaaactgaaaatgaattgggcaaatgaatgaatgaaagggtcaaagatcaaagtgaaggaggaatcagaatgtgaaattttagttgtttttgaggccgatgaagctaattacttcaaaattggttttggaactgtttgaaatgttcatcaagcaattttggtaaaaaaaaattaagcaaaaggaaacaataagcgtaccgaagtgctgaaggcattttgcagcaacaaaatgagcggggaaaatatcggttaaaaatgaatgagcgaatgaatggaatgaggagggggagaagaaaaaagtgcatttttatatgaaaaatattagcgtacatttgagtaacgatgagaaaaaactagagcaggtcgggaccgggaattttgacaaaaaccgggatttcccgccccggtcgaccagccctactccttattgttagtcaattctatcattcattcttccgatgttttccctggtcattctgttcctgcaaatgccttcagcaattcggtacgtttattgtttcttttttctgactttttgcatttcttttgctcaatttttgaccatcagaattggcaattttttctttatcgataaataaataaaataaaattcaatttgcggatcctgttgcaggattggaattccgttttcgcgtggccgtcttcgcgtggggtacgttttcgcgtgagtgcctgtttacgactgaaattggtcggatatgttccaaacatccatttttcgaatcccgaacccgaattcgaaaattttctttactttttttgtttttttatttcctgaggctggtaccttctttaataatttgtcatgttaatcccccagtctccaattacattgttaaaaatgactggtgataaaaccaatttgattacagaattttacaaaaaaaacgggaattaatgtacgaaacaacctttttatagcttcgaaatttcaagctggaaacttccacaaaaaatggaccttttttggtgtataaatgagaattttgtcggaaatttaattttcaactctcgtttgagtccaaaagttgggactttatttacatattcggggtttgttacatattttacatatttcgacgttttatacttattttttacatattttgagcggaccgggtcagtttagtacggccggtttagtacggccgttttagtacggccgttttagtacgaggggtcggtttagtacgagggtcagtttagtacggcaagctgtttttgtccaaaatagattctactgattttttccgaaaaaatgtttaaaattaataacataacatatttattaatgtgttaacaacaaaaaaaaataacaagcattgaaaaattacgggcgcatttcataatttcgagaaataccaacctttggcataaaaatttgcaaacgttgacctttttagtcgcagctttggtcggaaaagcagccaacacgggggttgcagtgttctgcaatacctgcgcacggattgtagccggcgcttcgcacgtctcaactgcacgccgcttgagctgggttatacgtcgctgacactccacttgtgcggcactcatgtcgcatgtgtggcttccaattattttgaggacattaccattaatgtcagtgtgaaggcgccctgaatttgaaaaatagtttttattttattttatgcatttacctttgcatttgtcgttagctccgaaaaactcgcatcgccaatacttccgaagttcatcgtcactgagtttgtgaagaacataaagtgaaccctcatgttccagcttctccttgtttcgctttgtctttatttcctgattgggctgttccatttgtattgtagctaaacatagatattataagtttttccttctttataattgacaaaaaaacatttgtaacagttatggacaaaaacagcttgccgtactaaaccgaccctcgtactaaaacggccgtactaaaccggccgtactaaaccgaccccgaccg

SEQ ID NO: 15592 - DNA, 1466 bp, Heterodera glycines
ttatttcatatattttggcatttatgcccatattttgcgattttatatccatatttttgacagccctactgatcaccttaagcaataaacatcgaaagtaataaaaaattttatttttaagaagttaagtttccattgataaatatagtatgtagttgctcgttcttaatttcggatccatagttttataacagcaaattacggacaatgttagggaaaaaggtagaactattttgagttttttttaaatttaattgcttgtcatgcctgataaaaatttaagctctaggctaaccaaagcaatttatttttaatttttttttctttattacacagttcaactgagcaatagcggccgaaaaagtcggtccgcaaaagtcggtccgcaaaagtcggtccgcaaaagtcggtccgcaaaagtcggtccgcaaaagtcggtccgcaaaagtcggtccgcaaaagtcggtccgcataagtcggtccgcaaaagtcggtccgcaaaagtcggtccgcaaaagtcggtccgcataagtcggtccgcaaaagtcggtccgcaaaagtcggtccgcaaaagtcggtccgcaaaagtcggtccgcataagtcggtccgcaaaagtcggtccgcaaaagtcggtccgcaaaagtcggtccgcataagtcggtccgcaaaagtcggtccgcaaaagtcggtccgaaaaagtcggtccgcaaaagtcggtccgcaaaagtcggtccgcaaaagtcggtccgcaaaagtcggtccgcaaaagtcggtccgcaaaagtcggtccgcaaaagtctatccgcaaatgtcgcactacggattgggccctacaaaaaaattaaataaccaaaattgttttttggtgaatggaattaaggttgatgtttttcagggtcaagaatgacaatgaaaaatgctgcatgaataaaaaaaattgacaattcgcatgcgctagcgtttttggcatcggaaagagatggacaaaagtaatcaatcatatttaaaatcaaatatttttcgatttttgaacatttttctgaggatttttaaaaatatgaaaatatttatcaaaaaatgctaggtaaaaaattttaaatccttctgattatatgtaaattcatttgttaaccaatttcagtggcttaggcaaaaattttccattttttaaaattgaacaatttccatcagatactaattatcaagcaacgatcaattaagtgttttctgacaacaatgactctccaaattcgagtacgacttcaccccgaacttatttcacgcgctaattttgcttaaaaacattcagttcaacgtgatttaattttcacctcattaaatttagattgaaattggtgaaatgccggaccggcccgactcgcccccgtctctgctctgattctgatcaatcaatgatcacacgaagaaaacagaattctgtgtacgggggactaatcatttacaa

SEQ ID NO: 15593 - DNA, 1231 bp, Heterodera glycines
caacattgttggtataattcgaaagctcttcaaatgctctattatccttacaaaaagcgaaaagattttttcaagtctgtaaaaatttattaaggaaaaaccccaaaaatttcgatttttcgcaattttcatgtataacttttttggtaattgtctaatggcgaagcaatattttagaaaaaagcttcaaaatagattaaagcttcaaatgataacaaattttatttttcgtttcgtatttcgtttgcgtatcgaataatattcgcatttcgcgccaaaatgcgaaacacaaaagcgaaagtaacaaaaaaagcgaaatatgcgaaagcgaaagcccgtccctggtgtaaatgacaaaatttattcaaaaagacaacaaagttaagccaaaccagtagggcttctttttttaggcaaataattttctcaaaaaattcgtctccacaatttatttatttattttcataaaaatgcttgatttaaaatttgtcgttattcgaaaaaactaaaatattcgataatttcacggcaccaatgccacgcatagcaatttctttgaaactttaaataaacaaattcataaaattacgttttttaaaaaaccaatccaaatttttttataaaatttgaccaacaaaaaaaagataagatgttttatgtaggtaggtctggaccggggccaaaacgcggaccgggacagggaaattcccagcaaaaaagttccgggttttcaacccgaaaagtggtttaattctgttttcatgaatttttctaaaagttccgggttttcaacccaaaaagtccctgtctcggttttgcccaaaattcccggtcccgacctaacctagttttatgcttggctcagacgcaactgacccctaccgtcaagagctgtcgaataatacgaaatttgtccggattagaccattttaaaaggttagaagtgccccattctgttcaattcgaaccccgaacccggattcgaacaaaaagtcaaaattcattgttcaacaaaattcacattttatatacataatttttttaaatttacattttgaatttcatccaattttcgcagtcatttttcagtgccatttgattcgcatttggtgctcagttgcagcttaggaaagcaaatgagtgaccaaacaaatcatttgctaaatcattcctccatttcattacattcttttttagtggtcagtcaattcgctggcataacaaatttaat

SEQ ID NO: 15594 - DNA, 1332 bp, Heterodera glycines
gaagaggaacagaaagaggaacagaaagtggaagagaaagtggaagaggaacagaaagaggaagaggaacagaaaaagaaatagaacaggaacagaaagtggaagaggatcagaaagagaaacagaaattggaagaggaagagaaagtggaagaggaacagaaaggggaacaggaagagggacagaagaggaacagaaagaggaagagaaagtggaagaggaacagaaagtggaagagaaagtggaagaggaacagaaagtggaagaggaatagaaaggggaagaggaagtggaagaggaagaaaacagagaaacagaaagagcaacaaaggcaaagaggaagagaaaggaaatgggaaatggaagagaaagataaagaggaacagaaagaggaagagaaggtgaaagtggaagaggaagagaaaaagcaacaaagggaaagaggaaggaacaaaaagagaagagagcaagagaaagcgagagtgatgaagtgaaatgggaaggtagaaaggagggtgaaaggggatgagaaagaggaaaagtaagagattttaagtgatcatattaaaaatttgagttttaagaaaacgttaattgaattcccggccattaaaaaaatcacttgccttcatacatataaaagttttttggcgcgtagcgccctctagagactgttaaatagcgaagctatttcaatttaaaaaaaataaattaaaatcaatttaaataaaaatatcgcatttaaattaaatttaaaacaatatcgtttttaaattaatttttgttcatttccaaattctcatattcctaaactatgaggatcgcttagtggccaatagatgctttttgcacgccccaaattatatctcccactagagccagcgttgaaagcgcctccggcgctttcacagggcccgcagggccctggtttgaagccgaaagagtcgccgaagaaagcgaaggcgacgcaaaagcggaagaagaagaagacggaggagggaaaggcgagacggacgcattggcacctttgaaaacgaaaaaggcacttcaaaaaatgaatttaaaatttcaaactgcgcaaaaaagggacaatttgaagacaaaaagcaaaaacggaggggggggggggacactgaaaagaaaacttagtccaaccaacactaaggaatacggtataatgaattaggaaaaaatatgggatgacaaacagtagacatccttgttacggtacagtaccattggcacaaggaaatgttccgtggaagccggtcagcggtgggggtacggtaggtgttgtggactgaaacagtcactgactgatgccgacaagag

SEQ ID NO: 15595 - DNA, 1531 bp, Heterodera glycines
tcctccaccccctccccattccaatgttaatcagtcgttttttgcctttgtccctgccgacaaatgttccgttccgccgccggcaatttcacacacacacatacaacacaacgccaaccgagcagagagggagagggacagaggtgatgattaattggtcgtcgtcgttgtttttgtcgacaacgacgatgaacatgaacaacgattgacgaggggagagggagagatatgatcggatgatggagaggaggaggagggggtgatcagatgctggagatgctgatcggaggctcatcatccgacccagcgacgaccgatcagcagcctcatcctcttcatcatcggcgccaaacattgtcatcgcccccctccctgtgctactccgcctcggtggcgttgttgcccgtccatccgtcagtccgtccgttcccctcgccgcggctcggacgggttgcaatcggcggatcggccctttgaaatgatggttggcgagttaaaaaacattggaaaaaagcggcaaagaatgcacattatcgtaaacgagaccgaacgactgactactgctgctgctgactgactaattaacgaattaattaattaattgatgagagcaaaaaggagggtgggggacggagccgtcccatggcattccgtgcgctgtcctttttcggggcgctcgctcatcagtcacattttgggtgtcgatcgggttcagcggttcgcctccgccgagtgggacgaagggaccggaagggaaagaaagggacagcgaatgttgcgctttttgatcagtggaaaaatgggactgatcagagaagcggggacggagccgatcatgcaaacagatgctgatcagttgagcggagagagagagagagagaaagaaagagagggagagagaggggggggcggagagagagagagagagagagagagcgacgaggaaagagagagagagagagaaagaaagagagagagaggagaaagagagagagagagaagagagagagagagggggggggcggagagagagagagagagagaggagaggagaaaggggaatagagaggagagagtagaaagagagagagaggagagaggggaatagagagagaaagagagagagagaggagaggagaaaggggaatagagagagaaagagagagagagaggagaggagaaaggggaatagagagagaaagagagagagagaggagaggagagaggggaatagagagagaaagatggaggagagagagcgacaaggagagagaaagaaagagagagagaggagaaagagagagagagagaagagagagagagagaggggaatagagagagaaagagagagagaggagaggagaaaggggaatagagagagaaagagagagagagaggagaggagagaggggaatagagagagaaagatggaggagagagagcgacaaggagagagtagaaagagagagagaggagggcggagagagagagagaaagagaaagaaagagagaggggggcgaagagagagag

SEQ ID NO: 15596 - DNA, 1151 bp, Heterodera glycines
tcccctactaatttaccccctccccccatttcttgccaccaaaccgtttgagcaacagcagcagcagacaattattgagccaccaacaagagcaccgacaggccatcatcggagaggattcggcaccggcagctctccgaactgtccttgatggaacaggccaagccgctaccggaagacatcgaacattgcgccgagtacaacgcgcatggattgacggatgtcggctggcttctgcttggttggagggaacaaatggtgatatggtgatcagcgggcggcggtttctgggggggggggcataactttcaaatagctttttggtggtggtcaacagcgactaattttttccgcccttttttcagccgcttgaccggcgtggtcgcccagtcgtgcgtgatgggcgggccaaacgccaaatttcgaggccggaaattggtgctgcagttcgaccgcgacggatcgcagctcttgtccgtcaaggaatgggagcgcaatgatgggcgccccagcgaattggcacgcgcgcaaccgggtgaccgcgtgttgctgcaacgactgaacgtcacgcaaaacaagggcgcggccgtcacttcgcacgacaacacctttttattttcctgctccttcggacaattttccgtgttgcagatattggcgcacaccggaaatggtaataaaatgcccgggggtgggggggggaaaggggttaatttgtttgacaaaatgcagtggcaactttaaagaaaatttagaatggacaccgacgagtgctcgagtgttggggggccgcgttttggccatcaccgccgcgcaacaggaaggtcggttgggcggcggccatacccactttttcgggcgttcatttcaaaaaaaaaaaaaaatccaggaatgcagcgacagcagaagcagcacattttcggggccatgccagcacaacagcagcagcagcaaatggacgaaggcggaaacgccgaatgtggcgaatacgatgaggatttgcaagaaattccggcgccggtccaggaacaacagatgaacatggtgagctgagaaaaaaaaaagtcgcgcgcgccgcatcgatcacacaccccccacacacattcccccatgcttttatatattatgcccatccattattacatcatttt

SEQ ID NO: 15597 - DNA, 1307 bp, Heterodera glycines
acgcgcgtgccccaaaagtgattgagtcgcacgagggcgacaccaaagtgatcgggccactcgcgtacgacacaaatgtattcggaccgctcgcgtgtgactctaaagtgatctggccgcacgcgcgtgaacccaaagtgattggatcgcacgcgggcgacacaaaagtgaccggatcagacgcgggcgacccaaaactgacggggccgctcgcatgcgacctgaatgtgatcggaccgatcgcgtgcgacctgaatgtgatcggatcggacgcgggcgacccaaatgtaatcggggccgcccgcgtgcgacccccaatgtgatcgggccgctcgcgtgcgtcgcccaaaacttatatatggtcaagtgtcggtcacgcccgcacgcgtgcgaccaggcatacccgggtggcgcgattctcacgtaaacgagcgcgccaatggtcgggcatttgactgagccgcacgcgtgcgagcccgaaatgcatttcagcttcggagaagcgcccgactccaggcgcccgactaccgcccactgtaccgcgtcaaattccaccactcatcgacagcagacgacccggctgccgcacgccgcaagcagcagcgccgctcgcggcgacggcgtcgcgaacggcagcagcgtcgccggctgcgtacagaacacctgccgttttggcgactgctggccgtcactgctaacaacaatgccggagagccggcagaagacgacgcggactggacggcgttcggtgccgatcagatggctaccgcccgggacctgctccaggctgaggggcgtacgctcaacgactgggtgcagttcgacgaggcgtccgccgactgggtgcctctcaccctagcggagctgaagcagctgtcggacggagtgcatcgtggaagcgactcgacagcagcgggcgaccgcacgtgccccgtatgcctggaagatttggaaggcaaagtgctgctgcatacgggctgctgccaacaacagttttgcgccgcatgcctgtggatgcacgcgggtgcttcccgctgctgtccgctgtgccgacggcatctgctgagcggtgccccgctggcgccggaggaggacgcctcggacagcgactcagtggccagtgatgaggcccataacgacgacgacgacgatatggtcgtacagtcaacttcagctggacgacgacgacgacgacagaggcgcagcggggggcggacgggtcccagctgctcgggcttcggctcctttggcccgccgtcgtcggacagcacaaaaggctcctttgtggagttggctgcgggagtgat

SEQ ID NO: 15598 - DNA, 1551 bp, Heterodera glycines
  misc_feature (1514)..(1514): n is a, c, g, or t
cacattttatcacttctcatatttcccatgaccaaataggggctgaaatttttttcagaacttgggaatcgggcccgggataggattaacagtgccgggatcttgaaccgaagtcgtgatcagtatcactattttggaaccgggccagggaaagattaccggtgccgggattttgaacaccaaatcaggatcaggatttgggaaatatttcaaggacgtgttgttttccggcattcaaatcccagttttaccgggaacctgaaaccaattctgggtcagtatcccgggaaaatcgcgacagttaagtgcctgatcctgtcctttctcgaatgaaaattatttatttaaaattttcaatttgttaggatgtggcattggagctgatgaaattgttgtcattccattgtcatgaattgaacgatgtttttacattttttcattttttattccttctttttaacttttatgcatttttgagggcttgaagaaaggggctcaaaaatagcatttctgtattagaggttcttagtgcatataaaagcatattttgaggttttcgagaataaatgcatattttgccatttttgtgtttttagagcatattttgggcatttttggcaaattttcacaagaaaagtgcaaaaaaagctaaaaatatacccccctaatggtcaactttttgggaatttttgaaatatacaccccttaaaaatcgaaaaattttgaattttttgtaagaactcttgaaaaaatttaaacaaaattttttttgcaattgtctaaaaaacttccttagccattgttttgttgtttttaaagacaattcagtatttttacacaatttttggcattttttgagggttaagttaaaagccttttttggcagtttttaaggcatattttagtgcataaggcaaggcatgtcgatattcatttgtttttattcaaaaaaaataggaattttttggaaacttattctttttaaaaatcaacatttttcacaaattttattcatttagatgggcaaaaccaagatcaaactcgaccatccaatggtaatatgaaaaatgaatttaattttgaaaaaatttttttttgttttaataaataataaaattttaatttttgcaacttttctttttctaatttctttaacaaccagacagtttttttcacaattttattcttttagctggacaaaaccaagatcaaaatccatccacctatggtaaggtgtaaatgcattatctttcctaatctgacggcataatgatagtcaaaaaactttcgctaattattcaagcccggcgggacccctactcccacagaaagttggaaattggcattgtttagcacatataaatccgttctttgattattattcaaaattcaattggaaaaccttttctgctgattttggcgataaaccatggcttagatttgttcttacaaatgctgggcgatatgggtcaaaattaggacccgcttatttaccgtaaaatgaaaataattanaatacaaaaaataagtcatatattataatattatatc

SEQ ID NO: 15599 - DNA, 980 bp, Heterodera glycines
ttcaaaaaatagattttagcaaaaaattcatttaaaatttacttgtttaattgtacatgatttatgcatctcccgcatctcttcttgttaaatgatttaatcatcatgctttttgttacaaaaacttttttaccacacacaaaaaatttattggtgaaaatcaattttttgaaaaatttaaaaagtaaaatagtggtaaagcgtgtgccgaattcaatttattttcccagtttaaactggttcaaaaatcggtttaatgacctttctgcaattggagacctaattttccttgcttaactactcgaatcaacacgtttggtacatatcactggtgccattttttgtgtaggaacttcaagacatcaggcgggagcggtacattggacacctgaaaattggatataaattcctctgttaaaaataatcgtgtaattagacgaaaaataaatttaatggattaatgaatattttttaaatctgtttttgaatttttttgtgatgtttttaagctgttgtaaaaacttatcttatgaaagattacgggtatttataaattaatgcagttaataatgaatactttgggtcttttattgtttagatatattatacatatgaaaattagttaatattgccctaatttatttaaactttcctaattttttaatagacacaaatatttttggtattattggagtttttaataaatcattcatttaaatttatttttcttaacagttaaataatggctattttttatttttggtccttaatttaattttaattttagtttatgttttcattttttcatttgttataaaaaaaatttattttttatgaatgatttctttggcttcacattacatttattcgttgatcgccacgatactatttattttgccatcaattgcatagattttgactaaaaaataaccaaatttagagatttttgggtaattgttaagaaaaaaaaagtttttttt

SEQ ID NO: 15600 - DNA, 3930 bp, Heterodera glycines
  misc_feature (3867)..(3867): n is a, c, g, or t
  misc_feature (3889)..(3889): n is a, c, g, or t
ttcttttagttgatgaatagtaaaaataaatttaagattattctggtttcttatattttcaaaaattgaatttactttcgcctttaaaaacgaaaaaagcaacgccctaagaaccgacctaaatatttttcaaaactttacccttaattagaattccgcttgcaattgaaataggaaaatttgtctttttggggtaatttgcagcctaattgtttaaaaaattattgcatatttttgtggttatttgacggttttgtgactagatatttcatacgtaattctcgttctttgcctcttcatgtacttattctggaatttttgtacctaaaaatcactcttaattactactaatacttttatatttgaaatattaaatatgaattaaaagaatttattttaaaattataaaataaaaaaaatagttgataaattattgaataatgtaaaagtatagttaacatttaattagcattctacagggaatgtatttccggaatttcagcttttaagttacggaattttcagatttttataaatatttcgaaacaacaagaaatttattcaaaaaatggtaaattttatttccacgccaaaatcgccaatttctttactttatttttaaattcctgttttggtgatttgaaaaaattgtttttttattataaattataatggacaaaatggcgaaataccacaaagaaaacacatgccaagtcgaattaatatttattcaaaaagccaatcgatcgaacatttacagtaccggaaaaaagtttctgcgcctaaagaaaaaaatttgactctctaatctaagagcacagaaataatttaagcttatagctaactttttattctaaccaaaattcttttgcaccaacttgatcagaccactcttttcatggtaatgaaaatacactgaaaatcggaaaaattatgaaaaaattcaaagttcctctatcgaattgccttttgaaggttcagagacgcggaagagagcgaaaagtggcggacgacgctcgaaattttatcttttgtttggctgacgaaaaaaaataatttttttaaaatgtaaactaaaatttagcagtatacaaaaagattaaaatttaaaaatataggaaaattgtcatttataaatgaagaatatatatagaagagaaccagaaaataaactaacatctccagaattgcaacttctattcgaactattttaaaatttattgtacaagtggctcccggacatttcgacaatgaccgtttcgacaataccttttcgacaataaaattaaatatatttttttaaataaaattcaaatttctgcaaaattatatggacggtgcggatttgggatcaatataaaaaagtttttttttcgtttttttcaaaatagcattatgagaatggctttagtttgccaattttcggcgcaaattgcttattttttttaattaaaaattgaaacattgttttacacctaaatagttgataatgaattagaagcttttaccctgaaaaaactattcttgattaaaaaaacaatttttttttgttcgaattcgggtctggagttcggaattgggcaaacccgagttaagatccgttatcagcaccctcaaaaacgcctaaaaactggttttgagcacaaaattaaaaaaaaatgaaaattagggacaaccattcttcaggattgccgcctgggtaaaaagaggacactacattaagttaaataaatggtttcattttggatttatattataggtccgtctcattttgtcttctttcttcactattaatagggctcggatttttaggtgctaaaaatccctaaataggtactaaaataggtgctaaaaaagtgcaaaataggtgctaaaaaccccaaaaaaggccaaaataggtgcgaaaataggtgttaaaaattgaaaaaatctagaaataggtaaaaacctaaaaatccgactcctaactattaataatcatacacaataggcgatagataatgcattcattaaattttaaaaatataactacctaattaaatttttctctttaaatttcatcaatatttttttaaattaatttattattttttatattcattttattatatttaatttgatattttaaattttggcgatatgatatagtcgtaaatggtcattgtcgaaacggtcattggcgaaacggtcattgtcgaaatgtccagccaccaacccaggtgctctattcactcaaccaagtttaatttggaaatcccacggtattttaaatataaaatttagatgtttttttcaaaaagtcattaacagggatcatttaccgtatttgctctttttatgtgccagtctccattaaactgccggtctccaattatgtacccctttctgaggaggttgaaaaataatctaccagtctccatttatgtgccaggggggataaatagaatttttaaataatttgtttggcacattttccaaaaaaaatcaattcaacagtaaaaggggctaataaatgaacaattcgttgtcatctccgactccatccagccctgcatcatcattagagtagggtcgctacttttagtgacggaaaatctcgaaatagttaactaaaatagtgagtaaaaattccaaaatagtggcaaaaagtccgaaatagtgacgaatagtgacctaattttcagtcaaaaattaagccaaaataattttattcactaattggagttgcaaatgaggtacttttcctttgaactattcccttatcaaaatactgaacatttttaatcaaaatttgtcaagaaaaaaaaattgtgggaagaatttttaagaaaattttccaattcttagtggtatttttgaaaaattttttagaccgattctcaggggtgcattttttgaaaaaatgtttaggtcgtttcttaggggtgtatttttttggttttattgcatttttgttaaggaattttcctaaaaatgtcgaaatagtaaattttcactattttagtacgaagcgccaaaataggtagtgatttctagtgcccgatagtgacatcagaatcgaaaaatttcaacgaaaaaatacgttttttgagctcctttcttcaaaacaattgagcaaaaaaattcgttaaatcactaaatgtagcgacactaatcatcagaaaagccaaaaaaaaactaaaaacttttaaaattaaaattaatatttaaaaaaataaaaaaaggcttcttcgtgatcgtttcgtctaactttcaccattaaaaattccaatttttatgcataccggaagcaagaaaatgatagatttttgtcattttggagtcattttcagaagttctttaacataaatgcaataaaaatgtttttttttgacgcgatgacattttttggcgacatgttcaaaataaatttcaaaaattttccactaaataaatcatcgaaaaataatctcccagtctccattagtctaccaatctccaattatctacccccttctgaggaggttgaaaaataatataccatggcatataaaaagagcaaatacggtaatcacaatgcaattaatagtagcggcaatttctttgcaagtcagccattcttcaaccagcagtcaaacttttcaagtgtccaaatccctgtgcttgatagttcggatccaagtcgaactcatgtgcaacacacccaaaccctgagccaagaatttcttagcattggtaacaatagaaaaagcaacaaatttggcagccaacaaccaattagcaacaaatcaaaccaatttggttcttcttctttctctgcaaaagataaggggaaaaagccaatgtattcaaataaacctccgcttcctcctgtctcttattcagatngaaaagtttatgaaaatgattncaccgaactcattgatgcagtttacagattgacagggggag

SEQ ID NO: 15601 - DNA, 1677 bp, Heterodera glycines
aggccgcgcccttatgataccattcgacttctctcagtgaatgagaggaatcgattttattaataaaatcgtgggtgtcactattcttgacttttaccgaagcaaataatgagaaagaacagactttccgaaactggcagacgggcaaaggcgtccttggccctgtcgggaaagtccttctgattcgtgacttgtttgcgcattttccatcgatgatggtttgccgaaacgacgctgcccaatttttgtttgtcgttgtgcggcagaatggggcacgttgaaactgtgcgaggaaagctcgtgccgaggtgccgcctttcgcgtgtttcgctgtggcgtgtgactttgacgacgcaatgattgatggaacacatcggattggggtctctgaagaatgccaatcaaaaaaacgaagggatgacaaaaattagcttaaaaaaattcttttcaattaaataaagatgtgtgttaaaaattgagcatcctaaatgtttgttaaaatataaatttcgacaaatatttttacggcttattttgacaaaaaaatttatctctttccgatagaccttattttcaaagttaattagactaatccttggagagaattggatagacgacggtggcgcatgatcaaaagcgactgcatttgtaggaaaatgtgattctttatctgaattgttaatgtctaattattaaatccataaacataaatttgcctgtacagtgtgttgaagggatttttggtggactttcacgcttggcataaactccactgaattgagagttcaaacatttaggaatttaatccaagaggcgaagcttacggtgtcccttcaaattgtaatggaagtgcagaagatccatacatttttttagcaaacattttattttaatcataaataaacgatgaaacgaaacggactttcaattcttttaaattaccaatcagtaatttatagtaaaaaagtttaataaataagcttgttgttttattaaaagcctgtgtattttttagaaagtaaaaatttaatttttgaggaaatgttttcaaaattatttgattgttgttttgaaaatatctcactcgttcgaccaaaatgtgaaaaatctgtgtcagaacccggtattacgaactctgacaacactttattaactcttggcgaggtggcgaggtcaagcagcttcctgctgttttacataatatcaagcgcaacaccacccaatccaacatttttacactctcttcaaaaggttatcagtgccaaatcacatcaatctgcagatgaatcaaagaaaaattggttatttaatgtttcgtttttttttattttttggttttttagctctccagcaaaattgaaacgcttattcaaattcagcaaccaatctaagaaaaatagtaatgagcaacagcagatttgtgccaagtcgaagcggttggaggtggttgttgtcgacgtaaataatgagccggtcgaagaaaaccttgcatttgtttctgagttggccctgttgtactgtccgcctcagccctatatggttaaggtgttttcaggaaaaggtccatgtcatgcctttctcatacttttctttagtctcgtcttcttcgttccctgaatttcggaaatgctccgtcgcttttcggtgtcgattggggcgatttttctgtgttggccc

SEQ ID NO: 15602 - DNA, 2347 bp, Heterodera glycines
ccttggcttgcgttttccatatggtgacgaaaaactcattcaaaaaattgcgaaggcttacgacatttgcggtgtgttagaaatgattttaaatgtcaagtgattatgttacttatatttcctcggattcgagtcggggttcattgttcgcaattgacacaaatgaattttatttggtcaatccgaaactcctgaccaacgaaatatcccttacacaactaggaacccaaaccaatcaagcacatttgtgcatgcattttatttgaaggcattccttcatttattctcgtcgatgagaacttttcactgctaacgcgaaacgggcgaagcgtttgtttgtcggacccccacggatatccctggagaagaaaggcactctacgaactcactgagcatactgtccaccgcttatcggaaatgccttcgctcattctcttcacgggtatcgaaaagggggaacagtgacgtactctcagaatttaggaagcatcgctgatcacgaatctgacatccatttcgaccaaattcgaatcccgaacccgtattcgaacaaatattcaaaaaatcattttatggtgcgaaaataactcgaataagggttcgggattcgaatttggcagaaatagatgtcagattcatgattagcgaccccgaaacccctagaaattttttatatgatttaaaaaataaatttatttttttatggtcgtatagtgcataacacaccgagtcaaaaaacgagacatgtgtcaataaatagagagtgcagagaaaaaaacatctctctttttggcgtactatttctttatctctgttaatagagaaaaaccgaatttacttctctctaagaaactttttttcccgttaacagattttcttcaaattttgcatatcgatagagaaaaaaattcttcatttttctatgctgatttattaattgtctatgctcaagttcaaaacttgcaagtttagaacacccatatattttttctaactcaccaaactgttcaacatttgcttagaaaaagcttctcctcatcaagagcttttgaatgataccaagatctttcaatttagttggcaaaaagcttccaaaataatttccgaaaatctattttttaaattttttggacaaaaataaataaaaatattcatgttgcacaacggactcgaaccaccaccaccctttgtccctttactatcttacaaaaaccacttcgccacatatgcatttactttttgaactagtggctcaaaattgactcggtgtgataagtaccaaaaatgggactgatttggaacatggtaacaaaaaatcccatcacattcagaagggtcggccgaggacatcgaattttcttgccaaattctcagtccttgtgccgagtcggttttcactcaacagaatgagtcaccgcaaatcgccgcctctttgcctgccaaattagaggacgcgaggtcatcagcatttattaaatttttgtttctttattacgtccggtctacagtttgctctcatttttgaattttatttttcagttctgtcaactcggacaaatcagtactgccactcgttgatgacccattgcagtttttttacacgggcgaagacccaatttgtgatcatgtgagtgtccatacacacttttccaattggatttctcccaaagaaatcccctgtagatattggatagcttgtgtcaggaacaagccgacctacccctgttgctcatctgcgaccctttggccggccattttgtcgtctgtgaccgaccagaagttagtgaaccaattgttttggcatttgtctcggactatcgcaacggacgcgccaatgtgttgtctattcctgacaataaacggcagttgaaggtggagttggggacggatagtcacaggacttaggcacggaaaagggagaccgcttcggacgaagattatataataaaaattttctggaggaaacggcggggacttacaattagtggaccggggaatgtacgtccccctctgaaaccgtccctgggtgtaactgctattatataaccctttattattgcttttagcatcagcggactgtcggaggcattcccgtccaacttttggagccgtttctcccttcaaattgccaccaacaacagcagcaaaagatggaattcaccaaaagtgcttaagctttcatgtcacttggaatctctcactttttaatatgctttttctttttttatcatttatttcatttgtctgcctatttttatatttaatgggtgaataaattggactttctgtttttccaatttttgctcgtcatccgtggcacttcgcaaatgctgcccattgaggggat

SEQ ID NO: 15603 - DNA, 1999 bp, Heterodera glycines
aaatatgagtgactccccaattttgagaaaccaaaattattaaatgataattaattaaaaaattaattaatataatcattaagacgttattattatgttaatctaatcgtatctttcataatgttcttacatttattcttcatccgatgctcaaattcgatttcggtgtgtctttcgcttttcgcttacattttcaattagtccaccattttttgtcccttttttaatcattcgccccttacagtaattttttttaaagtgcgcattgcatttctgctgctgctgcttcactaattgcttcgtgtttgttgagctgtcaagaacagaaataggaaaggaaagacaattccaaaacccccggggggagggaaaatcgaacgaattgaaaaagttgggatgagtcagtcactcattgacaaatgagatgattgtccccttcttcactgcttcattcccaacattcattcattcttcacgggccgtcaaaacaaaagaaaaatgaagttcttaaaccccattttaaacgaaagcttaatcaattaatttgactattttgataatcttcctcagaccatgtgacaatttggccgttcgtcctccaaatgaggcaccccttcgttttttggcactcgctgttcctcgtctctctgatcattttcatcgctttaatcactttctttcgcagaaatcaatggtcacacaaagagtctaacaaccgtgacgatgaaaagagcgttgatcacttcccccacaaaatgatcacttccttaaaaggtgaactcccaaatgccaatcagtgtttgcttttgcccttccgttttttaggggttcggcttgagttggcttggaaagtgaattggacagggcgggcacgggtcgacttccaagtcacattcagcggaagaccgagcagcattttggtcggcttttccgaccatggcaaaatcgaagggagcgatttttgcctttattggccaaatcggagccgaaaagtaaggggaggagaaggggagagagggagaaaggaggtgaaaggcactttgaacagctaatggatggatgggtggacagaaggtggaagttgcgcagggatatgcagcagaattgcgaactgatcagcacgggcacaaatcgaattgaatttggtagaaagttggtcacttgtgacccccgggactatcgcattgaggcaaattcatttggcacacaatgccttcctaagagcaattttttcacttttaagaagggaaccagcaacattctattggccgttggaactcgtaaacgcacaaaatcattggccgacccgaacatggcctatcaaatgcgcttcactcagctgttagtggataaagatgaaagtgatgctgaaaatagccatttgggtgggacggcagcagaaaaatcgcataatttgtttacatgggacattcgggcacaaaatgtgaccattccggcacaagtgaccacttattggtgtgccatcgttgaattgagtgaaactctgaagaggcacaagcaccatgcgatcaaagtcagtaataataggaagagggaaaatgggagcggaaaaaagagagggtgagaggggaagagggaatggaagtgtgagagggagagggagagagaggaaagggaaaagagaggggagagggaatggaagtgtgagagggagagggagagagaggaaagggaaaagagaggggagagggaggggagaagagaagagggagggagagggagagagaggaaagggaaaagagaggggagagggaggggagaagagaagagggagggagagggagagagaggaaggggaaaagagagagagggagaaaagtgagagagtgagcgatactggaactatcgaccaagcattgaccagttacaattttaatccagtacgaagcggtcatttagcccgggaatgccaaaattgtgcatcatttcgaagtttagaaggccaacaagagactcgtccatttgcgggcgattgcag

SEQ ID NO: 15604 - DNA, 1396 bp, Heterodera glycines
gaaagacaaatttgaaaaagggccattcaccgtagattgatttactcagatgcgaattccattccacccgatcagccacatttcccgatcactgggttttgtccggcagaatgcacacaaaaagtgaacagcgagtgccaaaaaatacactgaaattgctctttttccgctcagtttcccatcgatggcatttacatttttgcttcacaattgcactcccatttgacggggcgaaagttgcacagttcggtgatcagaggagggagcaaagtgacggagatcaaccgggacgaccactactcaccccattggcagcacatccgatcacttcggccttttgtgcatgttcgacggggcgatgtgatcagcaccacttgtgtgtatgagacacgggggatgaaacattggacatgggtgagaacaaaagggaaaagggaagaaaaacagtgatggcacacatactgtaatttgaagggcggatacggtattgaggacgaaatgtgcgtcaactacgttcactattacccggcatcggaagtgaattttgacaaattaatttttatttttctcaacttttcaggtcgaagtttgtaaggtaaaaatggaaataatattattattaaatattttaaaaagatattttaaaatactataaatattttcgcttttttcagtccgccgtttccaatgcgtctctccacgcgttcttcgcgcgactgtgaattttttttttttacaatattttcaaactcaatttttctttctctctcccaaaggggcgtcaaaaataagcagatgaatatccacgagaagtattcggcggttaaatgggtgagaagaataaacaaattggcagtttatcatttaccgttaattggacggaattgggaaaggaattgctgaaaggcctattatatgcgtaattaataaactcaattttgggatatttgtttgtttcttgttgtattccaaccccacttcagacaatggctaagttcgccgcgttgcgcgaattgtacgccgttgcctcgctgaacgtcgcctgtctccaacattcgggcgaccttttccccgtaaaaataatcagtgggggcagacgaggattaattaatttattattgcatttgattaatggtaagataaccaaccgactgtccatttacagggccaccccacaaattggagtcgcgtgccgaggcccgagtacggcacggaatcgtcgacaaacgaagggcaagcgaacggcgacgaatgtttggcactgaacgactgacttttgtccctttatccttctttttccttctttaaccttttatcgttctttatccttcctctgttgtccatcccctgactttccatttgcccttttcctttcttatcgttttgctttgtttgt

SEQ ID NO: 15605 - DNA, 845 bp, Heterodera glycines
ttttttgggaaaaaattctttctaaagggtgaaatatgcacaaattgtcataaaatgacctaaatagactagaatcatcttttagtatttaaaaaaaaaaaatatatatattttttggagcacactttcaaaaaaaagaaaattatttttttggagcacattttcacaaaaaatactataaattctcaaaatttttgaaaaaattgcgaaattttggatatttttgggggcatttaataaaaaattccttaaaaattctcaaaaaatgcaaaatatgtacgaaaaaatgcgaaaaagtccaaaatatgtataaaaattgtagaaaaatcccaaaatatgtaaataaaagtcccaacttttgttcgcaaacacaaaaaaagaaagtttttttcccactatttagagcaaggagaagccaggaaaaaaatatgtatttacataaaaatggaagccctggaactaacaacatagaaaaaccctgtattatttggaaaaaaaataaaatcaaaagaaaacgtcaaccggtgtcgaactcataacaaaaagtattgttaatgttgaagcactaaccactaaaccacaaatattctaaaaaatataagcaaatttactttatttcataaaaatttttaaaagatggttaaaaaaaattcaaaattgtataaatttttacctttaattccacgaatatgccattcttaggggtgtgtttttcacccccgtgcccccgcgggggcgaaggtcgcgcgggggcgggggttgcgggggtctgagtcgcggggacgggggtgaggccaaaaaacctgtcccgcccccggggggggggggcgggtgtccgaacccta

SEQ ID NO: 15606 - DNA, 1849 bp, Heterodera glycines
tttatgccccccccccccccgccggacggaggggaggggaaagggggccccattttctgggggtgtaatcttttgtattgaccgaaaggaaaaaagaaggggggggggatgtcccccaaaggaattgatgcacaaaatgttgccggccatttcgcttcgggcgtttgcttcggccgaggagcggtcaacatgtgcgaagttggctttgttgatctacccttttgacaaagtaatttggggcgggggtgaaatgatggacaaaagttttgatgaataattgtagggctaaacttttcatccggctctgatcacaactttttcttttgatcaaatatttttattaatattatttttcattcataaaattatttgtttttatcaatatgacttactccccctctaaattcccatgggtcctcgtcccgaactgtgtttgtccaaatttggacaacgaatgtttgcgtcccgccccatacacccgcccaattctttgcgtaaataaagtgataaaaaatatcacatactttttggccactggcggagaattggagcagggtgaaaatgcatttatttattgatattaattattaataattaaggcggtagctcttctccaagtgcaggcggttgctcaccgccgttggccattgcactgtacgtctgctccatgtttttgattgtaagtctcgtcacggcggtcaattctcgattttatctacagtatacttttttcagctcatcctcttttacgtggcctttcgttgtgctcgcgggcgcaacaacgagtacattttggccaacaatggacccgtgcgtttggcccgcgctattgcgcctcgaggtggggtagggggggggggaagggattaccctcttaattatagtaattaaaatttgtaatcattttcaagtggcttttcgtcgtcagcaccccgagcctttggcgattgccgtgcgccgtcgcgcgcctgcggtaaaataataagaatgtggggatgtaatttatgaaaataattcttgaaaattacaggcgccctgatgtgtcggacggaaggaaggggcgtgaaaagaatgaatgactaatgaaaattaacattaacaataatataattgatcttttcagattttgatcttttacataattttaatttgggattcttttaattgggtcaataaattgcacatatatattatttattggctgtgcgttccatcaaaacaatccattttagtggcgggatttgtatgtaggtcaagaatttgtgcgggatttgatgggttaatgtgataaacagaatgggtgtatttaacgcaaatggactatcccgagttcatcagtcgcaatttcacttaaataaatttttataaaattaaaaaataattttcacatatccttttgcctaatttaaattaaaaatataatgtcaataaatatacaaaattttcaccccagtttttttaagcctaaattttctcaccttatccattgctgtataaaatgtccaacggtactcaaagcatttcagcggatgcagatggacctgaaatgccggatgagcgccaactctggttggaaatgtttgagagcggtgactatgaagtgaagccgcgctaatttattttttctgaacacatttcatcattccctcagctcctcagctggtttggtcgtgaccgggccaagcaaatcatggaggatctgcgcaagtttgccgaagagacgggccgagaatgcacccatgtgaaaatgttgttggacaagatcaatcgcggaatgattaatgggaagaaagagggtgaataatatgcggaaaagcatttttgttgatgatgataatgttgcaattcc

SEQ ID NO: 15607 - DNA, 1597 bp, Heterodera glycines
cccccccccgccatttaagctaccgtaattcggaaaaggaagaggaaaatgcatttgaattttgaacattaaatttttaattgccgttttagttcatttatgtatgtaaatttcctaaggaatgatttctccattttaaaatacttgagcaaggtttatggccggaagccacggcttttccagaccccgaatccggcttaaaacccgggttttttcgggtccctgtccttgattgaaagttgtagtctgatcccgacttcaggtttccaaatcccaattcctcaaccctatgtctgttacggcacacaacaccatagtaaattggcggcggcacattgccaaacatattttttttttcaatttaaatttttatatatgtagagaaatttaaaaaatgaattcacttaagaattcgcaatttaggaatggttttaaaaaatatttaatgttaagtaatttttttttttaaaaataaaattttccaaaaagccttttaggaaacaaaaatgaattcgaaccctactcaaaaattttgtctaatttctcggctttatgctttagttaacataaaattttccaccctcccccctcttaaaattttttttgttagtttttcgtcttggcaaatcgattttattttgtgggtggggcgaaattaattcagcagagagcagcgataaacccaataaatgtgaatggatgacccattttttattcattctttattcacatttattatttattcaatgatttaatggatttatttttacattttttattgtggcaattaaaattttcaattaatttcaacaaaaattcatatttcactgcccattttcagcagaccactcttaattatatttggttgtgttgatttacatatgttttttatttccaaattttgggcccattaaaagtaattaattaattaaattttccctatttttaataattttttttgttttcaaaaaatttaaattttaaaaatgttgcgctctcttttaattttcaatttttatcccttacggaaaattttttttttaattttcatattttcgcaccctaactcaaaaaatttaaaattttttcccaccctaattttgtcctttcatttatcttttgaattttttttatatttcttcccctctccgcgctgtgcttggcctcttatcatcaatttttgatttttcattgaaataatttggcgtttcgtccccacccctctcaattttttttcttccgatgctgctgttacgtcatgactgacactgctgctaatttttaagatgatgagatgagttttggttaatgaactctgctgttccccctattccccgctttcccctccggggattttccctcgtttttcctccagggattcccccccccccgggagggatcgattaatagattaaattgaaaagtgtcaccgagtatggcgacttactcatcatccctaagggaatcacacatcgaatgaccacaacgtcgaaagcaaaactaaggcaaagcgtgcggcaggggagagggcacgtcatattaatttggaaattaagatttgaaaagaaatgcgattttagaggaactactgatcgac

SEQ ID NO: 15608 - DNA, 2254 bp, Heterodera glycines
  misc_feature (2221)..(2221): n is a, c, g, or t
tcaaagtctctgtctcatttcttgacccgattttctgatactttggatatcgacgacctcgactctcataattgttaatctcgactctcgacaccaattctcaggctcgactcttggcaccaattttctcgggcttgactctcgaaggaaattctcgaccatgagtcatggggttggttcctcagtattgagtctttgattcaatcttggtctcgattctcggggttaattctggacccgagactcttggcatcaatttttaggcttgactctcgaaggaaatctcgaccatgagtcactaggttagttcgtcggtcttgaatattggattaattctctggactttcaaaggaaattctcggtcattagtcatggggttaattggtttgtcggtcttgagtcttggatttaattctcgatctcggctcaactttctgcaatcattttgtcggtcacaataatttttgaattttgttcttgtcgttcggcttcgagtcgagaaaagctattaaatctcgggatttttggtttttcgataacagctttactaattatgtcccccaaaaaattcctccattctaattaaccctccgcctatcacattcgttcattaatcagtcctcgtgtcagcagagcaccctcgtacccctgatgctggtccccatactcattctcggcccaagattgatatccggggacggcggggtgcttaggcacacatttaatccgccccctctccccctcccccgccggggccaaccggataaacccgccactttaatccccccgcttcactggggcgaaattgtttttgcccctctcctcccccgagggggctttgaaccaaaaaattttattggaatgatttgcatagctaagctaaacactacaaaaaattgattgcgaaaaataagaatcggggaaagggggggggcgataaagaggaaaaaacctttataagtcgtaaaaaatttttaaattttactaccaaatttaaattaaaacccggggagagcggggggataacgaggagagagccttcgcatgccttcaaaaatttttaaaattttattaaaatccaaaaaatttaaaattaaaacccctccggcattcgacccacaaaatatatatacttaaaagtcggcttatgtgaggggatgaattttgttggtcggcttacttttgacctgattatgaaatcgcgtttcgctggctatcaataaatttggttaattatgcaaattaatcttttttaaattattgtgccacaaaaaattatttaagcatcattgaaacaatggcaaacatttttcgtacaatggacctatttttcttatgcaattgaaccctctccatttttcgaataattttttttttgccgaaaatttttgcttgaaaagcgtagcagcccccctaatttctagccaattaaattttgtctctaattaccaatttgccctaattgtttccatgtcgttaagccgttgtgcctgcccctgctttttgcacttaaaatcgcacagtacaaagtgatgctaacgatgattatgttaaagctgcttttgcttctccaaaacatacataaatttcccacttttgccattcttggccattaaaattcgcaatttttttgctcaattttggcccattttaaaatagttaacccttttttaaatttttttatgactaaatttttaatatttttccataatctataatttttttaaagttttcatttgtgtaagcatttcgtttttttttaaatttaatcctcaaaattctgcaaatcattcatttttaaaacccttaattatttttagcgtccaaattttatgtaaaatgtcattttttagattttcttttatttttaagatatatattttttattttttctaagatttttattttataacctttttatgaaattgcaattcaaaccatttatcttaattaaaaaatatttttatttaaaaattatttttttttttgttttttccatttaaattccctccaataattttcccatatttttgaattgtatcgatttcattttaatcaatcaatcatttatctgaaatgttgaaaatctttcattttttaatttccaaattttaccgtattacccctctttcatttgcttcgtcattaccgtaattagctagttaatttgccactccaattatatccaaaattccgtttagctttttgcctactgagctgntaaagcactaaaatatattttttgacttctaga

SEQ ID NO: 15609 - DNA, 1926 bp, Heterodera glycines
ttttcatttcctgtttattaaataaaaattcaaatttgaatttttagaaaaatataaaacttgccttaatttttttttccaatgtatttattttaatttcctcaaaatgaaaattggagcgccaaagaaaaaaattgcaacaaaaaaccatttaaagaaatatttggagaaaaatgggaggaaaaagaaaatgaacagaaaaagagagaaattgttgaaaaattcacacaaaattaaagcgaaaatcaaacaaaaagagagaaaatattcagcaaaagaatggaataaaattgaattgaaaatcggaaaaaaattgggcacaaatcgaaacaaaatttacaaatggatcaaagaattaggattatacaaatgccataacaaatcaaaaacggatgtacaaaaaattgaaattgtgcaaaaatttaatgcaatgaaaaatgaatataagcaaaaaggaagaaaatattcgagaaaagaatggcaccaaaattatgccgaaattgggaagaaaattggagtaaattatggaacaattcaaaaatggaagaaacaatttggaatgaatggaaaaagaataactgaaaaagagaaaatggaaaaaatgaaaatgtattggcaaatgaaaggagaaaatccaaaaatgagtgacgagaaaatttcaaaaatattgaaaattagtcaatggaccattttcaattggaagaaacaatttgagaagaattaaatgaggattaaaatattattgagataaaattgcattttccatttcttagagcctatttttggggatttttaagacatatagcctaaagctacctttcgagttattagtgtctatttcctaagcttttatttttagacctaaaagcctaaagaatttttgaaagaacctatttttgcctattggcgttttgtcgaaatttattaacaaaaatgcaataaaaaccaaaaataccttccctaagaatcggcccgaaaatttctgaaaatacaccccttaataaatgaaaattttctcaaaaaatcatctccaatatttattttattttcattacaagtttggtcttttaaattattttctcaataatgatttgaattcattttgttactttttcgaatagcttttcattttaggccactaaatttcaaactagttttgctttgcttttttatgtctggcattttgtaatatattttttaaaaatctttcgggagttaaagctggaacataaaataaaacgccaaatattttttcccctttttatgttccattatttatttctatgggtgccaaaaaaatatgtacaaaaagtggtcaaaatcgtgctgagccgagcctaaaaagtatcaatgattgaaatatttaaattaaattattatttaaatttatttgctaaagaatgactcataacttagcttaaacttagttaaattaatcaatcttgttattggtcgatggctctatgtattctcttcaatattatgtagttaaaaaatctagcaaaaatttttacaaaaagttgtaactaaaaattttgtaaaaatttagactcaataattttgttcctaattttttaaaactcattaaaaaaattttaatttaacaggattatatagaatctttgggctatctagtcatattaaagtaatatgaatgaattgcagtttgaacactatttacatgcattaaaagaccttacatttttgtatgaccataaaaatatgacgactcatttcattccttagtaacttttttttaagaaacaaccaattaaaattttagttatatgattagatagcccaaagatttatctataattctgttaaattaaaattttttaataaggtttaaaaaagttagttccaaaattattgagtctccattaaaggaaatttttaattacaacttttgtaaaaatttttgct

SEQ ID NO: 15610 - DNA, 2246 bp, Heterodera glycines
ttgtatggtgattggcacaacccaaggccgatggtggaagatcccggtcacaatcaatggcttaaatttgaagatgaatagagacagtggagcccaagcaacagtcatcagcttcaaaacgtggatcaaattgggtcaacccaaactctctccaacggacatcgaaacccgcaactgcaatgacatcgcattttcaaccgaaggaaaatttcattgcaccgtcagttgcttcgatcggccatccaaaacactgatcgcttacgtcagcagtgacttaaagcatgatttgtttggccttccgtggattgaggaattcgagctcatcccaagagaaattttgtttccaaagagcaccaaaggaaagccaaacgcgtcaatcaacgccaatgtcgtcaaggcaccaaacccggcgattggcattacggatgaatcctcgctcaccgctgtgttgcaaaaagattttgaggaagtttttaagaacggacttggccattgcgcaatcaaagcgcacctgattctaaaaccggacgcccgacccatcttctgtaaagcacgaccagtcccccatggtgcaatcgaagctgtcgacaccgaactggaccgcctcttgcagattggcgcagtcaaaccggtagaattcagccattgggccgccccgattttggccgtcaaaaagaaaaatggaaagacccgggtgtgcatcgacttttcgaccggattgaacgattcgatcgaactgaatcgccatcctcttccgagacccgacgtcatatatgcagctttaaatggagccgcatttttctcaaacctcgacctgagagacgcctacctccaaatggaattggatgaaaaatcgaaacatctttgcacaataaacacccaccgcggcttatttcagtgccaacgtctcccatttggcgttaaatcggcaccatccattttccagcacttgatggaccaaatctgcgcaggaattccaggggtcttctcttatttggatgattgcctaatcgcctcaaagaccctggaagaccacgtcaatgcgcttcacacgcttttccaacgcatcaaggactttggcctacgaattcaactcgaaaaatgcaaattcctccaaaaagaattactttttctcggccacatcgtttcctccaacggcatacgccccgacccagcgcgctcagaggcaatccagaaaatgcctgcgccgcatgacaaaacgaccctccgttcatttttgggagcgctcaattattacggacgttttgttaaaccaatgcgagaaattagggcgccattggaccaactcctccgaaaggatgaatcctggagttggggagatgaccaacagtccgcgttcgagcaagcaaaggcaattatggtttcagaacttctgctgacccactacgaccccacacttccgatcgtcgtagcggcagacgcgtcaaaagatggcatcggcgccacaatcagccacatttttccggacaaaaaggaaaaagtcatcgagcacgcctcaacagttctgaccaacgcgcagcagaactacagccaaattgagaaagaagctctggcgcttgtgttcgcagtccaaaaattccaccggatgcttttcggacggaaattcacactgctcacggaccacaagccattgctggccatcttcggctccaagaaaggcatccccatttatgccgccagccgactccaaagatgggccctaatcatggccaattacgattttgaaatacggtacatcaacaccgcatcatttggccaggctgacgttctctcgcgcctcatcgccaattatccccgaccagaggaggatattttgatcgccaacatctgcaccgaaaccgagtgctacatcagcaccattctgcaaaccaaaaccgaacaacttcccgtcactgcagacgaaatcgcagaggcgacaccgaaagatgagattttaaagaaaattttggcattcaccaaatcgaattggccaaagaaaagcagcgacccggacatcgcaccgtattttccgaaaagggaaaacattttggaaattgagggctgtttgctcttccaaaaccgcgtcatcgtcccccaatcgtttcgcaaccgaatgctgaagtccctgcacatggcacatcccggaattgtgcgcatgaaagcactcgcccgccaacacgtctattggccgggcatggactcggaaattgaacggattgtccgtcagtgtgaagaatgccaaaagg

SEQ ID NO: 15611 - DNA, 2994 bp, Heterodera glycines
ccgcttcacgggtgctcagtgtaaatatcgactggccattcaaattctgccttttcagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcatgtgggcaaaaggccacaaaaatttgcacttcccggcagaaggggaagcagactctcccggcagaaggggggagtcttttaagcaaagcgaatttctgtccaaaagacagaaattcactgaatgtccaaagggacaaattaaaggaggaaattcctctcctttactgaagggacaatttgaaaggaggaaaatgtttctcctttccttttgtaagccttttctttgacccaacgggggtcaatggcttaatgatctgtatgaaagggctcctgagcgtcccttttacagatagagaaaagactaagactctttcttaatctttattcaatttacacaattacaatttaatgcaaattgcttggacagaaaactgtccgggtgacttaatcaaaaattgatcagagtgaaaaaaatggagaatgggccgggcttttataccctcacaatcgatgggggcgggtccaggcacgtgaagaaatgtgcacaagcaaatggacaaaaacccattaaaaatgatgactcataacaaaaaatgaagagagaaaaagagctgagtcataaaaaagaggagcgagcgaatgggaaaaatgatcgacgaaaaaggatcaaaaaataaaggaaatttcaaagaaatttgtgtcgcttcggcgacatactccgggcctcaaggatggcggcatctgttgccgtctcttcgccaaaattcttttcatcgtcggtttggaagtcgacgagccaccctaggaggacgattctccaaacgtccatctggtagctgtgcttggtcacgtggaggagggtgaggttcctccaaaactgctggcgctctccaagcaactccgattctggttcggatgttgaccagttcgatcggataaatgtcgacaagcatcccttgctcgcgagggctaaaccctacatattcttgtatgcacggttttactgggtctacttgaagacccaaccgtacaaaatgatcgacaagtgttatgtccggagagatgaagagaccctccggaccataacaggtgaatccatcaaaatggatctcggcaattctgccaaaatgttcgccaagtagcgtggctccttcgctaagttctccgcgtaggcggacttcgacagcacggcgctcccgtgctgtttcataccaatgcggtccattagaccgctcaatccatgagctcaatggctcaatttggcgaggaacaggaggttcctgccagcgaggaactctctcctcctcttcaaatcgaggatcgccaagtccgtaaaggcgatcattgaagacctcggcatctttcgggtatgaccacccggcgagccgagaaataaggcccttatcgtatgggaataggcattccgtggaaggatgatttgaagagtgtggttgggtggcaaatccgcgacccttttataccactatccaaccgaagcgatgaatcatttcccaaaacaagggatgactcacaaaattttttaaatgccgaggggataggacgtgattcaacaccacatccgaaggatcctcccccggccaaatacagtattgccaatactgtaggcacattaccataaccctttctcattaaagaccaggaaataaatttccaaagtctatagaaaggagaaattttaatgaaaattgttaggcaaacaatgcctaaacaaataatcattatgaaggcaactgatgattggatgtcaatcaaagaccaaagggtcgccttccaatcaaaattccagtttggccaactggattggctgtttatcactctttcggagtgatttggactgtaatcttctatttgttcgggctggacatagtgtaatgtcccttttagaacaaaagaagtatttccagccaaacactttgtttggcattttgtgtcaattctggctttatcaaaagccaaaattgtctggtaaattgatgcgttggaatcacattttgtcgaaaaatgtgttccatcatcgcatttaatctcggcaagagaattgccaaaatttgtcgagcacacataacggaattgtgctcccgttgaacatctgtaacacccagatatgttcaacggcaaaattgtgcaaaggctttggtgaagttccaaagccatttggagaccttcgatttgaaggtttaattggacaggactaaatcctgtcaaggcaattacctttctcccagtatttctgagttggtaatttttgatgtttaatggaagtctcctctctggactttccaataatttttcaaggttatgtgaacggcaattgcagttcactaaacctgatgaatggtcaggtatgcaatcagtgcatgcctgaacaccaagactgcaattgaaatcaattgcttcttgccgacttttacagttaaagtcaattgttaatggctctctggttagagccatgttgctcccgtcataaacaaaatctgagtttaagacgggggcgggcggaaaagttactccaatcggagtaaggctgatgttgttccatttcagtgttcttcctggatagaggaacacctgagttgacttgggtttttcgctcaagggtttcccaggcgaattattgcat

SEQ ID NO: 15612 - DNA, 965 bp, Heterodera glycines
aaaaatctgaagtttaattttgtttttgatatgaaaaaaaaatgtgttagtcaagtgtcataacgttttaaatacggaattttttattccatatcaattgaaagctgcagtaaataaatgtgtaatgctacaaaaaaaactgattttcacttcgccttgttgttgtttaatgtttatcgaggaaagaaatatgagctccgagttcaaaggtcatcaaggccaattaggatgaaggggggggggggggaagggttgaaaaatttgtttataactactacctttttaaaagaaggcacgctcaaatatttttttaatatttattaccatggaatggcatgacatgtgatatttgcaatgccatgtctcgagatattgtcatgaaggacgaactgtatgaccaaatgacatggcatggaacagcatgaaattatcatgaaagaccatgtaagttaagaatgtgacctttgaagaccaaaaacaaaaaccatattaacacacgcaacggtttgctttttttgaaaaccttacaattcgtactggaaatttgggccaaaattcgccggaatgcgatcctcaaaatccacaagcgtacaacaaccaaaaagatgaatcgggtcagcgtacaagtgcccagtttctcaaataataaaaatgaatttgtttaaaaatatgttgttcaataccgagacgggtcccgttgatcgtaaaaaaattgcgcggttaaacaaatcaatgccgcatccgaccacgtccccctcgccatagtgcgttgcccatccaatggggtgccagcccaattccgaaatcgcttaatttgggattagaattatttagattgttccatgattttttttgcctttgcatcttgaacacggaagtttcaaagtaaaaatgctgtaagtgcatcgcgccggcaacaatgctctcagagaagagaaatctttaaaaaaaaattcagatttttt

SEQ ID NO: 15613 - DNA, 2277 bp, Heterodera glycines
  misc_feature (2224)..(2224): n is a, c, g, or t
caatttttaggcatttcctcttttctccttcgctagcccccccccccctttatgtaggttaataatactggaattaccaagaataagtcagatgaaattattaaaatatgggtagccttttaataaaaattgaaaaaaaaattgttttataaaaaataatcttgcaagaaatcgtctcgaaaaataatccaaaagtcaaattgcggataaatcccaaaaatccgcaacccgcaatccgtaactccaaaacccccgcaatttccgtaatccgtaattgcgcccagccctggtggggagggagagtaaactgtggagcacttgccctgaacgacttgtcctttaccattctgttgtccaattcctccgcctgtttgatgtagtgcacttgttcgcttaagctcaacgattgcagtgccgagttgacccatccttcgcgttccaattcgatgaattcctccaagtgtttggaaatctgcggcttcagcatctcactcgactcctccccctcctcttcgtccgcattggcactctctgcttcctaaaattgaatcggtttttggacaattagttccgacgggaatagcccaacagaaggaactgtcccatttgcgcgttgccattttgcgtgtttttgtctgctttagccaatgttaattttttaatcaattggttgattttggcgcaaattaagcagggcgccaaagtaaggggcattccattaaaaaccctttaaaatttatcaaataaattcaaaaaaaatttctcattttaatttcagtgtttctgaggtgtgaacaaatggaaccaattatccaagcacaaattgtgcttagcacttaattatgttcatttaccgtttgattgctcctcgctttggaagactgctcaacattccagcggagaaagcttgtctgaaaatagacttttaattgagactaacggaacaatatcattttataattaacaaattcaaaaaggtacagtaaaatgccgacagttcgatatttatgggtaaaatgcctgttagggtgcgtgaatcccgtgcatcattttgtttccaaacggcacttttcattcccccaaaaagaggccgtgagaattcgcaggaatacggtattttttctaattagtgcaattatcgtacgctcgcaaaccgaccaggtactgtttgagagctgcctcctgttcctttgtcggcccatcttttccgatgattcctccggcatcttttaatgctttcaaggccaagggtagagcaactttcgtcaacaaaagaaactgatcgttcagattttccattcccggcgaattgaacgccagacgaagctcacgctcgtgcgtcacatcgtcattcttgaaaaacaaaacataatagccacaatcaaaaattaatcggtcaataattaagtgcccagaaaatgaaaaaaagtggaaaatagccgagcgtaatcccaactccactcatggccccgcaaaccaaaaaacctcggtaaggaattttcaggaattactttcaagattttatgtctaaaattcagattttaattttaaaaattattttctccataaaatagataaaaatattacgacatttttgagttaattttaaaaataagaatttatggaaaggcggcgccggaaaaatttaagggatttctgcgaaaattttgttcagctaaatgtagacagatagttagtcggtctctctttgttgtggcatttccctgatttgtgagttgatttggcaccgatgtcgacccaacaaaaaatatctgttacttttgaaaaatcgccctcgtcgttgatcagatcatcaatttcacggccactttggtacttctaaatgaatttatttggcttacactttgtcaattgataatgaaaatgcgtaattccaagtcagtcacacaaaacgaaagaaagaaaaattattatttctccaaatgaatattttttaaataaaacaaatcagaaaactaaaagcagaaatttaaattttttaaataggcataatttttcgatttccattgcaacgtttccaactttatcagaaaacttctaattattttaatttaaaaatttgtgaattcattatgaaaataaaattttcaggggggggggaattcgtgtgaagaacgaaaagtcctcatttatttactcactgaccgttccataaatttcgtcagaagattcgtgcagatgaaagtcttgcattgttccgtanataacatcagactcgtacgccttcttcagtctgtgagacaaaatttgaaaaat

SEQ ID NO: 15614 - DNA, 197 bp, Heterodera glycines
agggggaggcaaactcgtaaatcgtacgggggcccgaggccgtcaactttttggcctctgaggggggggggggtgggtattcgtatttagtaaaggcaaatttctgacccccccccccccacttgtccatgtatgaaatgaataaaatccaaatttaatttaaattaaaacacagccaaaatttttaagcgtaatta

SEQ ID NO: 15615 - DNA, 2166 bp, Heterodera glycines
acaaatcgccctcaatgaggtgagtgatcagagcaattcaattgcttttttactgtcaaaagtaattaattaacatgctttttttggctgcaattgcttagtgtcttcggcgcgaaaaattgaaaaatttaccgtatcctaagactcatgaataaataccatagtcccttgccaatctcaaggttttcgatgccatgccatttacattttccctaaattttctcagtgccttcgccggcggcgctccgttcggcgccatgtccgtggctgacctgggcagtctgacccgtctggaggacaaaattcgcctgctgcaagaggacttggagtcggagcgcgagctgcgcaaccgggttggttttttgatggagctccccaatttttgaaatttaaaaaaataaataaatttaattcaaaaatttcctcgtagattgagcgtgaacgtgccgacctcagcgtgcagctgatcgcgctcactgaccgtcttggtaagttgcatttgttggcggggcatggccaccaattgatggcattatgccaacattttgctccatttttcttccagatgatgccgagggcacaaccgaccaacaagtccgtgccaattcaaattttaaaagatataattttgattttttttttaattttagatcgaagccaaccgcaagcgtgaagcggagctgcaaaagttgcgcaaactgttggaagagtcccagttggaggccgaagacgcgctgaacgtgctgcgcaagaagcacaacgtaaagcatttaggggcattaagctgagagaaatttgatgtgccattttgggtgaaaatcggagactaattaaccttcattaatatacatttcgttttgttcgcttttcaggatgcttgccttgactacaacgagcaaattgagggattgcaaaagaaaaatgcgaagtaacaataattaattataggtgtaaaaatttattggatttaaagcggcttacttttttgtgacttcttttgcctaattatagcataatttttgccgatttgtacagccctcctccgatgccgaaattaaaatcgcaaaattttacagcaatttgaaatttataccaagacggaaacaactcaaattgggacaattttgaatgattagatatccagatcaacagtgacctgtttgatcgctgttgatcacattcaatgaacccaattctctgatcactttcaggattgatcgcgagcgtcagcgcctgcagcacgaagtgatcgaactgaccgccaccattgatcaggtgcagaaggaaaagcatgcagcggaaaaggctgcagaacgcttcgaggcccaggccattgacttggccaacaagtgaaattttatgaattagaaaaaaatttggaaaaatttcaagggtggaggacttgaacaaacatgtcaacgacttggcccaacaacgccaacgtctccaagcggaaaacaatggtaaaaagttatggatatcattaatttatgatgcaattaggcatgaatatttatatcaatttcagtttaaaatttcatgccaattaatttttgtggcaccttttttgttaggcaattaaatttttcatttttccatgccaatttccacatttcaaattttgcgtgtcagttgtttttatgtaaattcaaatggcatctatttatattgcaaaattagtaaatttaattatttttggtaattagtttctttgtaattaattaattacccatgcatgactaatttggcatttatatattatagacctgctcaaggaagtacatgaccaaaaggtgcagctggacaacctgcagcacgtcaagtaccagctagcccaacagctggaggaggcgcgccgccgcctggaggatgcggagcgcgagcgctcgcaaatgcaggcacaactgcaccaagtgcagttggagcttgacgcggtgcgcaccgcgttggacgaggaatccgctgcgcgtgcggtgagcaattttatttttgttttattttggccaatcagactgatgaaaataaattatgaagcctttccccgccgattgtagccgatcagtgtgatcatattaattatgaagttttcccgatacataccgtaattcgcatatccaaacatttaccgtaagagcgtagtcaaaacaaccgtcgccactaactaac

SEQ ID NO: 15616 - DNA, 1483 bp, Heterodera glycines
acttccaaaattgtcatttgtattaccatatccaacggcgggtggctcggtataccgtaggaaaaaatttgatgcttttccccgacatatactgtaattcgtatatccaaacatttaccgctagtgcttaaccaatcaaccgtaaaccgtagtcactaactttccaaaactgtcattgacatttaccgtacaccggcgtgagcgactcggttctgtaggaaaaaaattggtgtttttccccgacacaagccgtaatccctataccgagcttaacccaatcaatcgtagtcactcgctaacttccaaaattgtcactgacatttatttaccgtacacaccggcgggcggttcggtactgtaagaaaaattttcatcaaaatattttcacaggaagcggagcacaaactgtcgctggcgaacaccgaaatttcacaatggaagagcaaatttgacgctgaagtggcactgcaccacgaggaggtggaggacttgcgcaagaagatgatgcagaagcaggccgagtatgaagagcaaatcgaaattgtacgttggacaaacggtggcacaattagaggggggagaggggctttaataatttggatggacattagggtggtaattagggcccgaggcacaactcgggccgcgcacttgtagattatctaagtcatgatgattggcacatttttacgactgaaatagactttttttggcgtcggaaactgataaaaatttccccgaaaattttcagatgctgcaaaagatttcgcagctggagaaggccaagtcgcgcttgcagtccgaggtcgaagtgctcattgtggacctggagaaggcgcagaacaccatcgccatactggagagggccaaggtcgaaaaaagggaaaccgacactaattatgcctaaatggagaaaataggcattccatcgggactaattaggccatcaatggagaaaatttaggtattcagtcgatattaattcgtcttgactgagggctaattaggtcgcaaaatcatgagaatctcagctatgctaaccatggtccgaatcgagggactcacgcgactaatttatgccagaaataaaccgggagtgaatctagcgactaattaggaggtagattccatataagacggaatatggggaactcgaacccggcaccataacatgagtacaatgtcattaccgtataggagcaactggagcgtacggtggcggagctgaaacaacgcatcgacgagttaaccgtggagctggagaacacgtaaaaatttttttagaaaaatgaaatttttgaaaaaatttcccaggcaacgtgagctgcgaggcgcactcgccgagcttcagaagatgaagcacctgtacgagaaggccgtcgagcagaaggaggcacttgcgcgtgagaacaaaaaactgcaggacgacttgcacgaggccaaggaagcgcttgcggacgccaaccgcaagctgcacgagctg

SEQ ID NO: 15617 - DNA, 2055 bp, Heterodera glycines
  misc_feature (45)..(45): n is a, c, g, or t
ggaccatccctcaaaaatatcagcaaaaaatacttctttccaggngagatagaatggattctcaaaaaagtccgaaagtaaacggaaaaaatttgatgggaacggaaattaaggattttttgggaaaattcgacggaattgtggcacaattgagggcaattgtttttcaagggaccgaggaggtaatggagacggacaacatcgactttgccttgacctgggatatgcagtgcggcggactcggaccggagcatcgaaattgtgtccaattgacaaccgctgatttggacccagttttggagagggccggattcggactcaaggtggccgaaagcagactgaagccacaaaatgcaaaattcgggcttaaggtcgtcggaactccgttgaaggctttgttggccacttttctgttaaaaaccaacgccatttcttcatctgcagccggcagaaagttggcacaatcagtgattggagcaccagtcgggtttgaactgatcactttcatcggaagccgcgaagaccaaatcaaaagtggccgaattccggtggaagaagatttggaggccatcctcgagaaatggaccgaatgctgtgcagttacacggacgaaattggcaaaatgtggatttggcgccatcaatgtgccgattccgcgctcaattgaagacctcccagaaggagaaggaaaaccgtggaccgaactgctcggaaaagccggatttgtgctggagaaagtgaaggccacgtcggtgctgcgcaaacaccaattcgttacgtcgccacgcataattattggagactcaagcgcaaagcaattggaggacttgtggccgacttctcagtttattggcgccacccaaggaagtgttggagatgtaattcgggcatttgacgcagtggccctgtcgtccaaagtcaaagtgggcgtgattataatcgggcgtgacgctctgatcagaaacgaaacggccgacaacgtcatggagaagattggaagactcatccaattgtgcgcccaattccaacatgttcagtttttttggctgcctccgccgttcatccgcgatcaacaaattgaacacgacatgctgatcgaccgaatgaaggaccatttcgcgctgatcaggggaaacattcgctatgtgtcgacaacaccgtcaggccgatcgcttctcgaaatttggcgctatgggaacggctacaacaccgaacatgtttctgccgaaggaacgatgaaggagaagggactgtacatgctcaaggcatggttgatgacacaagtcaacgatttcccgggtgatcgagaattggggatcgagaagaaaagggcggagagcgaagagaagggaagagggaaaacggaagggaaaaacgtgagaacgggagaatcagaccgacaacccagtcaccgccccattcgatcgccatttcgtcacaccggccatgcttttcatcgttcgaatcgtacgccgactcatcacccgtatgcgaatcccgtcgaccgacaccagccccagccttttcggatgccgaatcagcaaggcccgagccgccgacagttccagcgctgaggacatcgcttgtcggagggcgaggatgtcgtaattaataatgacctcattttatttttgattttatgatatttttggcattttgttttaatgtttgtgatttcgtttttgttttcgttttttgtcctcagactttaatttggaattgcctgacataaaataataaggctttattctgtgtgctttaattgtgtgcaagtgctgaactgttcgacgtgctgctgagtaaaattaaattatttgtacggttgtgaaagtcaccgaaaacgatggaaaatttgcgcgagatttgttccgatgttgaagcttaattaattaagattttgagcggatgataaaatttattggttaggattagcgtatgctttagcctcgttttattcccttttaggtctgaaaatggctaaattttcaaatgagtacttgtggtttttttttttggaatttttgagttttagaatttttgataggaatagaaata

SEQ ID NO: 15618 - DNA, 3849 bp, Heterodera glycines
  misc_feature (3828)..(3828): n is a, c, g, or t
ataatctctcttacacgaccaattcattattttgcctccgcggcggcggtgcgttcgaaaatgcgtccggcacgcgggtacagaaaaacacgagagtttgggacacgattctgctccttgaaaaagcaagcatcgaattaataagtggcatggaaactcattctcgtgaggttcgttaggaaattggctctattgcagtttagccaaccataaagacacgaccataaaataatttgagaactgtaatgcacaaaattgatccaagattcaaaaagttatagtcaaaaatatttagaaaaccagttttttgaagttaaaatatggtgcatttgtcaaattattttatagtcgtgtatttatggtcatgaaaatgcaatagcgccaaaaaattcatataagatttataaaagaaatattttttgtaggatttggcgaacaaagtgactgacccggcagtgctgacggagtgcgtagccaagtgccaactccggcggcgtcaggtcccggtgggcaaacgcaccgcagatgagcgagtccaacaggtgctgcttgtgtttctggcggcgttcgctgcagtggccatgacggtgacgctgcgaagccgacgactgcatcttcttccgcttcatgccgctgttgctggctttggtgttgttgttggtgtctccctcctccgtcgccttcgctttgctctccgtcttttgctgctgtccctcttcaccaacactttcttccgtttccgtcttcgtctctccgccctccttctttccgtgttctttggtcgccgtttcctccctcgtcactggcggtgtcttctcatggccaccgttggtgtcctcatcgcagctgctgaacacgtccaagtcggacaagtccgagtaggagtccgtctgctgtccgtccccctcctctttttcttcttcgttccctgcatccgtttcacggtccccacaatcaatgcccgtcccgtgctgtctcacaatgccctcatcgtcctgcccctttggttgctgctgtctcttttgacgcagaaatatttgccgttcctaaaatttggggaaaatgagtgagagagagtggaggggagggaaaagaagaaagagtaagagagaggggaagagaatgataagacaggaagagggcgggtgaaaggaagcgataagaggaaaggaaacggaggagagaaaataaaagagaagtagagaagagggggaaaaaggaaaagacgaaacaaaagagaaaaacgccctgcccaccctgaacagctgacagaatgcaattgcggcctcacgattacggaagcgaacacggataagtgcgggacgcgacgatcccattgcatttgaccagtcatattcttctggaaatacaattcaatgtattttcctaacccaaactaattgtctccccaaaaattgccaaagtgccgactttgttcacccccggtggcaccgtccgccgttttgccttcgccccactgtttatctgctcccgttgtcattgtcgtcgtctgttgctgttggccctcgcctcgtgccgtcgtcaccgttgttgcgctacgcgacgcactgctgccggtgccgcgtcgcggcaaacgctcaattcgcagcggcaaatggccgctcgccaccacaatcggctgcccggccgcgttggtggccacggcggagttcttcaacaggtcgagtttctgctgaaaatttgggatcgagtcgtgacaaattccctaaaaaatgcgtattattactactttgatttgattgcatcgctgtcgaaacccatcggaggacacgacgctgtacacaatgctggtgatccgttccgtgtcctcttccgcactgccgctgtgttcagcgacattttgaatgatcacatagcatctgtggagagaagggaaattttttgtcattttttttgatattctgtaaacaaggcatccatggatgggagcagttcgccctcccccccataccgtttccgaccaggaaaattgttttctagatatttttcaagaaaaaaaaatattataaatatcttttaaaaaatacgaagaaaaaatttattaaaatttattgagttaatttttgcaaattttttgaaaatttagaatggatcataaaattttgaaaaaagcgctaaaagattcaattcctctttgattttgccaaaaatttttcaattgtaaaaatctctacaaggataaaaaggtagtttttgagacaagaaaagaataaacacgtaattttgtttttacaagatgaaatttacacatttgacatataacaattccgtaaaaaaataatttttaccaagataaatgaattattgtaaacagaaccctctttttaaaatgattatcccctcgcattttttcggtgtttaacccttaaaacaagtaaactcactgcttctgcttgtacagcgccgcatactttcgcagcgatgcaacaagcacatgcaaatattggcccatcgaaaattgttcccatggcacaagttcgacacgtccgtttgggaattcctttaaaaacggaccttttaagagggttggcattcaccgaccaaccacaaaccctgtacaaatggaagccgttgtggtaatagcggggggcgacgttgagcaaacggccgtgttggtactgctgctgcgaatggtggggagggagttgaacggaggggtgggggaaaaggtaattttaaactagccaaaaacagtggaatcaatttggagatggcagtcccaaacagaaacaaaaaatcggagggagaatccgaagacccttcttttgtgctttggttcaaatattaacaaaaacgccactctgttggccgcgctgttcttctcgtcgcacatctgctgcaaatagttgcgcagcactctctccggccgcgtcaaatccgcgtggcaaaacggggcgcggacttggcgacggtcgaacacgcggaagacggacctttcaaatgggggagggaagccaaaatgagaagaaattacaggaacagagggcagaaaacatctgttgcactttttttgtacattttcttatcatatgacattaaaatttccaaaaagttttccaggcggcgcctatcgacaccgctggaccccattggagcattatactttgaaaatttgaccccaaaacggtaaaaaatcgttatttttagcgcaaaagccctacaaattcctgctttttcgccgcgataaaaattttgaaaaataatactgtagaaatttttttagcccgaataggcaaaaaaagctcctcgggtgctctccccgaattgtttactggatacgggcctgtggccagagaatgcaaaagagccaaacaaaaaatggtgggaccaaccgattgaacaactgcatgaagaacagagcgcactcgtggttacggaaatggacgcggatcagcacacagtcggtccactggtgctgctgtgggagttgaccaccatcaccgccattgccgccgcccaagtgaaaaacaccgccggcgaacggagcggcggcggccgccgaatgggggacggacgacaaaatgacggagggattggagagggactgaaacggcggcggaggggttttggacgaaatgccgtaaatgtatccaaaagattttatgcaaatgaaaaacatcttttgggtatgaattatcttttataaattaggggtcgataaacaaaggaggacccttttgaagataatgagaattaacacatttttaaggttgctaatcataatgtcatttatttgttcatttttttctaaaaacaaaaaattttttttaatcaaaagaggtaccaccctctttggttttggaacanaaaaacttttaatttctcgaa

SEQ ID NO: 15619 - DNA, 1622 bp, Heterodera glycines
ttatttctcttttttcttcttctttttcttcccatttttcattaaatgatttttgttgcgcttttttcttttctgatccaacataattaatgctaattatgatgatcaaaaacacaaataaagtgaatgaaagacacaatttcataataatactttgattttcttaaacatttaatgttaaatatttttgaataattttaattgatttatagtttaagaaaaagaattaaatttgagaaaaatttgttgaagaaaataaattttattaaatattttgttatccgatttttttaacaatgaatcaattaaaattaaaatagctaattaaataaaaagagaatgaaaaatgggaaattaaaaaaattcaagtgaaaatattaaaaaactttttttatatttttctttcacaaaaatcaaaacaaaaaagaaatttaaaaatcggaaacaaattttcaataattttcaaataaatagaaaattttattgttcgcattctaatagctaatttttgaaaaactaggctcaattttttaattaattttccgtaaaaattcaacattcttgtccaaatatgcaaagctttaaaaagccagaaattttaatgaattttgtcaatcattttttatcaaaaatgataaattccttgtttttttatttaaaaaggaacaatgtttaataataaatgtcataaatttttgaaaattttcaaatttatcagtgattaaacaaataaataaataaatttttttttctcaaaataaagtgggatatgattcccgatctggatccaggggttttcccgcgggaatcccatttccgccaatctctaataagcaattgtcaattaataattcttattttccattatgcatttaaattattaggggttaatcccgcgagatccctcaaatcctgcagctggatcgcaaaatttgaatttcctgtaacatttgtttattcattttaattgtatttttgaccaacaaaattgatcaaagcggatcagaaaataaaaacttcaacaaaaaacatttgacgaaatatttggaaaaagggaagaaaaattggaagaaaaaagagaaataattgaaaaatattataaaacaaaagaaaaaattaagcaaaaaggaagaaaatattcaagaaaagaacggaataaaattaattcgaaaattgcgaaaaaattggtgacaaataaaacatatattcaaaaatggattaaagaatttggtcttcaaaaaaagatatataaaagccacaaatcaaaaactgatgaagaaaaaattgaaaatgtgcaaaaattcattaccaggagcatcagcacaaaaaccggagaatgccgagagatctgtgaaattagatgaaaaatcaaattttattattagccttaaccaactacgagtggcacaacgcctacagcaacaaatctggcacaattgaaaattgtccaaatttcgcgatttaaagtaaagtttttgaaaaaattgaggatttttagcggccggagttgccgataggccaccacagggaaatttttgaaaatttaagttgcaatttattaacacaaattgtacaaaactactaattttttgaaaaaaaaatcaaaaaaaatttccgactta

SEQ ID NO: 15620 - DNA, 1737 bp, Heterodera glycines
  misc_feature (61)..(61): n is a, c, g, or t
  misc_feature (1715)..(1715): n is a, c, g, or t
aaaaaatattattagcttataaatataaaaaggaagtaaacaaattttagtattacatgancgaaaggaaaaattacatcacaattaattcgtggattgattatcatataattacaaacattaaacaacaggacattttaagattaaaaattttcaaaaattgttgacaaaaaattcttataggcatgtccaattctaaggacaagtaaaaattttatcaaacgaaattaaaaacgtgtcaattttattcaaaacgatttgtattgaaaaattcggttgaacttttataggttttcagattttatgacaaaaaaaaaaaaataaaaaattttaccttatatatttttatatataaaaaaaaaaaataagaatgactgaattataaaatgaaaagtaacattactgttaggcatatttaaaagttatcattttccggcaaacccattttgaataattttaattgattttataatttttattttaagaaagtaaatacaatttgagaaaaaaaaattaaataaaaaattaattgttagtgggaaagacatgcgggccatcgacgagtctgctccgtcaatgtccttgtccacggacgcgtccacaccctcacacagcgcaacatatcaaatcaatttgtttttaatttaaaaaaaacaaagaatttttgaatgtttttaaattttgggtcttcttttttattttcgaattaattttcattttttccatttttctttttctgttattcttttaaagctaatgccaaattttgttttttcatttttgaactgtccaataactcatcccgattttcttacaaattaaggttgacgttctggcaatttttatacaatagacccacaaaaatataaaaatttatttttagcttgtttcgtaaaaactgtcattttagctatttttcgacaaaaagatagcatataactatctttaaaagcaacaaattttgcattcttggtaatattttcgatagctcagattttctctattatcctgcaaaatttcaaataaagtttaagattggttcttgaattcaattaaaaatattctgtataattaactattaagtccgggttttccgttttaattatttttaatgcctttacattactccaaatatttttaaaattttcgccattaaaattataacattttttctattgctatgctttttaaaaataaatttctaccattaaaaagaaactgcattagaaaattattgtttaatattcttggtacatttaaaattccttaaaaaatgctacaaaaaatatttttgtattttatgtttacttttcaatataaaaacaaatatttatttgaagcaaagtgtccctactttttaatattgactatacaattcgagatgggctaaggaaagaacagaaaattaaatcgaaaaatgcgaaaaagtaaatttcttcctttcattcttccgttctttctttttctaattgatttttcgaattaaaaatgctacttcgactaattttcaatgtttttccaatttctttgtcactcattttcggattttctttttttatttgccaataaattttcattttttccattttttcatcctccgttattttacagcgaattccaaattgtttcttccatctgcaaattgtgccatagcaaattccaattttcttacaaattttcgcataattttgtttccattcttcagttgaatattnttcttgtttgttcaaattcatt

SEQ ID NO: 15621 - DNA, 1829 bp, Heterodera glycines
  misc_feature (1175)..(1175): n is a, c, g, or t
  misc_feature (1287)..(1287): n is a, c, g, or t
aattgttgtgctggccgagcgctaacaataattaccaaatttattgaagacaaaattaaataacaaatgaagcaatggggaatatcgattggggatgatgcaacaaataaatgaagtgaagatacaagtgaaagaatgggtcaaagggcggactatttatggggaggaaagtcgagagagagtacagaggcgagggacataaacaaataaataattggggcggccatttgagtcccatccctaacatctcacccttaaaaaggatctttttcatctgacacgtccattctttttctcgacacgtctgtccgacacgtccattcttcttcggcattcaacgtttgccattggagttcgcgtggcgatcgcttccatttgcgattcggagtccacaaatccaggtccttcatacttggccggtgaatactcctccaaattgttgcatggtaccgtcccgtatatccatcttggaagtggacgtcgtacatcattccctttcggctaatgacgtaaccaatttgcatcggttgtgatcctccaattgtgatcactttcgctccgacaacaaaattgttcgatggtctctgcccttcattcttttgggctttctttgatttggacttggcagggtttgaattttaagaaatttttgctttttatttttacaattttttttggcaaaattgaattaaaaatttttgtcaaaaatatgccattttacttagggtggaacataatttttgatacccaaattttttccaattttaaaaaattcataactccgttatttctgcgcctatttaaatgattcttttttattttgttcttcatggtatcctcttttatatcttactatcgtttcactttttatttgattgatagatttttctgccttttttcccgaccatgccaaaattgaaaattggcccactaatttttctcgaattttttatggtcaaaaaccaaagctggtaaacaaaatcctagtttttctatacaatttagaccagtagaatccgaatatggccttaaatgggacctatatttttagcctgagcttgtactgctccaactccatgcatgaagttcgagctgtacaggttttttgcgatcccagagaccaaatctaagaccatattcgaactcaacatacccgatttaccttgtttaattanatttcagaatttcccaaacccactttaaaaacattattgttacttggtggtctttgaaaaatgccgttttttggagaccactttcagtctcggctctccaataattcaattnttgtaaattaaatttttatatttttgtgttcttatagtcctaactgtgctctatttaatcactatttctctggctctgtatctcttttatttttctttaaatcagccatcaaaaatacctacctgaattttatttataaaatattgacaaaactccaaatattgaaagaaatattttttttctccaataaccccaaaaatattttttttattaaccaaaaataatgtacaaatgaaaaaatttgagcgcagaaatgcgtttttttgaggggcgccggacttttcgacagaggacttttcgacagaaggacttttcgacagcaaaggacttttcgacagaaatattttaaatttaaggaggggacttttcgacagtaaaatgtaattaagtttcaaatttaggggtgtaaaatcttaaaattttatccaaaagcaacaaattaagtcaaataattattgagatacataatttttaaattcaaaaattcttttcaagaatgtaaacaaataaatggagatgattttgtttacatattccatttc

SEQ ID NO: 15622 - DNA, 1863 bp, Heterodera glycines
ataatgactaatttcagatgttgcaatagtttgtggctcacttaagcttgttttaatctatctacgaaaaggagtgagaatttagaatattatgtattttcgactttttgttctggttcgagattcgaaatggtcctacatggatgatagaattgtattctccgatgccttggaatcctaaaaaactgaaaattttcttttcctacaatggttggtctcataaagtgcatatagaacatcatcatatgtttcaatttccgatttcgaatttcattgtcagtgcacctcaagatcgttccatacttttagatgtttgtaattctgttctggaagagtcctttgtggaaaagtccgggaacattattgattgctcctttcttcaatacatatgtatcagcaaacaataacactaaaaattggtcccttccctagcaaaagcgcactttacattttccactgtgctaactgtcaccaacggggggggggggggagagaggccacccaaaacgaacgggaaatggcagaaaagagggggcggggggggcaaaagccacgacaaaacagaggggaaaaaaagacatttagtctggccggtttagtctgaccgttttagtcagagggtcggtttagtcagggggacgttttagtctggcaagctgtttttgtcctacacggtttttattgtgatttttttcgaaaaatctttaaatttaatattaaaacatatttaacaaagtatttccaaagaaaaaaataacaagattaagcgcgcatttcatagtttcgagaaatatcaacgataaaattggtggtgtcgggattaacaatggtattgacatggtaattgtgatcattttggtaggccgggtaatgtgttgatggcattgtaagcctgtaagagtcgaagaattctctcatcggcggcatgagcgcctttggaggagggacttcaccagcgacacatcgtgcttgcgattatgagtcaatttttttaataaagctaatgaattttagtggtcaattcctgggaagtttggtaatttgagcccgattttttaaagattttaccaaaaattatggtttggataggaatctgtcacccacagattgtattgtggactagaaaacttaaacatgtagaaatttgtgaagaaaatggaagtcctgcgttttaaagtcacatacataaaatcaaaattaatagattgtcgcattgatggggtgttcttttacccctatttgttgctaaacatacatattttaagtttagtttttccttgtttatgactgacaaaaaaaaatatttgtatgagttctgggcgaaaacggctagccagactaaaacgaccccctcactaaaacggccagactaaactgacccggtccgaaaatatatgttagttaaaaattgagaaattatataacccatgagtgtaccaaaaaaaaaaaatcaaaatattttattcttcacttattttcaatctaactcccattcttaccattgtatttttggtacccgggaacccgcacctaccgggtcgggtaccggattattggattttcaaaaaaccgggtccgggtaccgggatcgggtattgcaaaagacccgctcgggtacacggacccgtgtaaccctaattgtcatgagaatttaattaacaaattttcttttattttaaatccagggccctgcgggccctgtgaaagcaccgtgggcgctttcaacgctggctctagtgggatatatattttggggcgtgacaaaagcatgtattgaccgctaagcgatcctcatagcttaggaacatgagaatttgataatgaacaaatccttaatttaaaaactatattgttataaattta

SEQ ID NO: 15623 - DNA, 3772 bp, Heterodera glycines
  misc_feature (3548)..(3548): n is a, c, g, or t
  misc_feature (3699)..(3701): n is a, c, g, or t
  misc_feature (3737)..(3737): n is a, c, g, or t
  misc_feature (3757)..(3758): n is a, c, g, or t
atttgtttctcggcgcgtttgtttgggaaaaatttgcttccttggctatctctttttctgctcaacagtaataagaatttcaaccgcattctcagaataattacgccgttctggaatttgtttctcggcgcgtttgtttgggaaaaatttggaaaattggctatctctttttctgctcaacagtaataggaattccaaccgcattctcagaataattacgcctgttctggaatttgtttatcggcgcgtttgtttgggaaaaatttggaaaattggctatctctttttctgctcaacagtaataggaattccaaccgcattctcagaacaattacgccgatactaattgttctggaatttgtttctcggcgcgtttgtttgggaaaaatttggaaaattggctatctctttttctgctcaacagtaattgttagagaaggaagtaattattgattaggtgtatgaccccacgccacttcgccatcttccccctcccattcccctcattcagttgattattgtgcccaccaatttgacctctccaatttattctctgcattaattattttatttatttctccggcaaataaacttatttaatttgttatcttcggacataacaaattttggcgcagtcagcaactcaacgacagcgtttattttccaagctttatctcgtgctgatattgcttgtggtgattcatcataaaccgatctttgccatattttacggcacggtttatcaacaatctgtgcaactaaaccgcatcttctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaattgttagagaaggaagtaattattgattaggtgtatgaccccacgccacttcgccatcttccccctcccattcccctcattcagttgattattgtgcccaccaatttgactctccaatttattctctgcattaattattttatttatttctccggcaaataaacttatttaatttgtaaaaagggcatcccgatttatgccgcgagccgcctgcaacgctggtcaatgattttggcgaattacgactttgaaattcgctacgtcaacaccacatcatttggccaagccgacgttttgtcccggctcattgctaattatccgcgtccagaggaagacatcctgatagcaaacatctgtgctgatacagattgcttcataaattctgttttcgaaaacagaatcgatcaaatcccagtgacaaccaccgaaatttcttcagccatggccaatgatcaaccactccaaatggttcttcaatttttaagaaacggatggccaaccaaagtcaccgaatctgaaatcagtccatattttccaaaaagggacaaaatttttgaagtggacaattgcctactgtatgaggaccgtgtgatcgtcccaacttcgcttcgcagtcgcatccttaaggcattgcacatcgctcacccaggcattgtgcgcatgaaagcacttgctcgacgtcacgtgtattggccaggaatggactcggcgattgaaaaagttggagcacgtgcgaagagtgccaactgggccagaaaaacccgaccaaagcgcttctttcgccatggccaacgacggacaaagtgtttcagcgagtccacatcgattttgctggcccctgctcagacggtcaccaatatttgattttgatcgactcattttcaaagtgcccagaagtctatcgtatgaatacaatttctgcctatgccacaatatttgtgctccgatcaatcatttttcggctcggaatcccagaagaaattgtttccgacaatgggacccaatttcgatccgccgaattcgccacattttgtaaagaatttggtattaagcacatcttcacaccgccatttcacccacaatcgaatggccaagtcgagcgcttcgttgacaccttcaagcgttcgatgaagaaaatgtcaaaaagcgaaaaggattggatcgaaaagatgctattctcctacagaaccactccacacgtcgccttgaatggcttttcaccggaccaattatttttcggcaggaaattgcgcaccaaactgacgctcatccatccaaaaggggaaaaagccgaaaattttgatcaaaaatcattcaaaaagggacagtcaaaatacaccgacaaaatggctcaaaattttgatcggaagcatggatcaaaactgatcaatttccttccaaatgatcatgttcttctgatcaattatcggaacaacaagacggaatggctccaagggaaaattgttgagaggctccataaatcgcccacatatcgtgtttatgtgcctgttctgcgtcgcgttgttcatcggcacgcaaatcagctaaggcgacgacatcttttggaagacgaagccgaaaaagaggcacctcaagtcgaacagccgccgccggttgtcgaaccgcctcgtcagccccaacaaattcagccagccaattccccattgaaagtccgccgatcgagccgaatcaagaaacccacacaattttactctccatcgagatggaaaatttaagcttaaaccttcgggtttcgaatttaagaggggaggtgttagagaaggaagtaattattgattaggtgtatgaccccacgccacttcgccatcttccccctcccattcccctcattcagttgttattgtgcccaccaattttgacctcccaatttattttctctgcatttttattattttattttcttcggcaaataaacttatttaatttgttatcttcggacataacactaataaacaacaaattattacttaatattttagtttcattaatttgatttcaatcaaaaaagacaataaacaattgcagaatttttcatttattttcataacgcaattattaaaaaaaagattaaaatgtaaaaaatactaccaataaatcagcggaaacgaacggcgaagaagtcaattcagagatggaatatgtatcaaaattttacaaaataaaatatagattaatatattttttcaattaaaatgagatataaaatacaaaaaaattctatgaagtatgttaataataaaattatcttacacaaattttagaactgatggagttttgtaatctcctaaaataaaatagcaaattttatattttttgtaaataaaatcaacttaaaagggatagaagaacagggaatgggccaanattaaaaaataaaaagcgaaatgcgaaaagcgaaaagcgaaatttgcgaaactgaaaaatgcgaaatgaaaaaaaagcaaaatgcgaaaagccaaaatatgcgaaaatgcgaaaagcgaaatgcgaaaagcgaaatttttttctacaattnnnttatagtaaaatcataaagcaaaaatcattttttanaattttattcaaatttaaannatcataaaacgctt

SEQ ID NO: 15624 - DNA, 889 bp, Heterodera glycines
ttattattctccataatttaaattgaaatttccatttttacatttatttttttaaagtgagggaaaggcaaatgcgggagaggcaaaaaacaaaaataaacttcttcagcccaattctatagtttttttttcaaatttatttcatatttatcgaattaactgtccaatgccttggtaaataaaatgaaatattttcaaccttgggaattgttgtccatttttaaaaggttaattaacaattgataattttttatatttccctttaatttctgtccccatttttctttttgcgcaccattccccctcgctccctctcaatcgttcttcccttcctctcccccctcccgcaccaaagaacaaatggtagaaaaactgacgagacatcgtgatgtgaagatatacttaaaggagatatatgtcctaatggcaggaaaaaatatcatagggaagagaaaacataaattaatgaagacaatcgaaagatagtaggcactctaaatatttaagattaattatgaaactgaaaaataataacgattatcgacaactgaaccaaagtaccagagaaatacggagaaagatggacgccctacgtgtgcattcgaaatcgtatggaatcgtacagtaatagcatccacctattttagcttacgagacgaaacgacacccatttattgctcgaggagctgttctccacacagtgtatccatgagcttggccaggaggatgcacggtatttggacgatgcccacgtcaaattacgctttgtgatgacaaagattggtcgtattcacttccgacgagtattgaatgatcacatcccggcacataaaggacaataatgagcctatctgataagtgtgtgcttattgctatttgtaagctataa

SEQ ID NO: 15625 - DNA, 2677 bp, Heterodera glycines
  misc_feature (17)..(17): n is a, c, g, or t
acaacacttaccccccncccctccccctgcaactgtgcacacccccgcaactcattttctgcatcggcaatgacgccttgtcaacaaaacacccccttagcagaagagtaattccctcccccagcaaattcagtcggaaacggaaaccaatccttcttcacatgtgaaaaaagagcgtattctttccctcaatgagagtcctcctattttttcttctgccgccgccgccgccgtttgatcatcggcggaaagggagtgatcggacgacggacagagtgattgatctgctgcccacccacagatgggccatcaaaatgagaaaggaggggagagccggccgatcacatcacttttccgcccacaactcaatccctcccccatttccatgcatttcattcatttcttcccaaaatagcgcccctttctccgctttttccttctgtctatcagtttaattgctcatcatctaatcactgtctcaattcatcaacagcaaaacatgcaacattatttcccccggggtcttttaatttattttcctttcctttaatccgttgaccccccccctccccatttgtcctctttttcccttctcccattacccttattaggtttcgtttgttgggaaccacctcagctgatcactgatcacctgcgggaggagggggagggaattctgcgtttccattatcatttggtttaaaagcgcacgtgtgggacgaacgaacagtcgagggagaattatcatttaaaattttgggaagttcaataaattggtatctgctattattattatatcatttagctgaatacattccaattaatttgttttatttttattgcctgacacagcgcaacaaaaaaaaacaggagaagaacaccacaagttggagcagttcgaaccgactatgataactatcagcagtttgggggacagtggccgaagggaaggaatggcggagaatcgacgggaggaactgccacagattgacggactgaccagcgaacaggtggggagagcaaattgcaatgcaatgaacatggattgacaggtggcagagttcaaagaggcattcgaactgttcgacaaaaacggagacggacgagtgaccgcctcagaagtaaggaaaatggcaaagtgatcggcgatcaaagcaaataaacaaaaaacatttagcttggcattgtgatgcattctcttggccattccccgaccgaagaagaattgcaggaaatggtgcgcgaaattgacgaaaatggtcagcaattaaacgatggactgatcgaatgaaaggaaaattaaccttttcaatgttaagggaatgggagcattgaattggacgaattcattaaaatgatgagccgaaaggagaaagagtcggaaaatgagaaagaattgcgggaagcctttcaggtcggactgactgatcagagctaatcaataatcaatcaatcagtaaaaagaagtgattagaactaatcagccaattgtgatagaagtgatcaaaccttctcaaattgaaattttaaaggtgttcgacaaagacaacgacggttttatttctcccgttgagcttcgctttgtcatgcaaaatttgggggaagaactgacagagagcgaagtgcacgaaatgatccgcgaggctgatttggacggggatggaaaagtgaattttaacggtacgaggaatttcttcagctttttaaactcaccaatacaaatttcagaatttgtatttatgatgaggcaaaaagtttaacggaagagagagagagaaggaagagaaagaacgactgataaaaccaacaaaacttttcaacgggtcatacaaacaaacgccggcggggctttcaggtgcagcggaatacttttggactttttggcacatctccttttggcattccatcacaaaaacaaaaaatattaacgtaaatttaatttctataaaaagcacctgaaactctggtatattaaattgtatcgaatttaaatttttgtagtcttcaaatttgtttataatcaaagtaaatataaggactcagaataagttttaaaaagcttaaaaaagatagaaaaccggccaaatccggtaatttcagttgaagatgagctgtctttaaaatcgagggttaaacgaatcaacgcctgtacatttatagtaccatatttagccatttttgaaaggcttaccttatagcgaatttgaagaaatttgagaaattacacccttaattttgaaaagtatatgtccatatttttgccattttatgtccatatttcgcgattttaatccatatttttggaagccctaataatcatcaatcaatcaattctttttattgtttttgatatcactcggcccggcgaaagcggcgtcgagaagactgaaaaaacaattagcattgagcatccttaaaattgttcaccttttgtcaaatccgtcatcaccgataaaagacgcactttgattctgtcgagcagtcaatttttgcatctcatttatccatttttcctcatcgcccgctgcaattggacaacgcatgagcataaaaccactttcatcttcttcattccttgtgatgacattgtcaaattctccccagtcaattcgttgatcatttcaaatggcaaaacggagcccattgaagaggacggcggaaagtaaacgccaatgac

SEQ ID NO: 15626 - DNA, 2416 bp, Heterodera glycines
catctccggcgggtcggtcacaaaatcctttgaagcaaaattgcatcagaatggaggaagaagtgagagccggtgctactgttggtggcgtaatgcttgaaaagaaagttattgaatttctaaaagatgagtgcagcaaaggccaaacagaatcagagccaatggaggaaaagccgattatggggaaaatggtaacagtggaacttgttattttggagacaccaacaactggaatgctggatggtggagctcaaatttctttgatcggtggcaaattcttttatgaattagtgacgagtggaaagttaaacactatgaaaagtggttttaaacgcgtttcaacgcggatttctgatgttaatggtaaagagttagagtgtttcggagtgattactcttccagtctttcgcaaagggtgtagtacgacaaacatttgctttcacatcaccagcgcaccatttgggtatgatttactcattggaacgaatgcgcttcgttcattgggcttttgtctttttgacatcccaaacaaggaaatgatcaattttgaggaaattcacccgaaaaaggaaaagtctgttggaattctttatcaaacgactctcaaaccgttatcaatgaaactggtaacattgtcagttggaaatgaatggaatgacaaagaagtaattgtcacatcgtcgaatgagaaaagtttgcatagatttgagccaaccgttgggaaaatcaccgcagggaaaataaccgttccaattgtgaattcatcaattgaattcgtgcaagttgacgaaaaagaaataattgtcgagttgtttccgacaaatcttttcgcaaaggcggacgattcgcttggctcaccattgttggtgaacaatcttaaattgacaccaaaaatgaatgaaattaagtgccaaagcatggaaattctcgaatgtttgaaaagtcaggcaaaagacatgtctgatcaagagtttttacctctcgggcgattgataagcgaatttgacaacatcttcgcaattcgtgaggaggaattgacacagacggacatggtcgaacatcgcattgacactgaaaatgcgaaaccgattaaagcaaaacatagacctgtcccgtacgcttaccgagaaaaagtcgccacaatgatcaaagattatctcggaagaggtttgatcaggccatcattttcgccctgggcatcacccattgtgatagtcccaaaaagggatggaactctccgcttttgtgttgattatagagggctgaactctgtaacagttaaagatgcatttcctttaccaaacatcgatagcactttgttagcgctcggcggaaaaaagtttttctcggtcatcgatttcatgtcaggatattggcagataagaatggaccctgaatcggttgaaaagacagcatttgtgacggaattcggacttcacgaattcaatgtcttaccgtttggcctctgcaacgcagttgcaactttccaacgcttcatgacgcgtctttttgaaggaatgattaacgattctgtttttgtgtacatcgacgatgttttgatcgcttctgaatcttggagtgaacatttaaagcatcttcgagaagttttcaagcgaattgatgaagcgggtttgaaactgaaaatttccaagtgccgttttgccgttaaagaaattccatttcttggccatatcttaactcgagaaggtgtaaaaatggacatggacaaagtcaaaccagtcattgaacttccaacgccaaccagtaaaaaagaactccattcactccttggattcttaacttactaccggaaatatatttttggttttgggtctttggcagcaccactgtttcgtctcctaaaaaaggacgtgaagtttgaaatcaaggaagttgaattaggcgcaattaaagcactaaaaaagagcattttggaccacgcaatgctttatttcccggatttcaaagcagcagttgacgaccaaaaacggcaatttgtgatgttaactgatgccagtaaaattggtttagcagccatactttgccagccggacgaaaatgggaatttaagacccatttacttcgcgtcccgacaatgtaatcggcacgaggcgcgatactgcccaacagagcttgaggcgttggccatcagatttggcacaaagaaatatgctcaatttatcactatgattccaacaagagtgataacagaccatcgtgcactcgtttcaatgttcaaaagcaaaaacgagactggaaatagtcgtgtggataaatggttgatggcgatgaattcccgttttatccttcaagtcgaataccagcctggcaaaaagaatatacttgccgacctcctttctaggtccaaaacattgcttaacgcaacagaaaaacgtggaaagggaaaaattcaaaa

SEQ ID NO: 15627 - DNA, 4701 bp, Heterodera glycines
ttttcattttatttctttcatttttcacgttttgagtgcccccccccccaatttcgtccacataaattgccaattactcgcctcaattggcgcagtttcttctgccaaattatttaacaaaaacaacacatttcgttgcagccaaaaagtttaaaaaataatttaaaaaagacaaaatgaagaaaatggcaaaagaacaaagaaaatggagaaagaagagacgggcggcgcgagagtcaaatcggcaaatccagcacaaaacaattgtcaaaagtcccattttcttctgatgcgattggttggccgtcgttcgtagcgaaaggctttttatgcggcgatttgaaagcaaagaccaaaagacaataaaatccttaaaatcaccactcattgatgagcagcaacagatggacgaatgaataaatgaatagggaaaagggggggggggggggacggatgttacgttaacgttacatgtgtcatctcttaataagcaacaaacaaaacgatttctccagctggcatgagatggacagtgacggaaggaatgtggcagccgatgagagaaaacggaaggacaaatgaaagaaaagaaaaagagaggaaaaagagagggggagagagacaagcggataaagggataaaaagcgcaattttaaatttatttacttttgaagagaaaatgaaggaaaagcgaagcaaatggcaaattaaaacggaacaattcacggaatgagaaacccagcggaaaaagaggtaaatgtgaaaatgtgggcggaaaggaaaaaacgcaccaaagggaggggaaaggggggggctaaataaagataaaaatgattgcccaaaaacccatgaaaatacaaaccaataaaatacgaaaacgaagtcaaataaaaataggaatatgaatacgaaaatataaatacgaaataacaaacaaaataaaaattgcaaaaaaaaactcaaaaaacggaatggcctgtttcggtgccaaatcaattaaataaataaatcattaataccatttttgataaaagtgaagacagatttctgagtgtttttggggagattgatcactgatcagtcacaaattttgaattcctttggcccatttcgaatcccgcgccgaattcatacaaaaagtcaaaaaaagcagtgaaagccaacattgttttttcctttctttcagctgttcatctccgaaattgtcgaaaagtatttgaaggaggaaataggcgaagacaaaagcgacggaagttcatcctcttcttcttcatcagagtcagcagaaacatcacgggaaacggaggaggacgagcaaatttggggaggaaaagcacgcactgatcagtcccagtgaaagcgccgtctgatcagtgaagggacggagcaaaaaattggtgattgacgcaaaaaaaaaacagattgtcattccatccatatttataattattctcttgatataaaatggttagaaaatttggcattatttcaattgaccccataaaaaagggaacacaatcggtggcggaatgtttgggattttttctaaaacttatgccttttttttggttttcgctttgaatttttgaccatttcttttcgagacttcttcaatcattctgagaattgttttaatttcattcataaatcattctttttttctatttttccgatcacttcctttatcacttttctcggctttttcctggctttttctttctctatcacttccttttcctttcatttttcccatcattcctttattttttttgctaattttcctatcgttctgtttattatcttgatatttttctcctttctcccctttacaccaccacatttatcaccaccgatcggagtatttgtcaaaatgtgctcattttgatttggtgcaaaaggacggacggacctttgacgggacggaacggaaggcgggggacagaaaattcagtaccaaaaaaagtaaaaaaaattttatgaaaaggtgatgaattgaatgtacggattttcataattttttcaattactatgccaattagcacaggcttatcgatgggtagggttgttgatggttacaaaattttccccctttctacgggtcacaattgggacgagactgagttgtccgcccgatcagtgatcgtttcgctttgggtgggggttaagtgatcgcagcaccgatcggagagtgtcacacgacgtatgatcaaacggtcaatcgcgcggctgcaatgatcgggggtctccattcacccctccccctttcccccgcccgcctccgccggcgactgcgaccggcgctgacccgaaagtccgccgtggaattttgcgccgatggcggatcgagaaaagagtcgagaactgatcagcataattgggtcactgcgcccgccatctcttcgcttcaaaatgctctttcattcgcccgcattccccccccccccccataattcattcgctaccatatttatttgtgcggtgattgtgaattaattgaacagtgccacgccgccgaggcgacccttattttgatcaagtgaaaatgagggcagaaatttcacctgaaattgcttctactattttgatgagctaaaaaaggaagagactcaaagtgatcggaccaatccttcccactgatcagtccattcgtgcggttttggctaaagaatttttgctctggaatttccatctgctctttgttttcccccaattaactgatcataaatcttgagtaccagtttttgaataatgatgctcgaggccgattcaagatactcgaaactgagatctgactacgataaaaccagacaaatacacaattttaacgaaaaatccaaattttctcgaaattggaaagaacccgagattttttcttggtcgagaatcgagaccgtgaatctcgagcatccctattggagagagtgacttaatctttgctttgtgccattcccagcccattcattccttttttgggcgatggcacctcccaatccgtcgttgcaccgcgtccatccgttgagtccaccggcggtgcctccccaccacgggaggcaacaatcgctgctcaacccacaaaaagggcatatgccaacattcagtgcagtgcccaatgaccaaaaggagcagccgaagtaagttcagagtaattagtagacaattagcataagccattagcagggacggataattatggcttttgtttttataattgggtcctttctttcccgaaaaggcgccgccgctcgctccgtctgatggcatttgcgtcggtggcatttgccactgtgtcggtgttggccagtgccatcacattgccaattgtgtacagccatgtgcagagcatccaggcatttatgcagaacgaagtcgacttttgcaaggtgagagaaagcgaatcattcattcattgctaaaataattaattggtcaccgagaaaacttttacgatggcaaacaaagagagaatttatttttataaaaaattagagacaggactgaagaagtctcgagaatagactcgggatgagaccaagaccacgaaaccccaaagttttcatctaatcaaaacctagaaaatcgagcattttaggcatctattatattgccattccttttttagacgcgctcgcgtgatatgtggcgcgaaatgctgcacgtccaggcgattactggtggtttgccgacgtcctccgacaacggcaccgccacgctggctgtgaccgctgcacgggtgaagcgtcaaactgttggcaccacgtcatacgatgcccaactgctagcgggtgcagtagcgggtggcggttcgccgccgggcatcagcggaaacccgcagggcggcagctgctgcagttgccaagtgggcccgccgggccctcccggaaccgccgggcagagacggacggcccgggtcagttagccaaagaccaattaggcccggggcagggggataaaagaattgtgccctatttcagtgccccaggacgtcctggaaacccaggacctccgggaaagagatggcgtgctgttgcccggaccggtgagatgtggagatgaaagttttgaaagaaaaaactaaaaaattcagcctccaaaacccccgtgccaaaaatgccctccagggccgcctggtaataacagtttccatgaaaattgaaaacttttcctcataaaggtccgcctggtccaccggggccgaagggtttgccaggcccccaaggcgaaggtgggatttgtttgaaattttaagaattcgttaaatttgccagctggttcatcgggcagagatggagcgcccggactgccgggaccgccgggcccccaggggccgcaaggaccgcccggccttcccggggacaaaggccccccaggagagccggggaaggtaaaacaatgtcagctattggtggcactttcaaccctcaaaaaattaaggtgattaacggggcaccgccaggaccacccggtgagtcaaaagggcaaatcaaaacgccacactttgtgaaattgtcagaaaaacataatttaaattaaagggcccttgggttttccgaaaattaaataatgaatatttattatttttcttaatgtttctgccatttacaggtcctccgggcgcaccaggaccacaaggttggttcggagtataatcaatcaaattaattaattgaatattattgtctatcactgactaataatgcgcta

SEQ ID NO: 15628 - DNA, 4004 bp, Heterodera glycines
  misc_feature (47)..(47): n is a, c, g, or t
  misc_feature (62)..(62): n is a, c, g, or t
ccgaaataccagaaatttttaccgtatttttccactattcgtgaatncgggtgtaatattcncgggttgtaaccaatgaattttgaactggactttcgacactgaccactgaccgagtggccttacaattattcgtcaaaattattttatggtcgcttttaatttgcattcaccactcggtaccgaaatgtccaaggactcggttggttgtactcagaaaatcagatccttttcagcttttttggccttgacccccaaactgacgagaaaacagctatcaaaattcagaaaactgataaaaaaaaattaatcttaaaaattcactaaaaattccaaacaaaaaaaggtcgccgccggagaaaaatttggacctttatatgaaaaatcggttccgagacacccccccccccccctccattgtctcaatcgtccgtcgtattgcgctttatctgacaatgagacaccccttgcacattatgatatgtgatatgttccattgtcaccttatttatacgttcctttactttcattaagtgtttttcttttttccttgaacattttatgtatattcgggatttcatgtaatttcttccagaaacgacgtcatgatcgcgacagttcggactacgtggaggaatcgaagcggcgatgcgacgaagcgcggaaacggcaaatcgaccgggaggaccgcgcacggaggcgttctcgggagaagagggagcaggtggagaaggagtacgaatactacttgcaaattgcgtgttcggagtccaaaaaggagtcgcaaaaaaacggcggacagcagcacaatgttggtttttgagggattttaccaattcacactttaatagtgccgaaaatcagaaaaggcctttttaattactatggaaatcgacagctcttaagggctttttctggccaaataaggcgttttaaaagttcaatctccaaaaatcacaaatgcttaaaacgcttttcatgggaccaaatgagttcttatctaatggaaaagtcatttattactaatatttattaacaatattactataattagttgtttttttactattgtaatttttccgattgctctttttcttttcccttttttgtgttcgtttcacttcgttctttttccatccttttttcgttcattccctcctctcccttcactcctcattcttttcggcaaaactctccgcttcttaaatttcacccgatcagtgattttctcttcactcatgcttcgccccctcccctccccttttcctttctctctctctcccacttttccttgggatcgccaactgtcccaaacagttgggtcgtccgtccgtccgcaaagcgttgtgtagcaagaaacgcacgaatcgcttccctccttttattatgggtggaagaaacaattgagcaaaaagagaaacttttccaggcgtttagtcaaggaaaaagcaaaacgaaaagggcaaatcttaaagttttttatgcacaccgcttgcccccctccccccgaaatttttatttttaccgacgactctcaagggtttctcttatccactctctgaatctgatttacaataaaaacgatacttgaaggagaaataattataaaaaattttttaaattttcggatggctggctcaaaggcacgaaaaaatcgattgagtgagaatgggtgagaaagttaaagagtggacaagagaaggtgagagggtttagacagaagcactcgttgtgtgccctccccccccccccccccccctccctgattgaggttcgctgatcaatccctctcccccctccctccctcaccagccggtcttgagtaaaattgggagagagtggcttaacgggcggagttactttgcggcccattctaatgggcggagattgaacaattgttgcctcgggcagaaagctgaacgtaatcgatttgtgaggttcctctccgtgcgagtgattgggatgataagagaacgatgagaatgaatgaatgcatcggaaatggggggggggggagcggatgtcaaaatgagcggtgagatgctgtttcggtgctttgtcttaagttttaaggaaggctaaagcgaatgaatgcgaagtttgctgccttccgttcattgtcatattttcgttaattatttcggctttgggcgcttttcaaaaaaacggaatcttttcttttattattattattattggctctttttgatatgtcgatgcaatttaaagatggcaacgacccgaaaaattagttctgaatccaactcaaagaacaaattgttcgcagaaaaaggttcggtaaatcggacaacaaaatcatccaacaaaaaacagcagcccatcgttttgataccgaaacgacgaaagcacaaaaattacatttccaagcggaagggcaacaaaacttcggctgcacttcgccaatgcgtctccgacccgtgcatttacaagagtttcgatcattggcatgaattgtggaaagaacctccggacggatgcgatgggccatgccgaaagacgagcattcggcagcgaaagaagctctccatgccaagtcaggaccagcttttctccaaccgaatccaacaattggacgcggctgccgcgaaacttcttgccgttgccaatgcgtcgattgacgaggaggagaaaaagatgatgaccgtttcagcatcagaacaactcgatgtgatgggcgtagtttcttcaacggcaatgaaaacaggacaacttgatcgaaatccaacgaggaatggcgccagggaagaagctgaattcgtttctgagataaatgctggaaacagccgacggaactccaaaaaactgaacattcagccatcacttgatatcactacaccgtcaacatcaaaacaactcgaaaaacaacaaacaaaagctccagtaaggaaaatctctggaaggaggcgcagaattgaggaattgtcgagaataaaagaggaattgagaaatgcaaaactaccatcttttgatgacatttcgaggcgtcactctcgacttcaaaaaaaggaggacattgaaaacgcacaagcgaaaagcacagtcgacgcagtttctgccgcctttcaatccacacaacaagatgccaatgccaagaaacgatccgtcggcgcttttccagcctctttgttggataacaatagagaaaaacaaaagcacaaaaaagccacagtgatggggaagccgccagcatcaccttcaatgcttgcgcgtcatgagctgaacaggttggccgagtattcgggtcaatcggctggacaatctgcggcaaagtctcccgggatcaacaacaacaataacaacattaattctgtcatctcgccttgctctccttctcttaacaattgttcgtacatgcgtctgcggaatgctccgccaacttccgctgttcgtccgccgtcaaaattacctcttgtggcagtttccattgaccaggatttcgacaatccaatgtttggatttgacacggatattcgagtccctcaagagcatcaggctgaaacatcaacaaccgaaacctttgatctgcttgcttctgccgttgatactgatgccaatgaccaatgttccgccgagagttgcaatagcaacactcacaattccgctcatcaacaacgggccaaaaacatcactccattggagttccaggcaacaattgaactcaacaattctccacaaaatattgctgacgcagaagacgaggagagagaagacgaacattacggaacaccagcggatgaaacaactgaggctcgggttcccgtgttgagagtgtcaaggcacggagttggacgtactgagcagagtgatttggatggcaggcatcaaatgccatgccatccgcccgtccctccgcccccttacccgggcagacccaaacccgtaaacccagcaaccgcttcgctaattgcctccctccaacttccgccatcagtttgtgccaaagtaacaaaatcattgccggtgtggatcagtggagtaaggaa

SEQ ID NO: 15629 - DNA, 2653 bp, Heterodera glycines
agagcctaaaaatgtcatccctatacataagacggaagtagtaattctccataaaagtttttgtagggaaatgcccaattttaatgactgattaaataacaactctttttgtattcgcttcgctaatttgtgtagcaaatagaagttagttagtttaactcacttcgattgagtaatggcctcgaccatctcaaaaacttaattaagtatttcaattttatgctttcccaaagatttaaaaagaaaattatccgattaaataaataaacatttatttttatttatttaatttaaaaattaaaaagcaaaaaaaaatgagaataaaatgcttttgggtttctggcaatacaatatgaattaaataaaataaaaaatggaagaagaaaggcaccgttcatgagatcaaagaccaaattgggcttggcaaaaaatgaaagatttttcggcacattttatttctttctgtccgttgtcagaccaaatcgccctcataagtgtcccgaatgctaatcccgccattttcgtgctgaaatgtgctcatcagtttgggtgccaacaacactgatgagccgccgttgggcaaacaatgcgttggggtctgaaaaaatgtaataaaaattagaaatattttaagcggattattggcacacctccgaacaatttcaatcaatcaatttatacgcaaaagcgtgacaccgacataaataacaatataaataaatttggtcactgaatgagatgaggtggtttcaaaagtaaagaatcaacatcataggtgtcaagaagtttagcaaagtcaatggaattaagtaacctcgcctctttaggcaaacacctatagaggcgagaggtacgaataaaaaacgaatgataccgaacattggttgaacaataagcggttttaataataaaatcatttttcagttctgaatatgtttttgaaaaggaatcattatgctgaatatggatcttttccaaaattatatcatggaagagttttaaatctatttttattctgcgttttaagagggattcttgtttaaagagttggaggagttcgttatacccgggtatatcatccttattattattacgtctaaaaacaatacgtaaaaatgttttttgaacattttcaagagcatcaatgtcttttttcatatatggattaaaaatcggagaaccaaattccaaaatggatcgacaataaacattgaatatatttatgagaatttttgggcttttagttttaagtgacttgagtaaagcaaaagatattcttattgcttttttagtaataaatcctatatgtttttcccattttaagtcatttgaaaaataaatgccaaggtctctaactggttcaccttcttcatttttcaaaattggaatattatttattaagtaacattcattagggtttttaggcccaagatgtgaaactaagcatttgttaggagcgattttaggccatttaattcacaataattccgaaatttattaatgaaagaatggagtggagaaatagtattttttgatagtatagaataggccttaagatcgtcggcaaaaagcttaatttcaacgttttcagttttacaaaaattaggaagatttgaagtaaattaaaaacaaaagtggtcccaaatttgatccctgaggaacaccacttaagcaagggaattcatcagaaaacgcagaaccaactcgaacaaaaaatgtacgattttgtaaataattttgaagccatttgagcaaagtaccatttataccaacatttttgagtttagaaactaatctttcgtgtggaacagtatcaaatgcctttgctagatcaaaatatataacatcaattgattttttgttttccaaagctaaactaaagtcatcaatgacttccaaaagttgagttgtaacagagtgttttctcctaaagccatgttggcaattcggaagtacattatttgtctcaacaaaattagtgattttctgggtaatattttcttctagaatttttgaaattgagcataaaagtgaaattggccgaaaatcaacaggatttattggattgggtattttcggtactggataaataattgattttttccaattaagggttttttgatttttaattaattcttttaaagtttctacatcaattttattgataattttattataaattaattttataatataaataaagaaatcattcaggtgagttataaagatatgaaatgaaaagctcaactgtaagttacttttttgaataacaacgaatacataagtctcatttttaaatactttttattaaaaaatagttataaaattatcaaagtgatttaaattatagatggtgctgggacgtttcttaaaaaccgccacattgggcgtttcttaaaaccgccagggcgtttcttaaaaccgccagggcgtttcttaaaaccgccagggcgtttcttaaaaccgccagggcgtttcttaaaacgccagggcgtttcttagaaccgccactttgggcgttttcttaaaccgccagggcatttcttaaaaccgccagggcgtttctaaaaaccgccactttgcgcgtttcttaaaaccgccagggcgtttcctaaaaccgccaaggccgtttcttaaaaccgccaactcatat

SEQ ID NO: 15630 - DNA, 1532 bp, Heterodera glycines
  misc_feature (1508)..(1509): n is a, c, g, or t
taaaaacgaaagactttgatttttgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttagattttttattcatctccctttttgatagagaaagcatctgagtgcctaaaataacttgtaaataaaatttggtgcgtttaaaatttgatcgtccataaataatttgtaattgatcaggggctcaccaaattttgcagggatacgtatcggaacactacaaatgcttactaatttttctagattttttaaacccggtgaaaattttttgcagacacccaccactttttcacttaaaaaaatttcaaaaaatttgatcgtccataaataatttgtaattgatcaggggctcaccaaattttgcagggatacgtatcggaacactacaaatgcttactaatttttctagattttttaaacccggtgaaaattttttgcagacacccaccactttttcacttaaaaaaatttcaaaaaatttgatcgtccataaataatttgtaattgatcaggggctcaccaaattttgcagggatacgtatcggaacactacaaatgcttactaatttttctagattttttaaacccggtgaaaattttttgcagacacccaccactttttcacttaaaaaaattcaaaaaatttgatgaattaattttgctaaaaaataaaatagtgaagctttaaaaattaataaaaaattttaaattcagaattactggagttagcatcatagctgtgcttttccttgtctttttgatgccttcgcaaaatctggtgcgcttctgatcagttttttaaaaaaaagttaagcctaaaatttttcgcatatttaaaaacaattaaaaatttttagattttttattcatctccctttttgatagagaaagcatcagagagccttatttaacatgtaaataaaatttggtgcgtttaagagcactttctgaaaaaaataattatgaattaattttgcaaaaaattggaaaagtacgcaaaattgcaatgtctaaaatttttaaagaaacattatgggacagttaaataattatatgaataagcattattctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctannatcacgcagagacgccttttcct

SEQ ID NO: 15631 - DNA, 3084 bp, Heterodera glycines
cccaattatttcatgtggatgatttcgcttctcttttgtccaagtttcgactctgtttttatgcattgttcaagacaatatatgtataatcatttctgcctcattttgaatcaagatttcctttggaaaattgtatgggtttttggaaaatgtatgatttttctctttaacctacataggtatttcatgggaattttctccatttttaattctcgtgacgagagtttcatttttttgtagatcgtgcgtacgtttttatattatttatttattatctaagtaccgtatttgatactgaaatggaacacccccctgaaataaagcctcccttttgaggagggttgaaaaatagagcccccgttcgaattcagtaaatacagtatatttccgatgttttaaccacctctgcctctccattgatcaccttttctgtctgatttggtatcgattgaccggaaaatggatcaatatttttcctctctctctcgctctgtctgtctgttctgtgcgcatctcaatatgttttctcctcctctgattccgctttaaaattgaattccatggttcgattattgtcatgtaaactcactcatttctctgtgtatatatatatatatatatatatatatatatatatatatatatatatatatatatatatatatatatatatatatatctatcttccttcctgtctggagatcggacaggatctatgataagagaatattgacccatgagattttaatttgctgccaaaaagaaacagattaattttgtttttaaattttcctgcaatatgtattaatgcttaaattctcgcattttatatgattaattctattgatcaaaaattgacagtcatataatcataatcataatcacagataattgtaatccagccctccctgtgctcgttgtaaactgattagagcactaaacatttttatcaaacaccatttgcctgattaaaatatgcttactgcatttttcatgtacataaaaataagggtcggggtcgttttcgcgtgggccgttttcgcgtggggcgagttttttaactataacttttttatttatcaaccaaatctaactttcttgatatcattcgatagccctaagtgtcctctattatcctgtaaaaattgcgaaaaatttcgtcaaggttcaaaaaagttatggccaaaaattttcgaaaatctggttttttgaattcgaaaacggcctggtccgccaatcacggatcaaaatcacggaaaatttgaaaaaatccgtgacccgtgatccgagatcacggcaccccaaaaaccccgtgatccgtgatcacggccagccctgatggtgacggccaatatacggcaatatcttgcatttgaatcgattttgagcaataaatgtgaattttgttgaaaattgagtttttgactttttgttcgaattcggggtcgaaatggatgtcggattcgtgatcagcgaccccgaaaacctatattttgacttttttacttaaaaattaaaaaaaaaaatttctgggggacaaactgcataagagccgacgaacgaaccattcaaagtagcaacagcaacaaactgttgaggagggcgttgttcagcagacaaaacggcccagcaaaatgccaaaatgagagtgagtgggaaatgaagtgagagggaccggtggagggaagggaaggagaaattcggagtctctccccccgcccatcgattgattgaattgatggatttcacaaaacaaatcccaaattcaattcccttctttacatccaacaatttattgcagtaataaaaatggatgtgtttattggggaaagaatgtggaatgaatgaaatttaatttggagggaaggtaatgaggagaatgagcgaatgaatgaatattacaaagatggggcggggggggggagggattgcgtggcggccaaagaaagcgtcgtcaagaaatggccgccgccattgcccatccccaaagtgttttgcttactctctcttcccattttgttcgctctcctcacatcaaaagcactctcatcgcccggagtccgcggaggaggcgccgccggtcaacaaaaccaacaacaaaaggaagggggacggacacccaaccagtcgaacaacggcagcagcaaaagcgaaaagggacgggacggggaatggacgggcaaaactgtgagaacggcacgaaaacgacggatgaacgatgagacggaggacaaccggtgccatcgttgtcattttcatcccttccgcaaggagctaatcaccaaaaccagtcatggaatttcttggaaagaccgatgcaacatgtacaaccgtagtcggcccgtaatgttgccaaggggggcgggggggcatttcccggcgattgggtgatcgtggtgaccaccgatcacgatcaccacagcattagtagtagcagatacagttagttgcgcaatatcggaaagtcattctgtatgccagtctaacaaaaagtccgaaagtccgtccattcgtcgtcgatcactttgaaatggctgcttaacccacccggcaattgggaatggattcgtgcagcagcagcagcagcagcagagcagcaacttgttaaaactgaaaaacggaccccaccccccccccccccgggggttatttgtgtttgtatgggcttattggtcgatgaatgcgagtcaaagcgggcaaaggcagagcataacacggtgagcaacataaaaagtgaaatttatcccattaacaaatttgggaaccgcccacttcggcgccggccttttcggcgccgttgctaacaacttttttcctgatcaaccaaattaaaaatttttgttatcattcgctagctcttcagattctctattagcctgtaaaatttcaaagaatttcgtcagtttacaaaaaagttatggccaaaaaaacctcaaaaattaactttttcttggctttttcggcgccgcgtggcataacttttttatttttgaatcaaattttagacaatgctttggtttcaatgaaaaataaatatgagaaaactaacaacagggatattgagaaaagaaaaagaaaatacaa

SEQ ID NO: 15632 - DNA, 905 bp, Heterodera glycines
attagagcaaatacggtaatccaaaacaggcgaatgaaattgactgggtgatcccggcccggttttgtacggatcgttatgacagcaaaaagatccggcatagaattgaagtgcaactgggcgaggagagcaaggaggagcgtcttgaagctggcgaatcgcagaccaaatggccaaatgcatatgtgatcccgtcaaaaggtcggtccaaaaacaaaccgttatctatccaagagtgatcacagtaacaatttcagatgggcacaaagtccgaataatcgacgcgccgggaattggtgacacaaaaggcgtcaacgaagacaaaatcaactttgacaagacgctcaacttcatcagcacattgcctgaacttcacgccgtttgcattctgttgcgtcccaacaccactcgcgcaacgcccgcaatcacatattgcattaagggactgctcacgtacttgcacaaaaatgcaaccaacatactcactatcataaattggcagaatagataacgattaacacctttttagaacattgtttttgtgttcaccaacgcacgcgggtccaattatgacatgggtaagttttaactgtcaacgaatcagtgaatttatatacttggtaatgattttcaggaaagaccgccgaagtattggagaaactattggcccccattgaacgagcgcataatgtttgactttctgtttttttcctcataaaagtgctttattcgctttcttataaaaaggtgtcaattccactccatcgggaccgaatttattgcgtggacaacgaagcgtatgaggcattgtgtctgatcaaaaagggcggcattgaatacgaccaagcagagatggaaaacttttcgaggagttggtcccatgcggagaaaggatttcggcgact

SEQ ID NO: 15633 - DNA, 2101 bp, Heterodera glycines
attaccatttgggttgcattttgatgtcaattatgcctcctaaccatttcagaccaaaattgaccggatcaacaaatacgaagaatccatcaaactcggggaggaacaattggaaaatgctccaacacttgaaaccattgaattcgtccctttgcctcacccgcgcactgtttgcaccgcggtaaattttgttacattttatgatcgacagcttgtctcctcatctttgtttttcgtcgaattattggatttttctaacaaagaaaatatgttcatttaggccagttgcacttcaatccagcgtacacttactggtgatgtcaagctcttcatgaagcactgtcacgagcattgtaattgtatatcaaagatcactcctgaaatctttcccgatgagggcttgaaatattgttgggcaatggatgcaacgaacacttgccgggtaaatgtcccagaattcaagagcattaaaactttttttatccttttatcactcacaatcaaacccaatccattttagaagtgtggatgcgattggagcgtgcacatgcactaccattacgaacaacgccaaaaaaccctcactcttgaggaactcaaacaaaaactcatttctgtccatcgtgaggggttgtcaacttcggaaagcgttcagaagcaaatgttggaagaacgagggatcatttacaaaaaggcacctatgaacataaaacttgacttctttggacgtgacgttttttaggcggcacaattttgtgccttcctgaagaaatgggcgctgaagccgtacaacgacagcatggaggcgtacatcaacatgtccattaaacaggcagaaaaagtggtcttggaatgcaaaggagaagcggatgagaatcttcatgaggacaaactgaagggacttcgagtcagtccgagcggaaaacaattaaatgaaattatcgagctgattgactgtttaattatgctaattaaaattcaaggaatctctccgtctctaccaagaagagaaggaactcattgacaatgcaactgcggacgattccaatggaccaactgttataacggcggagaatgtgaagaagttcttcgatgagctgtgcgaattgcccttttttggtgcagacattcggcaaatgttcgagacaaagcaaaagtcacggcacgagcatcagaaagagtactccgagaagaagacaaatgttggggtgaagttgagaccaaccaaaagtggaaaaggtgaaacagaaagccatagattaaattaatcccactgattgtgaacattaatccgatccctaattaagtcgtccaaccggagcagtgtttgaacgaagagcagcgaaaactcttgaaggcctacaagaagaaacaaaaggaaatggaacagttggagcgggaaatggagaatgagaatacgctgcaacgtcgtaagtatagtagaaaatggggagaagtacggtaacaaatggcgtaaaaagacccaaaaagaatattccgcttttttgactagcgcgttcagtataaacgttgccagaaatgaagtttctctctatctctatgtgtctatttattgcattaatatttctgtactttcatttagcaactggaaattccgctgcttataaccaaccgtcaacgtcgtcatccagcagttcatttttgcgtaagcaattccaaattatatttttttaagctccataaatttacagagaggattcccagctacaactatttgttcggttcgtcttcctcgcagaatgtgtcgtcgtcatcatatggcacacactcgcgcaacagtttcaatttgtcttcaaatttctcttcttatggtgcttgggaggatgatcgtggtgtgatgccgaagaacaaacaatggcacaacccccgctggggaccgaagtgatcaaagaaagtgacaaatgggaggacagacaaattattttaatgggaaggagaagagcgggaaaagtgcttttggactctatcattttatgagctttttaaattattaccatttttacgaaatttgacacgttttatcatttatttttattcactgacattttatttattcattttgttttacttttttggatta

SEQ ID NO: 15634 - DNA, 3162 bp, Heterodera glycines
ctatatttcaaattttaaattgagttcatgaattttctttgtcaacttccaaaaatgcaattttctcgtaatttttttagtgaattttaattccaagattcagcaaaagaaaaaaaaatcaaaaatattttacattattattttattgaataaaaatttgctttaatattttttaagataacagtcatgaacgctacattgacgaattattaaatgatggtgttagccaactcccaaaaacttgcgtcaaaaaagcgattagcacaaatgaacaaaattctaatgctgttgcttcgtcttctaaatctaaaggtattaaatattcgcttcttaaatgcgcaaatttattttgtcaaatcctgacgtatttattgaactgtgaaacaattaaatattttacggttattaaaattgcacaattatatattagccatttaaccatacaaaaattaatgttttacataaattaatgttttatggagacagaaaacttctgctcaaagtgctgacaagagaactaacccgaactataagtgcttaaatcacttatttaccactttttattgtgtagagaagggattgcacggaattctccgatttccgacataaattggcccctaaattgcaaaaaaaattttacaattttaatataaattctgataacaaaatggacttaatttaaaaaaaaatttttccggtggtgccttgcggcaccgccgaatctcctcacccttatcaatttcattttttaagctgctcggaattccgacttccgacacttttgggctcggaattacgacttcccaaaattttttggtcctcgctataccatctctggtctggaatatagttttggctttttttatcctgtatcaaaaactggttttgaaaaaattcattaaatgaaaatgctcacaaaaatacgttaatttaatgcagttttcctttatgtattttaatgaccattttatccgccagcagacagatgatgaattattttgatttttctttaaaatattattccatcaagcatctttttattcacttaatttaattttattttctgttactatttaagcggtaatttttttttgctgataattcaaaaaaaaaaagtttatttgctctaacttaattttttaaattttttttatccattttcgaaattttgatcactttttactgatcagtttggggatcagagacaaaaaagccgaaaatttacaagagcaaatagactatttatgataaatattgtttaaaagttctttaaacatttacagttcggaatgttctttgtcagaggcaataattaatgttaaattacataaaccataaaaaccgatatttcgaaatagatttttgtattggtaacactaaattacgaaaaaaaattttttgaattataaattttatttgctgcttttaatttaattaatttaattttttataagaaaattaattagtaaccaacaatttcagaacacaaaaacgaggaaaatatttcgataccaaaactaatttttctaaagaccaaagcaaattctataagtcacatgacaatagcaaaaagcatacatgcgcatatgcaaaaaatgagaataaatgaacacgcaaatttgaacactgtgcaaagtgatcaggccatggaagacattgatcaaaacattggaggaactgatcagacaaatgtgtcaatgccaatagatgtgatcaatgaaagtgccaattcactgatcagtctattagttatgccaattgcacacagttctgcagctgatcaagcccatccaccattgtcagaaggtacaaccaataccaatttgacaagcgataaaagtgatcagacaggcccagaaacaccaaacagtcaacggaaacggtcaagacagcgaaagcaaagctcaagcaatatccagcggactgaatttttaggatttgcatcaacagaaacggaaatagcagttatcaaacaaaaagatcaaagaaatgatcaaccaaggaatcaaagaaatgatcaaccgagtgatcaaagaaatgatcaaccgagtgatcaaagaaatgatcaaccgagtgatcaaagaaataatcaaccgcgtgatcaaagaaatgatcaatcgagtgatcaaagaaattatgaattcaatgagcaacaaagttatcagatgcttggactttatgatcatgatgatcaaaatattgaaccaatgtttgttgacacaaatgcaccacaaatgatcgatacaagcgacttcgatcaaattgctcaactggctggtgacgatttgatgttcccccatccgatggaggtgtatgacgagccgaacaatgccgaagaacaatttgtgatgatcccggtcggaaacagcacacaacaaattgtagcagaaagtgttggcaaaacaaaaagcaattcaaaaagtggtcacggaaaaagccctcaaagcgctgatcagaacatgcgcgactatgcttctccatcaattcaactgaagcaaaaagcgggtcggcaaaaaaagccgaaaattgacgagaaaatggaaaaggccaaatcaaaaatgggagtggaaaaagcgccgatcaaaccggcaaagcacaaatcaaaaatgacaatgggaagaccactgatgagaaataaatcaataatgattacggaaagaccaccgatgaaaaacaaatcaatggtgataagtgagagatcaatgatgaaaaacaaatcaatagtgataactgaaaaacaaaatacgaaagcggacaaaggcaaatccataatgatagaggaagaagattcagcgactgattcatcagatgaggtacactaattagttaaatcaaattttattgctctccattaattaaatataatgagacaattttttgcattcctatgagcaaatgatttaatgagtctttaaaaagagcaattaaaagattttgaatttttggatcgaaactgattaaatcatcatcctaaaaacaatatttatgattcgcaattttctcctataattaaagagatttctacacaaaaattcgagtttcgaaatatttgaatttcctatttttaattaactcaattattaattttcattttgcatttaaatgaatgattttagatagagacaaaggttcaactgataaactggccgatgcgaacatata

SEQ ID NO: 15635 - DNA, 2467 bp, Heterodera glycines
gtatattatttttcaacctcctcagaagggggtatataattggaggccggcagattaatggagactggcatatagaaagagtatatacggtaattggcattttgttacatttatttttggctcttgttttatggactacctatgaacaattatttggagaaaggttacctaattatgaaattaaaaggaatgacttactttgaattgtgttcatactgtcttgagcaacacaaagaacaacggatttctctaagaaaaaccaattctaataaagctagtctaaaacattatctaatcactattatctaatagttctctgtaaacaacattcttcacctttctctctaaattactatcatctaatctaattctcagcttattccaagctcttgctctcgaaagagccacatacaattgaccatggctaaaaacatctttcctcagatcaattccaacttgctcaagggtttgaccttgggtcttgttaattgtcattgcaaaagctaacaccaacgggaattggtgcctatgcaggtcaaaagggtaatctaaagaacagcaaagcgtgatccgaggaatgtaaacagtctgacctgccttgtctccagtcaaaagcttacacatgatcaaattcggatgcatttcttctacattcattctcgaaccgttacaaagtcccatttctatattcaaatcgcattaacaaaacaatagcatttttcttcagtctcaacttatgccgtggaaaccccgaagggttcaaagcattcaaatactcatccaaatattcaatatgctctctgtctattctcatcttgagctaagtctatactcgtataaacaacttcttctccaggcaacatttctaaaactctattattcatttcactaacatcaatattcttcggtgctaaaatggcacttttggccatttcattccaattctcagagacaatacatgtgcaaaaatctcttctgctaaatcaccattgctaatacaattctcgggcaaaattatctcatcgttttcattattccattttccactgccaatctctaacaaatctctcgcaaattcttgctctgttgcaagagctctcatattcttcgtcaatttatatcttttagccaacctccagtactcgcttctctttatggttgagctaaccatctcagctctcgtagcatgtttctgaattggaagggtttgacgaaagtctcccgtccaaagcataaccttgccaccaaatgcaattccattattcattatctctttcaatttctcatccaaagttctcattgcgcgcttatttatcataggcgcctcatcacaaataaacaaatctgtttccttcaattcttgccaaactcttgatctcggactaatactcgaattactcatatccaaggttaatccaaatctattgtgcaatgttctcccagcaggcagcaaagttgctgcgatgccagtaaaagccattgtacaaactttcttcttctgacctctcagcatatgtacaattgtcttgttcacatgtgtctttcctgttccacccggtccactaagaaagtagaacgcgggttcatttacaggattccatactctttgcaaaatttcatcacaaactttcctctgttcatcatacatcaaagtataatttctttgtcccaaatccaattcttcggctagatcaaatacttgttcaacatcatcatctacatttatctgttccatcgatggaaaatcggcaagcgtttttccagccttcataatactaagtgcaatttctctatacgctttagcattagctatttctcttctaaaattcctgctaaaatcttcagacaatgagtctttgaacatattccaaagctcctctggtttggcagggttgcaatggactaaaatcaatgcaaagaattctctcaatttccatggcatctcaaaactctgcttcttctagggcttttttccactcttcatcatttctaatcaatcctctttctagacatgcggctgaaaaagtttcacaaacttttgcattaccattcatatcaataactgatttcaaatcatcataggagcatgctcacttcacattcaataataaaagcctcaggtggtatcgttccggctcagccggtgacacctttaccattcggccaatagtgttaaaatgtgtttttctctctgtccattttcctttgttaaaacaaaacttctctggtatctgatgataaaacagagtctttgccaagtcatttgtcttattaaattcaaaataagccattaattctgatccagtcgctattctttcacggatctcttcttcatccatattctcatcaaaataacaaatatgttttccttgcaaatgtacagtcaaagacataatacaatgacttcggtcgtacataggcaattcaaggggggtccacactgcttcttgcgggcaaatataccgcg

SEQ ID NO: 15636 - DNA, 1486 bp, Heterodera glycines
ccatttattaaaaattgctttatgccaaagccatttattaattgaaaccaaataaaaattaaacccaaaaacatttcccattttcaaaaccattttttaacaccaaaaacaataaaaacaaaacataacgccacacaaattcaaacagtggcagaaacatacatacagacactcaactttattatataggatattttaaatatattaacattttgttttacgccaagctttttttttaacctttttaccgtcaatgaaggaaactcaacattttttaaattacctactcggtttttttcgtttcttccatgatcaattttgtcaattgatgatgtatgaaaattcctttagatagtaaagttttcgttattgactctgaacattattgtttgtcatcgaaaaagacaaatggtatgccgttttcctatttttttatctgataatttttttaggcgattagcaagggcactaaaattacgccaaaaggtggtaagggcggcaaaggaaagaagaagaagcttacgctaaagtttgtgatcgaatgcaaaaacccagtggaggatggcatcatgaagactgccacatttgtgagtttggtttttgggcgcatctgctttatgttgatagatttcaatatttatgtaatttttattttgccatagttaacggttctcgcgagcgtaggggcccattccctagtcagcctcgtcaacactttttaggaaacctttcttaacgaacggatcaaagtcggcggaaaaaccaatcaactggcggctaatggtgtcaaagttgaagccacgaagacaaaactggtcgttacatcggagcagccattctccaagcgttacttgaaatatctgacgaagaaatttctgaagcgcaatgctctccgggattggttgcgcgtggtagccagtgccaaggacacttatgaggtttggttttcttatcaccaaaaaagggtggatgtctttttcaggggtgttaaaatgcagttcggtccccctcacatttgtattaaattgaggagagggtcggagtgtggttaggctatatataacacagcaaactagactcattaatccatttttaatttttagcttcggtacttccaaatcaatcaggaagatgaagatgaaagcgacaatgaagcatgagcgatttgccatttcttttgttgggtcgtattatttgttgcactttttaccagcgataaaaacttgttaaaggaattgtttatgactaaaaaatacatgataattgggtaagctcaatgagtcttatttgatcaaaaaggattttctcagctcctgcaatcgctttcttgcgtcgagtactcgccgttcctgggctaatatgtcttgttccgtgatggttggaatctgaattagaatttgtctaacataaacagaatttaatttcattcttcccatattaaaagctatccatcttctgttagtggtaccctttgctgttaaacctg

SEQ ID NO: 15637 - DNA, 2726 bp, Heterodera glycines
tgcgtacacccattttgccaggagtatggcccgtggaactctgtggatgggcgaagtaatcatcttacatccttaattagggtgtcttcgcttcaattagtcactaattaatccttttaatttataatttcctatttaaatcatttcaataaagcaattaaaagggttattagagaataactcgattaattagtatctaattaaccctttaaataaatgtaattttttgttaggatccttatgtgattgtgaccgactatgagctgattcgttcaacatttctactcaattacaatgaacaaacgtcgggacgccatttttttcgcatcgctgaactcgtttctggtataagccattggaatgcataataaatattaaaataaatcggtgttaaaatgtaaaaaccatttttttatttaattgtggacgcgtgtacaaaatatgattccagggtatattaattattaattttaaatgtttaattactattttttcaccagactaaaatttaacaattattttatctttttataaaagtttccttgcataacattaaaatatttctgcaactaaatttaaaaaaaaacctctgccatgcaaaaaattagtaataaatattttcaaatgatttaaaactttttaattaaattttttttagtaatgacgcatcacaaatttgtaaattttttgtttttttttctaagcaagtcatggtttttacggcattttaaaaacgcatggtgaagtttggctgtacctgagaaggtatgcgctctctacattgcgaaacttgggcatgggccgaagccgactgagtgacgaagtgaatttattaattttttagctttatccacgaccggaggccccgggttttttttgccatttttttaagctcaaaaccgactgtctatttccgtcgataatacccataacaaatgaacggtataaactattcaagccgacctcattaaccctattttccgactttggaatttggcatatactatcgacctgatattctttttttggcattatgcagaccgattgcaaatgatttcaaataccattagccaaaattcggaaccccaaaaaatgcttcctacaaaggggcggaatgcaattaatttaaaattaaattttaatgcttttttagatgctaattggtctacgtgaaatgtcggctaaactccgttccgacatcaagcagaatggtccgtgcaacattgatttatgcaaaccaattagtgtgctggtcggctcctccattagcatgcttttgtttggtcacccgctgaaagaggtaaataattaacgattttctgaagcaaatatatacataactcataattgtggtttattaataaatttattaaattaataatatataattaatagagactggctggccattcaaaagattcgatcatattgaaaaacccaaaaaaacttcaattaattcgttatttattaggaagacatggatgattttttgaaagtcaaagcgaaaacgaccttgcttttcttgttgttctcatggtaagattttgaatatttttgaaatataaacaagcaaatgaaattgtaccgtaattagagagatacgatcgctaattacaaaaaagagactatttctcacatttatttaaggtggacgacacaaattgttgcttcatcgccactttggtatggaaatatgaaccaaaaaaatgggaattttctgaattaatttatttttaattatcaatgggttaatagcaataagctaggcttgggacgaacagaaatttttccactgtttttttcaacaaaattaatcaaaattagctatttttgggacaccatttttggcataaattttgcaattttcaggtggcttcgccattttcccaccgttctcaacaacttttaaactgatcgatcaaacactgaccggaccatatgatttaattgacaaagaaattgccaaaattgtgaaacggcgccaatttgagtcgaatttatgtgccgtttcgttggtggacgactttttggatacaattcaaaacagtgaacagcgcaaaaagaatggcacaatgccattggcgcaggacaaacattttcagtaatttttttttaatataaataaagttcattttaaatcaattaaatatatcaaacaaatctttaagtttaaatttgtatttattcatatctaaggtcacaatcaaaaattttatattaataaatatttattaatatttgttttttataacaaaaattgtacaaaattctattaaaaatcacaaattataatttaaatatgtaattgttcaaaattggaaataaatatattttgatatttaacacgttttattcattgattagtaaatataaaaaataatttcttcgccatttagcatggaatcacttcgatcactctgtgttgacttttatgctgctgcaaatgtaataaataaaaattaaaactttaaatcattaactttaattctttttttatatataggaatcgacaggaaacactatgaattttttggtgatttacatgatattgcatcagcaaatacagaacaaaatgcacgacgaattaaaggcaaaaaaagaaaaaaattaattttttaaaattaacttatatatacagttcagtgatggcacgaaatttggatttccgaagaatttttaggcctaggaattttggttccgatttcttaaaaatttagagcgttgga

SEQ ID NO: 15638 - DNA, 766 bp, Heterodera glycines
aaaactagagttgtacgggactgggacctggacacggaaaactgagtacaactgagtacctaggtcccggttttgaccagttttgaccgggaccggggaaattcccggttttttcccggttttaccagccaaaaagtcccgggttttcaaccaacaaagtcccggtcccggttttgcccaaaattccctgtcccgtttcaccaaatcaaaaaattttaaaatgctattttgagccgctttcttcatagcatgtgcgcagaaaaaatatgcaaaatcatacaatttataactagggctccaatttttaggtaaaagcctatttttttcctgagctccccgtggcctgaaacgcacgaaaaacatgtttttttggatgttgttaagctacttttcgagttattagtgcctattttctaggcttttatttttgcgcctaaaaagcctaaaaaaatttgaaagagcctacttttgcctattttggcgttttgtccaaaatttgttaataaaaatgcaataaaaacgaaaaatacaccccagaatcaacctaaaaaatttttcaaaaaattcatccctaagaatcgacccgaaaatttaattaattaattttcttgacaagaatttgtgatttaaaaattatttatctcaatactgatttggcttttttttaagtacattttgtatttttacactcctaaaaatgaggttttttagtgcctattttccattttttagagtctattttgggggtttttttagagcctaaagc

SEQ ID NO: 15639 - DNA, 2513 bp, Heterodera glycines
ccaactcatccacagcttgtttcttatacgataattagtgacattttcgtgcatggacaaattaagaatggatgatgagttttctatttattatatggatatatttggttttgatggatttatgctacataattaaattttaccataaaatctgatgagtcatcatgcggatttagacaatacacaaaatataacaaacgtttcacagagcaaacaaagaaagaaccgagaatgttattaaattaagtttggtttcagccaattctaataagagtgcaatttatcaaatcttagtataagaaaaagacagtggtaaacaaactgatcgcttttgcggattactacaaatatttaattttagcccaaaaatacaaaattattcaaaaaatcccaacaaattaataaatctggaattaattttggataggaacgaattataatacagcgttcatattttggcttaactttcgagttattcttacgatgtatttactgatcaattcgatttttcgggatcagcagggctcactttagatgaattttaatatatttaacgctcagtccataattttttttattgatttataatattaatttttacgattaaatattggaaatataccgaaaatgaatgacctatgggcaaattgcctttgtttcgaatggacaattggtcattttcgccctttggtgagtttgttggaggtaatgggaaaagcagcagcagaagaatatggaaattgtaaagtaggtcatcaaatgaatgcctcccatttgtgttgcgcataatttttgtttcgtttggggcgtttcggcaaataattaattaataaaaattctggaaaaattcaaccacctgccaaagttttactttttaaatttcacagaatgacaacaaaaaatggcactctcattgagcgaatggatcggctgttgaccaatggatatttcgcggatgtgcactttttggttgggaaaggggaagaaaaagaggcaaatttagcaaatatttaaatcaaaattaatgtgaattttgactttagcttctgtcggcacataaaattcttttggtgacggcttctgaagtgttcgaaacgatgctttgttcggacgacgccgaaaatgaaaagacaaaaaacagtgccaagaattatagacaaattgaaataaaaaatatttatttattttttgccccttcgcatttgcgtcccgtgccaatcactgacatcgatgccaatgtgttcaaggtgatgctgcgcttcatttatacggcggatttgagcggattgaacggagacaacgcaattccattgttttgcgctggtcagaataaaaccaaaaatataaaatcattttgttttaattagccaagaaatttcacctgtctgagctggccaatgcttgtgccaacttcccaatttccaaattgcacaatgtgtttttggcatttaaccacgcgcgccattttgaagaaaaggtaaaaaattattgtcatcagcagagatgagattttttggaaataaaaaattgccaaagggtagccaaatacagaggaaaaacctcatccccgatgactctttaggttagagccctaaattgtatgttttcatttttcatggtttaaaatgattttgcactgtctcaaaatttaatggtttaaatttttgagtgcttaaattcatttttaaaaaattttcatcatttttgggcatttctttgaataaaatccaccttttttatttgggggccaggcgccggaggaaaaatttgaaattttgacattttttacagattttcactgaaaatttgccattttaaaaatgccttatgcgttttatattaattctatacaaaaatatttatgataaaaaaaaataataaaaaaacacataaaattattaatgaataataaaaaaaatttaagcaaaaataatgtaaagttttttgactatttggcataaggcaaaaattgaaaaaccccgaccccgaaccccgaacgatttggcaaccccgaccccgaaccccgacacttccaaccccgacaaccccgaattttccaaccccgacgtaggggttgcaaccctagtttaaagaaaactaaaattttattaagaaagaaatcacgatttttaaccaatttcacacattctaaatcatttgttcatctcccaattgtttatatttttgcattttttttccattttttctttcttcgttatgcgtttgttgttaatgccaaattttctctaccatttttcaattgttgaacggctaactccgattttcttaccaatttccgcataattttgttcccattcttttgccgaaaatttcttttttgttaaattcatttttttcgctaaatcagtagagttatgatgatgcttcatataattttttaaattagaaaaattcatttttattcccaaaattgaatctgtgaacaaaaagtttcaacaaaagtcatttggcgaaatatttggagaaaaatggcaagaaaaagaagaagaaaa

SEQ ID NO: 15640 - DNA, 939 bp, Heterodera glycines
aaaaatatatattatttctcagctcattcagagagtatgtactaaaagttccgaagttaagctagtgctgctagaggaaattatacccaaagtaccatatcatactgtcgggcccatataaaaattcttgaaattttcatgaccttgaaaaaatatatattatttctcagctcattcagagagtatgtactaaaagttccgaagttaagcttgtgctgctgagaggaaattatacccaaagtaccatgtcatactgtcgtgcacatataaaaattcttgaatttttcatgaccttgaaaaaatatatattatttctcagctcattcagagagtatgtactaaaagttccgaagttaagctagtgctgcttagaggaaattatacccaaagtaccatatcatactgtcgggcccatataaaaattcttgaatttttcatgacctttaaaaaatatatattatttctcagctcattcagagagtatgtactaaaagttccgaagttaagcttgtgctgcttagaggaaattatacccaaattaccatatcatacactcgtgcccatataaaaattcttgaaattttcatgaccttgaaaaaatatatattatttctcagctcattcagagagtatgtactaaaagttccgaagttaatctagtgctgcttagaggaaattatacccaaagtaccatatcatacactcgtgcccatataaaaattcttgaaattttcatgaccttgaaataatatatattatttctcatctcattcagagagtatgtactaaatgttccgaagttaagcttgtgctgcttaaaggaaattatacccaaagtaccatatcatactgtcgtgtacatataaaaattcttgaatttttcatgaccttgaaaaaatatatattatttctcagctcattcagagagtatgtactaaa

SEQ ID NO: 15641 - DNA, 930 bp, Heterodera glycines
attttattgacactttgtcatcattatttactttattgaaaaagatgcccatttatgatggatggatgatctgtaaattgaaaatgtcctgaattgccttgtaacggaggccattaccccggagtccataacctaagaaaggcatctgatccataatccaaatttaacatcatttattcattttatttctgaagcttagaaaaagcgaaccttagatgaagagagcgtttttttttgttcaattattgtgtgagttcaagagtgatccagcagaactaattcatctgactgatcagcggggatcaattcggaaggatttggatgatacggtgaaaagggaaaaaaaagggagatttttcagtgatggtaccgcctccctagcccttcttggtgcaggaatgtgatctgttcttatttctaagtgatgttctgattttggtgtagtgaccaaattttgttctgatttcttaaaatcattcgtaaattttgaaatttatggcgaaatgttatttctgtcggatgagtcattattgttcagcaaaatcgaatgctcagcaaagacggagcgcaattcttgaaaagaacaattttatataaacggtatgcaaatataacactaattaccacaattagttcccttgcactgcacaatcgaattattggcatcagtgatttttttatcctgctgttccccttccaaatgattgattttttctaaaccgaaatttttttcaagagaattaattggtcatcacttttttaaacacaatcaaattaaataataatggcatggaaaatttcagagaatttcattgtttttagaatgtgatttatagggggtcgaagttgtatgaactaaaaaatgccaaatatgcgcatatataataatatgcactaaaaacccgccaaatatataaattgcatcatttt

SEQ ID NO: 15642 - DNA, 1996 bp, Heterodera glycines
aaaaaacgagatgtgtaccaataaatagagagtgctagagaaaaacattatctttttttctctaattttttgtctccttttggcgtactatctaatattttcattattaggaaaaacaacatttatttcgccacatataactttttttctactcatacaatttacaccaaattttgcagaaaaatattatgaatatttttaacgctcgagttttatttttttacgctccgatctaaaattattcaaaaaaacaaaatttcaaacgcttatatcttttttcaaactagaaaaaatgcttagcatttgcttagaaaaagcttgtactttccaagagctttcgaatgataccaagattgaccactttggttggcaaaaagcttcaaaaataattcccaaatatcgtcattttttatggacagaaataaataaaaatattcatgcagcccaacggacttgatctcctgcctttgtccctttctatcttacaaaaaccactgagccacacatgcaaatcttttttggtacagcagctcagtttccggatgctgtgaaaaacggtgatgcgacatttggggcgcagacacttgcggcgaagaattaaatgacccaaaaatatttcaataatttatttaagttaacagaattgttattttaagtttacttttcaataatgactaatttaacaataattcttgcaacctaatcacaaagataaaggttgagtcgtttgccattctaacagattcagaaaacatttaatttcgccccacccagcattttcaaagtataaatgggatactgtaataaaaatatttttataaggttcattatcaccattaaaaaagaggaagagcaccaacaaaactgccggaggccttatgggattgacccaactcgtgggattgctgaaagcctcgcttaaaaaatatctgcgaaatgatgaagcgacccgtagattagttaatgattttgacaataaagaaaacaaaaagatgatgatataattaatagagcctgataaaaaaaaattccggaagcgggagcaggatcgggagttcaaaattttccgggacgggagtcccgaacgggaatcccgtaaaaatcccgcgggtgtcccgatcccgccggcctctaataattaatcacattcataaattgcagtaccgcctagggatgaaaggctttgaagaataggactgaaagagtgattaaacaaatattttttaatcaaaaaaatttgtttaaatgatttttggggtcatttaattctgcgccccaaatgtcattttgactgggcgccgcaagtgtcgtcgccgcaagtgtcacgccgcaaatgtctgcgccgcaagtgtcgctttgactgggcgccgcaaatgtctgcgccgcaagtgtcagcgccgcaaatgtcgcatcacctaaaaatcctagccctaatcaatgatcattcaacgcattcaacggaaactatcgattgatataaggaattaaaatttggttgattttaagcaaagttacatgaaaaaattgtttaaattgatgggtttttgactaacgtaatacatagaatagcaccgacgaaaacggcgagcagaaaaaagggaatggcagtgcattggaatggaaggaatgcaacagaggaggaacatcaaagaggagaaaattttcaaaatgatgaccatttgccgggcgttttagcccctcccccgaaataaataataaatagggccgcgatttttagtgaaaaacttttttttttttggcttaattgatttgaagaaaggcgtaccaggtgttttcgacatatgaattaatattaatatacaaattagcatatacaaaatttataatttaattaataatgaattaaatgataatttttgtcaaaagatatatcgctttctctttttctatacaaatatttcttgaatcacccaaaaatccaacaaatatcttagattagattgttgattcgtatggtaaaatctgctaacaaatg

SEQ ID NO: 15643 - DNA, 4531 bp, Heterodera glycines
tggatacgtacttagcgccttaaattaccccaagaacagtgttattagaaccagtaaaagaaatgattttcaaaagacccgaaaaaaaataataattaaactcattaaaaaatacgtaaaaatataattaattgtgtattattttgatcaaaagcacctaccctttttcaccaaaaagtaaaagatcagaagcacgatcactgcgacgattggccaaacggtgtagtggactggaaaatttttaaacattaagtgattaatttgcatttataaatttattttatttaagcaaatcaatcatttgaattatacatatttctctacattttaattgtttatttgtaatttagttatttatttttattaattaataatttttatataatttgtgtggacaatttatttggaatgattaatctaaaaaagccccgactttaatcggaactggcagccccatatgaacaaaaaaatgtttcttatttaatcagagctaattttttgttaaataaaagataaaatttcgattagaaaaataatatttaaaaaatttgatggcagtttttgagaaaaaataaaaaaaattttagcgcagaaaatgttgtacaaagaaaaaaaaatagaaaatatttttaacgaatttatttttttaaatgaaaatgagttttttaaacatctgaattccaaggcatgttgtactgaatttgaaaagaaaatttcaaaatactgatttcgatttaataataatattcaaaaaaaatgcttaaatttttcattacaatcaatagagcgcaattttaagaaaaggtcatttgcgcaattaatttttgtattcagtgccctaatttaaatacactatattaataatattaatttcgaggaaagtaattcaatttaattaatttcaatttttattttttatataattttgggaatatttagctaattatgctaatcacttaccaatgtcgtttttgtccgagcgtgacggcaccgccgcattcttcgtaatttccagcactgaaaaaaggtcaaaaataggccaaacgattaaataaatttcaatgttaattctattaaatagccaaatatgctaaatggcgtcatttaacagtatttcgacactttcttgtgaatacggtaatttaaatattaaaattagttaattactaaccactgctgttcccggacgatggcagtggcatcgggacggtggaactgttttctgaaaaaatgttaaagattatgaaaatcgtcaaaattcaattacagaaactaaccactttttgtttcgtaattttcgtctcccgccagcggcggcatcgcatttgtggcattgttacctgataaatgttaaaattattagagcgtattttctgtaataccgcaaaacataaattttttttgaccacttacccatttccgccatttcgtttgaatttttcggctaattctaaacgataaattttttaaattatatttgctcaaaatatttttaacaatgaatgaatgaagcgtacaaaagcatagattgaatgatgaggaatattccattcgttttgtttttcctttattcgtcatcattttctccatgttttggcttcttcattcttttttttcttttattgcctattttcttaaattcgcccccgggggatgtttttcaatgattaatcatttccctccctccccagggaaatcggaaattttttgattgtgaaacgcattcctttccttctttacagttaataaaaggatactgtattaaagtaccgaaaaccccaatttggttcggtacgacttaaaaaagttaatctcaaattggcacaaacgaagtttggccaggcgaattggacagactgagttggccctcccctcccgcagaaaattttttcattgttctcggttctatgacctgtctctgcttctcctcctcccgtactgtttgtaactgattaaaattaatgtccccagtttttttatttcgtttttaaaactcgggtatttttgaaaaaaaataataattttaaatctgaagtttccgctcggaaaaatttaccaatttggtttctgtcccaattagaaattgaaggttccgagtcaggatcattttttcataaaaagcattcgactctgagagccgaacgaaaaagccagaggcctcgaaggccataattttacggcatgccctaataaaatttatgaaaattgcctaggaaaaaccactgggacaacgaagcagaaagaaaaagcacacccaaccgaagcacaagctgatcaatgccttggcaaaataaaaatttattaaaataatattttaaaaaatctatttcatttgtattttacccaatgattagtagtaacataaagtttgaagatattcgagacttggaattaggctcgagacaaagaaggaaactgatcactttgtatcgatttctctgcaattttttttctttgttttcctattttgatcacttacaatggtaaaacacgcgggcgccaagccaaaagccgatcagaggtgatcatttgaacacttcggaaaaatcgatcagagtgaatcggacgtcgacagtgctgtcgagttagcaatacttcagcgagatgttcacccacctgacacaattagcaatggttttaagcgtatttagtaaacgaatcgattggatgtttgcagaacatttgcggccccaattaaagtcgaaattttgcggaacataaaatttttccataaaaattttaattttcatatttttggtggacaaaaaaatgtgatcaaataaatctctcacttttctaattcaaaaggttactgatcagttgttcaccagtgtgataattaattttcttcaagcactttttaatcggcgttaattcgtaaattttgatttctgttagctttgccattctctcaacacatttgttttcggcatttttacctaaacccattctccttcaacttaagctggtgcgttaattagggaccgggccgaagagtccgatttgggcttgggccacaaaattccacacaattttaggccgaaaaatggcggaaaattttacttaaaaaagaattggtgccaaatgttgggaggacatgtcagaaaatttattgagtcgatgtcaagactctcgcctcctgctgatttacctgacgagcacgtcgagtgcaaatattttacgggttgtcaatgacacaggaggaaccaagcagcacctgacagaggaaatttaaaaaaaatattttatttttgaaattcaacataccaaaggccatgcgatggcggacacgaggctggccaacattgtttccatcagcgaacgttggatggcgtaggaaaaaacaaaggagatgtgatgaaaaagtcaatgctgcggcccaattcctccaagtactgcttgggaaagttggcgatcgatcacatttagtttagactatagcaaatttatcaatgccagattaaatgaaaaaaatgttattcagtcattgatcagaccagctaaacatttgtcttgtccggtgccaattggatgcccactggtcatcacaggaatccctgcttgattaagtgatcacccatcaaactcactttgttctcccgtgtactgctcgctccttgctcatccaaaggtggccaaatggtgccgaaatgcgctgtcctcccggtcctcaatccatccggacacgcagagaacacagtgaagtccctaaatgccggtttcgggtttaaaattcagtttttcgaattaatgctgcagcccaattcaaaaaataaggcgtttaaccaaattaaaaattacaatattacttttcaataaaaacaaaatatttttaaatttttgattgcccaatggacggacagacttttgcgtattccaaaaaggccaaatagaaagggaatattttttgcaagtctttttccaaaaaaatttggaattgatctataacctgattaaaatatcatcattacaataaattaaatttttataaccaaataacaatttttacaaaattataaaaaagcaaaattctaattcatagaaaatttaaaaaatatatataaaaaagctattttcccactgtttgaggatgagcgagtgtacaatggcggcattagtgcgcgtccgctcgcagccgcagcgccggcgcggccaacgcggcgcgccgcccgccgctaattaccatctctgaaaattgaagggcatttaccgatcaattaagaaaattccattcatttgtagaattagaatcaaaaaatttgctattaaatttgcaattttgaacggatcaatagaaaataatgggaattttttttgaatgtaaagtcctttttcccattctttggaagtggggggaggcgagcgacggaacttttgctgtgattcattctttcattctctcccccggggggacggacaatcggcggagaatgaatggcgaaaaatgggaaatgaatgccaaatgcattttaatgggtccaatggcaaaaaaggaggacagaaagggagaggtgccatttaatccaggaaa

SEQ ID NO: 15644 - DNA, 2615 bp, Heterodera glycines
tttcttccttgtctctcatcctcccccttttctctcccctcctcttttgcttatctctcaccatctctttttctctcctttagttttcttccttgtctctcatcctcccccttttctcccctcctcttttgcttatctctcaccatctctttttctctcctttagttttcttccttgtctctcatcctcccccttttctctcccctcctcttttgcttatctctcaccatctctttttctctcctttagttttcttccttgtctctcatcctccaccttttctctcccctcctcttttgcttatctctcaccatctctttctctctcctttagttttcttccttgtctctcatcccccccttttctcccctcctcttttgcttatctctcaccatctctttttctctcctttagttttcttccttgtctctcatcctcccccttttctctcccctcctcttttgcttatctctcaccatctctttctctctcctttagttttcttccttgtctctcatcctcccccttttctctcccctcctcttttgcttatctctcaccatctctttctctctcctttagttttcttccttgtctctcatcctcccccttttctctcccctcctcctttgcttatctctcaccatctctttttctctcctccttccgtctcctcttttctgtgttcctttggcatttttcctttcctcccctttcatggccaattattccgtcccttctcattgtcgtcgtcctccgtcgttttgtggcaccacgtcgcaaataggcacagaaagcgctggacaaataaatgagcaattggatgatcgaaatgattgagccgccgatccaaagcgaaatttggcctaatcgaaagggaaagaaatttacttacctaatgatcattttgatcatacttttaacatttaagggcgttaaaaatattttaaatttcactacctccgagttgcgcaacaaacgaaggcggcgtcattgaaagcatatgctaattagtgggggggggggggtaattggaaaaagaaaacaaacggagggacggaccctaatgattgtgtagtccaaagtgatgtaataaacgtccaaaatgattgtgttgcgcagctcttcccatttggaggagtcgttgacaaaatgttttgcttgttcggagggaaaaagcgctgaaattggcaaattaaaataataagcgacagacaaatgaatgaaatgaaagccatcacaaattaataatcaaatacagtaagtgacggttttgtcgaagcgccaataattgcacgggggcccacaatggcttttgcaacgctttaatttggaagagaatggcaaattcgaaaagaaaaataaataaaataaaaaggaaattgaaacatatttcagatttgcaaataaattgcttataaaagaccgcaattcgctcctcaaagccctttcggtacagctttgggtagacgcagcggaagaattggctggtggtgcaaatgtacggcgtcgtgggccgagaagcggcggccaacgaacaattgcagtccctttccgcttgggacatgaaacagtccttggaaatggggaagggaagggggggcaaagggaaattggcactgattagaccgaaaaggtcaaaatcagtcccgagactcagtcggaccgacgaaaaggccgaaagaatcgaaatcccttcggacgcacctcaaaacaccaaacgcgcgaataaacgccgctggggtcgtcttcgcggcatttgaagtgcggcgggtaatttttgaattcgtatcgcgttgccgtgagggggaaatcgcgtggacacccgacggcacaaacgacctgagaagagattttaaaaggccaacacatacttttccttttccttctaaattcatttgttcgcattccattttccgtttttcctccccaaatgttccgtccttttttcgtcaaaatgtccactttttcgtccaagtgtcccctttttcgacaatttgtccaccctcccccctcctccttttgctgtacatgtcgtggtcaatgcctttcccgcgctccgccaatttgaccaccactccgtcattcagcatttggttgacccccgggttgtacaatttcttcggcagtctcagaatgatgcgttgtccgtgcccgaatccgtcgctgcgctgctccccgccgcgcagtcggaagcattttcctgcgctggtcattatctcctcggccttttcgcacgtccgcgggtcgacaaaaaatgcctggggaagggacggagtaattagcaatcgaaaataattcgcccatcaccctcaaaatattctcatttcacctggcacgctattgcggaccgtttcacaaattcagtaaatgcaatttgcgaattgccatttgcgtccccagccgtccgtccgccgacgttttccaaaagtttgctaagttcgctctccatttggtccatgcgctgctgcgcgatcattttggtgtacaattcgtattgaaaagggtgctgggcggggctggggaaggcgagctccaaatattgggcgagaggggcgctgacattgtgcgaaaggagaaaggaacggtgaaacggtgaacggacagacgacgat

SEQ ID NO: 15645 - DNA, 3552 bp, Heterodera glycines
agcttgctgcctgcggtctttttattaatctcttgttaattatctcggataccatttcatcgtgaaattcttctgcagtaaagcgctttatcatcaaataattttttaaataaatcttctgctatgtaataactttgcttgttataatttagggaaatttttatcatggttcaattttataattatttaaattgttttttataggaagcttaaaaaaactttgaaaaattgcttagcatttatttcatggtctgaacttttcatattcatattgtacaagtcagcctgtttgttttaccattgttatgtttaatttaaatttggataatttctatgatcattttggtcttaagctgtcaattcttatgaggattttaattgttgacatccggaattgtctttttcaaacagcaaaaatttatatttaagataattatgtaaaatattttaataatttcatttaaatttattaattttgatttattaagaatagaaaatagatattatttttgttgtattttataatatttttttaacattcgcttatttatgcaactttttgtgctatcttatttttttatattaattattttaagaaaatctccgattaaccatcctaactttcgttctttttgatgaaatacaggtgaagtcataaaaaaattttaattaatttttttaaaagcttttcattaattaaagtgatagtatttcacttttatttaaaaaaaattcactcgtgaagctctgtggcgtttgggctttcttggaggagtagtttcttccgcttcccaatttatatattcttactatttttaaattgtataattcgtagtatttgttttccttgttatattattcttttttaataattattttaatttcttataacatttatttttgatgtaatttttatttattccttttctataattgtgtataaaataagttttattttttatttattatttagaataatttgtgtcatttaagcaagaattttattaatattattaaacttattcataaatattttgttgcaatactccatcaaaatggttcgttgcaaaaattaaataaataataatgattcacaaaaatattttcccaaaaaaaaacttttattatattttccaatttatacagcagtatgtatttaatttacgttacaatgtttttatattactgttcaagttctttaataaagctagctgattagtgcacttaaactaataatattttttaagtagacccggatttttgtgtgctaaaaaccctaaaatatggtaataaaatttgtgctaaaaattgggaaacactcgaaatagaaaatttttttgaaaaatattgaaatttgatttttagggggagtatgtttgaattttcttgcattttccttaagttttttctcaaaaatgccaaaatatgtgccaaaaccccgcaatatgtgcgatatatgtttttatgtgccaaaccgcaaattaatccatgaattacgtcaaattttggaatgataattatttaatataaaacaataatcggaatttttgaatttatttttatttttttaaatatgttattctactgttagaaaggaagataagcttatatttattttgtaaaaataaaattttcatcaattatagtcttttcatattttttcaaattgttgaaataaagcaatttcttattttggtttgaaaattttaatacttgtttaatttaattttttttagtctctcaatgtctttcttttttaaaaatttttcgatcatcaggcgcctcaatagcgcggtgtctctaacccaaacggtcctctttagggccatgagagacagaagaactatttacatttcaaaataattttattagagaatatatgcctttaaagtataaataaatttgtatagtttatttttatgaaaatcttttaaaggcttcaaattgcgaaataaatttctttatttaaatataaagttttattattctcggggccatttcttctttttcctaggtaggatatttgtacgtatgttataatagattatttttataataaaataactgggtattttggaatatttttattattatattttgtcttggatgttctgttcttaaagaattttgaattgttgaattagctaataattttaaaatagcctatttagcaatttatacctttaaggtgtaaaaagtataaataaattttctttttaattttataatgaaattcttcaaattgcgaatgaaattttagttttttgtattatgtccttttgtttttgtttctagtgaaaggcacaattcaatatggaaaaaacggcaacatgcgatgcacgttggaagagtttttttatgaaaatttattaaacatctttgtatctgcaaattttaattttagtaaatgctgagtttttttaatttcttgaatgatggaatataagattattttaaatatatgtttttttaaataaatgaaaccaaatatttataaaataatttgtgtttaatattacttgaaatgatttatttgatgtttagctttgttttaaacaatttttttataatataaatggattaaaaataacaaattttggtttattaaaaaattaaatattttttgataattttgtttctatgaatcatttattttaatgcatttatttaacttaaattgtttttcattcttttatattttattttttatatgtccaatttaagtgatttatattgaaaggtactttttaaacaagaaaatcatgatgaaaaaaattaaatcattaaaactttttttttctcgcggaattgtcgacttttttgaattgcaaatcaagctaaatttgtttttaaattcattatttgtatgtgcggcataaggaaacttaaccaaattcgaccgttaagaaaaaccgatattttgtgaacttaacatttaatatttgaacaaatgttaaaagtatctgtttgcattgtttattaaataaattttcaatatttgcattaacgtctttttttgttattttattttaaattatcacttaactaatttcgtcatatttcttctttttttgcgttatgatgattttaaaacattgtttcaataaatgtctacatttatttttataattcatgagtgttcaagttttgagccttcgtcctcgtcaattgtgacgagctattattttggcaatatatgctttaaaagtataaatgttttgtttaatttcattttcataaattcttttaaaagatgcaaacttcgaaataaaattctttatttagatatatatttttattacctttgttttgttttttattattcttgtattgtcttgtatttagagaaagataaaatgcaaagtttaattagatatgttatgatgaatataattaaaaagtaaattatcacaaaatataatgtttactattatcatggttaattattacttcgatattttgtacaatttaagtctttaattaaaactggttatttaaaaataaaataaattcagttttaaaaattataatttggctctttttatattttta

SEQ ID NO: 15646 - DNA, 5011 bp, Heterodera glycines
  misc_feature (8)..(9): n is a, c, g, or t
  misc_feature (23)..(23): n is a, c, g, or t
  misc_feature (75)..(75): n is a, c, g, or t
  misc_feature (101)..(101): n is a, c, g, or t
ttttatannttaatgctctcaanttatccattccattcattggctaccactttttccaaccgattggtcgtcggncccaaaaaaaaaaaagaaaaattatngtacggaatattaaacgaaaattgtccaattggtccattcccatccatcggaaatggcattccatcagttgttttaacgatgattcggcttcctatttttcgctttttccctttttttcatcgcttttgttcaatttgccaacgcttttcccagcgattggacaaaaattgtgcttgggaagtgtaaatttgtggtgatttggcgcccccttcagctgctttcccattttttctactccttttttgtctgtccataaataggcaccgaaaagccacccaaatcacacattttccattcaaatcacagctaatccatcctttcattcaatcatcaatcagttgaaccttccttgcacccttcatccatcccatcactctgcccttcatccaatcaaaaacggtaaattaaagaattagtataaaatgtaatttttaaaaaattaatttaaaaaaagcaaaaaagaacttcacaaaatggtccgctcaatgcttcgtccatcgatttttgccttgctgccgctggtgtgcctgctcagcgttttgccgaaacccgggcatggtaagtgaatacagtaacagaaattttcaagtgattttagactcgatattattcggtagctctaggagttctctgtagcctgaaaaaattcgaaaagttttattaagtttgaacaaagttatggccaaaagtacacaagcacaaccaggttttcgaatttgaaacttgacgaaattttttgaaatttgcaggctaatagaacatttatggctatcgaataatagcaagaaaataaaaaataaaatgaatttttgactaacattttttacttagaataaacaataaattttaattaaagctttcttagaaccaacaaaactacgtgatcttgtgttttctaatccatcaaaatttcaaaaaattcgtttagtttcaaaaaagtcatggccaaaaattttttaaaacgtttcatgtgtgtgcttttggccataactttgttcaaacttaaaacgaaatttttgaatttttcaggctaataaagaactcttagagctatcgaatgataccaagaattaaaaatttagttgtttttgagcaaaattatgtgaagttttttgttgaaaattttcatttggtatttattttataacgctctctttgatggatttttttttataacgacaaagcacttttttttcaaattccacattaagcaactaagtgcaaatatctcgttgaatcggaattaatgataagaaaaccgcgagacagggattgcaacaatgaagagaaatgtttcacgcagttctgttcaacgcaaaatggtaagatgaaaataattataattataataataacactaaaaataacaataataataataatataatagagataaataataaatacaataataaccagggcttctttttttatgtaaatacatgttttttcctggattctccatagcctaattagtaggaaaaacactttattttttgtgtttgcgaacaaaaattgcgacttttatttacatattttgagatttttctacatattacatatgtacatatttttatacatatttaggactttttgcatattttcgtacatattttgcattttttgagaatttttaaggaattttttttattaaatgtccccaaaaatatccaaaatttcgcaattttttcaaaaattttgagaattttttgtgaaaatgtgctccaaaaaaataatttttttttttttttgaaatgggatatcaaaaattaattttttaaatactaaaagatgattctaagtcctatttaggtcatttttatgacaatttatgcctatttcaccatttagaaagaattttttcccaaaaaaatcaccatttaaaaaattttatttacatattttaatacatatttctggatttttgtacatatttcatacatattttagtgttttttatacatatattatttaatttcataaattttatgattaaatatttaaaaaaaatgctaaaatatttaagaaataaaattatttctgaaaacaaaaatttatattcaattttttatagaaaaaattttcatttctattttaaatttcaaataattttctccctaaaattaaaaaaaatgtttgagcttctcttttaaatagacccaaaatttttgcggaagtttctaacatttagaaaaatgataacaaattttctataaaaaatcaattaatctagtttcataaaaaaatccgattttttaaattttcaggcttatttttattcaatgcgtggaactgtattggcatggacatgacacaagagcaatgtgacacactgagtgcgaataaggcaaacggagatcgggcccagctcaacatgtcgaaagttgctgtcagtgattggaaatgcaaatgcgctttgggaaatgccggagaggacatggcgaatgcaaattttgagtcgccagaaggtggggcgccaacagggcggagcaggacaaacaaaatgtcgccggtccaaacgttgacggacaaacaataaaaacttattcaaattcttgagaattaaaaaaatttaaactttttttttgttttttgataaaccagcgaataaaatttgctaaatttcagcaaaacgaaaataaaaaatgttttccttgaaatttaaattttgtcgaattaggctaggtaaggaaaaaatttttctattttattttttctgctggcgaagtttttggcatatttaaaaattctttataaatattttgaaaagcaatttaaaaacccttaatttttaaagaaacaacaacaaaaaaaaaagaaaaatttttatttttccacacctgactgatttgactgatccttacgcacgcgcgcctaaaagtgtttttttgcgcaacatcaagggcacaaagcccgtagccagaaaaaaaaaattcgtaggaggggggggggaaccttctaaaaatcgcaaagatcagacttttttgtgtgaaactcttttaattccagaccgaccccttcgctaacaccaaattttaatcaattcctacttccaaacgggttttcaataaaattcaaaaaacctttaaactagcgccgaatttattttaatatattattttttttacacatttttcattttcattttcacatttcagcaaaaatggcatgcaaatatcgcatggaatcggagaatgccgaactcaacgaacagctcaacaacaagctcaataaaaagttcaataacaatgaaaaaattcaatgcatcaaagaaaagggaaaatgcggcgcggtgttctgtaaaacgaaggacggtgaaataaaaaaaaatatatttatttttttaaatattaaaataaaattttgaaaaaaagtaagtcagaaagcacacatttctcccatatttctacaatttgtccttatttttttttacattttatccttatttttcccttaaatattggtatagaaaaaaaaaaaaatttaaaacattaaagattcataaaaatatttgtttaagaaataggaccataatttcaaaaactttaacggctatacctaatttgagacgaccatatatgtgtatttttaagtcaggtaaaaaagaaattaaatttctgattataaatttcgaaatgacacaaaaatccttaaaattcgcgacttttgggggaaccacttccccccccccctccccaactcgagtctctcggtttttgaaaatttcttttttttttatgggggtatagtttttgatctttatacatacgttaattttttttatgcaaacatttccattttccaggtgaacttaagtggaacaaatgggcctgcttctccgctgactattccaaaaaagtgtgtgccaaaaatgaaacaaatgccgtgaatgatgagcgtgacaaatggagcgattccaagttgccgaaagcggatgattggaagtgccggtgccgttttggtggaaacggaaaggacttgaccaataacaaatttgtgccgagaaattcaagtgagttgagggcaaaaataaatgtggacagagttttttcaaggacgcgcggaaagcgttttaaggacgcagaattttctgctgtattaatttcaatgaaaatttttataaatttactaaaaaaaaaaattacattcaccacaattttttagcggccattcgccatggtgacggaatgccaatgatcgttgtgggaatcatcatgggtaaaaaatttttttaaactaattaacctaatttgaaaaaaaaaaatttaaagtgccttttttaagctattttgcccccgttccatcatgccattctggatcaacttcagatgaattgagggcaaagattaagaacggaatttgagtgagatgccatcaaaaattcctagccccgatcagcctaaatttctttctccgcttctgaaccatcttatcccccctttttgccgattccgatcagtttcattattccctaattctgatttgcatttgtccccaattttcgatcaattagtgccataattaaaatttattttatgtattttattgataaaaaaaagtgattatttcaatacaatatttttgaaatttatatcagcatttgtatgaatacaatttttatctttgacatttttttattttgtaattaaattcaatcgaaatttaaaattaattttaagtattatttttctgaaattttaagcaattttcttaacaaaattgcattaaaatactcaaaaattttcccggcggcgcctatcggcaccgccggacccctttgaaaatggaggccaaacggcaaaaaatattaattttttggcgaaaaacggcgaaaaattttgtaaaatacaccccataattctcaaaaaaccaaaaatacacccctaaaaatcgaatttttgacttcagc

SEQ ID NO: 15647 - DNA, 1191 bp, Heterodera glycines
  misc_feature (1098)..(1098): n is a, c, g, or t
ttctaattttacaaaaaaatctagaaaaattgtcataaatttagttagactagcttaatacgaaaaaaattcaaataaaaaatttctatcaagaaaattcaaggaaatttaaaaaaatttttcaagttttttgagttttttccggaaattccggaaatttagtttttattaacacttagattttcaaaaagctaaaatacttttaagttttcttgaaatttagaaaagttttaatttttttttttttgcggcgacgttatgtcccggcgacgttttggggtgtactctcttttccggtcttacatattaccctagtgaagttttaagttttgttttaaattgatttttaaagaatttgtttttattagttctttgtcgcgttgattccataattttgttaccctccctcccagcaaaggaaattgttgtgtctgaccaacacttataccaaaactagagcaaattaggattgggttttttggacaaagtttatttagacaaaaataagttaaattggttaatgatcgatttagcaaaatgtggtatgtcaaaatgtgaatgaaaaactgagaagagaagaaaaaatcccaaatggtgtccaatgagctgcttatatacgggtcgggagcagatcgggaaaagggttttaggagagaaaacacaagaaacaaaaaggttaagacgaagaatagtcggcacatcaaaaaaagacaaagagaatgtttttgggaaatgccagaggggatgggcgaagggattagtttgggataacaaattcaacatcaaagggaagaaagagagaagagcattgtaaagggaataaattggggaaaaagtccaaaagcaaaatgccgatcaaaacaaggcaaaacggattcaacagaaatgaattttttgcctagtttatattttgtgttaacaataagtctgtaaatactttttttccaaattttccagttgatgatgaacatgctgcgagaaaagagcaaaaacatccaattcgaggcattccacgtttttaaggtatttgtttttgcgtgaaattttttcccgaacgacggcgccgccgcaccgcaaattttcgttaactttttctanaaaatccgctaaattagctattttttttttgtaaaaatccattaaaaaagataaaaaaacaaaaaaaaattccgcggcatctatcgacaaatc

SEQ ID NO: 15648 - DNA, 1139 bp, Heterodera glycines
  misc_feature (121)..(121): n is a, c, g, or t
accgggaccggctggtcgacttcctgtccgagtttcacaacgagcgcatcgacgacgagcagttcaacgacgagaaggcctacctgatcaagcagattcgacaaatgcaccaataaatttntaaacaatgtttttttcctgttttcaaaactgtggcgttgtgtttgtagagtgagggcgcgggctttttgtttgtgtttattttaatgtataacacaccaaaaaaaaagtcatttttaaaaatatataaactaaaaaaaaataaaattacttttttgtcattcattatatatcaaagattgtcattattcgtctttatcaatccaattatcatcatcgtcaccatgtttaatcccttcttccatttgctgcctttttttgtttgtttgtgtttttacgcattcattacacacagagatttttgtttgcgaagatataataaagccgcgagatttatgtatactaaattgaattttaaaaaatagtgaatttgaaatttcgggttatttaaatgagaaaacatttgtcaaaaattgcctggtttgagtaattaaaaataagatttgaattttaaaaagttaattatataattgagggcaaattctaaacaaaaatatttttcttaatataaaatacggtgattgtttccttttccagaaatggaactctcatacatttttaaaaatcttatttttggggtcaaatcttagtttttgagccattttttcttattttgaagaaaaaaaggttctattgcattcagcagaaaataaacttatataaacgcttctatagaccttgagctttcacttgataccaagaatatatgtattggccaagtaagaaaaaagttatggcctaagaaactgaggatggtcattcatgggacgcataaaaccaaaatctccgtgaatctctattttttattatattaccttatattagaatcggttttggacaaaaaaggggaattttggcgaatcattaatattcgcctcttcgttcaatttcggatccgggatttgtaatggcaggaaactaatatcatggtggaactcaaccccctttaatccccccagaaaaatacaaaacaataaaaaaaaaaaatttttcgtggcgtaaaggaagaacgcacctaa

SEQ ID NO: 15649 - DNA, 2611 bp, Heterodera glycines
gtccgcttctggctgcattttcttgcgctcgcttttcaagcgaaattccatttaatgaaaaaacccaatcgaatttcctccgattgacaagaaaaagtacggtacgaaaaatggaccaaactgcgaaactggtaatctaaaaaggggtgcatggaaaaagcaattgcagaggcagtgccaatcagacgacaccgttggggtacctccccccttgccccgagaaagattgtgtggcttttcgtcccccccccccccctcctcctttcccacctgtatcactgtgatgatcgacaagccgaggaaaaagccgaactgaagtgaattttgatattaatcggaaaggatgtcttatttggcataatgtcacaaaaaccgaataattgtgagtttcacactacgaatgcttgtgacttctgactgacctgtcccccaatttgggacataaagccgggcactgtgatggtaaccaccttgtgggaaaagagggtaattaattgagtaattaacccttaatggtcccaatgagtcacttctttgagatgctcgtactgcaggtcatagaaggacacctccaaattgaacgtctaaaaatggaattgattcaactattagcttaattaaagggtttctgacataattagcgaattcctggagagagggactctgctggagggaaacacttaagggaggggcacggacaaagtccaattgacgacagggcgggcgagggcatcggacagtacctgtactcccaccggttgcagcccgggatacattttggaccgtgcacagaacccgagtggaccagctgaatgatatcggtgtagctgaaagggaagggacagcaatcagcatagaaaggtcgggaaaaaaacaaaggttaggagggaccgatcgactgatcaaatgggagggggggggcgagcgactcgatcactgattttttggggagcctagtccagcggagcatagttcaagcactcactttttggcgattttcaacggctcgcaagtgggtagttcggtcgatattcctctgctgtgaaaacacaaagggacttcgatttacggcatttgaatgcattgccaaactcacacagtgtccaaatatggcaatgtgcagttgaaatggtcaattaccgtcgaagaaagccaattgcgcacaatgcaattggagtctttgccaaacacctggggccgtagtcaaagaagtggttatttgaccaggtcatttaaccatggtcatttgacctgggcccggtcaataagaaggtggtaatggttaaataaccatgaagttggtggtaaacctcggtcaacaagagctaccacgaactttggtcaaacaaccacgaagttggtggtcatttaaccatgaccatgaccctctttttttccctgtcaataagaacgtagttcatggtcatttgacgggagttggtggttagaaatgctaccaccatcctacccatggtagccatatttaccatgagccttttgacacggaaaattgtgagataaaaataaacaaaaataagattcttatagattgaagtgtgctctttcttctgataccaaaataaaaaatttatcttaatgctaagtatttttaaaaccactttttacaaagaaaaacacctccataaaataatttttataatcaattgtggtaatttttgagccaatttaaacatttttaaaaattctttttttatccctctaataggaccatgtatccctcattatcacataaatagaagaaaaaaacaaaatttttatgtgaatctgccccaaaattgcatgtagttaaatgacccgggtcaataagaagatagttcatggtagtttgacggaggttggtagtcaaaacggcacttcgtggtcattttcttattgacccggtttaccaccaacttcgtggtcgtttgaccaggtcaagtaaccaccttcttattgaccgggccctgctggtcaaataacgaccaaccatgtgaaaaacggcagaaacgaagatggtaaattttctgcgttttttaaccgccaaccatcttcttttactttaccaccaactttctaccatgaactgattaaaatttgcacttgttatattaaataaataggcaaaataaggtttaaaggccctggaaaattggtagaacaaataaaaataattattatttacgcattaattttttgtgaaatttttttattactatttaagaacggaaaattcaaaataaatttttagtgcttttttaaatttaaatcaagaataaaaaatccatattatgataattatggtttaattaataaataggctaaaatttgcacttttactcagtgtcgcctaaaaccactaatttttattagctcaaaatgccaaatttggtaattttttggggaaatctgttaacaaataacactcaaattttctaaattttccccggcggcgcctatcggcaccgccggccccccccccttgttccccaaaagttttttggaataagcgtgttttgaataaagttgtaaaaatgagcttttttgactcaaaaagttttgcataccaaatgaggcttttgaaacttttaatctgagagccctgtttttttgc

SEQ ID NO: 15650 - DNA, 1680 bp, Heterodera glycines
  misc_feature (1573)..(1573): n is a, c, g, or t
  misc_feature (1636)..(1636): n is a, c, g, or t
aattaatgatcagaaattgattagaattttttttaataccaaagctaatcaaatccaaaatgctaggaaaaaaaacgaattgcgatggctcttccctaacccatccacccgccgattggagtggaaaactcgcgcacccccggcggcggcgccgcgcgatttccattcattgtctcctgctgtggtgttctcgcccgtccccacctccacctgctgttgtttagcaaacaacgagccgaacaagtgggggagaagggccagaaccagcagcagcaggtgatcaacccctgctcatcagacccaaaattttcagaagtgcgcagtgcgtacaaataacaaaccaccgccctctgctgttcggcgaaattcccgcaaaatttgacggtgtgtaaaaaagttatagtcggagggcgccggaaggtttccaattatttaatcaacctgcacgttgttacattatgccaacaaatgtggcgaataatgatttcttggagaattggaaaatgactttcggcaaattgtttctcccaacgactcacccaacccaccgagtttacaaatcactaattatgatgagtttgctatttaattcaatgtgcctaatttgatcaccggattcaaataaaattttattgcgttatgtctttatttgttgaaaatgggaatttaatcaaaccctgtactataaattatggggctgtacgagagtcttggttctcgagtttcgacgactcaagaaatttgtttttttttggggggggggggtctcgattctcaactgcgacaactttaagaagccataactatagagcttgttaaaagcttttaactgatacgatgtttgtttgatttggtaaaaaataaaaaaaatttagttttcaagtttctgtcggaattaatgttcgggattcaaaaatgtctgaaacggacccaccccacgaaaatttaaaaaaaaaatttcacagaaatttttcgaaattaaaattttttatgaggggaaaagaacgagctgctcccgtctgagacacctcttgtgcatgtattaagatgcaaaatctttggacctgcataatgttaagtttcccggccatcgtcgcatttgcaccaccagcagcagcagcggcgactttctgttgctgctcacgttggtgctgttgttgttggacaagcgcgggaagattcgaaagaatttcggccggtgcatattggcgcaatatttgattttcaccctcaagcagtgtaacctgtgtgaaaaattttttggaaaattttactaacgatttttttttggaaaaattagcaattcatcaggcaaagaaaattgttaaaatgtcttttcttgaaattttatttaaaaaattttaagattctgtttgaattttttaaattttggcggtgaataaaagcatggacctggatttttctgaacaaaaatacagaaaaacctatatcctgggtccatgtccaggtcgaattctagaatttatggtccaaaaactagtcttatttataatcgcaatcaaaacccataattataaccggccctattccaagggaatgagattatgaaccnactgacacgtccctcccaagtcgcgatggtagcacgtaaactttcaacctcctcacgcacagncaaggtcaaatgcgtttttaccaatcctgtacaaaaatgaaatg

SEQ ID NO: 15651 - DNA, 1847 bp, Heterodera glycines
ccccccccccccgaccatggcctgttcaattttgtcgttaatgttgctgctgtcactgggcaatggtggacatggccaagggctggcgccggtacccttgtagtcaatacactcccaacgaccacgagtaaacaccgccggaaccggcacaacctgagaataattgtcatggacggtcccagcaccccaagaccaatccacaaaattatcatttttttggtgcaaatctgtaatttcgaatctcgggccccaattcgaacaaaaaggcatacaaaagtttcaaatttttttgttcaattcgggtccaggattcaaaatgggccaaactaatgtctaattcgtggcgatcccaaaaaaaaactatagacctgaaactgacgctcctttgacttggtagacgacatattagcaacaacaaaaaaatatgtatttaattcctcctaaaaatgtttttgatgagcgataatatttaaattcaaaaaaaaaatttgaatgaactataatgatcatagtaaatattctgggcacattcagcggggggctcaatatatcaatcattaatttatcattgtgcaaaagtgccatcggaggaatttttgcgttttccacaaaaaacaaaaacaaattcaattgctccccacagcggtggccaatcgggcgtatgaatgtgctgaagagccaaatgcacgccgttcaatcagttcacgacgccagcgaacgtacagcgcggacagcacagcatttttgatcaaatgatgcgagggaaagaatggatgggaaatcaaacaaaagtaagaacaaatgacgatcattgaccccccccccccggcgtctataaaaatgccatcatttttctttttaccgcaattccctaaatatagcctcctgaggagctgacaaatgaggatttatatttcgacactcttcgaaagggtgagggtctttgtttcggggattttattttaggaaatatgaaaaattataataattgatgctgaatcatagaattatttgtttgtttttatgcgattttttgaaaaaaatagggattctaaatacaaaaataaaagaattcacaaaatcaaaaaaaaaaaagaattaaacaaacatttaaaaatgtatcttcaactgtgctcatctcatagcataggattaagcttaatttcttttttttcaactggaaatttcctgacttattgatttaacagatgaagattttatcggggtccatttttaattgaattcaacaaattttatgaaacaaaaaaaaaaaaaaattcatggaaaaagcgcactgaactaactccaattgtcagtcgtcaatttttggcgaaaaaattttgcgcacccattcattttcacagttcacttagcgggagcagctcgttccccccccccccccggtttaaaaaaaaattctaacttagaaaatttccaagaaaaaatcctaggagtgttttagtgcacccctttcagcaatgtgtggcggggttacggtacttaaagcaccgtaagacgatttgtccgtttttggtgttacacgtcgacacaaaccacacaatgtgtagcaacaattttccatcatttcccagcagtacagtatatcagaagtacgcagtgcgtacaaataataaaccatcgcgcccgcccgcccaattctctgttcggcgaaattctcgcaaaatttgacggagtgtaaaaaaaaaattatagtctcgggtgcgccggaaggtttccgattaatttaatcaaacgtgcgtcattacattatgccaacaaatgtggcgaataaccaaaaattgataaaagaaagggaacgaatttctgtcacaaaattcgcccaaata

SEQ ID NO: 15652 - DNA, 1086 bp, Heterodera glycines
aaacatttaaaactcgatccgaagtttaacaaaaactcgaaatgttttaatcattttttaaatccactgactcattttctttttcaaaagtgttaatcggattcaaattgcacttaatttaggccattgtccccatcgtcgaattgtgcggaagtttacccttgagaaatgatcgaccattttcgagatgattgaatggacaaattgatctgctggtccttgttgatgcttatttttgctcattaattttaatgaattctttccgatagagaaaaaaaaaattatttgaccgccaagcgttgagacttcataaactaaggatccgaatttgggttccccgatcctgaaaattctaaaatggttttatctcgaaaaaatgggagatttttcttcaaaaaaggggcttaaatttgccctcaaaataaggtgttaaacgggatacgatttttagccttttacctattttttcctgagctcacagtggcctaaaacgcattttttttttgggggggcggggtggcctaatttttttttacttttttgaataaattttgtcattttacactcctaacgttttgatgctgagtttctcaaggtggattaaatcgtaccaggtgttttcgacagtgattgatttcgacagtactttttaattaatttctacatgatttattgtatatttgaattaatattaatatacactttgcaaatacaaaatttataattgaagtaagtaataaaaaataagacttgtatgatttttttgtcaaaaatttatcgctttcactttttctatacaaatatctcttgctggaatgagtcaaaaatacaacaaatttcttagataagattatcaaatcgtgtgggaaaatctgctaactaatgccgggtttgagtgccaaaattcaaatctgaaggctcttaagcaagaattcgaaaatctcgaacccatctgcaatgtataagagccatgatcttatcattttaattgtcaaaatttaacgagacatatgccatatagaacaaattttttaaaaataagctcaagggggacgaaatcaacactgtcgaaaactaacagcaccg

SEQ ID NO: 15653 - DNA, 1982 bp, Heterodera glycines
  misc_feature (21)..(21): n is a, c, g, or t
  misc_feature (53)..(53): n is a, c, g, or t
attcgatatttcgtgcttttntaatcaatattttatgtccttatttaattttntagtatgaatatttttttactctacttatagaaatagttcactatttttgtttgcttccgaataaatttaaatgtgccatatttctgtgttttgccaaatatttatgctttttaaaaatgttcacaattttcagccgtgcttttgccaattaatctttatgtttcaacataaattctaacggctaaaacaattgcatttggccattcaaaactctgatctctgattgaattgtggatagagtccccagctgatcaaagcaaaacgaacaaatgattgagaatgaatgggccatttgttggtgactcaaatcaattttatgtgtcgatcaatttgtgaatgtgtgcttcccctcccctccgctttttccatctttccgtccccatcggtccttgggtggaaaagctttcattttctaaattatacttttattcatttttatgcaaaaattattttaagtttttctttaacattttaaaattttcattttaaatttttgcagaaaaattctgattattacgcaaattattcattaaatataaatgtcgagcagtttggctgatcggatgaagctgatgttgagcacgggcgaggacgcggatgtgcactttttggtggggcaagaagacgcaaatgaggcgagttcggaaaaaatgtatgaaaaaatgaattctatctaatttgaaaccccctccccttgcaccgaaattgacttcaaaatttaaattttttgttttacttttcattgtttgtttcaatggatttttattttaattacatttgtgggcgtgttggaaaaacaaaaattaatgaagccgatgggggggggggcgctaggaaaatccaacactacaccaactttaaatttaaaaaatattttgattgtttttatcaagtttcgaattgaattaaaaaaaacaaattggttgcgccattcgatgggatattgccggattgtttacaaattttttgagatgatcaaaaagggcatagaaataaatataataattatatgcctaccttaaataggttttatggcaataaaatatttattttaaagaacttaagtatgtaacttttattgcaagtattttaaacattcactaagtcaaacaatcaaaaattatttgaaatttaaaggtggtatggtgtcggttttttcagtgtcggattttccagctccgatggagtggggctttaccatttttaattgtgaattgattttaagctcatacaagcccataaagtcattttgaagcgtgcttcggacgtgtttggggcaatgttccgttttgatgcgaagaaagaaaaaacagaaaatagtaaaaactcaataaattaatgatagtaattagtggtttatttaaattagtctctgccgaaagtctcgtggtgatccccgatattgaagcacaagcattcaaagtgatgctcagcttcatttacgcggaagatctgagcgaattaaacggagacaacgtaatggcagtgcttttcgctggtgaattaaattaattgaattttaatttgttttaaattaaaatatttaagccaataaatacaacatctctttgttggtcaaggcttgtttggactttccgattaatgaactgtctgacgtattcctcgcttataagcaagctcgccttctcaacaaaaaagtattaatgatttttaagtatttaatttattaaaatttcataaatcttttgtatgagagcgctaatagcttttgtttattttaattaaattggcttctttttagaatttcgctcgccgctgcatggattacattgaacaaaatgtggaaacattgatcaaatcagattcatttttgcaaattgatcagaatttactgtgtgaaatattcgaccataatatgctggtgatcatcaacgaatttcaactttggaaagctgtaattttaaatt

SEQ ID NO: 15654 - DNA, 2665 bp, Heterodera glycines
aatacgtcggaagcgtgtttcaaaatggagcttatcggtctggcacaagcttaagaggattaaattttaaaaaacacaacaaaatttaccattcactaaatttccaatttttaattaataaattaaatttttaatttgaagactcgcctcttttgcgtcttcgtcgcccaccaaaaaataaacatccgcgtcctctcccgtgctcaacaaatgcttcattcgttcagccaacggtttggacatgctaagcaattccatcattcgtttaattatctatttaaatgcggtaaaattattggcaatttcaaaattggcaagaaataaaaaccacggcacaaaatcagcaaaactttatgttcagttgggctttgtgattattttgaggaaatttgtagcaaaaaaaaacatgcaaatgtttcgttgtgctccttcccccccccccccctgtttttgtgcattttttcatcgctttgccatcggtaaaaaaaattgatccgactaaaatccaaacgtaaacaaaaagaattttggattaccaagtaataaaaaagttatgatttaaaaaagtgaggatgaatactcattggacgcgtaaatattgattggacgcgtaaatattgattggacgcgtaaactggaacagagccgaaaattgaatatattcaaataccattgggtcatgtgaaactataaaaattttgcgccaaaaatagacacttttatcaattttttgactaaaaactgccattttttgttatttattatcaaaatcagacaaattaaaaaaaagatgaagatgaaaggcggaattaaggacaaatgctactccagtcagtttgtatcccattttttagtcaacatttttttcaactcatttttggattaaaagtttatgaaaacaaatattcgggggtttttgaggtcgctgaccacgaatatgacaattattttggcctattgaacacaccatcccaaaaaacgagaagtgtaccaataaatagagagtgcagagaaaaaaacatctctctttttggcgtactatttctttgtctctgataatagagaaaaatcgaatttacttcgctacgtttaatttttttttctatacgttagatccactccaaattttgcatatcgatagagaaaaaaattacaaacaaaatgtaagggtttttaaacgcaaaaaaagggttaactaaaaagttattcgagaaacaaaatttcgaaccctcatatctttttcctaatcaatccaattgcttagcagttgcttagaaaaagcttctcctcataaagagctttcgaatgatatcaagtttttccaatttggttgggaaaaaccttcaaaaataattcccaaaattcgtcattttttaatattttggacataaataaatgaaaatattcatgttgcacaacggactcgaaccaccaccctttgtccctttactatcttacaaaaaccactgagccacacacgcaaatcttttttggtacagcagctcatttctgggatggtgtgtgaagaattgaaaaaaaatgtggtcaaaaaatggggtaaaaaaactggactagtaccggacaaatcttagaaacaatgcaaaatgcgatctatgacaattgatggatcttttttttgttcaattgtttatgatttgtcttccgccatttttgcttcttttacaatgaaatcaacagttagtgtcactttgtcctcgcttttgttgtaaaagcctttgctcgggtccatcaattccttaattacctcataattggaagaattaagcaaaaaattgaattattcctcaccgaaaatttaatgaaatttttaaatccccagtcatataattcaccgttaaaaacatggtctttaaattccttcctgaaatcccaaacaccgtccatttgcggcacaattcggtaaattgccgccgaacatttgcaactccaatttttgtcttaatggcaattaattactttttaatatgaaaagaaaaaattgagagaaaaaaaaaataaaatctcataatttataagagctcagactatccagtttctttgccctgctaccaaaatagcgagaaatattttaaaaaatgacctaaaacgggagaggaaaggagataatttgaaataaattatttttgttcattcagcaaaatattttcaaattgattggtcaattaatgcttctggtcatttaattgtcacacaccgtaaaagtggtaaagtgtgggaatcccgagctgttcgacgtgttgttaaaaacttcgccattaaaatctctactcaaatccgccacttcgctcattgatgaattaattctcaaataatttgattatgaacattttagtataaaaaattaattaaattttagttaatttttttaccaaatcgccttctctgattcccattttgacgtataaatagggggccaaatcggtgttggcatcgttttgaaagttgatgatttcgttcgcctttgccttttccaattcatctttgcccgccaagccttaaaatttaaaataaaataataataataatataattttaatttttttaccaaatttttcggcaagatatcgcaaaatagtcgcactttgtcccaatggcttcctgtcaacctccaaaactggggtttttccgtagaaaaattctgaaa

SEQ ID NO: 15655 - DNA, 2339 bp, Heterodera glycines
taaaatttcagggaagaataatttgtcaattataaattcattttaaattattatgaaaaaggcgtggctattaatttcaaatattttaattatttttctattttaggcttgtactttgtggaagacattttattgaccaaagaagtgcacaaacgatgcattattaaatatttgccataatttcgaattctgtcgggttttccctccctttttcctatctccaaaaatgaattaattttggccctcccctcgcaaaaaaaagcaatttccttccgccaattaaatatcatttcaccagaacgtgtattttatatatttattttatcatcaaattttaattaccaaatgcatttgtattcattttattattttagtttaaatttcattcgctattttttatcgaataaacatttaaatattaattttaatggtgacaaaatatgctttgattaaataatgcccatttcttgaagccaaatagcaaggaaaagcatcagaataacgaagatgggaacggcaacggcaagaccgatgatgaacggtaggggtactgtagagcaatgggaaaggaaagattaatgaatgaaggggtcgggattgatgaagctaattggcaatttccaattgattaactgaccttttcgcttagcttcctctgcgggcatcgaaattggcaccggcatgtgatcgtacggattgggcggagatgccaccggcacgccctgcggggatggcacgcgcgaaacattcagcggcgaattggtccgcttttcgtacacttcaaacgtttcccgaggacccaaaaattctttcctataatggggcaattttcatcaaaaaattaattgtttataaaaaaatggctcactttttcattttttcaggagaaattggcaagaattattataaaataaaatattgaagggcaatttttttacatttcgctttaaaattaaaatttatttttttaaataaatcaatatctaacaaatattaatttgaaggtctaatgaccgtaaatgttaaaatggactttaatgtctttttataaaagaactgatgaaggacaaaagtgtccgtccgcacattggaattttggaatggaagaaaagatgcgatgggaagaaaattggatgatttgggcggagatatttaggggggtatgtgagacatcattttatgggtgcgcgtgcataatcaatggaaaacaacagcgaacgaacaagcgaactttcccatttaagagattgaaatttatatatatttaaataaatttaaattaactaattttggatatttttctctaaatgcaagcagattttgaaggataaaaaaagaaagggaattggggacaacaatatccaaaggtaacataaattttaaaagtgcaattagtataaaatgttagaaaatgcttagggcaataaaattaatatttaattattttgcattaattaattattaatgttgttttcaattgtacacattaaaacatggaacggaaagtgatttttggctattgacaacaaaacaaacaccaaatagcaaatacaaaaacaaccaaattcaatggaccattcgaatttaattcattccgaccggttggaaagggtgggagagattaagagattacagcgaaagaaaagggtggcacaacagcgaattggagagaaaaagaaaaacagagaacggaaatagacatagagagagaaaaagagagagagggctaaaggaacgcgcaaaaaaaagagcggaaaatgccgaaccaacggagaaggaatgaacgaaggaaaagagggagcgaatgccgtggcatgacaaagaaatgaacgaacgaacgaacgactaactgaatgtgactgactgttgttgcttgttgctattgccaatttgtgcattcgttacatttttaaattatactttatggcgaaatatttattttaaatgcattaggtaaatttgaatttcgctaacaaatcaaacaatccatccattcggtcggactttttcattaaatgctttaaattttcagaagattttaccaatttagatcaaaaaattttcccaatctttatatattattttttcaaaatgcggcagtcgcccaaccaaacgccggtcactcgcacaacgacgacgacaatcactgaacaacagagggaaggcgaaggagaccaagtgattgtttaatcaatttttcaaatacagccgataggtccaatccttttcctatttaagagaaccaatcctgaccaattggggctaaggttgaaagaacggcccaacacgcggccgaggttagccaattccaagcaaaaaaaggactgttttgtttttaa

SEQ ID NO: 15656 - DNA, 1309 bp, Heterodera glycines
ccctagatcgatctgtcttatcgagagctatcattgcttctatattcgtcgagattggtccaagagaaaaaaacatcgcataaggcaagatattccagacccataataaaaccataaaagattggcagattaggcacttaaaactattaaaattatacaaaaaagactggtcttttccatttttggccaaatgggacttaccgccaaatgtttgactctatttaagcaagttcctttggcttggtgatgctaaaatcgtgggatccgttttgaagtttacacgacctttaagcttctttattgtatgtcattctatggctttaaggctttttattactttgtaaagtttaacaaatttaattaagttttaaaaagcgtctaaaactcgacaaatttattaatcagaaattttgcgatatgttaaaatatctgctatttttaaagcttcgtgtaaaccgtaatagtgagccctattttggtgatgcaagttgtgtgtgccctctttttgcaaaaaataaatcatttttcgagatgagattgcgggttttgagggtcgacgaatccaattttgacattcttcggcccgttccgaacccgaaccaaatgtcgaaaatttaatttggaactaactgatttactgactatgaaaacattttttacaatttttgattaaattttttctatttatatatgccaataatcactgcgatttatttcgtgcatttgaaatgtgaatttttgaatttcgacattgttccaaattcggttttcggagttagatgtcagaataggatttttcgacccccaaaacccgaaaatcaaattcatctcaaaaaacgatattttattttcgcggaaagggtgcccaacataacttaactattacccagatttgggtgctgatcttcccagtaaagtgcaactatcaaacatttattaaattattaggtgtaatttatgccttttcccccttccgccggttttttccgtcccaccaattccaatttcattaaatggttcaaaacaaactgtcaaaaaccccccttcttttcaggaatgtgaaagttcgcattgccgtggccacgtggagaaacagcgaaagccgccgccgtcggacgatggaaatggcggcggtgggcccggcccttcgtccatttcaacctgatcaattttgccaatcatttgcctatccatttactattatttatcgatttcctttatttaaacattgatacaatgtattagaaatttaatgtataatttccaaggagtcttttgtgatttgtgcgttaaaattgggacaatccgt

SEQ ID NO: 15657 - DNA, 1679 bp, Heterodera glycines
  misc_feature (991)..(991): n is a, c, g, or t
gaaggaagagataaataaaataaacagacgacaaacgctgacaaaaggacaacaaaagcggacaaatggacgacaaaagcggacaaatggacaacgaaatcagacaaatggacaagaaaatcagacaaatgggggacggaacttcgaagagaccgtgaccacccttcccgtacctttacatttaaaaactttgtaacataatttttaaagcttctccgtttcttgtcccgttccccgtttcccatctctcttcccagttacctttctctcgtttccctttccccgtctcgcgtccccgcgcattactgaaatatgtttattttaatggctttttgtcctttggctaatgcaaatttcattttgtttattggatttttatttatccgccgacaaaacatttctttgctcattcgaatagaaaaagccgcctttttcatggaatgtttcatcagcacttagtggagggatggcacttgcaattgacacaaaataaaagtgcgcggaaaatgattaatttacgaattgaaacggacgaataaacaaacaaaacggagaaggaaagcaatcggaaattggaagcaaaaactgaaattggcattattagcgaatgccaaaaaactaaaattaaaattaatttaattaaatcaaattatcgctgcctgccaattcattcgttttagctttttctttatccattataatatgtgccatttggtggttttccggatttgttattgcccgtcaatccgtccaaatcccctccatgccatcgtcacccctttcccctccctgttccccccttttttgcccccttttctccgcttttggtatttccgccattcgccccccccaacccctcccatttttgctcccgtaagattaatccaaccgaatccgtcaaatgttgggataaagaaagtgccaaaagatacaaaaggagactccccgcgcctccccctttttccgtttgccttcgaacatcggacattanatggcatccaaaattttattagtgtttattgtttttggtaacgaagcgcaaaacgaaaattgcttttaattgccgctattcaatgaaaggaataaaaaaaaagcgaagcgaaaaaaacaaaattaattattttatttatttatttatttttatcggaatgttttatttttccgttaaagttttaatactcacattttcacccacttcagttcatttcctttatatctgaatttctctcatcaatttggtttcgctttaatcattaccgtaataaatgctcttttcgatataccgtagcagcctctcatctcgactcatttcgtctcattcttctccaattccatcggcacatagttttgacaggaaggcataattggacggggattgggcgggggggggggggggggaaaggcgggatttaattgggcgacgcggtggggtgagggataaccatcgccgtgttccactcagtctcttccaatgctttctcttcgcttccattgccttttcttccttttctctctctgttcgtcatcattccccgtctctctccctctctcccctcgggggacaaatcatttccatctctcccctccccgcccttgaatgcttacaaactccaattcccttccccctccccacgcgtttcatgtgagggcggtccctcgcgggatggatggacttgtcc

SEQ ID NO: 15658 - DNA, 1615 bp, Heterodera glycines
ggatacggacaccaaactttactccttcccccctcccgagtttaacctctgtgttgccccctccctccccccccccccatcgccccgggggtcgaattaatttgccctatggcaaatcctcgcgcgaatttgtgacgaggctttgcttactgagcatcatttatggatgggcattatgccacaaacgaattaatcccctttcccctctccattttcggttaatccggcttttttcacggccaaatctggcaatttgtgtcactttttggagtccatcatcttgttcgtacagctactagatcacgcaattttggcgaagcctttcgtcattctttgccctcgtgtataaaagcgttaatttcggcacagacaacggacagaccaatggatggggcatcgacggcagaggtgggactgaaaaggaagggcttaatgagcacgatttctaggagaaacatctcttttattcaagactgtcttactcttgaccccttaattatttttcctttatatgtctggccatcctcataatttatctttatctttttctctctctctttttcactaattttcttccatgtgccgttccttctgttcagatgtcctcccatcaatcgccccatttcgtccctcccccgccgctgatttgtcccctcgggcgttgtgcctccacttcgtcgtcgtcgtccgcctcggaaaagtgccaaaggcgcgagtcaccgatgtcaaagcattcgattcgtgcaattttggagaatgaggcgggagaggaggagaggatgatcaacgtgaagaagaaggaagagccgggggaggaggacagaagcgggaccaattgtctgccgaaaaaaccgtgccaaacagcctccggcaacgacaatggccaatcgctgcaaaatcagcaaaatttatcctctgatcagcaacgatcgggtttttcgccaccgctcggcactcaagggcaattgcaacagttggccttgcagaattttctccaacagtttctcctccaccagcaacagcagcgaaaggactccacgctgtcccattctcttccgccggtgccgctccaatttttggcaccccaagggaaggcacttttgtcgccactgttcacattgttcgctgcaggaggaggaggacaaacagcgattggaggaggcgaaaggactgatcagacacaggtgagaaagggaggacgactgatcagagtgatcggagaatggacggggtaaagagtgatcaaagttagagaagggttgggaaggaaatgatcagagttagagaagggttgggaaggaaatgatcagagttagagaagggttgggaaggaaatgatcagagttagagaagggttgggaaggaaatgatcagagttagagaagggttgggaaggaaatgatcagagttagagaagggttgggaaggaaatgatcagagttagagaagggttgggaaggaaatgatcagagttagagaagggttgggaaggaaatgatcagagttagagaagggttgggaaggaaatgataagagttagagaagggttgggaaggaaatgatcagagttagaagagggttgggaaggaaatgatcagagttagagaaagggttg

SEQ ID NO: 15659 - DNA, 2395 bp, Heterodera glycines
aaaattttataactcgtttctgaaaagtcatactgtaaaagtaaaatactaaaaaaatccgcaattttttgctctattatataaattttatttggcatttttatcacttttttgaaaaaagttatagaaataaaagtgattttggaatttgggaccacaggggtgtgactaggatttttgagtggaaaattttttccaccaaaaatcttccaaaaacatgtcattagggctattttatgacgctgatcacgaatacgtgatcagattttacttttgacatcgttaagccctcagaatccctgtgtgattggggattctgagtcatcatttttttggggggggggtgcaaagttcgaatccggacggtgtacattatttttctttgtattttttgagttaattttcattacttttaataaatttaaatgtttggttttattaataataaatttttttagtttaattaaattttttgatgaataatgattttcattaaattatttattatatttaattaaagaatttcagctattattttaaaatttaatttgtaaaatttttttcatttcaatttaaataactattcaaattttcactgcatttaataaattaaaatagtttggttataaattatttaaacgttgtttttaattaataaaacgagtattttattataaaaaattttaaattaaaatgcatgtgatttttaatctttaattaaaaaattttccttagttatttaatattagctttttaggggttatttatgacgctgatcacgaatctgaaatcagatttcagttaatacatcgttaaagccttagaatccctgtgtgattggggattctgaggctaaatccctgtgtgattggggattctgaggctaaaattttaaattaattattaattttcaacgtcgtttttaattaataaaacgagtattttattataaaaaagattttaaattaaaatgcattcgatttttaagcgctaagcgcccgtcctgaggccgcgaagcggccgaatatccacgacaaaatttaaaaacgggcgcgaagcgcccgtcatgaggccgcgaagcggccgaatgttccccacaaaattaaaaaacgggcgccaagcgcccgtcctgaggccccgaagcggccgaatgttccccacaaaattaaaaaacgggcgccaagcgcccgtcctgaggccgcgaagcggccgaatgttcccaacaaaattaaaaaacgggcgcgaagcgcccgtcctgaggccgcgaagcggctgaattaaaccttagaatacaaaagggcacggagcaccctttgaggccgcgaagcggccgaattaaaccttaaatataaaaaatgcgcggagcgccatttgagtccgcgaagcggcctgaattaatccataaatataaaaaggtggcggagcgcccgtcctgaggccgcgaagcggccgaatgagtccacaatatttagaagcgcaaagcgcccgtctgaggctgcgaagcggccgaatgcacttgctcatcacttaacaaacgcgcatgcactagcaacgaagtcctttgcgcgaagcgctcatgtcagcgcccgcccatatataccaaaagtatactgtctacaccgagcaattactgtgcaaagcatactgtctacaccgagcaattgctgcgccacaacacgctagtttatatatatatagaataaagttgggtttcgttaaaaaaattataagtgcccgtggtttgcccggagggggctgaaattttgcaggcaggggtaacttttgattgcgcatctgggaaaaataaggaaattccggtccggaagccaactgagcgccagcggcgctgaaacggccaactttgaaaaacgagctcggttttcgggctgtaactttttcctgggaaccgggagcggaaaaagtctgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggtttagcggagcgggttggcgccgcttgagcatttgtgcagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaatttcaaaattttccggaatagaaatttttccggaatgagctccccattttcgtttgaggctataactcgtcaggcgttgattttagcggaaatttgtc

SEQ ID NO: 15660 - DNA, 2095 bp, Heterodera glycines
ataaaataaataaaaaagggatgaatcaccactcaggacttattttctgaaaattttttcacaatatttttaaatttagctaaacttccgatttccatagctgttttgggtaagcaattccacggattgattgcgcgaataaaaaagttattccgagatttattactgaatcttttattttgaatcctaaatgaatataaatttgaaaattttcgagggtttttcctaattactttagcaattcgaattcctttaacagatttattttcagaaataaagaagaaattttaaaatttgtaaaaattcttttaaaattttgaccaaaagagaacaatttattggattgaatttgggggccgaatattgggtcttcaaaaaaccaggtcaggcagggacttgaaaaacggatatccggttttggacacggtacgatacccggaccatcatgctcaagtataaacaaatattctttattttaaatattgtttaaaggatatcgatagataaataaataacaatttgaaaaaggaattggtgatggttaaactgttcaatgtctaagtgaattactaaaatataaaaaattaattatatggcttaattatgcaaaattttcctcattggttcaaactaattaataaaaaaaacacaaatggaaatacaaaataacgcaataaattgcatatatttcgtattaatgaataatggcacctatgaacaagaaaatgaaaaaataataaataaataaatattcgttagattataaaactaaatatgtactacaaaaatatttatattaatacgagatcgaccaaattcgccgctcgtgtcggaggacacagcgacttgtttaaatgtaattttataatgaatgcaagacaaataaattaaaaataacatttataaaataataaaaaataaatacaaaaatattattaaaaataatcttcttatagaatacagggggcaatgaaggcggcaaatatatggaataaatgaaaaagttaagagaaattataaaacaacaaatatttaaccaattaaagtaaagctaagaataaacatttaaaaaattacattcagttaaaaaaatatatgttagttattaatattaattttgaaattgaataaaattgctaatattaaatcataagaaaattccaatttaaattgaaaataatatctacatattcttataatagaaaatgataaaaaattacaaaattaattttataaagaaattgatcaggagagagaatacatgagacatgattaagaaatttaaaaaacatatatttgaaaaaaggaattaataataacaaatataataaaaaaagaattgacttattctgcatgaaaaaattaaattgaataaaaattaattttcatcttttggacaacaaaaataaaaatgtaaaaaatagaaagaaagtttaaatgtaaatttaaataaataaatatttaagacttaggaacctaaaagatgaaaataaaattaataaaaagttaggtttaactaatagcataataaatataaataaatgacttaattatttgtttatgaaaaacatatttaatactcggagatattccaaaatataataaatcaattaactaaaatttacatattacacaaattaaaaagaatatttaaaaatctataattttaataacaaatctaaataaatattttaagggcgagagttacctgaataaaagagaaacatatttaatccaattaactgtaattacataattatatataaccgaatgaaataaacttattataaattaaaatagcatttataaataataaaaataaatacaaaatattattaaaaaataatcatcgtatagaatacaggagccagtgaagggggagaaaaattcagcgcctttaccatggaataaatgaaaaagttaatagaaaattataaaacaacaaatatttatccaattaaaaaagctagtaataaaaacttaaaaaatgcattcaattaatttataaaaagggttgacaaaaatcagcataaataaagaaaatgaaaaagaaaaaatgataataaagaaaaaataaaggaaaaaatgtaaaaca

SEQ ID NO: 15661 - DNA, 1718 bp, Heterodera glycines
  misc_feature (18)..(18): n is a, c, g, or t
  misc_feature (74)..(74): n is a, c, g, or t
  misc_feature (1545)..(1545): n is a, c, g, or t
  misc_feature (1623)..(1623): n is a, c, g, or t
  misc_feature (1674)..(1674): n is a, c, g, or t
attaaagggtccaccttntacgggtccgggcgcttacttttttgtccaacgcctcaaaatcgacgaccgcatcnccttggccctgcttcagttcgggcaacgaggccaaaaagtgttggtgtttttgctgtttcggcgggtcgccgtcagccgccgccgccagcgccgccgtggtggccatcggcgcagttggcatcgcattttgtgccgccggagtcgcacgagcagaaaagtgtccgacgttgatgccggtggaaaacggcacaaatgccaatcgccgatggatgggcagggggcgcaggaggaaatgcctgagcattttatttgaaatggaaaaattgggaaaagggagcacagcgggttttttttattgtcgctaaaaaataatggatctttgaaaattaataacaaattacttagattttttatttgcatatttattttgtattttggcacaatttatgccagggggtgattttttagtgaaagaccggacgatttcagtggaaaaatcaaaaatatttattttggcaaaatgttctcatgaaaaattaaagaattacaatttttgaatgtctagaaaaaaatgtttcttttttttctgcacgtttaaattagggctggccgggtccgggtatttgggcaaaaatcgggcccggttagacatcctcgcaaaaaaaagagtgggattttgtggtttacctcagttgggcgccagcatgcttttccattataacttttttctttgtcatccaaacccaacaatcttggtatccattcgaaagctcttaacatgctctattagctttacaaaaagcgaaaagattttcaagcttggaaaaaagttatgaaaaaaaaacttcaaaaatttcgacttttcacaattttcatgttataacttttttggtaattgtctaatcgcgaagcaatagcttagaaatatcttctaaacatgttaagctttcgaatgataccaagattattggatttggttaacaattaaaaaagttatagtccgaaaacttgggctggcgccaaaacggcggcgccaaaacgatacagacccatgaattgtatcgatgcgagcgttgattttgtctgtggttggtcatggcattttgttgaacttttgtaattttcgcaccgtaaaatgattttttgaaaaatttgaattttcgactttttgttcgaattcgggtccgggattcaaaattggtcgaaatggatgtcagattcgtgatcagcgaccccgaaaacccctagaaatgtttataaattgatttaaaaattattatttttttatgggctgtaaacgacattcctaagtaccaaattcggcacttattccaggcccttctagattaagtaaatgccacaaattcaaataaaatagacaattcacatacataaatgtgaatttttaaatgttgactttgttcgaattcgggttcaggatttgaaagtgatcaaatgaatgtgtcaaatccgtgatcagcgaccaccgaaaatcccctatttggaaacctggggttagaacagggtggncaagttttttttttttcaaaataaggacaaacgaggctaaaactaagatttggaccccaaaaataagattttttctanaactgatagtagcgcgaaggaaaggtaataaacccatgaaaatcgacttanaacatattttattagcgtaaaacaattgaaattgattatcaaag

SEQ ID NO: 15662 - DNA, 1542 bp, Heterodera glycines
tgaactaaattgtatagctattgaagctctatcgatccccccggcactagctaaataattttgtgattttctctccattccccacaaagcttttgacctttgctaagtcactttcatattgaaattaagtttattttaatgaaaattttattaaacaaaaggcaacattatacattgattttttatttatgattttgatccaaattaatttatgtcaaaattggtttttgtaaatgatcgttaaacttatttatttatatgaattttgttatttatgtttgttttgcctgttttcaatattttttgattttttattccattttctcatcatatttaaacttttcaatgtttgtgtttattatttgctattgtatttttttattctacaaatttaaccttgaaaagaatatattttaaattcgctttcttttgactaaatctttcactgaattttcttctgccatttaaattcacaaaatgagcataactctcagaatttgactttaaaaaaagcatttcaaagattacatttattttaatatttttgtttttcaatatcatttcttatttctttcatttatttctatatttaaaatgtgttttttaattatttcttatccttattatttttttaatcatggctcagtcgcgattatgttattctttcttttttaaatatctatgtattgtttttttcgatttcccttttatttattataatgtttcgttttttgtagttttattttatttatattctttataaatactattttattaaattttgttattgtataagtaaataaatttgtgattttctctccatttaaatgattgcttttgacctttgctaaattgatattattcaaattaaattcacgtcgttgccaaagatttggtcaaaataaataatttttttatagtttttcaatccgaaagtaaattgccattttcgtaaatgaaaattccattataactaaataaataatgtatattttattaacttttacactgcgatttgtatatagtatttaatataatttgtacaattattttattttttctgttttttccattgggtgcgcaatataaaaaattccgtttatatatttgtatttttaatttgtgatttattaattctaaaataacttgttgtgcccaatttccattggccccactcatttactcaatttgcccatctcttcctgtttccccttttcattgtcttaaccaactgttgcctttttcccaaatcgccccgcctttcgtttgtggggggagggattggaccaaccccggaggagaagcgatcactttgatatcggttcatcaacttttgctcttcaccgatttgttccttttccctttttcgctcacatttctttgtgctttaaaataaagggctgttgaaaagccaactcggatttcaatagacggggtcgcgcctagccctgaccttggtcaggggtctgaccttggtcaggggtaggcccaacgaccccacaggcacgcctaatatggtccagctggacggatcatcatctt

SEQ ID NO: 15663 - DNA, 3164 bp, Heterodera glycines
  misc_feature (65)..(65): n is a, c, g, or t
  misc_feature (102)..(102): n is a, c, g, or t
tgaaaatttgagtttattttgttaacagattttctctcttctaaacaatttttgcgattttgggncatttttctacctaaataggagttcttggagcaaggnggtgccgacaggcgccgccgaggaaaaaattggaaattttgacaaattttaaacaggttttcactgaaaattcgccaatttataggtcgtattttgaaaatttttgagaaatttcatccctcagaattacgtttttgaaagaccaataaaatgattacttttggtgacttaataacagcaaatttaaatattatttattctttttcagtctaaagcgctttgagaatcccccggagccaccaagagagcgcatgcctttttattccagtaccgtggcgcgctttgagtgccaaagcgaactggactcagcggccaaaccgagaggaagagaagaaagaggagaccgagaaaggatgagccttggaatgagcggaaagcggatgttcgcaaacacgctcaaatcggcagtcgggacagtggaagatcgtccgtgtattccccctgagggattaaatcgcgaaatgctcaaaagaagaccgactccagcaccagtgccgcagtttacgacacgcagcgcggagaggagccccgtgaggaagacatacgcgccgtttcggaaagggatgccactggaacgcgcagaggaagccatctacaaaatccgcaagtcactgctcgaggccgcggacttcgacggattttcatcttttcctacccccttccccctcacaattttattatttactcattttcaaatattaaataaattagaatttttgctctttatccttttccctagtggccaaaaggggaaaagaaataaggcgaacgtttgaaaaagagggggaaagagagagagaaagagagatagagagagtaaaaagaattaaaaatgaaaaatttaagaattagttgttgtgttaattgcgcgtccatcattcaggcctcgacagcatggaattttggagggtgccgtgcgcaaattttaactgcacttcaaagtgcttcgccataatatggccagaaggaactcaaaaacccagtaattcgaacttttttttgctctgatttttttgtgcataaataaaaatttttgaaaatttgcaggctaatagcatttttcgaatgctttcgaataataccaggaatgtttaatttggatgagaaagaaaaaagttatggtcgaaaaattcgttcgacgacgtttcggctgacgacgttttgtcctactccgcctccggtgtgcctgaactcttcacattggaattgggcttttccgttgctttgcgccgtcttcagtctgctcctttccatcacttgcgtcatggctttccttctgttgcgccgtcgtcgccgcagctcttctcacatttccttttgcagacaatgccatcgcttttccccgaaataaaagaagggggagggctctaacacggcacacaattgttaaaaatttctacttcacagcaattgttaatttgtttacacttttttaaaatattttaacaggatgaaaatgtatgaattaaattttttttttttatatgaggcaaattatcagcagaaaaaaaaattgaggcgaataggtaaaaatggaaaaggagaaatttttagcccaatttttttgtaaaatagcctaattggcgccaatttatgaataaatcacataaaattttccaaaatcatttttttgtttcgctcaaaaattacataaaaattatcttattattcgtttttcaaatgataaaataggctcttatcagaatttgaatgaataataaaattggtattcatttcctaaatagcaaattcattgaatttttcaagttttaacccactagaaactttatattcttcttctcttgtttacattctttttatgttcttattattttaattaattgcataaattattcaactttaaatattgctaatttttttagtttgggatttaatttaatattttgtttttgtttacgtttgacaaaagtttttaatttttattttattttgctccattattttattttttaattatttaatttaacaaaattgctaaaacatttcactttgtttagaaaccaaaaataaaattatatttggtaatttgcttttaatttttccattaaaatatttctctttgtccatatttaatttgagtattattaataatataatttttctaaatatttttgttttctaaaaatgtgtgttaaattctcccatattttaatccaaataatcatgatcgattgcttgcaccttttattgttgttgctccagattatatattaaaaatgtttcagattttaaatttaatttaattacttaattattgtcaaattcactaaggttttctttcgtgattatagcagttgccaaagcaatatgttaataatttttttttctatttacaaattaagatttattaatttttaaattatattatttgtttatatatttggttttaaataatactgttcttaatgaacattaatttgacagcctatccttggcattggctttccaaaaattcggttaattaatgagcggctgttgaatttgttaaatgaatgctcctattgcattagttaattataaagcaattttgactttgtcactttttcatctcaagcccactggtcattcatttttgtttattgtcgatgatttgtttatttgcgccaaatataaataaaatagttcactttttttggaaatcaaaatcaaaaatttatggttgagaattttgattttgattttccattaaatattttagtttgtccacatttaatgatgctgttaataatatattttttaatgtttgatttttaaaagtgttttaattcccaataagaaaaaccttcaaggatttctttcttttcctattagcataagttagtcatttttacactatattactttttcgtaagcagcccttaatgatcttttgatttatatttgcatataatattaattaatgaatgtattatatattttttaagaaatttattaaaaatttattgatttattttcgtttgaaaatatttaaaggaattttgtatcatttaaataataagcaaagataaatggcttttaaatcgttgctttgtcttttaccc

SEQ ID NO: 15664 - DNA, 2231 bp, Heterodera glycines
  misc_feature (11)..(11): n is a, c, g, or t
atacaaatttntgtaacaaaaagtccaacgaaaatttggcataatttaggacatacttgggatttgaattgaaattttaagatcttgaataaaagaaataattcctcccattttaaaataatttttaaatgaaatatttaaatttaaatttcagggaattgtgtgttgtgaaaaataatgacaccacaattctcaaccatcatctttcaacatcagattcatgtttatatcagcacacaaatgcgattgacacattagtacgacttggtaaaatggaaaaatatttaatttaattgactttaatttttaataattattttttaattaaatagctgaacgtaaagaattcaatgggatcagtggaaaatattttgatgctaatggcaaggaaataaagcttggcgccgacacttcggacgtcagggttcaagtaaacgttcttttaaatttaataatggattagtaaaagtaattaaaatataaatattaattaatgaaatatattattgctattcaaggacaaattatggattgaatcatcattaatttgcaatgcaattctcggaagaaaaacggctacagagtcaacaattgaaaattcatttaaatatgccacaatattccaataattataagtagtttctcactgaaaatctttatggcaatttaagcattggaaatattatttttaataatgaaaatttgcaaatattagaggctaccataaaaaaggaatttatgattgagtaattttatttacaataataatatttcaaattgctaaaatttagttgcatttttttctaattattttattaatttattttgaattttaaaattgcaaaacgatctggtaaataaatttgctttcattatgctttgattcaataattagacaattttaaaaaaatcaccatgtcacaacattcctacatttttcatattttcacgaattatggtatcaataaccgagccgataactttgcccaattgatttgtatcggttgcgcatgtttcataaactgttcattaaaataaattttaatattttaaaataataattatttttatttattatttaaaatctaattcattttatttgaatttccttaactgtatagcttcttttgttcactcctgtggattttttgaaattttcttcgcaaaaaagcaacaccttcttcgtaatttagcccaccttaaaaatattcattaaaattattacatattagtaaattaaataatctaattacctttatatgttcgaaataatatggaaagagaaattttctgaattttcatcgcaaatcttttttattcagaaacagaatcattgacgatttaataaaatgcgacgagtttgcgatgctgtcgaaaagctcttaatttttgttcattttttaaatttttttaataaaagtagggttgagcggtaccggtaccgaccggtaattaccggtttttttggtaccggtaccggtaccggtaccggttttttcaaaaatcaaagtatcggtaccggtttgtctagtaccggtaccgccggtaaaaatttgcactggtaagaatgggggtctgggtgagaaaagagtagggaatggtgaagaaggagaaattttttgaaaaaaaaaattaaattatttattttcatttaaagcatttgttcatatgcataagtggtcaagtggctaaaccttctgattttattatttctcgcttgggttcaattccccactggaatagaatattcttcatattttctttaccattattttaattgaaattttaatttaaaaaaatattccaactttttttctttcattttaagcatcctaaaaacccaaaaattaatcaattggtctttttttacaaattctgttaacaaatcgcattaaaaaatacaaaatttttcccgccggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaaacttggtcaccgagcaatatacatatacttctgaacaattctaatgctaaaaaacaggcactcgcgcgaaaactgaataaa

SEQ ID NO: 15665 - DNA, 1645 bp, Heterodera glycines
tttttttattaaaaatacagaattctttttagttaaataatacatcatcgaagaatggaatccattttctacgttgggatctttgtccacctgcatcatagacacttaaaatcatctaattaattgcatataaaaatatttttgctaaattaaaaccaatatacttgaaatcgatgtccctcaaggtgaattgaagtctgaacactaaaattcatttttttaagcttcatacaacactgatgagtctgggtttcgttggaatttttttgggattattccgggttatttcgaaaattgctcgggatcagcctcctccaaaaaacaaaacaatttctttttgtgtttgcatccggcacttaccccctgccgttggcactcgagtcagcaaaatatccatatttgttggtctgtaatccctcgttgctatcctctcaatttgatcaaaaaagctttaatattcattgatcagattttaaataataataataacttgattaaattacaataaaaatattttattaaaaaaatttctcactggtgtgcgctgtcttggatttgataatttgatcgcttttcaaaagcaatttgaattgactggtcttgccaaattggttgaattgcttgcttcaaaatttccgtgatcattgcaaattctaagccatttgctatgtgtttatgcaacacattaacatcattctaaattggtttttagaatttatatttaaaatttaaaaataaattttataatttatttacgattaatgaagcatttccaaattgtaagccaaggtcagtgacaacatccaccaattccatcatgcttcttactaaatttttatattcaaatttttttattaaaataaaaattagtttaatttagtgtaaatttaatgaaaataacacagtaaaattcaaaattatatacattaagaagaaataatattttgcacctgtatttgaaaaaatgatgcactttctctcttccacttcattctcagtgaatccgtttgtgtgtaaaattcttttaaataataaattaaattatcaaaattatttaattaaaaacatgctgcatttgttttacctgaaatttcacatttaaataatataaataaatatataatttttacttacgcaagtgctttttccgctttcaccaggcccttaatcatgaaaaacaattaaattataatggaagaattctttaataatttgaatttccaattttatttttacaaaaaatatatgtacccaaaagaagcagcttttgaacatatctttctggtttttgatgcaacattttgttaattttattggatgcttctcgggctattattgcttccgtggattggcatgagcccattaaatattttagttatctaatataaatatacctatttaaaacataaatatatttattctaactgctaattcaatttgggtttttttcgctactaaaatattcatctttttaaaaaaattgataatttattaatggtggttgtttcacgatttcggtcgaaatttgaatggctaaataatggtatcttggcggtgctggtaggtaacgcctggggatatacgtaagatttgaatgatgaaaaccttttttattttcactaaataaatccattgacttctaaga

SEQ ID NO: 15666 - DNA, 1315 bp, Heterodera glycines
tcatccattttctgctcactgtttttgttaaacgaatgcttctccggcgactgttggtgttctaatggaacctcaactcgggtcaaaaaggaagccaaatacacgcgttctctcaatcggtcgacgttggcgaagacccactcgaggattggaaagacggcactcttttggccttcgagcagttcaagccgccatcgttggcttaacaaagcaacagaagcacaaataatcagcagcaaataatatttgcatacatttggtcaatgtcccgcggcggcggatattttaacatgcgaagggcagacaaaagacgcgtcatctgggaagaatggtaatggacgctaattagccaaaaaaaacaatcggagtgagcccatcctaaagcaattgctcctcctatacgggctctgctgatcacacaccgtttcatccggtgcctctgatcggatgtctataaaatcagccgccgtttgtccctccacccaaccgatgacatcggacagagtttgcaacagcgcattggcactcaatgagtccaatttgacaatggttaaattccgattaaatggagcacctctcagtccgtcggcaatgattcgaagtccctcagaattcatcacgaaaaagaaacaaataaatttagggaataaacaaaataaaagaaaagccacggtgtgttgccatggcattcttcgcccccacccccttcaattagtaggaccatttgcaaatttcaatagacataccgtatcgctaagaaacaacagacactgtaagagttagacactattaaaagttaatgaaaataaaagtgaacaatgcgccaatgaaaaaacagacagctgaggttagacactatatgttttaccattgtttttaattaaattttgtatgcttgtaacttggtcaatagaaaaccaaaagaaatttttttgtgctcattttgaagggaaaattctaaagaacattcctaatttaatcaaaagttttaaaaaaattgtttattagcaaaaaaatgaatagtgttattttatatgttagagacatggaaatagtgcgtcaaaatgagagaaaaagaaaaaactttgcccagtcgtaaaattttttccaaagttgcgattttcttgaaattttgcataaacacatattttaacccaacctataggatgatgctttgttttttgtcaaaatgctttttaactcgagatcggctcttcagtttttacaagggaaaatctcagcaaaatttttaaattagtggggttttttggcgttttgtccttaggcaatttttgtcaaaatgatgatacatgac

SEQ ID NO: 15667 - DNA, 1431 bp, Heterodera glycines
  misc_feature (14)..(15): n is a, c, g, or t
  misc_feature (34)..(34): n is a, c, g, or t
  misc_feature (81)..(81): n is a, c, g, or t
  misc_feature (223)..(223): n is a, c, g, or t
atgccaaaatcttnntaccagctccaaaaatcanttaattgtagacccgcaaagttgatactaccgaaaatgtttcctttntaggatttcttatttggtcggtttgatcgaaggatttttcggtcgaagggcttcgtttaacttttgtgtgtccaatgcgatgaaaaatgacttggaacgccgctggggtgtgaatgctatcaccgtttatgaccgtccgccnaaattggttctccaagtaaatctgttagcattttcaaagtctttgatccatttttaagaaacacgagctccgaagaaaagataaaattcttgcattgctttacgtcggaaacactgagcggactcaccgagggtaagttgttttgctaatagttcattttatgcttacttaaattcaatttttagaatggaaatttgttcacgaagaagctgatggaactctcacgcttcgtgaaaatcgaccgtttctcgctgtttcttccacaaggtatgaatggaaggaataatgcaccaatccatcactgggagggaaggggtgctagagggctttagcccttcggacccgaagaaaataaaaatttttcattttccggcgacggtggggcgggggatagatcaaaattcaccttgggactttcacaatgaaccacttattgttagctggactcctgacgaagacttctccattctgcttgatgcgcttgtccgcctcgaccaacgaatggccgacgtggaaacacagaggacgtccaaaacacacccgaaaattgtggtggtcatcactggtaaagggccgcagaaggaattctacgaagaacgcattcggaataccaaatgggagaaagtgcgcattttcactgcttggttgtcggcggatgactatcccaaggttcccaccaatgcttagttttctatttactatttgccccttttcagtttctgtcctgtgccgaccttggagtttctcttcatacgtcgacctcgggtgaatagctgatgagtttggactcgtttaatttggtttccctaaggatttgatttaccgatgaaagtcgtggatatgctcggcagcggtgtccccgtgttggccaagaactttcccgccatcggtgaactcatcgatggaaccaatgggctcctctttgatacgcctgaagaattggaaaatcttttggccgacctttcgcttggatttcctggaaattcggttcttgtctattttctagtgatgctcgagaccaaaaatttcccgagaccgagactcgaccccgagactcgagacccaaaaccccgagaccaaaaaaacccgagacttttttcaaaaaatttttcttacacacttaaaaatcgaaaaaaatcaatcttttgagtttttttctcaaaattttttgtttttttccttatttaagctaccatactttttctttt

SEQ ID NO: 15668 - DNA, 2518 bp, Heterodera glycines
aagaattgtagcaggcggcatgaaaaatgccagaataaaattccttaaaagtaaacataataaataaaaaattattttttcattttttaacaagttaaagaaatagagtatggacgagagactgtgggttttggtgagaacagcagataggcttgagtaagacgagggataggcttaaaaatgactgacgcactgaccaatccgatgatggcaaaaatgacaattgcaaacagcaccaatagcccaattgaagcagtggtgccatcgcacacagaatggatttgagcacaacttgtagacctgagatttgaattttaattaatatattttatttcaaattaaaaccagggctggagacgtaactggattttaaataattagcgaaatacatatccttaattatgggattccaaaatgccctatttatgaattactaatccgtaaacatttattttttcatttatgtccaaatccaaaaaaaaacttgttagcatttgaaagttcttagacattagtcatcattttttgacgaaaaatagcaaattttaaaaataacattgggataattttttttatgaatttttggcccaaaaaaattcaaattccccccatctgaaaactttttttcctggctttgggcctgtcaaatttaaacaatttaattttctcaaataaaaaacgcactcggaatgccgctgacaatttttttttcttattcaagacccacgccgttgccttttgtcgtattgtttctgctgcccacccgcgcaagttggttttggtcgcgtccggttgagaacagcgtgcacttctcggtaaatgagcaaataaaaacgaaaatttcattcaaaaacttgtttttgacttatcatgaaaaatgggtccaaaaaaatcaattatttaaatcttggacagaattttgagaataattaatgtcctgttttgccaagtagcgccggtgccggcggataaattttagtttttttttttcaaaatttaaatatattactattaataattcacatttgttccaatagctttgcatcggcccacccttcccgaatcggacgcttgacaaaaaatggagacggcaacattcatcgcgatttgaggatggcgaagaagaagacatttgtgccgaccaatccaattggaccgtgcaacaatactgaacgagcaacaaaagcggcaacaatttgcattaattgaaaaggtttgtcgggggcgtgtaccatcattcggggtctgtgcccaaataaggaacaatttttctaaggaattgcggaaacaaaaatttttcgcgaggggatgggggggggaagggagcaggaaaaaatgtcaccggccgaaacctcgtcgcaaaaaaaaattcagaaaaaaaaattactactttttgtgatatcttataaaaactttttacagtttttttcttgaaagaattcaaagtttgaaaattttttaaagttttggcagcaaaattttgggtacatccgttttccatctgtccaaatcagtaattgtttttttttcattcttacttttccaggtccatctctttcccaaattccgcggcttcctcaaaagtgcgctgcccgaatggaccaacgaattgtgtgactgcaccacatgaaattcatcgtcttcgacgacactgttctcataaggttcgtttttctccattttttccccgatttaatgggtccgtatgtcataaatattgtaggaccgaccaaatccttttaaatttaaatagttaaaggttaaaaaaatttatgggtaagaaaaagaagaaagatttgacataatcattgattttgaaatttctggcaaaattctgactggaaattcgggaatagtacctccggtttcctaatattttgtttttggtttaaaaaaactaatatagtaaatcttcctgattcattagactttcgaatatttgttgttttttttttgattttcattttttttaaattttgccaccggttttttttttctaaaatctctcacaattttccagtgccaatttgtccgaccaaaactttgtcaaccattaagaatcgctatttgctgatcgagactgtccactgttgaccaacttcttcgtcgacctgttccgcctcgttgacaatccttccggcggatgaacgcgtcggaacagttttttggaaaaaactcagactcttggtaatttttttttttaattttctattcaaaattggataactatcaaaggaattattcccccaaaaaaccgctgggctgtcgcccatttgtccctccccaccgaaaaactgggaatgtgttggcaccgaatttttttttataaagctgtaaattatgcttacttggtctaccatgggagcaaaacaaaattttcaaaacgtttattatattttgaatttttgagtgaaagaattggtgttcccggtgatcctttttttgtcgtcgcaatctttccctatgacatttttaaaagaatatctgaaaatgtatgtataatgaatccggaatcatg

SEQ ID NO: 15669 - DNA, 1719 bp, Heterodera glycines
tccattttttaattataaattttcgttgtttacttttaacgctcgatcccgattgttcattaaatttttgttttaatattccactagtcctcgggtcgtttctcagtcgttgctctaaagcttttgtacctatgggtgatggagcattctcgggtgaccgtctcaatattcgctctaatgcttgattaacattactttttaaatatgccgttccatcagctctcagtatatgtcctttagagccaaccccaaatttctcagggtcattatttataattgacataatttttccttttttcttgactacaaaagacttttgtttttgacgaaatttacttgttccaacacgcattggtcttatcagtggtctcgtctttggtgttgatgttgttgactcagcatcactctcttcagcagtagtgtaagggtcttcaagtgttggaatagagcctgtttcatccaatccttcgtcattaacaatttgagtaggaattttgctatctctttcacgctgttttggtttaaacaccattaatgagccatctgaaagctcaacctttaccggtttttcttcaacttccttcctaagttttaagaaacgcctcaattcctggttataaagtaaattttttgaagtagcgtctaattttctctgcttcaaaagtgatgacaatttatttttagcattttcaacgttaatctcgccagactcaggctttaataaatttttgtacaagtcggaaggaacaagaataaatttattctccatattttaaggcggcaattaatactggtaatagtaatggagccaaattaacgaaaaaaccaccaccgttttgttgaaaaactttctttgcacccttctcagttctaactcttcctaattttcttacaaaatttgcgtatggtaaaagtctatatttttgtctcttcgtgagcgggaagtacccctttaatatattataactaatttcaattaataatgcaatttgttcactagtagcctctttaaatatttgttgtctctttttaaaagattttgtttttgtcaatttctttaaaaaatccaagttttgaataacatttttaggtaaactaatcattttgaatatacaatgctttttcttcatcttctttaaatatttttgtccgtattctcagcaaagggctcgaagctgggtgtaaatccaagaataaatatccatacggtgatgcggttgcatctttataggcacttaggaaaaatgtaagattttttggaaacagttgaacgcccaaattacgtatttgaagtgcagcattcggagcagacattaaaacaatatattgtgaattaattcgggctaccttcatctttttttcaaataaattttgggttatgaaaatcacacccatattaagatgatgagcttttttaatgaataattcagataggtttttctcatcaattattgttaaaaggtcatctagaattaataagagaggcttctttagagagctcagcaattcgtccctaggaggtcctttgtgcacgatgcactcccattttttgtagtacgaggaatactatcgattaaattgaccgtaacgataaagcactgattttgggtgtgggctaatcgattcgatctctttctctcgaaaattttagtaaaaatgttgttttacctgctactacgatggtcctactaattaccataccaaaaggcaaatttaatt

SEQ ID NO: 15670 - DNA, 1361 bp, Heterodera glycines
  misc_feature (108)..(108): n is a, c, g, or t
gctccactacagattggagagtcttctttgaagaattgaaagacattataatttaccaaatttagttacaaaaccctgactatttttctccttaaatacctttttgtntggttaatttataccttttaatattaataatgccatatttttcaaatttatttctgaataaatattcaaatgaaaaatacaaatgtaaaattgaggatagaaaaatgataaaatgaaagactcttttgatagatttgaaggcatatcagaatttttagagttcccttaaaagtgagcaaatacacccagggaacggcttcacccttcggtccccaatcaaacactcactcaccaggctgcgcattacaataatgaacagctcgtccaccttcatctcagatggatggcctggagtgttagagaggatcaaccaggggtcattccgtcccaacatgggctttataaaagaagggaacaataagaaaactaatatacacagaaaaaaattatacaatcattttcgataaccaaattcgaggacttggaatgaatcattaataataccttttgtgaatatgggttgataatgctttgtgagggaatgagtaaacactttgccttggataagattaggacgaataaaatggggatatgtaacaattatggggtcagcggggtcatcggaaccataacgtaaaatttgctcttttactgtgtcataatggatcatttgcacagtttgtgcatcaagggtgaaccctcttattttcaaatcatactcaattccagcattgtctttccgttgaagtttcagtccgtagtttttgcagccagcactgatgaattccaaaatgtcgtggtctggtttttcgtccgtcagctcaccgaggtgtccctttcctgttggtagtgggtcgttgtcctcgggatgaacgtagatgatgctgtcggtgtcaaagtagagaatttcacatccgggggtgtcggccacttttttgagggcatcgtagaggtatagacgcgccattgatgttgtgaagagggagatgactacattggagtacttattttcgtcgacaaactcctcctttggtttgtaagtgagcatgaatacgtcgttgtcctcatccatcatttccaagtcgattagctcaatctttttgtcttcggtatactgatgaattaggctttcgtcgttgtcaattattgcttttgagagaaggttccgcatggagaagcggccccagagtgagttgaggcagagcttggcgatgtagcgcttcccaggctccgacttcatcttttctttgtcgagtttaatttgcaattcccccagcactcctcaatgtattcactcttctgctcttcgctct

SEQ ID NO: 15671 - DNA, 2911 bp, Heterodera glycines
ttcgacgattttcacgaataaatcaaaaggaaatgcggaccaaaacgatttaaaaatcgtttcacaaattttaaaaaattttcatcctcaccgcttcgtaacgaaaacaaaaaccattaatcctcgatcagtcaacgacatcgacgtcagctctctcgatcactcttcttcatttcgttttgtcttcctccgcttgctcccgttgttcctcctcccgcttaattagttggacaaggttttaaagccccttccatcaactcaccagcttcaattcgtcgagtctgccggtgtccagcagccaattcgagacgaaatgatgctccagctgctgtcgcatttgttcagagtccggcatcgtcttccaaagttgctcaagtcgccgccacacggaatgcaatgcctcatctcctgaaaaatcacaacatttaaaattgaacccaaaaaatgatatggtcccaccctgctcatccaaaagccccaaaaatcggtgttggcgcgcaaatggaacaaagtggtgaagcagaaaatgggcctttgtattttttgaaagaagggttcgcaccattggttgttcgtcgagaaatgccttgaactgatcaactgccgtctccagtccgtccaaatcacctggggacaatagatgggccttaaattaaaaaatatttacacaaaaaatgaagacaatcactttggtgaaaatttggattttccccaaatgtgccatcgtttggcaaattgttttgccccattccgtctcgaaaagggcctccatttgatcggcgtggacgaggattttccggatgctgttccccgtcatgtctcgctttctgaacgcttccctccttgcccctatccgtctgaagaatttctgggcgacttcggcattttctcccgcttccaactccttgatcagagcattttccgaggccttggaagacatagaacggagccaacagcatctgctcaaaattgatggacggcagcaatggtgcacaaacaatggccgtaaaatcgccttcatccgcttgtacgccttctgtgttccaagttgagcgagcagcaaaagcccatcctcagcgtccatcccctccttccgctccttgcccttctttggcgtgtagtgcgcgaatttgtgccggatatctcggtggatccggtacagagatgcgcggctcgcggaacgtgagcgatcacgatcgatgacgtccacaatttggtcgacgatgtcgcgcctggcgctgcgctgcagttcatccagtcttttcttcggtcatcctctgtttggtggtgctaaaatttaatgatcagattttatgaaattcaaaaaggaaaaatttcactcacttgttggtggtgccatcggtggtaccatgtgctcgtccagctgccgacgcagatcactgatcagcgcttctcgattgcgcacctgctcgcgcagaaatttgatggtgtcgtcccggtccttgagctgcttctccagttgttcgatgcgctctgatcgctcgtcaatggccagcggtggcggggtcgtctctccggtgtccattggcgcagttggtgttgtcgaaaaaggcaccaaatcgccgattggtgtgacagatgtcgacggcagtgaaaagccaaattacaaaatttcctcgtccatttccggcgtcggcactggtcctggagttgatggcggcggttccatcgcttcttcgacggatgcagcagatgttgacggccctgcttcgtcctgcggtggcatttcggcattgggattcggctgtggagcggctggaatacaaaaaaaaagatttttaagtaaaaaatggtgaaaaaattacttctcttggccaaataggcttgtctcgccttgaccgtttgcgcttgtcgctcctctcgcttgttccagcgcttttttacagattctctgccgattagcttacttaataattttctttttgccataaatacttaaagaatctatatttttatttattagcacaaaaaaaaactttctaattcgacctattttaatattaacttgacctattaaccgatgcagaattttttctctatcgatttgcaaaatttggtgtggatttaacaaacagaaaaaaagttaaacaggatgaagtgagtgttgtttttacacacattaaaataaagagatagtacgccaaagtgagagaaattataaagaaaaagagaaacgacgagatagtactaggcttttctctgcacagtggggcgaacccatagtgccgattcctcactatattctctattctttctctgtcttaaatctcttcctataacactctttctttagttgatttttctttattcttcatctttaacaccctctcacttttgtgttatctctctctccattttattttccgccaaaaatcatttaaaaaaattgctttaaattcgctaacaaagggaggtggccaagtgtccgtgggatctcggaatgagattttttgggtagatagagcttttgaaaaagagtattttgacttggcgttttgctcaaaatgtattaacaaaaatgcaataaatcgaagaatacacccatataaatcgaccgaaaattttcaaaaatatacccataagaaatgaaaaactttctcaaaaatctattatttttttgacaagaatttttgattttaaaaattatgtagtgctcaatctggtttggcttaatttgttgccttttgactaaaatttttcattttaactagagtgccacgggaccgggaccggccgggaattcccggtcatccgaggtcccggttcccggattttgaaaagctcaggtcccggtcccggtcccggtagggcaaccgggaaaaacaagcactggtaagaatgggggtatgagtgaaaaattagagatagagattagagtcaaaggaaaaaa

SEQ ID NO: 15672 - DNA, 1512 bp, Heterodera glycines
  misc_feature (1447)..(1447): n is a, c, g, or t
ccccccccccccggatgcgccgcccgtaagattttccagtgcacttcctaatggtgcatgcgacgtaccgggcaaaaggcccggttcgtattggctcggtacactcgctcgtcgcttcgcttcgctccgctcctcgctcgcgcacctcgaggggcagggcacttcccgcctttattttattttattttaatttattttattttatttaaatttattttaatttattttattttattttattaaaatttattttaatttaatttattttattttattttaatttattttattttaatttattttattttattttattttattttattttaatttattttattttattttattttaatttattttattttattttaatttaatttatttaattttatttaatttaattttatattttcagaacaattttggcgttttccagaattttcagaactgttctggtgtgtttcagaattatcagaactatttggacgcttaccagaatttccagaattattctggtctgtaacataattatcagaattattctgaagcattccagaacaatcagaattgttctggtgtttaaactgtaaaaattgcatgcaaaaacacaaagtaaaacacaaagcaaaaaatgtgaaaatactcgaaaacacatgctaacatattgaaacacacgttaatgtaacgaaaacacacgtgaaatgttgaaaacgcaagcaaacgtgtcaaaaatacacgtaatcgtgaagaaaacacgtgaaaaaccggtaccggtttaaagaattcacgtcaaaaacgcacgtaaacgtgaagaaaacacgtgaaaaacatcaaaatccgtgaaattccggacattccggatgaatttgcaattgtaaacggattgtaaaccggaaggcgaaaacacaaaaaaaatcggcttttttcgacctttgccggggtataactttgttcgaatttgtcgcagagctacgaaatttttttctcacccttcctctcgacgagctctacaaattgttcgcttaccgcaaaagcgtagctcttacggttcctgagaaataaggtgaaaacacacattttacaacccatttttggccaattgtaaaaagccgggttttttttctttaacccaattttacaaaaaatttttgctggtgcgaattttttccacacgggccattttgtagagaaaaccgagctctttcgattggtaccggtcccgtggcgatccgttgagcccttaaggagagggaaatcgtttagtggttagcccccccgttatttttatatacagactaggcgtcccggtagatggctgcgctttatagaaagccgagcctatcccgtcgagttgtagccagtaacggggtagatgcgtcaggttgttagtgcagtagcagctcaggcgcagatgcgtatctggatgttagtgcagcagcagctnccggaagacagctgagcctacccggaaacccccatgcccgctaagtgacatctaaaagaattgat

SEQ ID NO: 15673 - DNA, 2600 bp, Heterodera glycines
cataaagcaaagcgtttttcgtcaaaaagaaattgtgcccatctttatcagagtccggcgcgggacgggaaaatctgttaataaatcgcacaaaaactttctccggcggtgcctatcggcggatccctctgttccaagttttttgaaaaaattgcgccgcaaaaaagcggttttgaaaagcaactaaatagtcaaatttatggaccattaacagatttgcttcccgatctatttttaccctctgacccattcgaaaaatcttagacgcccttttaatgcatcccgccagccctaaaaatttattgttcaaaacttcaggtattttttaatttttggaaattttttgaaatttaataaaaaaaaatttcgaattttccaaaatcccgcaatcccgcgcgggatcctgcaaattttaaatgcgggatttgcgggattaatcccgcgggatcccgtcccgcaaaaaattttgaattccaatcccgcagcgggatccgcacatttgaaatttccggtttctaatttttatacactggcaaaatgaattttctaaaagttttcgttttaaaagtttttttcgacccaaaaataaaaccccgtagtctgtaaaaactttcgggctacgggtccataaaaatctttgtgcggttttggccccattgattgggtcggatgctcaaaaaccggactcaaaaagcttaagaatccggaatggcttttaaaaaaaacattatttgttgaaaaaatttaataaatttgtttgacaatttttaatccgaatttataaaaatgtaagcgaaattagattttacagctaaatgaagggaaaacgcccaccggtttggccaaaattcgcattggcgccaaatgcctataaagtattataataatttttcatatctaaacaactaaataaatcgctcgaccccttgaacataaaaaaccttgatacttagggtgtaacataagtttccgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatggctgatttaaagaaaatgaaaagagatacagaggcagagaaaacgtgagtaaatagagcaaagttaggactataaaaaattataagaaaaaaattttattacttcaaaaatgaattattggagggccgagtctaaaaatggtctccaaaaacggcatttttcaagaccatcaaataacaaaatgttttaaaagtggttttggaaattccgaatttaattaaactaagtaaattgaccacgctgagtccgaatatggctttagatttggtctctgggttctcaacaaacctgtacagctccaacttcatgcatggagttggagcagtataagctcagggttaaaagataggtcagatttaaggccatattcggattctactggtctaatttgtacagaaaaccttcttttttgttatatcaggttacttttttgaccataaaaaaatcgagaaaaattagtgggccaattttcaatttttgcatggtcgggaaaaaatactaaaaaattgaataagcaaataaaaaatgaaacaatggcatgaaatgaaagaagactttctgacgaacaaaataaaaaaagaattattaaaataactgcagaaattacggagttatgaatttttgaatttgtcaaaaaaaattgtgcggaaacttatgttacaccctatgtaggtccgcgtcttggtttgttttttttcattttcattattcacaatcatacacaataggcgattgaaaatgcattcattatgtataaattaattcaaaatgtccggagagaatttttttatgcctattttaacaattaggaactattttaaatttattaattatatttaacaactgaatattttatttatattttttaaaattaattttatttttatatcatttattatttttatttgatatttaaattttggcaatatgatttggtcgtcaataatgaaaacttaaatgcaattttaaaaaattcaaatttttaaatggtactcaaaagaccgcatattaacattttatcgttttcaataatactcatcatttaatgattaattatgttattaaagcaatatatattatcgagtccattgacaattcgagttgttattgggttttgatcagtttcatttattaattttttatttaatcatatttatttatattaaaaataaagaaaaactcaaaataaattttaaaacaagcatttaatattttacaaaaaattcaatgacaaaaaaaaataatgataaataaaaaatataatataactttattattcaaagcgttaacagccccgcaattataccacctagaaatttgaacagaaataatacgaaggtagtgctagaatattataccatatccaacaaagttttagtgaaggtgaacttttgcatgaagaattcgttaataatacgacttatcaaaaaaaaa

SEQ ID NO: 15674 - DNA, 2447 bp, Heterodera glycines
  misc_feature (1931)..(1931): n is a, c, g, or t
taaaaccctgaaaaacttgctcattcacccaataaaattcgtttgttcccttttagtgtgtgataattaaacaatgggccgtttctcttcaacccttttgccttttatgttcgccgcctttttggttacgctgatcagcgaacatgccgatggcactggactaccgcagcagagttgctgttgtggaggcggaggcggtgggtgatgttgttgcggtggtagcggaggtggacttggcggattaagtttaggcggcggtggaggcggctgctgctgttgcggaggcgggggcgggggcggaggatgttgttgcggtggcggtggcggaggatgcggtggcggtggaggcccaatcatcgtcaattgtggcggaggaggaggaggctgcggtggcggaggcttcggctacggaggaggaggcggctgcggtggtggttgtggcggtggaggtggatgtggaggtggatgcggttgtggaggcggttacggacgaagaaaacgacgccaggtgtcttcccatttacaaattaaaagggcatttttggaaaaaatatttattttttggcagaaaaaattgcaataaaatattaagtttagtttttttttctttttgaaaaatttttttaattttttctcttttgtgtcgaagcatttctccttcaaaatattgttaaatttgaatatatttttccattttgttttgtaaagcttgctgcccaaacgaattacaagtcgagcgactcgccatgtcctcaaaatgactggaaggaactcatggaacaagtgattaatttctttttaattcttgagttaatcaaaatgaataatgcaaaaggcatagaaattttcctttccttgcatttttcaattttcgagaaattcgtaccaaggcccaataatctgtgggcatgttttgcctccatgtttttaagccatgcaaaattttccgcagagcatctcatcagaggactcggtccgctcggtaaaagccatccaaaacgggctgttcagacggtactccgggcgcaagttcctggtgacctgcgcaaccgcggcaaacgaagactctgccgccggtgccgaaatggcggcgacgagcgccgccaccgctgccgccgacccatcagcagcgaataaagtgcacttcagctccgccgggaacaactactgcaacgtggtgaaggagcgcgtgtggtgccaggcggtgtcgatcagtgcgtgagcaaagcgatcggaaaaaagtgatcagaggaggaggaagaagaaggaaaatgcaaaatgatgatcagcaacacctcacaattgatattataataagtttttaattaaaaaaaaaatatatattaattacagttaattgcatcgcttttgtcagttctttgttaggataattattataaattttccatgtgtaagtgtaaaatcgtatgtgtgcaaaatgagtttgatcagagatggtgtcatttgaatttaaaaaaaacatctcgtcagttgtgatgcgttcttgttaggactcaacctcttggataatgtgcgctaaaagtggtaaaaaatgagcaatgcacttttttggtcacagtttttgaaaccttatgaattttaagaaatttggagtttataaaggacattggctaccgctaatgccaaatttgcttaatttatttgcttcagagaaatattttacgatttgtcaaaaaactcgaaatggcgaattttatgaaagctcaaaagtaggacaaaatttttcgtgatattgaacactaatttaagtaacaatttataagtgccgcagaataaaaagtgtaaaattttttaaccctttttatgaaatatttaaatgtcgttcttaattttcaaattcttttaattggaaaacttacattttgtattgtctttcttcattttagacagggctcccagatctgaggctntagcctcattttgtggtttttgataggtcaatgaggctacattttcaaaatgaggctttgaggctttttgtggttttttgagaaattttgaggatttttaggcttttggggaaaatcgtaagtctgtttaattttatgattaattttgataaattggcataatgtttgacagtcatttaatttgaattttgctttttatagagtatcaaacggaaatctcacccaaatttagccagaaaattacaattttttcgaaaatccacaaaattatgaattttttaaatgaaaagctgctaaaaatatagtcaaaattctcaatttttcccccggcggcgcctatcggcaccactggaccctaaaaagccttttttaatttgctcaaaatttggccatttttgtggacaaatctgttaactattcacattaaaaatttaaaaattttcccggcggcgcctatcgacaccgccggaccccccttttttacaaaaattttttggaaaaagcgccgcaaaaaaa

SEQ ID NO: 15675 - DNA, 3948 bp, Heterodera glycines
aaccaaatatttttgaaaatgaaaataattttttaaaacttttattgtaaagaaaattagatgaaaagccaaaaataattattcaacgacaagtgattataaaaaatgaaaaagacaagaaattacagaataaaatgtcacaacagacggacatggccaagttcgagcagttcctccacacagtgaaagggaagcatgtgccgtgtgcctttgtccaatgtgacgagcaaatccgcatttgggtcgtttagactcggcaccgggatacggtccaactgcaaaaaatcgcacttacaatcatacaaaacttcaaagtattaggatgtttttgacaaatgaactatcaatttatgcccattaattggggtgggtatcccgcgagaccacccactgacattgtctttgagcacttcgacaaacacccgctgggagtgggcggagagtgagtgcggcaccggcacgtgctgcatgctggcgggaaggtgcgagagaaaggcgtcccgcagcagtgtgttgtttgcgctcaacagtcgctgggcgaactgcacctcacgcgcctccaatagcgcgggctgttccggcacgcgcccgcccgctcgtcgcgcctgcagcgcccgcctaatgcgctccgaatggtcgcgcaaagcgagtgccgggttctgttcaatttttcttagtcgaactctgaaaatgaatctaagtaatattttgtccaattttcgaatttccacctcaaataggaatttacaatgtgttccgtccggtaaagttccatccgatgggctgagcacgtcaaactgtttttgctcgagctggccattatgattttgtcaatgtgtcccatttgcgctaccattttgtctgccatttccaacttttcgggcaaaagtttgggggccgccaattcgtcaagaaatgcgcgggtgagttctttgaggagctgaaacagatgagtccaacttcgccccccccaccctttgcccacctccgccaccgtccaataatcgtcggcgtcgtcgtcgccaccgccgtcccttgcgttctcattttcattatcttccgcctctccgtttccatcgtcggccatgtccaacaaaatgccaatggacagtcaaaacaaaggccaactttgacgctgacaaatgaaaaacagaattttttgaaacaactgataaaaacagattggacttggattcttccggcacttaatgtaaaaattcagagaattcgatgaaaattttattaaaagaggtcaaaggataaatcattaaattacaagcaaacaattagtcggaccaaatttagattaggaatagagatcagccaaagcatgacacccaatttcatttgaaaattttgttttttaagagaagttttatagatctctatttttattggcggggattgataaaagtgagaatttaaaacaaatattggttgcagccattgtcaaaaagagaaaaagcaagtcacttccgactttcttttccatcattttcatcgtcagcattctttgttgctctctaaaagtttaatgaaatattaatacatttgaactaaaaagatccatttttggttttattgcatttgtttatatcgtaacacaaaaattgccatccgggaacgcaatactttttcaaaatgtccctctcctccccctcctcaccctgatgcattggcggtgtcgcactcgtcgcgtccgctgcagtttgaactattccaccagttggtccttgatgatgttgttgttgttgatggtgatgaacactgccggcaccgacaatcatttcttgcggttgttgtggtccagcggatggcggaagacccatcggttgaggcggcggcggttggccctgcagagaatgctgagtgtgagaaagccgcgcataatactgaaataaaattttacatccccataatttacattgttttctttacttgggattgtccaggagttgggtaatgctgtggctgttgttgaggtgccgacgttggcggagggccatacgacgcgtacggtggttgttgaccgtagcgatgctgcggcggtggttgtccagccgagccggcgtaataatcgtactgaaaataacataattagatagcaaaaacacatttgtaaaacctgaggaggatagttggcgatgggtcgccccggtggtcccaccgcttgcggtgactgtccgtactgcgcgggtggttgtgccgcacgtgacacgcttccgtagtagtgctgaggtggtggggccgcttgtggcgggaaggcctgtggcggtgggtatgtggcagtcgcattgtgcggaggcggcgcgtacgactgattgtgaaccggcgggggatacgcagacggtggcgggtaataggcggtagacagaggcggttgggctgaaatccaacaaagttctcataatctatgtttcagggcaaacatgagataaaagaaaatcttattcactgcttaaacaattacaatattgtggttgttggccttgagctggcggtggtggcatttgttgttgtggtggaattgaaggtggtgctgatgtcggtggctgttgcggtgcgtagggagcggctgtactgcttgccgtcgcgtgcggagacggtgctggaggcgccgccgcaatgggcgcagtgtttggcgtcgaagtcgtagccgcagcagtggaaacttccgctgcagtattagtggccaaagtcaaagggggctgaggaggagcaacaacggagccccattgacggaggaacaaccgtagccagaatcatctgcaaatgaaaaattacccaacatatcgaaatatttgcaggataaagaaagggtcattggacaatgtctcaccactagctggtggtggtactggttgagtttgttgtggaggcaccgatacgggcggaagcggctgttgagctgcttgaacggacggcgggggctgtgcttttgcagcggattgagacggcggaatgccggccggtgcgaccaccgcttgtggctgcgtgggattgctaacctgcaacataatgcgtgcccattcttctaattcaagcggtgttaagtttaatgatacttcaaatcccggtggtaatattgtcggcattcgtccatcatttgtcagttggtgttgtgcatctgaccgtgctcgttgttccaaatagcgaagttggtccaaatggaatgcttgtcgttctgcaatcagctgctgacgctgggcctccaactgaaaatttggggaggggagagagaataaaactccaattagaaaaaactcgccgtttctctttcccggtccatcaattgctccaactcctcaaagtgctttaacttcagttcgaactaaacatttggtttacgttgaacaataattaaaccattcaaatgccacttttttcatttgcgcttccacgagttgtgccaccaatgctttcattcgcttctcctccacccccaccaaatatttcgcttttgttgccgccgctccgagtgccgttgctgccgccacttggatggcttccgtcgtcatttccttcgcctctctcacaaccgcctcttccttgtccttttctgctcctccactttcttcggtattctcgtgttgttgttcatcggtgtccattttctcctcctgctgattctttgctgcctccgtttggcttatttctccgttttctaattttgccgtttcccgtgtgtttttctgctccgatttttggctctcatcggactaaaattaaaacattcattcaaatttaaaacttcaaaaatcctacctttgtgaatgttccgattgcagaaagtccgacttcgccgtccaattcttcggtctctttggcatgcgattcaatgttctttctgtgcgctttctccaacagtggcgggatgtcgtctctcatttttccgaaattctctgcagattaaacataatttatataaatttcgatcctaacctaaag

SEQ ID NO: 15676 - DNA, 1374 bp, Heterodera glycines
tccccctaataatagaccacacatcaccactcaaattgcgtctgcaagacgtatcggacaaaaatcaaaatggatttagccgatatgtgtcgatcatgaagttgcgatacgcaatgtaactaaagggcctcaattctttaatcttcaaagtcaagtttacgtttcaggtgttttgcttttgttgcgtccattgaagaagtcgggatgtgcctgcttttcgatttgatgaattgcattgtaatcgaaccaagcggaataggacggcacaataatgtaatgggtctgcggttcgactgtcgaagataaattcgtttgggttgggtcgagctgattagcagccggtccatcatcatccaattcagttagtttttgctgctttgaatagccaatttctatatctttgtcctttgctaaatttttaattattagttgcaatgaaatttggtggaaattcaaaagcatgaaccgaaacaaaaattacttttaattatggcggaaggagtgagtgtaagacgactgttttcgtcatcatcaatccggtcaagatcaactgattcggccacttccgatccttcttctctctttcgtttaaacccccttcaatagaaacattatgatatttgttaagaacattatgatatttgttaagatagaacatataaaataattactttggtggcatttggtcgttgcaaaatcaatgcaaatgatggtactttgttaaaagtttctttagctaaaatttataaaatgaaaattaaaatcatgacactaaaaaactcataaataggtaaattatatttgtcaaatagaaagatcggcaagaaagaaagaaaagcacggtatgttgccgataagagaaggaggaggtaatgctaaccagagaccgagatagatttcaaaatgccggacttgactgattttttcagaagcaaccggtttccgaacccggtctctcaaaatctgtaatccaaaaaaccggtcaatccaaatttttctaaaaatcgctggactggcttccggatccagtaaaaaccggtaccgggcccggtcctatctattatactaattgggtgtgtcattccgtgtttttttgccttttttgagcggaaaaacagattatttattggcacgaaagattttgcaatttctctctccttcccttttctttctttgttattgctcacatgcacactcgattaagacaccaaacaacaaaaagagtttgttattgacacaccgtgcattttcaaaagcaaaaacaatttttcttatgaaataactttgattgaatattcttctaaagcgaaagcttttattttctttccaaaaaaagaattttccttttcctttattctgtatttgctctaaaaa

SEQ ID NO: 15677 - DNA, 3821 bp, Heterodera glycines
cttcaaaatgccaatcattatcttcttcactccaattttcccttgataattgttgatttcggcttcttctaataactttgtctcactctttccaaagatcgctctgtccctttctttccgatgatcaatttctcccttttatgttttccgatcactctgtcccctcactcctttcctcttttctaatcagtgttgtgtctccccccccttttttttctctgccggtctctctgtccctttctttccgatgatcatttcccccttttctgttttccgatcactctgtcaaatttcctcttttctaattaattgcccctttttctctgcctgtctctctatccttatcttccactgatcactttgtacttcctcctctgatcactccccatcttctgatcacttttcccctcactcaatggcgtcgttccgttccctccgcagtttttccattaatctttcacattccgaatttgtcattgcatttttcagcttcgcttcatgtagtgcttgtgcgaatttgtctcgttctctcaatgcttcttcgtaattttcgcgaccttcgcttagttccgcgtctttcctctcaatttccgtctccaaatgagtccgttgggccatcagctaaacttatcatattatataattattaattgctgtcacgttacctcacatgaccgcgccctttctgcttcgaattcggcttccgctcgcgcgcgtgcctttctttgcgcttccgccagcgttgtcatttcgtcctccactcgcttcgctctcgcgtgtgcctcgcgttccgcctcgtcggcacgcgtgtgttccctgatcagttccgtttcgcggcattccgccattttacgcgtctcctgcatctcggcatgcaattggtccacctcgcgacggtgttgcgttcgttcgtcagcccattctgcttctcgccgggacatctctcgcaacgattctctgtttttaagggtttcgtccgattgtccgtccgtctgcaccttttctctgccgcgtgctcttctcgcctttcgcgttctttcgcttccattttttcctccataagtgtcctttgagcttcccatcggtgcttttccgcgtcaatggcttttcgtacggcggacggaagactttccggcgcagaaattgcctaaagcgctgaattaggaaaagaattgcaggcaatccagtaccggcactcccaaaattgtccaaatttggctttgtgtgcgttcgatcgtcgcccgccgcgtctctgactcatcgaggcgaagttcggaggagaagcgcaactcggccaactgaacgtgggatgcatttcgaggttctcaagtgtccaaaatgccttcgtcttttgctcctccaaaagtgcgcatcgctttcgcaactcttcggtttcggcattccctctccgattggccattaaatgtaccaattctctgcgtgtccgtcgtgccaatgtcaccgccagtcgttccgtcagttcattccctaggaattcatttttggtccattttctcttcgaatttccttatttctcaccaaaattcgcaaattcgtccgctgtttccgttcggtattccatcaatttttgtctcagtttagccaattccgtctttattttaggccattttcgtgcttcgttcgttttctcgtgcggactttgccggaaatgggccaaaagggtttggctggccaatgcctgcaaatgctccaattgcttctcgagctgaccaattcgaacactgtcgcattggggaggggggcgggtgcatttagtgcctaattaatgtctttttcaacccaaattcggcattatttggcccctccgtcgttggccgtgccccccacgaagtgtttggcctttggtgccgaagtgaaacatggctgtattttaattttattttcaattaatttatttgcttcattttcttttaccgctccgtttcttctgatcgtgccgacgaatttggcggtgaatgactccgcgcgcttcgccaattcgcgtgccgaaggcgcgaacgaagcaactgaaaggcaataaaagaaagcacggggttctcctttccgtcccttttctcgcctgctcttggacatgctcaagaatcgctttttgttttcgttgttccctaaaaaaggaaacaaaaaaatttaattatttaatttatttatttttttgacctgagtccggcctcaattcgacgtcgagtgaaccaaaggtcggaggaaatttgctgcaattcgctgatgccaaaggatgaaaatctgtagaaaacgatttgggaatttccaaggagtgatcgcctctctgatcactgagtgatcggaaagtgagtgatctgtcccttcctttacctttgcgaattcgaggggcgttcgtccgtttcgccaatattttccaccaaatttggcaccgacattaccttcctgcgctaaaatgaataatttaattattaaattgaagcaattcttgagaatgcgaccaaatcgacgaaaccgacggaaggcgtgaagagcaacattggcattggcacgggcactgacccggggagattcgcgcgcgggcggaggtcgtgcgagggtcgtgaaacggaagcaagacaaatcgtcggcaacggcacaacattcgccttcgacccctgcgggcatttgaggaaaaatgggcattccccggggggcgactcgtccgtctctatggctaccatcgcaagcgatgcgatggcccttcaatcgctgaagtgttgcccatccatccccggctcattagctaataaaacacagtgaccatttcgggggaggggaaagcgaattcattgggaaaattaaaaaatgaaagggaaagcgatggaattaatttttaaaaaataaaataataaccgattagcccacccaatgcttacattggccttccgcgagaacaattccctctcttccgccgacttttccctcggagattcgcccacaaatttttttttaattcgttgcgatggcaaaagtgaaaacaaaaggacagaaagaagaagtaggacaatgatcggaagaacaccgttaagtgattgggggaagaaaagaaaatgggccaaagaattaattgaaagggacggagaaaagggggagcagagaggggaaaaggcggaagagagtgtgcagaatgaagagacagcagacattggaacagaaagagggacagcacattttggagcagttcaaaagagagcgggagagaaaaagagggtgcagacagtggaagagggacgacacattttggagcagttcaaaagagagcaggagagaaaaagagggtgcagacagtggaagagggacagcacattttggagcagttcaaaagagagcggaagaggaaaagagggtgcagacagtggaagagggacagcacattttgtagcagttcagaagagaggggaagagaaaaagagggtgcagacagtggaagagggacagcacattttgtagcagttcagaagagaggggaagagaaaaagagggtgcagacagtggaagatttgtctttttttttctaaattttaatttctgtaagaaacttacaaccattaaaatcccagcgaaattttaacgagtcgcgagagaattacgcggactgagaaatgggggggggaatgaccacatgtggtgaccaccacagtaaatgcgaagaaaagggcaatttggggagaagggctggcgcaaaatgcaaaaatggggggcggcgcgagagaatcgataggcaaaggaaattcggaggaagagaaagggaaaagggaagagtggccaaataatgaaggaaattcatgaaaaaacggata

SEQ ID NO: 15678 - DNA, 970 bp, Heterodera glycines
agattaaggcgattgcagaaatgcccgtccctacccatttttgtgagcttcgatcatttttgggaatggttaatcatctttagcgatttgtgtaagacaaagaaatttcgtcgatatgtgtggtgcatccggtttgacattattatatatgcgcatgtatggaaataaaatttttttagtggtatttttgggaaagaaaatccccgaaaagtgtgaaatagccacaaaatgacataaaaattactttttttgatgtttttagggaacattttcatacttattttttcttttgaagttttcaaaatatggacaaaaatatttgccgaaattttgaatttttttttgaggatttccaaaaatttcagaacaaaatactcaaaatatgtgaagaaaatgaaaatatatatgaaaaaaatccaaaatatgtagaaatatgtaagaaaatcccgaaatatggataaaaaccacgaatatatgtaaaaatatgtaaataaaagtcccgatttttgttcgcaaagacaaaaaagaaagtggttttcctgctatttagagcaaggagaagctaggaaaaaaatatgtatttacataaaattggcagccctaataccgtatatgctctaattatagcccagtctctattaataccgcagtctccaattatcccccccccctttctgaggagtttaaaaaataatcacccagtctccatttatcccccatgggggataaatagaatttgagaacattgtttgacactaattatttctgaaaaacaaaaaaattttcccagcaaattggttgataatttgcgggaaccgtgttgacccacacatagggcttgagcttatgatcattggttggtgggtttttgtagtgaagaccggacaactggggggtcggaggggatccccgagtccgggataccgacggaaccccgatcccccatcaatccccgaacattttggtaaaa

SEQ ID NO: 15679 - DNA, 1669 bp, Heterodera glycines
tccaggtcccggcttttcgactcccggcaattccccacccgattctgttcagaattccgggtctcgtgcaattaattctagttcaaataatgaatttgtaaagaaaaagagtaacaattcataattgacattgcaggcatatgaattcaaatcctcaaaactaccgtatgtcgcattttacaagaagttctgattcactgatccattttctgatcacggaaaaatgcaatttgttcagttggttgcatcattagcagcaggaacgggaaggtcgttctgtcatgtgttcgttcgtccgtcgatttgaccccccggggggtacaaaacaaagcaccaccaattttcaaagataaagaaacataagaacagccgaggataacaacaataaaatcacataatattcataatctttggttgcaaaatgcaaaaacaatcagcccccggcttttaccatttacgggattttaaaaatactttcattcgtgctcaatggatttaaatttcaaccgatccttgttttgtaataaatttataaatttcgcagatgataagcaaaagttttcccgtttcaaatcacatttatcacatttactttctgatcaattcaagattcaaattctcagtctctccgtgtttaagcctaagccaaggcctagcctaaagcttctaagcaattgtacgagttgtctgtgtacaagttgtcacgacacccgaaagaaactgttaaattttaaaaaatttaatagtttattttgaaccaagataaatattttagtttatttgtttcattatttttcaatttttatagtttttgtaaattctcgtaaagctgagttgtcctcagctgactgatcctgtcgcgtccatattaaccggtccatttgaaaccaaaaacaacgattggcttatttgaaaataattggagtttaacttttgcttatatgaaatgagaaaccaattttaaatttttaaaaatattttttaacttttgttttgaattttttgtttccttgtaatgtccggttcccggtcccgaatgaaaatccaggtcccggcttttcgactcccggcaattccccacccgattctgctcagaattccgggtctcgtgcaattaattctagttcaaataatgaatttgtaaagaaaaagagtaacaattcataattgacattgcaggcatatgaattcaaatcctcaaaactaccgtatgtcgcattttacaagaagttctgattcactgatccattttctgatcacggaaaaatgcaatttgttcagttggttgcatcattagcagcaggaacgggaaggtcgttctgtcatgtgttcgttcgtccgtcgatttgaccccccggggggtacaaaacaaagcaccaccaattttcaaagataaagaaacataagaacagccgaggataacaacaataaaatcacataatattcataatctttggttgcaaaatgcaaaaacaatcagcccccggcttttaccatttacgggattttaaaaatactttcattcatgctcaatggttttaaatttcaaccgatccttgttttgtaataaatttataaatttcgcagatgataagcaaaagttttcccgtttcaaatcacatttatcacatttactttctgatcattcaagattcaaattctcagtctc

SEQ ID NO: 15680 - DNA, 4113 bp, Heterodera glycines
  misc_feature (3018)..(3018): n is a, c, g, or t
  misc_feature (3048)..(3048): n is a, c, g, or t
tttcaggcccatgcgttgtgccaaggaaaaaattgtgcaaagacagcgatggatttgaaaatgggggaaacggcgtaaagaaacgcgaagtgccggagggatgtttaagcctttcaaaattcgaacaaaatgccaaaagtgaagggaatgaacaaatgggagcaaatggaacggacaaagcgatgaacaaaagcaatgaaaacggcataaatgccaacggaacggaggagggaaacagcggcgaagtcagtgccaaagaaatcgccgactttttcaacagctaaaaatgggaccaaattgtgaaggagaagaagagattcctttaaatcattccaatatcgcattttaattttcccttttgcttttttgcatttaaaaaattaaaattaaaatttatgttttcggtgtttggccggataaacatggccaaatctccccccccccccttcttccctctttacccatagattttacgagttaatctctgccgtatttgtcggcctatccttttggcgctgtgtttgtccaaattcttagctttcccctgcccgagtggccttttgcttccggccggtagagagaggtcaatggcgaattggcggaggtgggcctccccgggggttaagggctcggggataagggctgatctctcacctttgtgttccgcccccttcccctccgggccctccttttttgcttaattcacatacaatattttggcctttattttttattttttgccaatttataaatggcccatcgcaaaattcggtcaatcaacggcttaatgtttttggaacaagtaattgaaagtgagctgagtgccattgtttttttgttgcaattgccaggcctttgcgttctgcgccgtttttgttgctgtgcaaagtgccaccgtaccactcgttgaacaaacgctaccgtaccagcagatgttgggccatccaatccatggcgaaagatgcgacccaaaaacggacggacaaatgtttccgattggcgacgctttagcgagtgacaaattcctttactgccatcgcgaaaaaaggtgaaggcaaactgagcaatgccttctgtttgggcatttgtccattcaattgaccgtttggcaccgaaaagaaaaggacgaccgaaatgactcatccaaaaaaggataattgccccatttaaattattccaattaaaaaagaaatgccttcatttccgacagagtttatgacattggtttttgcgttggcaattcgttcgatccgataaagcgaaaatgcattgccaaaacaacaacaattcacgtggaggaaggcgaaacgacgacaaacggagcacaagtgacaacaaaaggggattattcagcagcaaaaggcattttaaaattaatttattaatttatttattattttcccaaagtgccgacatttttgaaaatattttccaaagccacaaaacatcggaaagtcccctcgtcggaacaaaaaatgaccggacagcgaatccgcgaatttttgccgaaaaacaccgaagctggcattagcactaacataaagacacggaaagcgaacagttcaaagaaagcgatagaaacgaatgttcaaaaattggcccaaaatgacgacgaaaaaagggacgaaatttcaaaggatggaagggacgtgaaaatattaatcaaaatgagaaggaattcatcggaaaacgttgaacaatttggaaaaaaagacaacatcaatgggccaaagaaatgccaaaaatggaaaatcggaaaataaaattgaggaaagcaaagtgcggcatttgggtattgactttctaaaaattgagattaataaaactaaattattctctgctcattttcagtcgtttgttctgacggttcgttgccattcggcgacaacaacggccattcccaccgctgttttcccgaccacgggcacaacccattcaggcactttccaaaacaatgccaacgcattggcagggactgtccaggatttagcacttttgggagttcgggataactcgctggggatttagcccttttcggttttatgcattatcgcatttttttaaatttaaaaaataatttatatagactgataaattcaatagaatattaaacaattaggaaatattgtaaaaccaattttttattaaagcgaacaattacaattgaaagattttgatcattactcaaaaacgctgatgaattgtccactgacggattgtccggatcccccgcgtatccaccgccccttccccttgggctttccctgcgcatttggcattggcaacgctctcattctgtgccgtcccctcgtcgttcagttcgttcgcctgtcccttctcctatcgttgcgagttcagctccatgctgcgcacccaccagtgctgccccgaattggtggacaaatcaaaattatttgaggaggaaaattgggcggaggacggagaagggaccacgggggagcagcaaagcgaacgaaggcccaatttggtggggagaaatgcaaattgggaggccaaatggacgcacaattctcttaaggaattcgacggcgcatgccctgcggcacattttcttcgaatccatccgaagaatggttttaagcactcatttcaaatgccaactttccattctcctcaggccaaccgaccctttgctcgccgggttggctcattctgaccggccacggcggttgtcctccgttctcaaaatgcgtctatagccctccgctgctccaattcgtttgctgtcaaccgaacaatttgttaaaggcaatggaaaacgaattgaaaggccaaagttacgccctttacccgccattaggtcagaacggagggattttcatcaattacataattagcgaaacttaagggatttttccggcgcagtcgggttgcatcgacgatggccaatgccaaatgagattccctggggcgaaatgccaaaattgggtgtgcatttgcccgcgaaggactcagtgcatacaaaggacgatgcggtaggtaattaaagacacaatntaatcaattttccacagttattaattgtcncaacggatattccgccgatctcaatggaatttgcacgacaaaagaagcttttgagcagaaactgcaaaagaatccggcattttttcaaggaaatgattgattcagtgcatcactttttgtttttaagtattggaagatccaaaattgtatttttttttctttaattttttctcttaattttatcccaattaacccgaaatacaaaaaaaaagcgaaagtgaaggtcgatttccttaaattacaacaattaacagttcgtttccattaatgtttctctcctccgactcttttcactttccccgtttcattttcccttcgaattcttttgccaatgagctgagtttgagtgccgcataatccataagttcggccctttccgaatttgaaatataaccgaaattctcaaaattggcacaatgcaaaatgaaatttgtcacgaggccctttctgatcgtgagcagttcctttccgtgcgtatcgatgaaacgtttctgtaaattttaaacaattaaaaaatttaatctaaaacttaagagacaaagcaaagcagattaaaaatgatagagaatttaagcactaaaattattattacattaaattccaaaaaataattaaattcactcaccaaaagagcaaaaagctgacaaactccgagttggcggtttgttctcttcccaatgaatccgttccacaggaggaagaaagccttctcctttctggtcacatccgtaaattggttgagtcccttacgaaattaattaaaataattgaagttaattattattccaatcgccctgctcactattcggtgaatgccgctcatccattcgtggaaattgtccactaaaattcttgggatttttttgaattttatcccaaaaaatcattagtctttccgtccatcgcttacctccgtaaaggttttgaaacggcgggtccttaagttccgtatatttcggctcattgaacggcaaaatgcctttgaaactaaaaatttgcaatgttaaagcaattaacgaccattttgcctttccctcttgaattccaactaaaaagccattcccg

SEQ ID NO: 15681 - DNA, 3642 bp, Heterodera glycines
aaaaatgcatattttttattgttgttcgttgtatcacctctactccaagtttgccaaatttcgaaaaaattctcattacaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctactcatatcttctgaaaatagtgttataaatttgaatggaatttttgcatttttcactcgtaaaaacattttccctaataattagagaagtgatttgattaaatatatcttaacccactcgtcaaacaaatgaatgatgtgccggttgtgcttgattttacggaacacctctaaaaattgttgctcccttttcaaatcttctagcacatcggctggcaacaactccaacatgatcgatttgatgataacacattggtttatcggcttcccatcaatgtcaaccgcatttaagggacttgcatgaaagacctaatcaagcggaaagttaaaataattcaaaatttaaaaaatggtaatgaaagctaaattcaattctatttggcctaggaaatttcgtattgatttaattgatttctaagtaaatttataaatttattacaataattttctaacaaataaattcaaaaattgcagttttgcaatggactgcgatttttgggcacaaaaaatcgcgaaataggcacctaaaaaggcagaaaaaacgcaaaataggcaaataaaatttttaaggatttttagggagcaaaacacataaaaatttaatcaaaaaattaatttagattatatatcaatttaaataaattattaaatattctgtaatttcgaataagaacaattttgccttagtattaaacataaaaagcacaaataggtaaaaataggaattctaaaagtcaccataaaaaccccaaaccaagcgaaaaacgcgttttttgtgcttatctgtgcgtatcaagtgcaaaaattttaggcatttgcctaaaaatcgcagccctattaataatatgtaaaaataaaattttataaaatgactcttgaagttgctcctccgcttattggctccgggaacacgtaatattcattaattttggtttgagctgaattttgaatacgcaaaattttcattgcaccaatggaaaatttgttgcatttatccatttcatcgagtaattcttcagcgtttggattgggctccaaatccaagaaatttccttgtttcaacattgtgatcatctttgttggattatccacagcaagactaaaattaaatatgatttgaaattaagcgaaagacgaagtcaaacatttgctatttttgctatttttgaaatttttaattgttattatgtctcgaaattcaagatatttgattatgatagattaacttgccaaaaagtaaaaaaggattgatcaacaggtatagcgatttaaacacgagactttgcttacttggtggggccggaatttcggtcggcagggatcaaatattttttttgctcctcaatttgctccctaaaactgcctactgcttttaagctaccctcatgaacgcccaaaatagggccgtttcgtcggaatgatgcgctgggacttggcttcggcggcaatggtggcaacggtggcttttttgttttttgattggaatacattcgtgccaaacttttttttgacgtcgcattatcaagcgatggcattcgggaggtcatgcgaaatgattttgtccttatattaatatttgacaaaaaatttgggtctggctgttttggtggtgaacaggaaaatttaaaaaattttgatattccatgatgcttttcttgtggatacgattttgacaatgctaattgccccgaagcttttggcaccgcaaccaatgaacttttgctgccaacttttggcgactttatactaagtgccattgatgttgatggagtgccaatgttggttgcgtgactagcgaaagattttgaagaatggctcgattttgataaaaaattgtcattgttgccacttttctgctgattgtcctttgccgaagtttcgtcaagctcagccatcattaactgtcttatatttcctccaatcggggactgatcttgcttgtcagccacttgatgctcattaggctccttcatgtcgacatcaccggcgattgggatttccttggtcttcgaatctgcctgataattcgttctattgattggtattgtaatcgaatttgtcataggtttatcatctcctgatccttcagtgatcggaatttccgtcgttacctgatcaggatcatgtcgagaagtgagattagtgattggaatttgaagttgctccacaaaatgttttgcatcttgaatttttaatgtttttgttgattgatggcttggattttctcgttcactttggtcctcttctgttacatttaccagaccaattggaccgatttgaaattttgttgatgtcttctcagtttttttgtccgtatgtttttcatttgttgcattaatttggcagcatcccaaaaacaaaatcaacagcaaatgaagtgatactttatcaaatcttttgactcgttttaaaaatttatacatctaaaatttaattaattttaatatacataaaagcaaaaaaatattattttaaaaataaaatagtaatgcaataaattaaataaaatgaaaaaataaaatttgaaaatgtcctttgtaattgtttaaaatagaaattatagcagcataagcattgcgtgtcattttgtgaagccctaatttggcatgtgatttttataaattgtgcacttttcaatgctcatctgtctattgtggcaaatgactgaatcattgatttacccaaaatttattgaaataagcaaataaaatataataatttggcatattttaaaaaaaatgattgtacggtgattgtcagtgtaatagttttatgcaattttttacgaaaaaaaggaaatttcaattagaatttacaacaaaatgcagtgatcccaaattctttaaaatgttcagtcaaggaatgtactgggccgggctcacccaaaaaagtaatcgggacgctgtaaaccttttagtctccttgagctccgcctacaatttttggttttgtccaacaatttataattaaaattttatgtgacgtagaagagactcgaaccttatctattattataaaaaaagacccgttaaaacaaatattttgcgaagattttgataagcaattggacgcattttaaattgtcatagattgtaaaaatccaagaaaggacctttctttgtctaccgccgcatggaatcttgaacgaatgttagaccaaaatgatctggtcaaaatttcaaaaacc

SEQ ID NO: 15682 - DNA, 1478 bp, Heterodera glycines
tctaatcattttgtgtgagaaatgcgctccatttcgtcaatttgagcagcagcgaagggtggagagggaggggaggagagaacacgtgaaaatcataggcaaaaagaggacagtaaaaaagagaggcaaattcgtcggatggtatgcattggcagaggaaggcggacggatggatcaccaacactgctgctgatcagagtcaattcccggggaacatacgtaaatgtgctctatccgatacgaatgttacaaaaggtgtcaatcacaaaaatttgtacctaattaactattaaatgaaaatgcgtcggaaaattgtgacggagggaaaggaaaaaattatatatgtattgatttttcatacaataaataaaatatttataagacaaatcgttcaaatgagcagacagacaaaagagagacaacaagacacatacagaaaattgatagaggagaaacaaaaataatgccgaaaacaaaacgaatgatttttaaaactgattaatttaatgcccgttttgtgtcaattggagatgaactgcttcacattgtggacaaagtcctaaaaatgcaaggaattcaacaatgataagcagaatggaggccattccccgctttttgttaccatgacaattgggattttcgcagaaaggctggactcaatgaggcgcacaatcagatgacaagcttcctcatcggataattggaggtggaaacgttcgagcacctgaacagtgaaattggattctaatgagttgggaaaagccaaagaattgtgatttaggcagctaatgagaatgagtgagtgaaatgttgtaaaaaaattagcaatatcatcccacaaattctcagtaatttcagtatgtagttcaaggaatgataaaattattctaattgagttttaattagagtgagggatgccaagggcgtaccagggggagacaaattgaaaacgtacaccttccccaatgggcgggggtggaaatgaacaccctcaccccatcattttgtcaccttcatcacggctttgtccctctccacggcaatgtcgggaatgcccgcgtccagcatcaacgagaagagattggtgatcagattggcatgccgtcggagaatgcaaaaagcggttgtgcaataattgacaaatgcgcggaagtgctcactaaaaaaaacaacaaattttgaaaataaaaatgcatccacagtaaagagaaagtagaaaactgtatagaaacgctttattgagtgccccctccccctgactggacaatcggacagtggacattccgacagtaaaatgcacaaaaaaattagaaaatgccgtcgccgaaggggacagattgtgccataagcgacaggacggcattgtgtgcgaggaacggcaagacaaagcgcttatattcagcaaatgtgcaaccgtcatttacgaaatgccaaactcaaactaatttgcaacgaaaatgttttagactgcattggca

SEQ ID NO: 15683 - DNA, 1805 bp, Heterodera glycines
  misc_feature (859)..(859): n is a, c, g, or t
  misc_feature (876)..(876): n is a, c, g, or t
  misc_feature (935)..(936): n is a, c, g, or t
  misc_feature (1722)..(1722): n is a, c, g, or t
gtccgggagcccccctccctcctctcccccgttccttcacctgttttgtccgcccatcgcgttgaccatctccgaagtgagtttcatcgccggtggcatcggtttggggtctctgccgaggatgaagctaaagtcgacgtggaacattttccctaaacgcatttattaaaccaaaatgttgccaaattcgtacggaaaagcatgaacaaaatgccaaattcaaaatgcattcttaaatgattaagccagcaaaacggtcattagtttgtgtgcactttattccccctgcatcgtttcccacacgcgcgatttttttaaatttttactttaattttcttaattatttaccgtaaggtgtggatgaacacggtctgaatgtgcgcagtgtgtcctggaaagaagtgagaaactcatgaggaaaaagtgaaaaccaaccaacttgaatacttttgatgtccgcaagaggagtggcgccgcggatgaattggacaaaacttgaaaaaacgactcatttacttattttgttggtacgttttgaaatggcccacccttctgaacaactcgtggccaacacggcgtacggagtcaggcacaagtccaacttgtcctccttgagcagctcgtccatcagtcgaatcatctgcagcaccaattggtcctggcgcaagtcgtcgccccgcttgaaaatggtggtgtacgcctccgcacattcgtacggcgtgagcgcgtcacggacggtggagaaagtgagacgcatcggcatcaaattggaagagaacagcacggcggactcgggctgaaccgcgcggacgtggatggacgggtcgagcggaagaccgagacccttaagagaaaatgnggagacaattatcaggngcaatgaaccaacatgatttagttttttggcaagtccctagcaaatcacccttccctgnngggagggggtaaagcggaccaaacgatgacagaaaatcaccttcaattccgtcaaatccacattctccgacagtttcttccgcagcacctcctgctttttggaccgactgccgctcaaatcggaaatgactttagcaatgtccaccaaagtgtcgacaaatttctgaaggacaaaatgcatcttttctgttctttccccctttcccatgattttgagggctgtgggggtaccccagttggtaaaaaaaacttcattttgcaaaatttagtttttttttcggaaattttacccgggtacgtccgccctggaaacgcactctctacccaaccccccttttgtccgctcactttttgtgttgcgattgtgctcagtgtgtgccgtgccgacccgtttcccttggacagttcctgcttcaagcggcccatcaccaagcagtacatggcggagactgatgacggcgcatttgtctcgtcactgtccgtcgcgttggcctccatttcaacctaaaggaaaccaaattgcacaaataaaggaaaactacgcaaaatgtcaaaaacatattcgcatttgtcgtccaaactgtgcgtaccttcaaataccagaagaggaagttggcgatcagactgttctcacaggccgcgcggatcaaaaaggtggccaaatccatggattcttgcgcaccaaacattgccattgtttctattgggccgagaagcatcgacgcggtcggcgacgacaccgccggggcgactgttgccgaaactgcagtttggacttccggcggncgttgccgaacggatgagcgatcactgtctaaaattcattattatttttgagggtactaaaaatggaatcctccatcacatgc

SEQ ID NO: 15684 - DNA, 2425 bp, Heterodera glycines
tcaccttcgacatttttgttgtgcaatttgaaacgtctcagcatggcggtcccgtcaaaattatctttgaaaaagtcagtgactcggcggttgccaaacaattctgaaaaaagcatacataagagtaaaggaacataaaaggatttgggtatgtgattattttggtattacctatacatatgataataaagaaacacacccaatgggtccacacatgatccgagcaaccactgactgatttcccccggtcgcgtaagtcgttcctgcaattcgaaagcagccgccgatgacttggcagctctttgagtttttaacgaccgttgttgttgttttttagcagaaaaaaaatttgcaaacattttatccaaaataaaaggtaaatgaaggattataatagggttaggcggggtttggcaatggtatagattattggtcccgaaaatttttttttaataaaatttgagaaaattatttttaggggtaatcttaggcgccgagcacgaatccggacttattttgtctcagtctcgaaccccgaacccggattcgaacatttcgtaatactgtcgattgtaccccgcacccttttttgaaaaattttaatttttttttctagaaacaaagttggggttttcagggtcggagatccgattttgacatcaatctcgaccaaattcgaacccctgacccagattcgaataatagttcaaaaatttaaatttttcaaactttacatttttacttcaaaatggtttaaataatcttttattgacgtattaataagatcatgtttgattccacgtatatagccgggttttgaactaaaactgcgaagtacgaaaaattgaattctcaaacttttgttcgagtccgggttcgggattcgagactgagccaaaataagaccggattcgtgctcggcgcctcagattacccctaaaaataattttcttaaactttatttaaaaataattttcgggaccaataatctatacctttgcccatttggcggacaatgaaaaaatttttgcgcttgaaatcttaaattatgtttgatttacaaggcgggaaaagggcaaaaaaagttggtactccttgcgtttgggttggaatttttgagaatttatattgtaaggaagaagctggctgggcggttaaaacgcggaaagcgggggttgataagatccataaaaagaaagggcagatgtgcctcggtagcttaatggtagagctgcccacggaaagggtgcatgagtgggttcgattcccacccgaggtttaacattttgcccatttcttattatatgtattttttgcggcgatatttcgaccggtgttttgtcctctccctcaaaaaaaatggcagaaatataaactaaaaacgctaaatatggatttatatggactaaaaactttcaccaaatcaaaattttaacgtagaaatgcttttttgagcccatttcttcatagcatatgagcagatacttaatatgaatcttagcatataattggaaaaaacctttttttttgtgtaaattttcatcttttagtcttaaatacccgggaaacgacaaaattttccgattattacagaaaaccaaattttaattgaagaagaaaaacataaaaatgataaaaacgagcaaattgatcgaaaacattagtgaataattaattcttccttcagagagtcgccaaatcgaatttgaaattgggcccaaaattcgcctcaatttggtcgccaaatgcgcgcaaagaagcgaatggatgaaatgaaccatcagcaaaagatggatcaaccaaaaaatcagaagtatctgtgaaaaagttaagggaattttgattattttaaacataaaataaattagataaaatagacaattaaccaaattgtaatttaaaatcgtaaaattatattatttattatttgctaacccaaacgaagtccatttttggtgaaaatgagctgtcgagtggccgaattgacgccaattccaacggtatcgccaacaccgtaggaatattcggcatttattccctttccttttccgttaatcaataaatagccatcgctttcataggcataagtgcccttttcccattgaattgatcgatccaattttatctgctgtttaacagcgaatccgaaagtgatgcccaaactgaataaagaagaaataactaataaaatatttcactttttatacaaaattcgcttacaaatgcctttcgtcttttttcataactgaaatttcgtagtaaaaaaagtcggacaaatgcttattcagcacaatcggatatttagcgaagacggagcgccaaccttttgaggagaaattgaattttgatgtaaattttaaaaataccataaccatttcccttatgatggacaatgagacttttgtcacactgatttcggtgtcct

SEQ ID NO: 15685 - DNA, 796 bp, Heterodera glycines
aaaattttcagtaaatttttttgaaattttaagtaattttcttaacaaaattgcattaaaatactcaaaatttttcccggcggcgcctatcggcacccccgcggcccccccccctttccatatccttgaaaaatggaggccaaaatggcaaaaaatattaattttttggcgaaaaacggcgaaaaattttgtaaaatacaccccctaattcgggatttcaaaaaaccaaaaatacacccctaaaaatcgatttaaaaaagaaaaatacaccactaaaaatcgactttttgacttcaaccccccccccccccccccaaaagccaaggtctggggctacgcccttgcttttgactgttcttttctatttgactgtaattataataataacaataatgatgttatggtaggtacagtaatgttgctcatttcccttacctatttgacagtaattataataacaataatgttacggtaggtacagtaatcgttgctcatttcccttacccttttgctgttgatgtgccatttccattttgtcaaccttcgtctgcactgtcacaattcgttccgtgacctttttctcttgctcttcttggaatgccttctgccgaaattaaacgatttttttttgccaaaaaaatgattgattttgttcttaaattggttaaaagaagctagaattaaaaattgaaaaaaatggtcaggtaataatagtgctgttggtagcccccgtttaagtcgtaaaacatgttataggcacagtcttcacgaaacacacttatgcattcggagtgat

SEQ ID NO: 15686 - DNA, 3741 bp, Heterodera glycines
tttaaaagcggtggcaagtgactccgattttgtagcagcatttttgtagaatgaattcaaaaattgtttgtttgcttttctgccatttcatattgttttgatgtgctttttttgggcgtttttttcttcaattttgttgtccaaattttttaaatttttatgtcaaagttttagcacgcgtgcggcgccaccgtcgccaaaggcgcggcgcggcgtgccaaaacggcggcgcttttttggccagcaacaggcgcaacagttggcgatgcgcttgtgcgtgtgccaatcctgtcgctcagtgccgagacgtgcattgggtgggtttttgatgcaatttatcatcctgttgctaatcacctttttctccgtctaatgcttcattttgctgaaactgaattttcttgttttggtaccgctctgattttagtgtttttttcgcaaaaatttcaatgccccgaattccattaaatacatttccgaatttctattttcccgctttttagacgccatttctctgttcactccgctgaacacgccctcaaaatgggcgccaggtcatccacgacatgtggccgtttgccaacggcagttacgtttcgggccgggccgtcacaaagtcgcgggaagtccaggttgtcggttgggtgggattacatggcttatcattatgcttttgattaggggtggcttgggtgaaacaatttcaaagattttttgacccattttaacctaagaatgcttttcaagttgattcgtacatattttgacttgtatgtcgattttcaaatcgaaatttcgaaaaaaaataatgttttcaccaaaaaaccgcatctttttttttcaaaatatttttatttctcagcacaatgtccgtgtccaccatgagcaccgcaactgctgctcccgcgacttgtgcctgcagatgaggggagggcgacaggctggcggtgcaacacagacaggtaaccagaaaatccgaagcggacacagggggggggggggggaaaacgaaaattttttgcatttcgcaccaaaaagcttttaaaatgacagtcaatggaataaattaagaaaacgtaataaaaaacttcctttaccccatccccaaacccacccaacccactcgggaaatcagtgaattccgaacggttttttaatttattttttgccatttttctcaaaaaaaaactggcactgtcatagccttttgataatttttttttaattttttgctagcaatgctaacatcggtgccattctttacaatttattcccattttcattattttcccccattttctgtccaggtttaccatctccaattctatccgtccaatgtgtcctttttgtcgggcctttgggagaaggaatttgagcgcacaattcgcacttacaaaagcccatacatcagcttcacctatttccactcacaggtttttattcggaaaataacaattgggtgaaaaaaaggcaaactgaaatatacaaaaaaaaaaaaaaaattttttttttataaattaattttaccaaggccaggtcgaatcaaaaaagttgtttatagtgcattttaaaacccgttttttatgtaggttttgtggccaataaaaccagcggtttggattgggtcaaaattgaaaacatttttttggattttcaaatttgcttttgctttgcaatatttactaatttcggcaatcctaacgaatgggtgtccttaatttaatctttatttttggactaaaaatctgtttcttaggatttttgggtactgattacgaatctaaaccggattagctcaattcataatcgcaaaccgatttcgaacggaatttgaaaaaatttaccaaaatatgcgttagcattctcgaaaactccatgaaacggatttagagcccaaatttattaaaaaaggattaaaattagggacttccattgattaggagtgccgtaattacaatatcgttttaatttcattaccgtatcctcccctccctttttttttgttagactttggccgaagaagcgaaacgcaacgcgcacacgctggtgctccattttgtgttcgcctttttcattctctttgctcctttctcggtaagacacaatttttcttttagcctataaaaacttaatattttaaatgaacgttttttatgcttatattgttggataaatttcgaggattgtatcgtccggcggtgctcaaatgccggcgcccccacaaaatgtccaggtcacgaaatgtccacaagagtaaaaatccattaaatgtccatgaaaaattaaagtttataaaaattcgggaaataagtctaaagtctattttagggttttcggagtcggtaaacttatttttcgggtttttataaaattaaattttatttttttctggacatttcgtgggcttgtactcttgtggacatttcgtgggtagcgcaaataccaccaaagaaatttttttttgagttttcaaaatttattttcctaatttttaagggataaaattaagaaaagccataattaacttatcgctattatatgcttctcaaatccaaaacgcaaactatattgggactaataaattccaaacaattaaaaaattaattttttgtatttccctgaaaaaggttggatacatccattagtttaaacgcatcatttttttatgaaatttagggagcagctcggttcttctcgcatcgtttccccacgagaaatttttttaaaaaaaatttgctaacttagaaatttttttagaaattttaatggtggattagttttttaaaaaattttccaaaaaaatcgctgagaatttctcgaaattttttttcttagaatattttataaaaagatttattttatttttttttaatttctcttgggggaactgatacgggggagaaatgaagtgcacccaaaaattttcttgacctccccatcgttcgtcgtaaggagggcggctgtaaaagagggtggtcgtcgtggaggggaggcgttaacgtagggggaaaatttaaaattggtacaatttccttagcgaaacccatgcaaattcaaaattttttcccggcggcgcctatcggcaccgccggaccgcctgccaccgccttccccaaaagttgaatgttttttttccaaaaaattatagaacttttcctacgaaatatgatataaatttttaaactatttttttctaatttttttactcctgtgttttgtagctacgaccctacgcaatattttataatttaccaattcttttattaactttaccctacaatttgcaggcgttgtacaacatgtcccatctgtcgtgcccacaactgttacattgactggacactgtccaagccatttctggcaattttgggtgtggtcaacgcgggcatgggcattgtgacggccatcggtctgcttaacatttgcttggtgccaaaaattcctaagaaatttcttagtaagaaaatttaaattcgaaaacacttagtagtgcattataaaatctcgaaaaaaccgctgaaaaatttttcaaaaagttttttgcttgaaatttcttgttaagaaatttcttaggatttttttcccccgcttcttgcagatgactttcttcgccgctctcgctgttcactcgactgttcatgctcggctcgcgcgcaaacccggacccgaaaatgttggaggcgaacctcgcgatccgcaggcgtccaatacattcagaattggtcagtcagtctccatgat

SEQ ID NO: 15687 - DNA, 915 bp, Heterodera glycines
gacggacaaatcgggcatcgcccgttttcggcggatgggcgaagcgatggcggacccggcatttttggtctcataataataaatatcacatacagaattgggttgaaaaatcaatggcacttatgcagtttaggccacacaaacattttttgtttttatccatgaatcccatattttcgattcattataaaaaatttttatatggcctaaactgtataaatacaatcaatttaacgattatatttctactcccatttcgcattgcgatttttttgaattgttcaaaaaacaaaataaaaattgttataatttttcataatttttgaccctttatatttttgccagatcctgatcactgattaccgcgttgagtgacgcgctttcgttcggcgttggcgccatcaccacctttccggcggtccaaatcttttacatttacatttgtgcagcaatcaccatcaaatttgtctaccaggtgaaggctgtcttttgaaaatattttttgttcattttctcttcatcattatttgaatgtagctcacaaagagaacattaaacattcccaacattgtgtgtccaaaccacattaatcctaattttatcgtgtagagaatggtcgatttgctattcggaattcacggctttaaaaaaaattcttgattaaataaaccagagaaatcagtcaaaaaatcgccggaccggttggccaggcctggtaaaaaaccgataccatgcccggcccggctcgtctctattgatttaaaataaggaaaacttgtgaaattagaggttcacaacctaaaatgtttttattttctataaaaatattaaaaaaccaactcaatatttataaaacatccgttagttttctacacttaaaaaaccctccttttttaaggaatcccgtcgctattt

SEQ ID NO: 15688 - DNA, 3187 bp, Heterodera glycines
tgcttagccatgccagctcctcacttgttgacgcctacattcagccaacttggccacctgttcctcatcgaaaaaatgtatgaaattttaaagaaaattattgctcaatttactatagaaatgctccattttacaatgattctgattttttaaaactaaagttacaaaaattatgagttacttaaaaccaccataaaattaaaaaatttgagtttttatttaaattttccgacaaataaacatttgatatcgaagaaatataaatgagtgttctattagcaaatattaaagtaattttaaattttattaatttcatagatatttaaagaaaaaattacccaattaatttggttttttaatccgtttcatttatgtttagcgtgtcgtgctgcttgagcttgggcggcatgcaatcagtgccggcgtattgacacaaaagccatcattaccgtacagctttttccccacactttgcgcggttggcaacagcagcaaaaatggcacacaaaaagtggtgacttgtggtgccaatgcatttaatgagcatcaaacgcatgggtggcaattgaagaggccaattgaggcataattataataaatgaagaatttaacattgtaaaatcccatttgaatcaaattgggccgtggtgagccgaagtgacaaaagtatcaatgttcataatatttaaatttaattaataattttaatctatttgctaaataataaatcttaacttatcttaaacttagccaaattaaaaaaaaacttgagctagctctacatagtctcaatatattatatatatatatatatattttttttaattagaaaaatttaacaaaaaatttgtaaccaaaacttccaaaaaatttagatttctgaacaatcttgaccctaacttttttagaactcattaagatttttgaaatttcatataataataggtaaatttttgggctatctaatcatataagggtgttatgaatgatgtttgaacaattttcatgcatataaacaatcttatatttttatataaccataaaaatttgacacatttaattctttctaactttttttcggatattatattaaattttaaaaatcttattgagttttaaaaaagttagcgtcaaaaatgttcagtctaaaatttaactattacgcacattgatgcttttgtcacttcgtcctagcactaaattgggcgatcagagcattaatctaaattgttttctaattattatggttggaggacaatcggctcctaattttggttttaataatttttctaattatatattttttcgtttgcttgaattaaatacaaaatcaaataaaaattacaaaatttataaatgctcttttgtttataaattttttttataaattttcattaaatcaaaaactttatttttaaaatcattgtttagtttaaaaatgatgatggtgaagtggtcgaatttgacgacgatgttctaaaagcagtgctgaacaaagctttgctgtcggattcggccgcccaagctcaggccatggacataagcttcagaccgcatgattatttggtgggtatcttggaatggatcagtcgggatcttattcccttattctatcaaattcatggatatcctggatttgattttttaaaattcttttattaatgaaaaggtgaaattataatgctaattttcgaatgcataaattttaaataaaaagtgattttctgtatagattaattgaattattttaatttaaaaattggttcatttgatttcattggagcaaatttctttgtccaatttctcaggttggcatatttaatttccaatttcttagcaattttttcgtcactaatttttggattgccttctttaatttcaaaatattgctccatctttcttaatttggcatcactgatatatttattcttagctaaaaacaaaaatttaaataaaatagttttctttcccttacttttcttgtaatttggcaccaattcttttttccattttataaatactctttcaaaaatgcccaattccttcacaaattctttttgtttgcgatggccatataaatttttaaattcattaattcgttcaatgaattacttctttttctcatcataaaaactttttttcattattttaattttatttttatttaaatttaattcttttttccatttgtatatttttaagcgatttgtgcctaataatttcccaattttcgcctcaattttggaagtgtttttccattgaaattttcctttttgcttcaacttttctttaattgcttcaaatttttctatcatttaattttttgttgattatttggttcttctttcgtattttgatcagttctattaatattctgatcttttgcatttgatcaattgattcagcttcattttcttctctttcatttttatcccattcgttgccgaatatttcatcaaaatttggtcgggttttgctggattcaatttcaaaagcaaggaaaaatcttataaatattaaatgccacaaattcatggcaattaaaaaacatataatattatgaattattgcattaaatgaatttatttaatattttattcgctttttcatattaatatttattttattatttggattttctctgcaacaaaccttcgtaattacgagccaatcaatttttcacttagatttttatgaaaatttttggcaaaaaataaaataaattcagtcatagcggggaatcaattttttacggatttttttaaaatcgctcaaacaaacattgtttaattttattataccattcgaaagagaattttgaaactttgctcttattaacacaggttcttctggcaattccgaattcttttacacttcgcgcagcgtctgaattggtcaaaatgcttttggacactgcccaatttggttttaaggtagaaattaattggttttaattgcttgtcgtattataaccttcatagcgcgacttttttcgctaaatactagagttaagcgggaccgggacctgaacacgtacaactgagtacaactgagtaccgaagtcccggttttgaccgggaccgggactattctcggttttcccagccaaaaattcccgattttcaacaacccaaaaggtcccggtcccgggtttgcccaaaattcccggtcccgctcaactctacta

SEQ ID NO: 15689 - DNA, 3379 bp, Heterodera glycines
tcaaaaatggggagaagatggtcgagaataatggtgccttttttgattaaaattggttaatatgttataaattttcaaataaatttttgtccgctatgaaagaactttccgaacaccccaataattagttcaattttaatgacaatgagtagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaacaatgagtctctgcatttttttgcggcgcgctttttcagaaaacttttttgagttacggcggtgcagatcgtgataaaatttgaagcaattgtaacagattttgcccaaaatacttaccaaatttttaagccagtcaaatccttttgcgaattgttgatcatttttatcacatctcaacaatacaaatgtgccagtgtatgtgcgattgtcttctccttattttgtgcttcatttttccagtatgttttttaatggggtaaaagttttttgaagttttcatttgtagccaatcgccgtcttaatgcgccaagggtgcaccatccatttttgcattaacattttgcttacttgtttggcttggattccgggagtgatccacgccatttagtatgttaaataaaaatcgtattatgttggaattgagggttattttttaaatttcattattttacggttaaaataaaatttttgttcagttaaaataacttacgattcaataaaaatttagtgtctgcttctacgcgggtgtcactttgcgtcgctaagtcgaaacaagcgttgaccgcggccgagaaaaagttagacggatttttgatggtttgacatgctttacaattttatttacggtttttcagtgaattttgaataaaatttcaataggagtgtttacgcttgtttagtcgaaccaaaaccaaaaaaccggtacgcccggttagcactcgaccgtaaacaaccctaattttcattataaaaaattctgctgaaaggccggatccctttgaatgaattcgcttatacttactgatgatgatgatcttccataccattctgacacatcccatttttatacgtagacttccatctgatctaaaaaatcctattttccttcgttgcaatgttttgtttaaactcataaatttcaaaaatgctattgcattttaaaacgatacatgattgagaatttcgctgtttacattatacatttgctttttctttttagtaataaatgtttaaggaaatgcccactcgcttaaggcgcttcgcaatttgcgtcggcgttgacgaagaaaatgggacttgtctgatggtttatgagaacgacttaaacgccattgaagtgaggatggtgttttccggtgtgcaaattggcaaatggtaccggttcgacttggcaaaaggcacgagacgaaattgggaggtagcggaggaacgattgccgacgcggattatgccacggggggacgcggggagtggcggaacacgcggggatcgcattcaggtgaaccacggcacaacaaggcaaatgatccgacggattgggtctgccataaaatgtttctaatgctgtttgaaattattctgctacccattggtaattcctttctgtttttagctttgccttcccattttctttgtccccaacttcaaatgttttggctgcacttggcgtgtcacttcaccaacttcttttaatgacaaaatgcacttcaatttcgtttcgcctcgattggaagcgccaggcaaaattaatttcagcgaagaacgactggccgaatggaacatccgtccgggggagcagtgttttgcatttttgacattgtattataaaatttgtttatttaaaaaatggatgccacttttcagggattgccaagggcccgggccgagcataaaaccgccgcaatggacactcgatgcagtggagcattttcacagggtatgatttgtttataaatcagtttttgtgtaacatgttaggatttcaagaggcaacccgtttccatttgcgacatttcgatacacagtgaaaatgcctcctcaaatagataaatttgaaaagcttttcaatatcttagtatccttccttttgagaaatttaaacatgaattaaaaattaaatttttgataaagaatttacggattggatgtcaagataaatgaatttttcaacaatcaaaactcattccctgcaatatcaaatttaattttaaaaagtccttcgattgtttattttcaggtcaatgttgacccattggccctctccgttctgtccgtttccctcggcgcttcgaaagaatggggcattctgctcgatttggtcattgaatctgaggacgaaagaaatggaatgggtttcattctgtgcttacgcgacggaaaattcgcttttggacgaattttaaaaaccgaaggtcacaacgacagctgctggagggcaaatgtgggcgacactgtcggcttctctttgatgttaattttccaattagacatttctccaattttcctttcagtgatgttgattgctttaattaccccgttcggttggctttgaatgttattgcctggcaatccccggcgttcacttctgttgactccgatgttctttccgaccaatttccccaagaatccttgcccgaatttccttcagttcgccttatttctaaaagtactggaaaaatggctcaacatttggtaatttgatctttctgatttgcaaatgataacttttttgttgcttatgagtgtaat

SEQ ID NO: 15690 - DNA, 2739 bp, Heterodera glycines
ataaaaatattttcttatagaaaaaaaatctcctctattcatccatataaattttattgttaaattttaagggaatcatttaggaaaaaacatgctaaaaagttgacgaaaaagggaaaggcgcgttcatttcacaaaattataagtagggctaaatatatttttttgtacatatttcgctattcttgaggattttttaatgaaattttatgggtacatttttgaatataggcaatttttcgtaacaaagtgcactcaaattttcaaattttttttcaaaaaattttcacttgggaaaattcccggttggtcccagtcccggacgaaaatcgaggtcccggtcccgacttttctgatcccggtaagtcccggtcccggtttttgtcaaaattcccggtcccgtgcaactctaataattaccttttttgctaccttgctatagcctaatatgcacgaaaacgagtttttaacttggcttgaagcttttatcttgaactttttggtgcattttttgcctattttttttgaaaaaacggtaaatttttttaaaattttgcaacttttcctaccatattttattacaatttccaaaaaattttccggcggcgcttatcggcaccgccggaccttcattttaccttaatttttgaaattttaaccacaaaatgagtagaatttgtcattttctatctgagaaaaagatcaaaccggaaaatgcagatttttttttttgcatcacaccctcaagctataggtaaaattttttttaaaaaatttcgcttttcgcatttcgctttttcgcatattttggcttttcgcatttcgcttttttttcatttcgcatttttcagtttcgcaaatttcgcttttcgcatttcgctttttatttttcaatttggcccatccctggtgtatagtaaggcaattaaaaaaaaattaaaaatgttcagcaatttttgctgcgttttcaatctttattgtttaaaaatcaaaattcgtttgtatttggcaattgtcacatttatttctgcgttgcatggatgtattgtcagtttgggtttgcttaatagtggaaacttacatggtgacctaatgatcacttgttgcttcattgactttttcatggtgtaatttaaaaaatatataaaaattaacgtgctgagacgaagtacgaaaagtgcaaggttgggcgaagcacgaaaaagtgcaagtcatcaaattaaaatcaaaataattaatttaaaaatgaaatcaaaaataattatgttaattacatttaattgtaacatttattatttaaattccgttacataattaaaatatttttttatattaatgattttatggattgctttgttgattttgacttataaggctaggaagcatggctggacgtaattacggaaattacggcctttttggaccgccgtaatgacggattacggatggccgtaactgaaaaatcgccgtaattacggattacagatttccgtaattgaaaatcagttacatccagccctgctatgaagacttccttaaaaatcaataagaatcattcataaatttttttctacaaagcggatcctgattggtggattttctctctctttttcagaaattagttttgctcttctcgcaaccttgcatacgagattatgttggaaatggtcgtttttcagtttttgaaataaaattagcgcaaaatgtgaaaaattatttgctgtattttatttttaagtaattatccattaattagtatatttttagtgaagcttcggttcaccacgcatataattagtataaaaatatatttccattatgtaacggaatttaaataataaattttgtgattaaatttaattaacataattatttttgcttttcatttttaaattaattttttgattttaatttgatgacttgcactttttcgtgcttcgcccaaccttgcacttttcgtgcttcgtctaagcacggggccaaccgtgacggcccacctgctgattgtgagcgagtccgaaaaccgaaaaatacgctctcgattaatgctatattttaatttatatatatcatatctttctatttattattaattgattaaatatgttctgtctttattaattgcctcgtcagatatgtaatataacgaagtgaacacattgattggataatacagttgttgcaaaattgggtcgtaatttgtacatattgtcaacagagtgtaccatggcataatggtgacttgaccaagtaacgcatgacatacggcatggatttggacagcaatgcatagcacagtgattcgcgcactttccttgtccaaaggattttgtgccggcgccgcttctgtgccggcattattccaacggcgcttttgtgcttaaaattttcaaattttgctggttactctttcttatttataaatatggagaagttttttatttccaaaaatttgaaatatttaaatatgagaaaattatagcaaaaattcattgctttcaataaagacctggacctagatttttttcacattttatctggaactgatttcctggacacaaacccaggaaaatcctgcaaagaaaaatccaggttgtctaaaaatggcctgggcctggacctggatccaggaaaaatccaggcctggacccaggtccagtctgagctctagtttatataagatatctttgtggtgatgtatttttgcttcttcaaaaaaaggtgacaaaaaaaataaaa

SEQ ID NO: 15691 - DNA, 1072 bp, Heterodera glycines
  misc_feature (43)..(43): n is a, c, g, or t
  misc_feature (60)..(62): n is a, c, g, or t
  misc_feature (83)..(83): n is a, c, g, or t
  misc_feature (116)..(116): n is a, c, g, or t
gtagaaaattaacgacaaaaattccaaaattacgaatttttanattttaaaaaatgaatnnntagggtccttgctgaattacnagggttatcgtcttaccaagaaaacatggcatntatcaagttcttggtttctgtagccatgaaatacacccttttttcattttcatgttttctgtttattcacgttataatatttggattcattcaaaaaattttaaatttttagaaaatattttaaattattatttttaatttaggggtcaaaatgttgcaaatctgtttcataaaaaataatgaaaaaaagtttaatacaaattttatgccccatttgaaactttttcatcatttgacctattttttacaagtttgggcaattgtttgataatgattaattaattagttaactaattacattttctattacaaaaatttggccaaaaaaaaatgaaaaatatgccaatgcttgtcgcggtgcttttgctggccaccctcatcaccatgaacatgttgatgttgaccaatggcttatgcgaatacaaccacacccttggatggtgccaaaatgatggagattgcctgaaaaactgtgcgcccgtggcggaaaatgaatgcgactgcgtttcggtactttcaaaaaaattatacaatatttaatatatatatatatatatatatatattaaagtgaaattttgaaaaaattagcgggcatgacttgagaattttcaaaagaataatacttgtggactacggtgcctggcgatttaaaaaatatactgtatctcccagatattagggacatttggttttgactcaagtaaaaaaaacaagcaaggttagacggtgctaatttgggggtcagggaattaggaaaagcaaggttactccgtgccgatttatgagtcagggacttttttaaattcaaatgctctaaaattaaagaataataatctcctttaaagcgcataagaatcgacttgattatctgttcataaaaccttggaaatataaaaatggtttttcataatgtaaaaattaaaaaaaaatccaacttaattattgcgcaacaaa

SEQ ID NO: 15692 - DNA, 3210 bp, Heterodera glycines
  misc_feature (868)..(868): n is a, c, g, or t
  misc_feature (3168)..(3168): n is a, c, g, or t
tttcgagtaattcccgtccctaattatcgggtcgggcttttttggcgcggcatattttggcgccgcaattttaaagtttatataatattttttttatgcaatcgaataaaacaatctcttgatatcaatggataaatctaaatattctctattagaaagagtaatttaaaaaaaaatcttgtgttcaaaaaacgatatggcatgcggcactaaattggcaaatattttcctagagtggtacttcttgatcacttataaaaaaattaaatgaaaatgacaccatcaagtccgaattaatatgcaaaatgtcaaaagaaagttcaagaacgaatctgagaagaacgcatattcagcaatggcacaacaacatttgatccgtattgatttctacaaagatatttgcaaaatgctttgcggtattcagtgctaaaatatgaaaatttactatttttagaaattaaaattaattgattaattaaaatcacctgcacatgaaaagcactggagtacagctggaatatgccatcaaaaagagaccattaatgtattcaaatgttaaaaggttcaagccgagcaatggaagtatgccattaaagaacacagaagtcttaaatgggaactgaattagtgaccaaagcaccccaaattttttttatagcttctgctcaaaaagacaaaagaacacaaaaaaataaatccaattttcaacctattcaggtttaaattcttaattttttaaatggattttcataaatgaaatttttgataaattattaaattaggggttttcattaacaaaatatctttacaaaaaattttaaaaaaattgacgcaagttgattttgcgatccccaattctttgatggcngttttgtttctgaagtcctccgtccacatgtatattagtgtccacatctgaagaacatttaaaatgctgttgtggaaaaaactttcatcacgaatggatttgttgaccgaacaatctgatcaattccactaaaggctaaatttaaaaaatctaaaaattgtgttttaccaaaaaaccatcctttttgttggttctttttcataatgacattttgttaaaattatgccaaaaatttatttaatattttatttgaactaaaattgacataattagaattcctcaaacttttcccaatgctttgagctgccataataaaaattaacgttgacaaacacagctttggcacaacaaagggcaataaaaaattttgaaaagtttgaggcggccaccaattttatatctaatcaaattaaaaagcaataatggctgacaccaaagtgggcggttccgatcactgataaaaaatattaaatgaaatgacatcatcgagtccgaattaatacgcaaaatgtaaaaacaaagttcaagcagaaatgccagaacaacgtatattttgcaatggcacaacgacatttgattcatgttctgttctgcaaacatatttgcaaaatccttctcgatattttttgctaaaatatacaaaatcaattaatttttcctgtcattaattaattaattataaacacctgcacagaaaaagcaccggagtacagctggaaaatgccaccaaaccgagaccattactaatgggccaaacaatgtgttcaattgttaaagtgtccaagctgagcaatggcattatgcaataaaagaacacagtattcttaaatgggaactgtaatgtacagtaattgtgaataagtttattattaaattagggtttttcattagcaaacataatcataatgaaaataataatattattactccaatatagcagatgagaccgattgacataataaaactcagcgaaatgattaaacgtctgttattttctgattctaaattaagaatttcgattactctaattaattatcaaatttcatcaacccgcaaatgactgtccgtggtgttgtccattacgaaaataattgaccagccaaatcaatgcataacatgtgaattcagcacaatatgttattaaagttaatatattcgacattgaattagtctctggctggtgtgccggatcaccaattgagcacatcactggtcttaattaggggcataaaatttatcttaaattataatgaccttaattaagataccaaaatttatttttaatttaattaaaattcaggggcaatttatatatttaatagacctcaatattagggaaattaattttaaaattatattcaaaaatcatttttaatttttcttctttctccaaaatgtttctcttatctctctctctctctttctctctcacttctctctctctccactctctctctctctctctcactccctctttatttctcactatttatctcctccagcattgcaactctgacaatttctctcactttactttattcatctcttgcgctttatgtctttgtatctttccatcgcttttttctctctttctatctgtctcttttcttctctatcacatgctctcttcctcgttccgtttttctttgtctctctctctctctttcgctctcactcttactctgtctcgctttctctctatctctctcttcttcccactggcatgctttcttttactctcataatctctcttagtttctctctctctctcactcttagtcttacgctttctctgtgtgtgtgtgtgtgtgtctcttttattttaacaccttacttatttttaagaaaggtcttaaatagaaatttattttaattgtttttttattaaaatttgggggcaatttgcaaagccgtttattttgaattttattaataactaaagggagaacccttttgaaattaaaaaaaaaaattcataatctgaaaacatagggctttagttgtctttaaccgcgaatgtaaaacacctattttaaacaattccgactactttacttaaatttgaaaaaaaacctaaatcgaaaaatttgaattttcggcttaagttcgtgttcggcttagggattagaaatttgtcaaactagattcagacccttaattaagaaaattcaaggtatacggtaataaaaatttaaaatacaaaaataaattaataaaattcaaaatgtacggtaataaaattcaaaataagcggtaatgaaattcgagatatacgaatttgcaagacgagccaaatttanatatttaatttcacacaaactttccccaatgctttgagctgc

SEQ ID NO: 15693 - DNA, 1418 bp, Heterodera glycines
  misc_feature (33)..(33): n is a, c, g, or t
attcaaatttcgagattttgagtcaaaatatgnaaactttgattgagtattgatggaaaccctgccaaaaaagtacgaaacggagagaaatagtttttgttacagcaatccaaattaggaggcatcaacaaagcgaatgcttttagtcgcaataattagcgtagtttaaatagcctatgacttttcgttaattaacaaaaattaataaaaaataaaaacaaattaatttatcgctataataagcctaaattggcacaactaagcaatgctatatcagagcacatttgtatcagaagccgaacaataattatcaattaacaccagttactaagcagaccataatttttccgcgtcttttgaatgatgaaatcattttcgggatagcaatttgctgtgaagccaattttgtaaaaaactgttttttaatcatttaaatagggtaggtccccgaccattcgtagtgagacaagtctgggtcgagatttttgggggtccgctaggtggtggtttgggatagtgatgctcgagagtctcggtctcgagtctcgactcgagaaaagtctcgggtttttttggtctcggtctcgagtctcggtctcgggttttcaagtctcggtctcgattttcgagactcgagaccgagactttttacaccccgaatgattgttggcctttggtaaacttctatttttataaattttaggttcttttttgttaaagtttgttaatatatgcgtggtccagcgggttgtgttcttggttttgttccttatttttgcgttggatcacttcccctccaagtattattttttcttctcatttttcaaaattaatgtttttttcgatgggagttcaaacacaattttaacaattaaaatcgtaaaaatgtcatttttggactaaatctattaacaaagtgcactaaaaatttcaaaattttctccggcggcgcctaacggcaccgacggcacccaaaactcttacttttattttaaaaaagtagctcaaagacgcaaaatttggtcattttttggacaaaatccgttaacaaattgcagtaaaattttaaaaaattttcccggcggcgcctatcggcaccgccggacccctgttaccgaaaattttttttgaaaaagagcaccacaaaaaatggtgtaaaaaagtcaatcatatgaaaaggaaaaatgtatggtagcttaaataaggaaaaaaacaaaaatttttgagaaaactcaaaagattgatttttttcgatttttaagtgtgtaagaaaaaatttttgaaaaaagtctcgggtctcgggtttttttggtctcggtctcggggttttgggtctcggtctcgagtctcggggtcgagtctcggtctcggtctcgagtctcgagtctcgggaaatttttggtctcgagcatcactac

SEQ ID NO: 15694 - DNA, 3315 bp, Heterodera glycines
  misc_feature (3180)..(3180): n is a, c, g, or t
ttgaggagagggggtccggcggtaccgacaggcgccgccggaaaaatttttataatttcgttctgatttattaccagattttcaccaaaaaggccaatttttgccacaaatcttatattttctttataagatagttacattatgcgaattcaaaattttaatgttaaaggaatcagacaaaattggggcactacctccaaatcaggaccttttcattttatcattatttggacccttcggtggcagatgattccgccagtgagtgattcctatatatttaaccgaattaaacttaatatcatgagtttatttacgcacaaatatttggaataacttttgttaaaattattacatagtttaaagtgcgatgtattttgaatgatttttcttaattttttataaatacagcattattgtaatataatcccggggcgtgtatatttcaattccctcttccctccaaaatatttgtattttaggggagtctttaccaattggctattgtattgggactgggtcgttttggcgccgacgttttggcgccagcctcagtttttttattataactttttttcttgttgaccaaatctaacaatcttggtatcattcgaaagcccttcacaagctctattagccttacaaaaaacaaacaaaaattttagcttctaaaaaagttattaagaaaaaaactcaaaaatttcgacttttttggaatttcatgttaacttttttggtaattgtctaatcgcgaagcaatagcttagaaatatcttctaaacatgttaagctttcgattgataccaagatgctggatttggttatcaacaaaaaaagttataacccaaaaacttgggctggcgccaaaacgtcggcgccaaaacgatacggaccctgccgcggaaccttcaaaaaaaaaattaaaattgaaaagtgttggcgttccgtttccgaacattaatttaaatttatttttcccttttttcaaaaatttgtgcatttttttttctgcgcgtgcaattgtgccgcgtgttttttgaccaccaatttcagttggcgaccaaagaggccgacccgcgggccggcgacgttgccacagttttctgcgacccgtcgttggccaacgcgtgcctcggctggcatgcccagctcggcattgacgacatgtgccgggatgcgtggaattggatcagcaacaacccggacggattccgaggggcggcggcgagcaaatgattttttaggggaggggggcaattcgtgccaattacgttttttttattttttttactgggtttgcgagggcaccacagaacgatggatggcacatatagaaccgcacaggatgttcgagggtgtccgatgccgaccggttttccggggattagtaccacggcaaagggaatgatgattagttttcggcattttgcatgttggcaccgtacatcctcgcccggggccgtccatcagcgatagaatttattattacttaagcaattgtttttcacatttttacatttgcggttattccattcactttttctttgctcttttccccaacttttttcattttgttaatttattttttaatttttgttattttgttccttgttggtgtgttttattcgattacatatataattttgttcattttaatatgttagggatttgttttactttttttcttttcttttgttggaaaatttcacaattttatttgaaaatattaaataaattatataaagaatagatttaaaaacgattagcagataatcgctcacttaaatgtcattgattttgtaagaataccatgccctagggggtacaaatcagggatagtaccgcaagtcaagaaaaactcccggaactcgggattccggcgccaaaagtggtattgcggtccaatcctttgtacaaattcaaaaaaaaaatcgattaatgcaattggtgccgtttttgccttcattcctcctccttcttctcctcattcgcataatcttcttcttctgctgttgcttctgtcactgtttttgccacttcatcgtcgttggcaccgttttgcccctcctccgtttcgtttttgccacgagtgtcgtcgtctttgtcggtttggcattggcgtgggcgtcgtcgaaatgcgaacacccggtacatggtcagcacttgccattccgatgttgatagggttccctgaacaatgaacggggtcaataaaagggaaaacagctcgtttccccacgcctcgaaaaacctctaaaaccttttttttaaaaagtgaaaaatttttaattttctaaaaggaaaatttctgaactttggctaactttctttataaattccataaaaaatctaaaaatcgatttatatgatggcttgacccattcgctcgcaaaaggtttggtaactccgccccccgttttcagatatgttgattttagatcaaaaatgaacgagttttataaatggcattgaaaatccatgtatgaaggcatttcattgtgtatcacaaaacgttgcaaatcacacgtggcaaaatcaaaacggaatgccactaccggtgggtagccaacattggtcaatgatcacccaccactgttgtttccacgggtctctgctgtcgctggtgccattgtctctgctgctgttggttgtgtggtctcccccaccccgttggtccctcatttcttccgcttccgtctttgtcattggcactgtcgccctccccgtcggttgttggtgtgccgctgctctttctcagccgtgccaatgccgcgccgtactcgcgctgtgccgcttcgacgccgcccttctccgtctccaagcgtcgcgcgtccaccaccgtctccagcgcgttcatgctctccatgagttggcgcgcctcgcgcccgcgctgcgccatgaaatggccaatggcgtccgggaagcttttgctgtacaccaactctaggcccatctcgtggagcatcctgaaacaaatcgagcttaggggaatgggcaccgaaaaattcatttaaaaacgactccaaatcgaaatccaacattttctaatttttctacaaaataactaaattcaaacaaaaatcttttaaaattttttctttcataccccaaaataccccaaaaaattttttttcaaaaacctcaataaaactttaaataaaatctaacaaataaaatattacntccatcttttctccttctcccatttctcctccaatcattttttctaactcccatttttattaaaattttttcaaattaaattaaacaattcaaaacaaactcactctttaatcattaaaaaataacacaaatact

SEQ ID NO: 15695 - DNA, 1039 bp, Heterodera glycines
ccatggaaacgaaaaaggaaatgacagaaaaaaggaggcgagagagaagagattggcaaaaagaaatgaatgattctgagaagaggggggggggggggcaattaaagggagggttaattattaattacggcactaatttgggatgggattcgttgaaaaagcacgagggaatttaatggaaaggagcgaataaaatgaaaaaaaaaagttaaatgccaaaagaaatatttgggccaaacatcaaataaaattaaaaagttaaaagggatatcgttctcgttttggggttcatcataagaaagaagtgatgggagaaactaataaaattatttcaatctttttacaaaattttcgtaatttaaatttcgcagataaatcatttggttatatttataaattatcaattttattattaaatatttttaaatatcccaaggtcactaaaatgcaatcaaaacccgttaaaatgtgccgggggggggtaaagcgtaaaaagaaagtgccgtcgtctcccaatcgcttttcgtcttccattctttgcccttccatttgaatttcccaatcatttcaaagtgttcctaaatgtaagcttattttccaattgtcatttccccttacatttgtcctgtaaagaatttaatatcactttggacaatcgttttgttttcctccagcggcccaaggattagccgtgccgtgccacgccgagaagggaagggattagccgaagtcggcattccctcctccccttttggccctttccttgcgccgtgtttatatttatacactcaccggcacagtcagtcactaattaagtgattgtcgcatcatcagcagtgcctacgtaagaatggcctaatttggccatgacaattggctgctgacatttggctttaattcgcaaaaatcggcgtacaaaacgccgaaattggcggcaaagtgagaaaggcattttgcagcagtttcagtttcaatttgcattaaaagcttgattgtgatatttttgttaatccgatttgtcggatgaaatgtccgtctc

SEQ ID NO: 15696 - DNA, 3233 bp, Heterodera glycines
tcttaattcattccacgcttccctgagctggtcattcatcttttccctcctccgtcttcaatcgctaaatccaatccgactcatttcggccccattttcacatttggcactttcaattattccccacttatttcattatctcaatttgcttcctcatagactgaccaaaccaaaaaatgctgaatccctccggtgctccaccagcattgagtccgctcgtttttccgcccgcgcaaaatcagcagcaggacacgacggcgttcgagcagttggccaacttgcagtacagcttcgcctcgctgctctcctcctaccaatcccaactccatttggaggaaccgctaaccgccgcactttcgcacgactcttcgcagtgtccccaggcgaccagcagctctatgtcaatggcacccctttcgtcttcggcaaatttggccggcacgaaaaacttctcatcgtgtcgacggagcagaacaacattcaacaatgagcaggtgggcgaattgctcgatgataagcactgatcagtccatcagatcaataagttggaggcggtgttcgtcggcacccaatacccggatgtgtgcctcagggaacagttggcaacgcaaaccgggctgagcgaggcgcggattcaggtgccaagggggggggcaatttggccactctttgtttaccatcccaccttcgcggcttaggtgtggttccaaaacaggagggccaaggcgcgcaagtcgatgaagcgatgctcggcccttccccccagcacttcgctgccttcgctgtgcgccaaccccaactttctgtgtccgcccgaaatgactttggacgtgttccgtcgctgctccctctcctcctcctgctcgtccacctccaacaacgagtcgagcccccaactgtcgcctttgccaaccccgcaaaagccaagcaaatgccccaacagtttcttcatcgagaatctgatcgagaaccaaaatggaagcggataaaaccgagtgaatggatgccaaattgtgcggtgaatatcctgaacaatcccataaatgcaatgaatttgtaattaatgaaaaataatcagccaattcctctcaatatttattgactctaacaatgattagttcaataaatgcttgattaattatgcaatttaatgtcaaatgaggtcattcttccgctcgttctttttaaagttcgtcattccctttggcattttttgtctccgcttttccatttccgtttttcctttccccgggcaacaattccatcgccgcgttgggaaaagcgagaaaagagacggaccgatgcctttgctcatctccaaaatgccgttgtcgcaccacaaaagcactgaaagtcgagacgcaatttgctatgaaatggtccgccattccaagcagtgccaaatccatcggcacattcgctcctccggcacttcttacggtgacgggccaacgcacagatttggccaaatgggcgccgatttgggccaagcgatggtcgcgatcactggcgacgaaaactgcggacgcggagagacggacgacgtgaaaacggacctgagaagggccaatgtgcaaatggaagaatgtgtttcgaggcttccccaaacgaaagacctcctccaaaatgatgtccatcgacgggtcgcatgcgtccgccgtcaatggcccattctcttcttccggccccgtgcattggccactggcaaacagttgtcgttttcccattacattttcttcccggagaaattggcacacattttcctgtcattccaaatgcgattttgatcataaaatgccaaactgacccaatctctgccatttctcaaatgaatgccaacgaatgcctttccgtggccaaagttgcgggaggcaaattcaatcgctttttgcttaattcgatcattccactggccgaatcgctggatgaaacggtggtcggggcggacgggaaaagcggcgggggcagaagaaaaagcgaggacaggcgaagaatgggcggggaatttaaaatgggacaatggaaattaaaatgaaaccactaaaaaagaaggggttaaaacgattcatcggcattttgccgaaagtcgtaagacccaccaatcgccgcccccccacgtgggactgaattggccgagactcactccgtcgcccatttttctctgattgtctccctttgcgtgtcgaatccgcccgtcttcaccccaaaatattcttcgcccacaaaatgtgtgcctgcgtaacgccaaaagggaccgaacggattcccttcggtggcatgacagcccaaaagggaggcattggcaaggccagggcgaggggaccaacagaacactgaagggggggggggggtaattaaaaagtgccgatttggaaaaaatgcatttgagtggcataaaccaaagcggagatttttgcgcttttaactcatttgtgttttttatttaatttgagaaaaaaaacaaatttcggctttttttggactaacaatttgcaatcaattttttcaaatttcatcttacaattttcttatggccaataaatttttttaaatttcgaaatcgcagcactgacataaacaatgttaaaatatttgttttttttctcatttctcagcacctcttcgtttttccattggccaaatttttggagcgattccatgcgaaaagtcgcggagcgaaacaattcggtgaaattgggccaatggcggcacgaggaaaaattggtcgaattcgatcattcccttcagttttattaattttcaaaatgaaatatgtaaaatgcccaccgcctcttcagcgcccgggggataatttataatgggaggcaaaaccaaagtccgattcagcgatttagcaaaggcaaacgcacccaaaaactgttccatttggttgccaaaacgcccttaattaaaaaatgaaaagctgcgactttggcacggcacgaacccatgcaaggacaaaagagaacgaaggcatcggaggagggaaagggcagcgaaaagagggaaagagcgaagagatggcaaaacaaacgcatggaaagaaagagcaacaaaaggggggggggacttttgagactcgacaatttgaatggttacataaaaaatgaaatggaaaatcggaatttaagtcggaccattggcaagggaaaatttttttaaaagaaaaaaatgtaaatttattatactaacaaataagaaaagtcaaaatacaacgagaacaatgagcaaaa

SEQ ID NO: 15697 - DNA, 1185 bp, Heterodera glycines
atttaattgttttatttgttatttaataaagggtattttattttattttttggttttaccaagtatttgaattttaaaaatttttgcttggcgcccaaacgagctggcgcccaaacgattgcgcccaaacgtgagcgcccaaacgggtgggtcccaaaagtcgcgatattacaaatcagctcgccagctgttgattttaaaaaaactgaaactttggcctcaaaacggaaaagtaccctttttattagtgtcgccctgaaaaaatgatggaccatgcgaactgttggttcggggtgagggacactatagtctggacagtatagtctgagccaagtttagagtatcataacttttttctcagcgagccaaattttataatctaggcatcattctatagcactatatgtttagtcgatggcaaagagaatggcgaatttttctcctccttctgacaacactgccccaaaaaaatttctgtccgaccttgaccaactacaaatccccaaagaaatcgactcagacaactccattcccgactacgccaagttgcttatcaagcagcttcattcccttttaagcaccgcctccgtcctaattcattcacaggctgcggctgtcgacgcggtcgaggaggaacgacgactgagaactgtcgttgtgacaaatgtgcccgaaagcatatcggacaaagcggcggagagagcccgggaggaccgtgccgttgtggacgaaattttgaatgccacggacgtcgaccaggcaccaattgtcttccgcgtcggcaaacgaatggatggacgaccgcgcccgctcaaaatggaattcccgaccaaacatgcagcgcgacacgtcatccgcatgcgcggaaaggtgcaggcattgaatggtctccataatgtccgcgtccgcgagagcatgaccaaggaacaactgtcggagcggcgaaaattgattgaggattgtgcgaagaaaaggcagacggacagcggtgattgggtgatttatgccaatcaggttgtgctgagacaggacattgaccatattcgaaaaaattttttttattatttttttatttttttggcggcgatctcgtttttaattgttttgcgctttcttgaggacatttttttaaattaatgttttgtcctcaatgtaagcggatttttcccttttgtggactttttc

SEQ ID NO: 15698 - DNA, 1722 bp, Heterodera glycines
ttgtgatcattttgagggaggtgaatgttattaatttcttcctcagggtggacgagtcggagaatccgtgcgtcggcttcgtgatacaatgaagtgatcatcttagacttctcggcgaaagcaggatcattgttgtaagcctaaactactaagaaaaaaatttatcatctgaaaaattcaattgacatgtgtgaggccaaggattctgatctgcctcttcatgttgcggacaaggtgaaaaaaacagtagcggacactgcatgccggaagcactgtgcggaccgcaccgaccattgccaactcgaagtccattgaaattgtctgcggcgcgaaattcggccatcgttccaaaagaagctgtaacatgcgcgtataaattgcggcacacttcgatgttaaaagacagtagcaaattggaaatacccaaccatctctcctaaaaagattgaacattgtgataacacaattaactttactttgccaacaacacataaatttggctgaaaagcggtggcgtcaatgaaaacgtgccgtccgcgtaaatgtcactcatctgatgggcccaatccgccgtagaagctcttccaaaaatgagaatccttaataccggttcaatgatcagcatttaatgtataaatgatgtctcaccgttgaggtccattttgtccttgaatttgaaaaacgccggtgtcgccaatagaaattgttccaatttcagttcgcttgtaaatacgataggtatttggaatttccaactgctccaaattgagaggttcggtccgcggtgcattttcatcacggcgcaatcgtttgattacctaaaaacaaaaaaataacaaaattgtttttggatataaacccacttttttgtggcgcttttgctcggaaaagctgctagcacaggtgtgcatgtgttttgcagcacttgagcacgaattgtcgcaggtgcctcgcacgtctcagcagcacgtcgcttgagtccagttacaagtcgctgacattccacatgcgcagcattcatgtcgcacgaatgaactccgaccaacttctgcacaacgttatttaaatccgtgtgcaaacggcctgaattttaaaagatttgcatcaaaataatatattaacatacccttgcatttgtctgacgggccatgaaactcacatcgccaaaatttcttaagtccatctgcgctcaattggtcgaaaacatagagtgcgccgtcatgttctaacttaactttgtccctgatctcatgtcgctgtccagtgggccttggactcaaaaatcgaactttcttggttgttctttttgatcgtcgcagttccggtgtttgttcttctgtttcttgttgttggtccctctgatcagtccgttcttgtggttgcattcgatgatcgggtgatggtgtgttttgcttgtgtccttgtggcgatcggactggtgaatgaactggtgccggaagatattgttgaagcggtctgatcacttcgtcgtttgaccactcatgatcagtgccagtcgctgccgatagcctcactgcgtttgcttgacgtgtgatgatcttatgtgctaattgtggggattgaattttaagaattaatccattctttgccacaattttgccaaaaagccaaactgttttaccgttttggtaattaacaaactgtacttgatcgcctattttgaactcaatcctttttgctcccatgttttctgttaaactg

SEQ ID NO: 15699 - DNA, 3962 bp, Heterodera glycines
aaaattgaagtttttgtgttttgctacctaaaagcgttaataaaattttgtttgcccattttaatgcctatttgaggatttttgtgcccatttaatgcctattttgcgattttttatgcctatttaggtgcctatttcgcgattttttgtgcctaaaaaatgaagccctactcataataaataaataaaaaaattttactaaattgaacaaataaaaaatccctaaatttgaaaacgtttatgtccatatttcgcgattttcgatccatattttatggtcatattacgaattatatccatataaaattacaagccctacatcatgaataaaagaagtccagcgtattctttttgattggaaaatatgagatttatacacgtacatacatataagtgggggaattctccacctacaaatgttatttaatttattactaatcactagggatgggaattttatgcaaatgcatatttttttcctggcttctacatgctctaaatagtaggaaaaaccctttcttttttgtgtttgcgtataaaaatcggacttttatttgcatatttttgcatatttcgagatttttgtgcatatttgcatattttggctttttgtacatatttcgccattttttggaaaatttgttaacaaaaatgcaataaaaacggaaaatacacccctaagaatcgaccgaaaatttttaaaaacacaccactaagaattggaaattttctcaaaaattcttcccccaaatttttttttcatgagaaaatttttgatttaaaaaatgtcaatatttgctaaagagaattttataaaagaaatgtagaagcgcattggcaagtgcattagtaaaaaatttttttttattgaatttgcacccctaattttcaattttttagtgcatattttacgatttttgtgcatatttggtgcatatttcacgactttatttgcatatttaccgtatttcctcgattataagccccggggcttctattgttcaacccccctccaaagggggcttatattcgaggggggggggggcttcccgtataatcgaggaaatacggtatgtgcatattttggccacttttcgtgcatattttttgcatccctgcaaataagggtctggtgtgagttaagtcatactgaaatgtcagtactgaaatgactgatctcagaagaaggtgatttttctcatttctcttccttctttcgttttattcgccatcgccacgttcacgtttaaaaatgtttctacaatgttaccaaccagcatctaaaacattttaaagaaactttgtttttttaatattttctagagagtacataaaatctcaatgccattgcgtttggatgtaaaacggcgattgctggcgagatccgatcgcgttaaatcggtggatttacatctcaatgagccttggatgttgatttcactttacaatggctttgtgcacatatggaattatgactcacaacagctcatcaagtcatttgaggttgtcaaaattgttctttttctacaatattttgatagagccttacaatttcaaggtttgtgatctgcccgtgcgtgctgcaaaattcattgtgcgcaaaaattggatcgccactggttctgatgacatgcagttgcgcattttcaattataacacgttggaacgtgtacatcaaatggtttggttcataaacttaggctaaataagaaaatttacaggaagcgcattccgattatctccgatcccttgccgttcacccaacccaaccatttttgctgacttcatccgacgacatgctgatcaaactatgggattgggaagacaaatggaagctgaagcaaacatttgaaggttcgaactggtttttgtcgaccatgggctataaccaaatttctaccgaattttttaacaaattttgtcaaaaactgcaactccgttcatgattatccgaattgagtgattttgctttcgacggccccgagtattctcaatttccggtgcaaaattttattaattttaaaaagattatgaacaaaaatgtttggaaaaccagtttataatacaacgaaatttttgaaatttcagtaaaataaatattttatgatatttaaattataaagccaaaaactggctcgggccccaggtgaccaagtactgcctgtaggcgccgtctgggaaaaacgaaagttactaaaaaaactatttttctccatgacatttacaattggatttttgggaaattacaattaattaaaaataccaaggcttttaataaacatttcttattttcttgcataaaggttttctcaatgctttttaaatttatcatcttaaggacacacacattacgtgatgcaattggtgataaatccaaaagacaacaatacctttgccactgcatctctggacaaaacaatcaaagtttggcagttcggaagctcagtgcccaattttacgcttgagggtcatgaaaaaggggtcagtccatggatcccactatcattcgaactttgggtaatggtttatcgaaataggtcaattgcgtcgattattatcacggaggtgagaagccctacttaatttcgggtgcggacgaccggctaatcaaaatttgggactaccaaaacaaaacttgtgttgtcacgttggatggtcattcccacaacgtgtccgccgtgtgtttccaccccgaattgcccattatcatcaccgggtccgaggattcgaccgtgcgcatttggcatgtgaacacaaacaggtgaattcatgtccatatatgaactttctttttgatttttatacgattattttcgtttggtcccatggcttagtcagaattccctaaaatttgcttcctttcttccatgggtttgaatccgcttcatgtcctgataatttacactgattatttggcttatgattataaaaaatgctgttcacgtactgaacaattatgtcgaccatttacaaaatgaagccataaatctataaatcccaaattgcttttcaattttccttttttggaaattgtttttcttttccgacagacttgaaacaacgctcaattatggtttggagcgtgtttggtgtgtcatggcccagcgcggctccaacacattggcaattggctacgacgaaggctcagttgtcatcgcacttggtcgagaggaaccggccgtatcaatggatcccagtggcaaagtgatttgggcacggcacagcgaaatacaactggcaaacttgaaaaccatcgaagagcagacgcttgaaaacattcagggtaatactgaattttatttatttcattctaattcatttaagacggggagcgattgtcattggctatcaaagacatgggatccacggaaatatatccgcaaaaagtgcagcactcaccaaacggacgctttgtcgttgtatgtggtgatggcgagtacattatctacaccgcaaccgcattgcggaacaaagttggtttcggtgccgaacattattggacaaaggggggaaggtcaattttcattttcgcacagtaatggaggcaatacgaagagagtatttttattcgtgcgataattttgacttcttaaataagggcggtgaggagaggaggggtatttcgcaaagaccaaacactctctgatcagtctttgatcctctcccataataacactgctttcagtcctttgggtcgagtttcgattttgcatgggcaaacgatgccaacttttacgctgtccaggagaattcgcagctgatcaaattgttcaagaatttcacggttcgatattacggcttacttttttttctagaaaagtaacatttaggaacttctccaaatccgacccgatgtgatggttgagggcattggcggtggtcatttgctcgctgcgcgctctgccggttctcagagattttacgattggagcactggacatttgatacgccgtatgactcta

SEQ ID NO: 15700 - DNA, 4048 bp, Heterodera glycines
tggcttcttaacattgtttttgtgtgatttaaccgtccattaacaataagagtcgagttttttaggaaagaaacatgggaaccattgggtttatacctggagaatttagaagagagaggggggtgttaacagatttttaaaggggatgcgatggtactcgaggatcctttttttgcagcgaaaaatgcatccataatgatgggctcaagaactaagaaagaatgatttggcgtaaaaaatcttaaaaatagtgcgaaatttccaatcccccccccctcatatggcggcgtttatctgcacggccggaccccttctgttcgcccaaggttttttgaaaaaagcgtcacaaaaatgaagtagaaagcgaataaaggccgtcgccaggggacttccccaagccgaacccacgcccccctccccattcttgaattaaaaaataattttgttccaacaataaaaatggtacatcttgattatcttcattgatttgatgaaccatattctaaaggactgatttattcaatctatatcacaaatttttgctttttttatatgctgtacaaatccctcctacagtataaaaaggcaaaatcgtttgttgctgttttcaggaaagcaaacttgaaggacctttcaacttttccgcagtgccattgcatgggaacttcaaagatgttgaggcaaaagtgaacgttacaaatcacattaaaccggtgtggatttgcagcattaacacgcacaaaaagacgttggcttacaggtatttgttattaaatcagaaaggtattttccattgctaaagccaggctttgtttttcctttccaacggatatatgtctaacgcttaagcagcttttcgatattttagtaacacttttaatgccaataattgtgataattacatgaacaaaaattaagacttttttcgaggtgctgatcacgaatatgacatcgactgcgaccaatttcgaacccggaccggaattcggaaataatgtcaaaaaatcaaattttatgaattttgactttgtcgagttcgggtccagggtacgaaattggtcgaaagaaacggtcatattcgtgatcagagaccagaaaaatcatcctgaaattttttaaactatattttaagcacatttattagcattttaaaattgattaaatttgtatcctaaactagaaaaaatgttcctgcatattttgttactactgtttttgtatttatttgataaccaacaacacaatttcagttacgaagttccgttccaaaatgcatccaagctgatcatggacaaactcatgcggtggtaccacagcgaaaaccacgacaaacagttttcgcttgttccgcttccatttcaaaatgttggacggatgagagaagcgctgaacaaagagttggatgcgaactacgacggttgtcgggatttcgtaggtataaatattatcgttgtgctctttaattgagttatttttaaatttaattgttgttccattactatgagcaaaaaattaaggaaaacataattgttaaggataccttttttagcagtggcaacattgacttcgggatgggggctgaattcaaaaagtcgatttttaggagtgtattttcattttcagaaatgtagaattaggagggtgtgttttgcagatttgttttttcgccataaaaatgaatttttttttttcattttgggggtacggcggtgccggcggaaattttaatgcatttgattaagaaatcttttgctctttgaaagtttacacggccataaaaatttacgcaaccattaaaaatagcaaggtcatttaagctttcaaaaacttatggagggaacattcaaaaaattaatttttttattcatagagctacgcctattacaattagcatggacaaatcctcaaataaatgcccatttccctttctaatttaacgcgttgtttaggcggtgttcatttcttcaaagtgaacacctccaaactgacagctgcgctgcactataccattctgatgccaagcaacaacgaacaatccaggtaaaaaagctttgtctttgtcctgttgtgcaagtgggtagccagtcccttggctttgggtgggggagggctgaattcaaaaattcgattttggggatgtatttttgaaaatttggcctgcgatttgttaagagttgcttaaaatattctaaaaatttaaccaatttcttgaaaatttttactttttttgggtttaaggcggggaaagccccctccccccccatggtacgcccttgtgctgacgcaaattatttgaaatttaacagacaaaacagttggtacatgcaactcattaaccaattctggcgcgatgatagcagcaaaaaacagtttaaaaactaccaaattcccggatctccgccctattggtcaagcggtttcctgtcgcttcagtacgcaatcgaaaaggcgttcatcgaattggtccgtatcaatatatatatttatataatattttttaatggacttattgttaattttgtgtattttttacattgtgctcaattaaaaaaatatatagagatttcacttttttacgtgcttttaaggccaatggtgacgatgctttggcaaatgtttcgctccgtctccaccgtttgcccattccgtcgtacatgaacaagcaaatggccaccataacggtgcccccttttctgaccacgcttttgtttgtgtgcgccttttccatgctgaaggacattgcggtggaaagggagtccggcattatggtaatttaaatgggataacacatatcttcagaaaatacaaaaaaaaaaaattgatgaaaccatacattaaatcggtggtcggcccggtcgtttacgaacgaatgttagaggtgggggggggtttaattgtgcgaaggagtccttgccatgtagatcgacgagcttttcataattttttttacgattttagtcaaaaaaaatttttttttttttttggctagttgcaagactgaaaacttcttattattataaataattaacaataatgattgcgttttttaaggcttacatgtctgtcatgggcttgaatcagttcgctttctacggctcacatcttttgattgctgtgctcaaaatgttgccttttgctctgatattcgcttcactttgtgttatttatcgactcattgaggtttgctatttgctttacgacgagggcatagccaaaccgtcgacaaaacactaaaataaaattttcaaaacatggattcatcctttatttgatccaactttttgtttcagtcggactccttcctcttcatcgtattgttcgtcctctttggcatttcgatgttggcatttgcgcttttcctcagcattctgtgcaagaaattcccccaacttgggcccatttctctgatggcagcgctttctttttgcgcgcctcctctcttttataagccggatctcgcaaatgtgccgttgtgtctgctctcatcgcttaatccctttttcgccttcggaagtgccttgtatattattgaccttgccgagcaaaaaagtaattttcaatattttctaagggcacataatcacgcgtcccttttgccacttattgttagtgccaaaaatagttagctctttacgtgccattatttcggaggccataaatgacataattcaaaccaaaatcattgcgtgcaggagttaaaagaaaaagtttcgtttgaaaattggttttcctaagatttttcttgaaaatttttcgtggggaaaacgacgcggtgggggggggggaatgaagtgcaccccagggacggtcccaggatttttttcacacccgtttttttatggtggcgcggtttttccaaaaaaaaattttgggggacagggggtccggcggtgccgataggcgccgccgggaaaatttttgcggttttaaatgcggtttgttagcagattttgtccaaaaaatgaccaaattttgtgattttgagccatttttagcagattttcattaaaatttgtggattttttgaaaaatttagcgacatttcttg

SEQ ID NO: 15701 - DNA, 1076 bp, Heterodera glycines
ccgatgaactgcatttagagccgcaattaatacactaattgattcaatgaagcccccatttcatcaacagacagatgaactcgcgactgatgactcgtcgcagggaatgaacgcctctaacgctgatgatgatcaaccgagtgacgtgccgatgtgaccctgatcaatttgctcattatacatacatattgtagaaaaaaataacaatgataataattcggcatttgtcctttcacccccaggcactcctttcggcacttattgtacatttactgaacacactcgccaatttcctcattatacaagttcgtcttttgtgcttcttctgtgccagaaaataaatgttcgagattcatttatttatttttcggtttcggtgggctttagcctcctaagcccccgcccccttcgctacgcccttgcggagatccgaatttgaacagcattgtggagaaatacgagggttaattttctggggatttcagccctcatttgagcagccctaattggtgcatttaatgtcaaaagtaaaaagaaataaaaaatatttcgtcggaaagaatcattaaaattaatgagcaaaaatggatcagcagatcaatttgtccattcaataatccccaataagccgatcatttctcaattaaatttcacttccgcacaattcgacgccgcttctttctgccgctttttcgcgcctttggtgtggacgacaatggcctaaagaaatggcaaaatctacttcttttttttttacctcgaaaatttttaaattttaattgaatttgcctctgaacaaaaagtcgaaaagaaacaaaaaccccaaaaattaattgcaattttaaattttgattttttaaagatattctcaacgtaacaaattattctaaaatttcaattattttttaataattttacgcaaattttgctcaccaaatgcaatttgcgccattcaaataaatgctgacattgttcaaattgttgttcgaattttgttggtccgtccattgtgcagtcgttgtctccccattttggcatcgcttaattatccatcgttcgttgttgaccaccatccg

SEQ ID NO: 15702 - DNA, 1320 bp, Heterodera glycines
agaattgtcggcgaaattcggcaccgcaatttggccccttcaccatcattccgagatgccaagtggcgaatgttttgtgcaaaacgtggccaaatctgtcgggccaaaaaatcccagctcgggtggattttgccataaatgcacacgtccaaacacaaattgatgcctcttccatcgtcgaaaatttgtttgtttgagcgcagaaattcgagcacggattggttaatgtacctgaaaaaggggggtgcctatttcaaacttagaaatttaaaaaactacttgagattttttttttgaaaaattttcggaggggttagaaatgagctgctccggaaaaacgatgcttttttcattaacaaataagtgcttataattaatcaattttttaattactcaatccgaaggtgcgtaaagcgaattctgttgggcagcgaatggtcgggccacggaaattccacaaatttgccatcgatcagaacagaaaatttggcgagttttttgtcctgtgtctttgaaattctgatttgtctccaaattgtcaattcgattttgccgccgaaatgtttgtccaccaacgcattgaaacggggcgaaagcaatgccaatttgagaccaagttgggcacggtcaaaaaatgggagaacgtccatcaaaacgtcgttacaaatccagctaaaaaatgcggggaaaaatgattgaacggtttttaaaatgcttaatttaacacaagaattcggtttttgtcggtattacgcattgcatgaatgaccaatgtcctcagtttcttatcatagccttcatttttggtatcaaacgaaagtttaaagcctgtaaataaaaaaaaaaaattttttatcgaaaaagttttataatttctttttaatgccagtgatttgatcttttcttgcatttataaattgccgagactttaagctttcgattggtaccaagaatgcgaagcatgattaagtaagaaaaaagttatggcccaagaattcatgggacggacgcgtaaaaccgaataaaactgaaaatttggggttttcggtttttcacattttcgtcaaagttcgattctttttctttgccactcgaagacttcgccgtttgccaaatgctgtcacaagtgaacccatcaattgctgctgcttttcatgaccaattgcggcggtagaagaagaaatgaggcggcgattgtcggcggaggaaaatttttgcttttttgtgacgggcggtgccattaaaaataataataataataataagaattgcctaaaggaaattttcgtatggaaaaaaatactaagggatttcgaaaat

SEQ ID NO: 15703 - DNA, 1060 bp, Heterodera glycines
agggggtcatgatggagggaaaggggagggaggggatgtagggaggaggatgagaggggagggaggaggggatggatgtaggagggggacatgatggaaggaaggagagtagaaagaggggaaggggacggtgagggccgttctcctccattacccccgcccctctcccactaaattcgtcactgttcttaaatcacaacttaacatatgcttttacagattcgttgggctcgacaacgacaggcttggatggctcgtttaaggtgcgcggattggaaaatgaagtgagagaattggggaagtgaagccatgcgaccgtttctctcctcagatcggctccatccgtccctatttgagaatcacccacaaatgcgacgtgaaggacgaattggtcagtgaaatcaaaagtcataatgaaatatagtggggtcgaccccttatttctctgcttttattgagcctttatgggggatttgtccaacacttttccttttttggcattacttcccttccccttcttctgatgtgattttttgttcccttagaaatgccgtcgtgtaacggagatcgacatccccaaggagaaggtgaacaacgacgtgtacgagatgcattttgtgaatttaaatgtgcatggccatagggacacagagaattgcgatgagtgaccaaaagggaagaaggaaaagcgaaatttgaacagatcaattggtaaatcaaattcaaaatgaactgatcaagggaaatacacatcatttaaaaatgagaaaaaaagtttgtttcctctccctccaaattgtcacttcgtccgtttctcttttgtccctctccctccaaattgtcacttcgtccgtttctcttttgatccgaaagtcttccgatgggccaaaagttcccctcgaaatcagaaaggtcgtccctcttctgagtccaagtgaacttcgggtcggacacaaagtgaatgaatgagtcgtccttttgtcggccttccaattcgatgagaacgatcaaattttgctctttcatcaccgcccccggcacaaagagagtcaactgacaa

SEQ ID NO: 15704 - DNA, 1477 bp, Heterodera glycines
atttcaaaattcaaaaacacctgcggcccctgcgttggccaataccgtcccaaattgaacccatttgcgagagcgacgccgtggccccaaccgcgcgagtcgagaaaagtgtgcatttgggcccaatcgatgtgagcggtggggaatttggccacaaaaatggtcggctcttggagaagcgcagaacgaattgtgtcggtgggctgacaaatgagcgaagtcattcttcgcattggcaaatgctttttcccttcaaatccctcgctttccgacctcttttcgattttttgacttggccattcgcttttcgatttcggcgtaaacattgtccaaattcaccccgcactgaatccatcgtttgctgatcactttgccatcgatgaaaggtggcgagaaaagtcccttaaagttaactgaaaagcggcgggggggggacggcactttggggtccgttttggtcagagggtacgtaagtcggccgatgttttccacttaattggtgacatcgttccgttgcgcgtttccttctccaacccacccaaaatgtccattctctgtcccctttttccgcctcctttcagttccattttcatctgtccccccgttttgtcattgacactcaaattgccctgcgatgagaaagaccaatgttttcacttaatttttccctttgctatttgcctgaaatatcccatccaaaaaggcataagcgtggtcgcgaagttcaggcacttccaatgtttttccgtccgtctcgagagatgcgctgtaccaaacaaagccatggtcccggtaaaacgcctcaaaattcaacggcccatcggaggagtgaatgcaccgctggcgactgtccgaagaactcagcgaactcgaattggtcagagcgatgaaatcgcccaatttaacggcaaaaacattttggatggaaacgccactaatgagtttggtaaatggaaggaggggggggggggggaccaacgttctgttcttgggcagtggcaacggcggattgggccaatcctttttggcgccgatccaatttcgaatggccccgtaaagtggggtgatttgacccgcttcatcaatgggggcagcgtaatcgtacgaagtgatcacctgaagtgacgtcattcatcgcccctttcgccactcacaggcccattcgtttctcttccgctccaaaaaccaaagctcgtccctccatgaatcatgtacagactgaacgaagcgttttccgcccacatgtaatccattgttttcagaacaggaccgatttcctggcgaaccatcgatttttcgccccacatggaaaaccacgtggtgtaaaactcggaattgacgggaggacctttttgggaaggtgaaaatacacgcgaagaaatgaaagagagtgcacaaagacaacagaatgccaaaggcggaataaatgaaagtgaatgccaatggtccttctgtttgcttttgaacctccttggag

SEQ ID NO: 15705 - DNA, 1829 bp, Heterodera glycines
ttttgatcagagtttagaaaaaaaagttatgggccttcaaacgcaagcaaaaagtgagaaattagcccgccgggactcagttggccaccggagagaaaaacccgtatttttcccagatgcgcctcaaaaagttgtaagacccttccacaactttcagggcgctcccggccttcggccgggagattttgtttttgaagacgaactgcaacgtttctctatagtaatataaactagcgggtggcgcagtaattgctcggtgtagacagtatgctttgcacagtgattgctcggtgtgtaggcagtatgctttttatatgtatggacgggcgctgacatgagcgcttcgcgcaaaggacttcgttgctagtgcatgcgcggttttgaaatgaatttatggatgtgataagggattttggtatataggtatcgcgaggacgcattcataattttgtggaggactttcggccgcttcgcggcctcaaagggcgctccgcaccctttttatatttaaggtttaattcggccgcttcgcggcttcaaagggcgctccgcgcctgacgcattcataattttgtggaggacattcggccgctttgcggcctcaggacgggcgcttcgcgcccgtttttaattttgtggggaacattcggccgcttcgcggccttaggacgtgcgcttcgcgcccgttttttaattttttggggacattcggccgcttcgcggcctcatgacgggcgcttcgcgcccgttttttaatttttttgggggatattcggccgcttcgcggcctcaggacgggcgcttcgcgcccgtttttaattttgtggggaacattaggccgcttcgcggcctcaggacgggcgcttcgcgcccgtttttaattttgtggggaacattaggacgcttcgcggcctcaggacgggcgcttcgcgctctcaatattgttcttcttctctctatgcgtttctttagcatttaacataatgaaagcaatgaatttttgaaaagttattaaggggttgtttcattaaattaaaatgaaaatattttttaacaaatttaatttaaaaaatacatgaaattctatcaattaaaaaaataattaatttaaacttataaaatttatttatcaaaaaaaaattaaatataattttttatttattaactcaacaaaatattttaaattaattaaaatcattgaaaataacgtaaaaatacaaagaaaaataatgtacaccgcccggcttcgaacttggcccccccctcaaaatgatgcctcagaatccccaatcacacagggattctgaggtcttgactatgtcaaaagtacaatctgttacgtattcgtgatcagcaccctcaaatagccctaatgacatgttttttgaagatatttggtgaaaaaatttttcaactcaaaaatcctatgctcacccctttggtcccgaatctcaaaatcacttttatttttataaaaattcttaaaaaagtgataaaaatgccaaataaaatttatattatagagaaaaaaattgcggatttttatagtattttacttttcccgaatagcttttcagaaggcagctacgaatttttttctgaaaaatcgaaaatttccagaaattctgaaataacttttttcttttttgaaataaaaaactcaaataaatcccgtaaaattctccttatttttctctatttttaaagctttattatagttaaatcgatgaaaccatcaccgagttatgaattttccaatattaacccaaatttccaggccaaaaattgccaaaaaataagaatttttaaaaaattcaaaaatatgaaac

SEQ ID NO: 15706 - DNA, 2885 bp, Heterodera glycines
aactttttttttgaccaaccaaatccaacactgttggtatcattcgatagcccttcagatactctattaccctgcaaaatttcaataaatttcgtcagttttgaacaaatttatggccagaaaggttagaaaatttggttttttgaattcttctggccataacgtttctgaacttaaacaaaattttgaaaaatttttaggctaattgatgacaatcaggtctatagaatgataccaacaaaatgctgatttggttgacaaataaaaaagttacagtaaaaaaaacccggagatcgccaaagtgggcggttcccatttttagcaactattttgggggtttttagaaactaaaactaactattttggcactttttagtaactataaatcgtatccctaattatgacgcggagggattttgacgggcagcggcctattttaggtccctatttatacgggccaggacgttttcgcgtggccgttttcgcgtgagggccgttttcgcgtggcagttttcgcgtggggtacgttttcgcgtggccgttttcgcgtggttgcatataaatgagaattcataactcacattatattttaccaaaatttgtttcactcttttttctaacgagtttttattttataatttaatgagtttataaactaaattaaggctatttaaattatataatatggatcagcagcaaaaaattaaaacaaaacgaaacaaagttaagttagaacatgacggcgcactctataacgacatcaataacattcacctcccccaaaatgatcacaattatgccaatgccaatgtgaatcccgaaaacattatcaattttctcattggtgtttcctgaaactatgaaatgcgaccttagtttgttctgaaatttgttatttttttgttatatttttataaaattttaattattttttccgtttgacgcacatccgaccaaactgacaaattattgtagaagatattagccgaaagaaataaaagaattaaaaagttaagaaatttgtccaaatgcgggttcggattcgaaacatggatgttttgcacaaacccgaccaatttcagtcctaaacagctactcacgcgaaaacgtaccccacgcgaaaacggccacgcgaaaatggccacgcgaaaacgacccccgaccgaaaaatgtgttagcactaattatcagcatttaaatctgacacattgtcatatatgttattttttacaaaaataaattataataatttgtgaatacagtggctactcgagtccaaatcgaaaaaatgtatgctaaaaatcatttaatgaaaataaaacagtgtctaggaaatttagctatatcatcgttcttgaaatacattcctgttgccaatttgttagttgttatacaattgttatgccttaaaaattgaaaattggttgaaaacaattattatttaaataaaactttaatttaatctttatataaaccctagtataaaatgcatgcaaacaataaaatatacaagcgtaaattcaagaaaaaattgcgaaaacgtagaaaaatttaaaaaaaattttcaattagtcaatataatacatgaagtgttcctctcttcatttataaacccttatcaatttgtaaatttttcgataattctgtaaaatactgttgcagtaatatcaccccacaggcagcaggccaataatctattatcgtttaatatacagacagactataataccgtatccgtatttgtccattaagctcaccataggaaaagccccacgtttgtgccgcattttcatttttctgtctttctttatttgcttcattaatgctttttgcgtgtcaatttcagccgggtcaatggacagcaattcgtggccatttccatttccaaaatcatttcgcacttcgctaattgaaatggctttggccaattcgatatcttcattctctttcagctttaatgattccgcaatcgcgtgttcgagaagtaatacttcagtttcgttgtggttagctaagcctagacatgatgtggtgattgacatataaaattttatcaaatttaattaaaatttttattggcattaaaattcagaaataaatatttcggctgcaccccaaaatgtcgctctgacgaaaaaagttttttttttttggtcataactttgtttgatgtcaatccgattatgctaattatttttttttgatattaatgttttgcgaaatctcaaaaatttcgttacttttcaaaaaattatggcatggccagaaggaattcaaaaacctagtttttcgaagattttttcccatgattttttttaatcatgcacaaaaaaaatttatcaagaattctgtgtgttaataatgcttttgaacaactaacaagatatctttaatttattttagaaagaaaaaaaaagttatgatccaaaaattcgtccaacaacgtttcggctggcgacattttgtcatggtggaaaaacctcatattaattaataaatttagttttcaattttttaaaaaatctaaaaatgtcagatagtctcaattgaaatatatataatttattttataaaattcacccgaagttgaagctgccaatgagctgctggatgttggaagatttgctgtcatatcatccgcatcagaaaacaacaaatcatatgcgtcggatgctaaatttaattaaaaattgtgaaaaaaatatatgtttaaaattttttttacgttttttgcccgctgagatgttcggctgtgaagaatcagcatcagacgtctggccatagctagttgctatttacaacaaaaaaatgaaacaaattaattcaaaattttcaataaagtcaaaagtaatttataccgcaaattcttggatttttttctggat

SEQ ID NO: 15707 - DNA, 931 bp, Heterodera glycines
ttatgtgatcactgataatttaaaacttagctgctattagttctgaaaaatgtactaaaataattgccaaaatgctgaaaatcgttgcgaaaattggtgttaaaaattgaaaaatccagtggagttctttatgtacaaaattccattggagacaaatgccgagaaacgagtgcagtatttttcattcttactgtactttgctaggaaatttctggtaaaaggcaaaatatttgctaaaagttcgagaattaaccaaataggccataaaaccagttttaggtgtttttaggtgctaaaaagttcgcttaaaagaaaatatagttttagtgcttctctcatcaagtacaattcttagaaaataggtaaaaacctaaaaatcataactttaataatattaaataaaattatatattaaataaaattaaacttactccatcctaaagcttctagatcatccgaatcgtagttctcataaccggttccgtcaatctgattgtcgtctgccgcctgtccatgtgctcgattcactattatcaaagcaaaaacaaaaatttggtgaaaatatgggaaatgcattggttgacactaaaattgtatcataattttttaataaatataaaaattgttaaacaattgaaatatgaaaaggcttaatattttaaaaaaattcacaaggattaaaaaatattataatgatatttttataatatttgtataatttattattttcaatgaaatgaagaaaatgaatttatgttattatacaatcaaaaataaaatttgtataaaaaatctatatttttgccaaatatgtcattgattgaagggctgagaaaattgccacaatttttttaaaaggaaacatatatttcaaatttaaatatatttattgagcaaaccacaggcacattagtgctcttatgtggcgcat

SEQ ID NO: 15708 - DNA, 1095 bp, Heterodera glycines
ctgttgcgcgtccgacgacacttggacaatcgctggcttttgctgctgcgacggctcgtcgccttctgatcgcatccgcattccatcttcgtcattcggaatgtctttcttcggtgggtgcgctttggagcagtacaaatggagcaacagctgtcggatgggcctttgagcagatgcctaaacatttcaaatggcaaagtttggcattttccatcaaaaaaaggcccacgagcactgcgcattgctccggggcagcgatacaattcagcgttttcggatcgaacgatttgcctgcggtaatttggcgttctgttattcatctttcgttctctcacccgaagggcacccaatcgccaacggtgccgaagcgatgccgcggcacaccaacgcctggcgggaacacttttggattgggcctttcccgtcaaaaaaataaagggtcgcgtcgaaagggcttcgctgagcgcaaaaattgatcgcctaatgaatgattgagcttggcattatggcagcatttactactaattatccaattagttaattactcctaattagccaattggtgctaattacccctgttttactctttcacctgtgccagcttctcagttgcgtcgtttaacaagttaacttccggcacaaaacaatctttgactttcctcgccattttgcctgtcaaagtttcattatttacgagcgaatgaatgcgtttcccttgcattgtttgcccacaaaaacgctgcccagcggacattcggcaaaggtaaagggtttttggtcgttgccgcacttcaaaaagctgaaaacaatcgcaaagaatttaattctttcaatttgtggccaaaaatgcttaaggatgggccaaaaggaaaattaattggaaaagcaaatgcaagtgaaagttgctgttgtttttgtgctgtactcttggaaatcgacagaattccatcggctgtttgtccctttttctgtttgtccattttttgcccttttgtccctttttctgtttgtccatttttttgtccctttttctgtttgtccattttttgcccttttgtccctttttctgtcgtcccttttgtccgcttccctttt

SEQ ID NO: 15709 - DNA, 1942 bp, Heterodera glycines
cttttcttcctccctttggttcttttctcatttgaccacctcgaactgcacgggccgagctgaaaagtgtctccgctgccgaaacagaaattctcgaggtccgttcgtttaatttgagccgaattttccaagggattttcgtcatttatttgtgaggaatccgacgacgaatggtccctcgccttcggcggtggcactttccgctcctccgattggacagaatctgaaagaaactcccaaatggcacaacagaaagggagtacggtaattggggggggggggggggggttacggtatgaaaggacagaaaaagcacagtcaaccaaaaacaaacaaagttctttgagaagagagcagcagataaatccgcgaaagaaatcagacgaagacaccaaaaagcaaaaataaaaaaacggcgacttatttttataccaatttaattttaaaatttatcggcaccttccgccgaagaatgtcgggagcgaacgcaaaacggcaaaaagaatatcaaaaagaaaattttcattttaatgtcttgggagagaattgaacggagtgttcccaaaactaccaaatctttgctcataataattcccactcagtcggtgaataatccaacatttgctaagacactgactaacgcagcattcagcttaaacttaaggaaaattgcttttgctatttttcggagaatgcataggacagcagcagtgacaagtcaaaaatgctcagattaattgtgagtttctgtagccccgtaattgacaaagtaaagaaattaagtattttatgcatgtgattagaaattgaaaaagtcggtgacgagaataaacggaagcaccggcagaaaaaaaaacaataaaaatgggaaacgaggagggactaatgatgcttagggaagggacaaaagaaaataagatggtatatacaatgttaaggccaagaataaaattcaaattgaggcgtaacaacaaaggcggactaaacaactaatccaagagataaggcgcttacaaacggaaaggaaagtgtcaaaaataagtcggcattgtgtaattgtcgagaataacaaaaggaaatgttgggattagtttgatggaatagtaaagttggacaagccgacgatgaattggactgaactcacaattagctgcaaatggaaatgccaatcggaacctgtccaaccctaagaatcatttcaaaaatggtatgtgttcgaatagcgagggtaattcccattctttagtcgtgttccgctattaaaaccacgggggtaagacgttaatgttgagtgactgctaatggccattcgtcctgcactcggtgtgtataatgttgcggttgatggacgagcaaaaacgccgctgttcctaatccttgaatatgtagggtaattgcgatggttatcaacggttgcagttgtgctgatcggaatgactgaagacgatctgagcggcactacgggcgtggagggcggcacggcactcactccgttgtgccgagccatcactctgttgcccctcccctcactatcgccatcatcgattgaacaacgtcgtttttcatagctattctccaatattaacggttccgccgagctgagtcgaataacgcctttgctggccaatggcgaatgcccgttgcagctgttagcattggtcggcccgactccgttgttgtacttggccaatacgtgatccggaagtgcatttggaaaccatttttcacatgataccgtcatcaaagattgttgatcatctcggtgtaaacgtcgctcgtaaaacagcaagtaggactttgtggagacgcggatgtcgccctgtccgatcggttgggacacacgcgaatcgtcgaaggtccgccattggccgtccaatgggttgcgcgttgtcgcagtgtaatgaccgagaatttgttctctgcagagaaatacctttcaata

SEQ ID NO: 15710 - DNA, 3366 bp, Heterodera glycines
atgcatttttctacctaaaatttgcaacttctcacgctctcttagtttaaattgtaatcttccatttgttaattatgcacttttaaaaagtacaattccgtataaattacgcctttataaaaccaaaatcatgtacaattgcattcattcccacaacccccttagttacaatagggcgataccgcttcgacaacttaacagaaataaccgtcccgtccttaatgttgggcctcaggaaattggggtactcaatcaaaattgaacaaatgtcatcatcatcatcatctccttcttcatcatcctcatttgaatggcacattgcgtagcgtaggacactcctcttgaatgtgtcaaagtggagaagctgacaggcatcggcgctcagtgttatgccccgtactttgagcaccgttttctcctccccgctttggcggtgccgcatccgcagggcgtactgtttgcacccaccggaaacaaattccacgagctcgtggtccggccattcatccgaaaggtcgcctaggtggggtcccgtctccagagggcacccgtccgcctcacgatgggcgaaacacacactgtccgtgtcggtgtagatgagcacagagtttggtgcgcgcgcaaccgtctgcattagccgcaacaagtggaggcgcgcgactgatgttgtccaaagagaaagcacaatgtttgagcactcgtgttcctcaacccattcgtttcctgccgcataggtgaccagaacgcattcgtcggtgagctggtcaacggagctgacctccaccgctgggttgtcaagcagagcgcgcagttccgcgggcgagtcggtcacaatcgttttggacaacccgttgcgtaaagagaatcgacccaaagggagttgttgcacagttttgcgatggtccgcttggccttgttgtgcaccatcttttcccgctcgattcggattccgaatttttcctcacattcctctatgaattgctgctgatcttcctcggctgtgccaatttcgtccgggaagccgctggcatgcgttttcatggccatgaattcggcaacgtagcctcgaaaaacgcggtcgctccaccgcgtatcgtcccactcgacggagcgatagtaggccgtacaccggtacccgttgcgaagcgcctcctccaactcgattgacgtcacagtggacacccacccccgctcatcatcctcgcgatgcgtgcactcgtagtcctcattgacggctccatgcggatgttgcagagcacaggtacggcacagcgggaaaagaagccgctgatcaaatttcacgggcagtacaggcacatcaacatggtggggcggcacaacgaacactttgagaatgcctcggaccggcacctggtcggcgcgtcgccagtcaaccgcctgctctgcctcaccaatgatgttcactcgtgttgtgtgacccacggggtatgctgtcacagcattcgtgtgggggtagagtgaacgaacgtcgtaatatttcatccgccacccctccggcacctcgtagtgtagtcgttgtggacccacacgtcctccatggtagcagtccttcaaacgaattgggccgctgtcattgtactgcgcaaaggcgcgcttcatttcgtcgttgttgcgcttctccgcgttgatttcacactcccaaaatacgagcacttgttgcacctgagatgtgatgaaggccatccgtctcgcatcgtcctcccgtatccgctgcgccgttttcccgttcgccatcactgtttggggctgaaagcggtgacgcgggtggtcgtgcgcgtgccagtggcagccgttgacctcaatcacggtgtcggtcgccgcgatgtatccgtccacagtgtactggccaatttttttctctccgtcgggcgaatgtaacgtctgaatgctcaccccgttctttttggcgtaccagtccatgaatttgagcgctacaaggctttgcgtgtttgtagtgtcgtagccgcactcgggcacaatggcgagctgatcccgcttgaggtgattgagtcgaaagtgtctcattgaggcactggcgatggtcatcggctcccacgttatgtcaatgccaccgccgatcacttcaaatgcattgtcgtcatcctgctcctcctcctcttcgtcgtcgtcgtcgtcatcatccaagcatccatgccgctccatcgggtcactgatcgtcaagaactccgtgcgaaaagcaaccaacgcctcaattagtatgcgcgtgtcgttggtgcagtaggctgcgagctgttcacataggtcgaactgctgatggcggtgttccgcgtaccactggtcaaatctgcgctgccggtcgggcgtcattccaccgtataagtagtcagcttttggcggtagcgactgcagaatgtgcccataattcgcctcaacattcgccaaatgagggaagaactccttatcctgcacattgagtccaaacgctccgggcagagcgcctagtggcaccggcataaggttccagctgtctcttacgatgatttccggatttttttcgcccctcgcaattttcatttcgtataatttgttaccacgtcggatcatctacgggcaaaatccgtagaggaagaactgccgaaacagcataatgttgtcaaagcgacctccgaaatgggtgaagagcattgtgggatagcgcggatcgaattcgctgagcagccattgagcaaaggccgccattggccaaggagtgaagaaaagggcatcggtttgccccccccccctcccccccccatttcggtgaccatcgctttggcaagtcggacagccccaaacagcagcagaagcggaacagtgctgctaatacacataaatatttacagctcttaaaatgcataagcggatcggcggatgatgtgatgatgagatggaaatggctgtgatggaaatgaagcggaggaagtgagtaattgggaaatggaagcgatggctgtgttatgttggccacagaaaaggcgacgctggaaggggtggacgtggaaggatgaggggacatagagggcagggggaggggaggcggggaatgatgttttgggacggaatgttgggaagggacgcaccgttggaatggggggggcaatggacaggcgaggggaccattgccaggctttgacgggagaccttttcggtgtccgcgtccaatttgcgcttatcagcaaggcaaaagttttgatgcggaaagggcggcattgagcgagcgaagcgttgatgatggtcgggaatgaatatggaagggaatgggagaagggggatggagaggcgagagggggcggggagggcggatgatcaaccttatcgggaaggcgatttcggagtcaacttcat

SEQ ID NO: 15711 - DNA, 1618 bp, Heterodera glycines
cgggcggatggcccgggggacaggtttttcggctttttctcgaggctagtgttaattagtttgtgccctttgaaattaggcatgccttccggcaatacaaatggcttttgaagatgaaacatggagcctgatttattgccaaattacgcattgttacttcatcagtttaatagcaaggcatcaaaatgcattttaaatattccgtcaattttaaaacaattttaattttcttttcaatccgtcccttttcttcaatgccaacctggcctcactgcttggcaattatttgaattgctttacaaacctccgaccaagctgatcttactttcgggctgcagtcccgtcacgacgctggtgaaaattttgaaaatcacatttttccaaataaattttaaggggccgaagcggcgcccgtatggaaccttctcgtggttacctaattcaataattaattgatttattttttacatttaaattttttctttcatttcaaagctctcttacggcgcttcttctcccgccctgtccaatcgcgcccgcttccccactctgttcagaacacatccatcggcaaatatgcaaaatccgacaaggcataatttaaaatgcaaatgaaaaattattaaaatttattctccaaagaaattcagagtccatttgtttgagaagttcaaatggaaacggatcaccattcttcaatcggtggaagaagtattcgactcaaccgcaaaagtgatcaaaaaatgcatgaaaaacataataaacgaattaattgaggatttggaagaacaatgcagcgaaaagggaattcgcgtggaaaggcacagtttttatggaggtaaatgttagaacagaaaatgaatttaaataaaaacagagtataaatttaacaactattacggtaactctcgtttttatatcgtaagacccgacggatgctctgaaggcaatacggcgccaagatgcgcgaattattgtcggactattttatgtgaccgaagtacgtcctgacatttgctcatatgtttttttcgtcaaaatgatgctcgagagtctcgataagagagttcaaaaagtgttaatttctggttttgaatgtgaatttgggcctgattctctgtcaaatttctcaatcaagcctcaaaaattctcaatgcgggcacaattaattagcctcaacccattcattttcattaccattttaaatttaggcacgccgtgttctctgccaagttcaatttatttaaaaaaacagtgttttcaagcgaattttaggcatatttacatggtctttatggacgaagatatggtcagtgcaattaaatgcttctttaattttggtcattccgctccaagtttggtttatgatcggatggtattccgacgcgtggttcattccgcccgaggaggaggcgttgaactgctcgcgcgcacaaatggaacgggccgcgcagtttcacttcaccacggagagtgtgatgctgtcgcgcgacttgcagccggcgatctctggcatgacgggcgagcaaattttcagacgcgacttcgccgccggatcagcaccgaccccgcacgaaactggcggatgccccgaggcgccgctggcatacgacgctgt

SEQ ID NO: 15712 - DNA, 1035 bp, Heterodera glycines
tcccgaggcccaccgcccgactcaacgcgtgtgaagcagtggccaatcactgtggattttcgggtacaaaaaaaaacattttcaaaataatcaacagatggaaatgattaaaaataaataattatcttttgaaaatttgtgaaaaaataatatgtttatcaatttaccaaagggtaattttgttatgagctaatgaatctgttggccattatttagctgttctgtgccacgatggttttcacgtgtgtcggcatcgccctcacaatcgctctttggctgttctgtcgccgacatgcaaatcgaaggtgactaaatttagaaaattgaaattgctgtatctgcaacatacaaatttcatattttgtgcttaatataaattgtcttactttcttccgaccaaatcccataataattgtctgtctgttcatcccaaccatccaaagtcaacctgctcttctcatatatcttgccatttctatatgctgacggatcaaaattccttccttatttcaacatcagtcccgtcatctcctaaaccttttgccatcacttgttctttgtcctatccctctaattgtcagtgggcggtccgttcccgatcgctatttaagcttgtagcgttccctcacaattgttcatcccctggttcactttattccacctgtctccaattgtgcagacacgaatccggaggtgttccacacagtcgactgttgttccccctttgcccttccgaataaaggatattattcgaattaccgcgacacagtgttttggagaatgcatcaacaccaaagtatcccaatcatatttttatttaatattcatggaggtcccgccgctgtacatttggagacggctatttgttcatcatttttttggtttcaactaaatattcattttttgatttgtttgatctggtaacaactcatattttgaacggatgaaaggctgaaagatcagtgatcagagaatgggaaaaaagaggaaatctggaggaaggtggagaatgtccagcagaatgagcgatgagaa

SEQ ID NO: 15713 - DNA, 996 bp, Heterodera glycines
tttcgattaattcgttcttcttttgttctgatctggtggatcaagcttctttaggaacgctgtattctcctttacttcggagctaaatttatacatttttaatttaatttaaattcatattcttatatactattcaattggtaaataaatttccagagtctcatctggaaaaattttgctacataatctgaattcctcatcagaatttgggtgcatgttaatcatgagatagctaaattgattattggtcgcatcgttatatgcatccatgaaataattcagtctttttgggaacagttgtgaccccagtgtcctcacttgtaattgtcctgaagggttacgcattaaaatcagataatgggcgttagctcttgccgttttaatgtcccgaccgtagagactctgggttacaaaaattacgcttacgttccaattatgggagcccctggtaaagagtaaatcaagaaaattgttctgcatgttaagcattaaatcgtcaagtatcagtaagaggggtttttcctgttctttaatcttattcatgtccggaatcccgttaaaagtctcgacaccctccccgattaatcctaaaatactatcattcatctcaccgtaacaataaagaattttggtgggcgatggttcaattagattcttatggtgttttaaaaaccgtaatagccaacgggtcttaccactcccggtagcccccgagagaattagagtgaacggaccgcgaaacatttttaattcctcttatttatttgacctatttatattttcatagggaacatgtttcgcgcatttggggcatagccagaaattatcaaataatgatgtaccgaaatgcaaaagactgtgctttttacacctgctacaaatctcgtaatgacagggacagtaatgacaacacttaattttatgtgggcagttcatttttcaatttaattttatattgggttgctatttatagaaggggtatataaagggagtgaa

SEQ ID NO: 15714 - DNA, 2306 bp, Heterodera glycines
tttaattttaatttaaattcatatttcttatatactattcaatttgtaaataaatttccagagtctcatctggaaaaattttgctacataatctgaattcttcatcagaattttgggtgcatgttaatcatgagatagctaaattgattattggtcgcatcgttatatgcatccatgaaataattcagtctttttgggaacagttgtgaccccagtgtcctcacttgtaattgtcctgaagggttacgcattaaaatcagataatgggcgttagctcttgccgttttaatgtcccgaccgtagagactctgggttacaaaaattacgcttacgttccaattatgggagcccctggtaaagagtaaatcaagaaaattgttctgcatgttaagcattaaatcgtcaagtatcagtaagaggggtttttcttgttctttaatcttattcatgtccggaatcccgttaaaagtctcgacaccctccccgattaatcctaaaatactatcattcatctcaccgtaacaataaagaattttggtgggcgatggttcaattagattcttatggtgttttaaaaaccgtaatagccaacgggtcttaccactcccggtagcccccgagagaattagagtgaacggaccgcgaaacatttttaattcctcttatttatttgacctatttatattttcatagggaacatgtttcgcgcatttggggcatagccagaaattatcaaataatgatgtaccgaaatgcaaaagactgtgctttttacacctgctacaaatctcgtaatgacagggacagtaatgacaacacttaattttatgtgggcagttcatttttcaatttaattttattttgggttgctatttatagaaggggtatataaagggagtgaaaggaccatttgattgatacattgtatcaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtacaactcctatcaaagccacggcattattatgggaatccggaaaaatgatatgtctggggacgaaaagtctgatagactgtgaaaatgctattaaaaaatttatagaaataattaagggttcggggtgtccgggggcttcttacaccggacacacggttgaaaatattgtttcgacctttaaattcggacgtgaaattgaactgaacgagtttcgaaaaaatcgtcgtgcattttatgaaccggaaatattttgtggtttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaagttagggagacgataaaaaaattttcatttatgggacggtcccccaatttatagttctgttggctatttattttgttatcgattacttcgcgcggcgccggcattgcggcgccggacgggcggggagggaggggagaggtgattaaaaccgcacggttttggctaattttcaaaaagaatttttaatttcaggatccgaaaaatcatcataaaaaaattcaggattgagaaaataaaaccggcccaaaaggtttgggatcaaaaagatttaaatttgcaaaagaaaaaattgaatttccttcacctgccactttggtgacaggtggatgattgatgaccttccgcggcgctgcgcggcgcggagagggggagtgaaaaaaaaaatcgccagtgcggatttgaggaaattaaatctacaaggcggcagacttcaaagaaacaacccctcacatagggttcggttggcacgcacccctcctataggcttgggattgtgcgggaaaatgtccccgggcggtaacatcaaagggctgcgcccctcccataggcacgggtttgtgcggtaaacacccgtgcgcaaccgtgcgcttttgacgtcttatactactcccctgggagaagggagtgggaaacatgatttcaaaattttcaatttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaagttttcaattttttctagtctaatctactcaaaacg

SEQ ID NO: 15715 - DNA, 3607 bp, Heterodera glycines
acgtgttttgaataaattttgtaaaaatgaggcttttttgcctgccaaatgaggcttttgaaaattttgatctgggagccctgagtaataatataatttatttgcgttaataaattaaataataaaaatattccaacgataaaaagtttttgtaataaaaaggaatcttgaagtttttacaactatgtcttgacttctatcttttttagatgcaaaaatgttttatgaggcggtgcgacaagttttggacaatataacccaaatggtgtctccatcgcatacaatgaattctaatgggacgatggcccaatctaacaatcagcagcagaaggcgccactgagcagtgcgcctccgcctccaccgcctcccccaccgccggacttcaaaaacttattggctggcaaacaacaacaggcaacctttgccgacaaacttcgggatgtcaaactccgaaagtgttctgcaggtcccttgatttagcttagcacctcccgcccccaccttcgcctttttaggaaacggtgtccagaaacgtaccgtctcgccatcaaatagtgttggctcttctaacgggagtgggtctgtctcgtctaaattccaaagccaagatttgatcagcgaactgtccgatcgactaagcaagcggaaaatgactgtggaagcttcgtcaagtcggataagttatttgatttttaaaattgccaatttagatgcaaatggcaccccaaatcaaccgaattcacagactcttcccgtgaacaatgcgaaaggctctcaatcagcgattcctcctttcggaaagtcgctttttggaaatcagcatttaattgttaaaaaaacactttcttagaatcggcttcgttgttgcatcgtacggagggacaccgtcgacagcgggcgcagcctccgctgctcatgactcacaattaacttgcgaaccggtggtgaaaggcccaacacaattaacttgcgaaccgatggtgaaaggcccaacttcatcagctcataatgacattgccaattccgaggctcgaccaaaggcgacgactacgagcagcgatttcgagcggatgaaaggcgaactcctggaactgttctcgaacgaactgcagaacttcaagcgggaacttgcgcaaacaatccgagacgaagtggccaaattgtcagccgatcggagatgactcaacttgttcagaatatgtctctgttgtacattgtcttcctttttaatgtgcagtcactaacgctcttcacctttaatggtaaccataaataaaatttttatcagtttcttttttagaaagcgagtagtgtcaaatgatatatcatttgttggtaatactaccgatggtaggacccctttttgaaaaaaatatttaactttaaaagtcactgaaaatatgtttctaagggatttcagggtcgctgaacacgaatctgacactcattttgaccaatttcgaatcccggacccgaattcgaacaaaaagatcgtaaatttaaattttcaaaaatctaaattttgctcctagatgaataaaactattctaacaattaaaatgagtcattctatgcaggatctaacgaaatagagaattttgaaaattatagatttttgactttttgttcgagttcaggtccggtactcgaaattggtcaaaataaatgtcagattcgtaatcagcgaacccaaaaacactaagaaccatgtttcaaactttactgtcgagatcaccaatgtcgaaaactaacagcacctgaaatttgacattttttgggtgaaaaaatagcttttttttcttaaaaataataggcataaattactaattgcataggttaattatctcatttgatggaacatgttaattttttttatcattttattaattttaattcatttttaaagtgaaagctgagattttcgcattaaagtattttcctttcaacaatttcatccctttcatttggattaattccataaattaattttcaaaatcatggacattttcacaagaaaacattaaggatacggttggttgttggattaagcgaatgaagcattgggtttggcataattaaggtttgtaatatttagtaatcggttgtccatattcattaattatgcccaaatcggtcggttgccaactcaatccaccagctcctcttttgttgggaaaaggagtgactatttacacgttttttacagcgctattttttcaaaaactttttgggaacttggaggagagtacggcggtgccgataggcgccgccgggaaatttttaaaaatttcagttcaatttattaacagaaattgtacaaaacttactagttttgtgaaaaaaaaaatttaaaaaatttccgacttttcatcaaaaatttcggaagtcggaattcagaccccaaaaatgtcggaaaccggaagtctttccgtgccatacctggtgcctatcgacatttgcgagaaattttatgaaatttaatgcgatttgttaacagattttgcctaaaattgaccaaatgacgcagtttttgactcaatttctacaggattattaagtaaaagcctatccggcggtgccgataggcgccgccgggaaaatctcacaaattttgaatgaaatttgcgatgaaaaatgagttaactttaattaaatttattatttaatttatttaaaaatatttggcattctgtcttagaacaattttcaaaaaaatcaataaaatcccgcataatcccgcacaaaaaatcaaatttgcggatcccgctgcgggattggaactataaattctttgtgggacgggatcccgcgggattaatcccgcaatccagtattttccaaaaaatgcgggattgcggactgggatcccgcaaaatcccgcgcgggatcccgtcccgcgccggtctctaatattaattaacaaaatgaaaaatgaattgaattttcgtggaaattataaattttacacattcaaaattgtttcttccatctctctttttcttttataataattttcaattatttctccttttttcccccattttatatttaaaaagaataatatgaataaatttatttagttttttcaaatattttctgttaaaaaattttcctttaataatatataaatggtggaaatgaaattgaaatgatttattattattattattgttgtaacaaattataaaaatgtatcttaaattgtttttttagttaaaaaataaactaataatattttttttcactatatttttcaaacactacgaaatgaccattttgctatgtcatatttctaatgcttataaaaagaaattttttgtatataaatttaggaatctttttgtttcatttttcttaaattccgacaaataatttgaatttctctttttttattgtgaattttttaacttatggactaatttcttgtaattttttgaattttttttatgtttttaatctaattaaaattttattttgttttttaattcaattaaaactcttaatttttgtaaagtttacagaaaatgaaaaaataaataaatttattaataatattttttttattcgatttacatccaataacaatttataaaatcgaattttaat

SEQ ID NO: 15716 - DNA, 1949 bp, Heterodera glycines
aacaaacagcaaaactaaacagtgattaaatttatatttttattaggggaggggcggggggatttttttcttttagcaaaataattccattttatttgagatgacaatttattcactaaattctgaagaccggtaaagaaaatttgcgggcgccgggagcgggagtccaaattgtcccgggagcgggcggctttccgtaaaaaacacgtcatttttaacagggagtccggcgggagggagagggagtaattccaaaatttaaaggaataaaaacaaaaatatatttaatgcaaagctgtgatcaaattttcaaaaataagcaaatcataaataaaataagattttggggtacagacacatttttaaatagattataaagcctaaatttttgagcggtttgcatgaaaccattcacagattcagtccgaatgtgtgcctgattgttatatattttgtgttaaaatgggttaatatttagctttttagatctaattttaattaaaaaactgtgcctttgagacaggcaccgccggtgaataatttgtaaattttgagttcattcatgaacagattttacaaaaaacctaaccattttttatggatttttgagccattttttcaaaaaataagcgagttttggatctgctgtgccgataggtgccgctgatgaaacaagaaatttcatatccaaatttgattgaaaatgttttggaaattcgaaaatcatctttttggggttggaatttttattttattatattttttgtcaaaaaatattaacaaaaataatttcttaattataaaaatcattgcaattaatttgtattttaatacaaaaaactcacttcccttattcttttcgtgcaaattgatcatcgggtaaattttgttgtgcgaattcatttggcaacaacaatctgagaaataattaaataaaattacgattctataatatgaaagggtaaaaattaattaatccaaaacttgttggatcaaatttattaatttccattggatatatatatctaaacggtttattgatccgtggtgttaattaatccaggtcattattcgacagaaaactggaagcttattgcttccgatcgggataacaaatgattgtgatagaaagtacaaattttctggaaaacattagaaaattttggtgagacacgaactaacatttaatcagtcataattgggacaattacacccaattctgatcagttccagccagaccgtactgtaggaactattcagcgtaattaagacttaattacactcaatatattttgtgaaataacactaattggcccacccttcctcaagatgacatcattggattgtgcagtcccataacattggaaattgctttgctgatcatctaaaacattctctttgttgttcttcacaatcgccgctcttccgcctcctccgatcagtgccgtccgttcaaatgggaccatccaagctcactctcgtcccaaccttttacatttttgtttttaaatttgaagtagtcattcaaaaacaaaatgaataagagccacttaaaatctactctcaaaatttctaactttttggagttaaacactcaaaactttttttgttttttttattaaataaaaatcttttttacaataaaatcaatcaaaataataatttatttttaaataattgctgtaatgtcaaaatcgtaagatgattaatagggcgcgggttttaattgctttgttttttctgcagtcttaattttgataatttttagctcgaaaattcttcatattaacctcactattcggcagtagaaaatatccattttgaacttttcgtaactaaaatggttacgtcactatttttatcatttcgtcactgttttcaaactccaaaaatccacattttctttaataaccaatgtatcgaatcatataaattgataaaaactagag

SEQ ID NO: 15717 - DNA, 1633 bp, Heterodera glycines
  misc_feature (50)..(50): n is a, c, g, or t
  misc_feature (62)..(62): n is a, c, g, or t
  misc_feature (1608)..(1608): n is a, c, g, or t
tgatcacaaatgtgtagagtgacgtcaccaatttgtacaacctttgtctntattttgtatcnaagatgtgaaatgtgtttatcaattggacaatttttaacaaacaaattaaaactgataagagacaattcgaattgattgctgattgatagcggagaggtggaaaaaaattgaaattgataaaaaaaattcatttaaattaaattatgataaaaattatattgatttagcctatattgaagagaatagctcaaacgatcaatcgctttactgaatttatattaaaaaaaactaatgaactccgaggatatcgatgccggttgaaactcattatgccgcttaatctcggcttttccggtactgacaaagtccagcttcttctcgacatttaaatccttgtctaaaaccaatcttttatagccaaactgcaaacagaaaaattttaaaggtaaaacttggctccctaaataagttaaaatcactaacgccaaatacatgaccaacaatgttgttgtttttggtgtccaacatattcaaacactaagagtcgacctagagatataagacctgacttcgggacaatatgaatctcaaaaaaccccaaattttttcattatttaagactcgagagcctaagcactcgatcagcattcgatatttttcagcaattttctcaaatttaaaataaattcaatttgttattttataaatcagcttcattcctttttctaatttctaatttttaaatgagaacgaggcactgccgagaaaatgaaacattaaaaacacacataattttcagatttcgcttggactagccgagtggcctacagattaagcattgtttcatgaacagattatgaaaaatatttaattcgaaaggatgatatgaatgttttcttgttgttgttgaattgttaaactgttggggattcaaaaaatttgcaattattgaggtaaatataaataaagtaataaatttttgaatttttaattaataatggaactgatggacccagaaaaaggcttttacgaggggggagctgatttattaacattcagagctgaaatcaatttagcttttggcggctcaatcggaatttttcaaaattttctttttttggatatgactcatccgatgaaacgcccaattattaccaatgctaaggaaacgccaaaaattgttattaccgtaattgaaaatgcagtggaaaaatttgagaaattaatttattgtgaattctccgagcacagaattggatggtaaattttacactaataaataatatttattttagatgagtgtgtggaaaatgttcttctgctggccaatcattttgggctggacacaattgagaatcgtagtgtcgaatttttggtggaaaaaagcaaaaaatcggccattcaaaaattcaatttggcacatcagtacgccatcattagcatgaaggtgaataacaaatcgaaaaaataggaacacaactaatttcagaaaaaaattctgaaggatatgactagaaaggattttgttgttgctgggaaaaacatttaccgtgatttgttggaaatggaaaaaaggacacttgaaaacggtggaggaattgacancacgccacaaagcactttttggcgc

SEQ ID NO: 15718 - DNA, 2628 bp, Heterodera glycines
gcgcattcttctacctagaaaaatgcttcttaaattttttaattaattttatgcagaaaccacaaaactgcaccattgccaatgcttcttaaattttttgatagtgagattttaaaataattgatttttcgacacaccgtccgaaaaaacgagaagtgtaccaataaatagagagtgccagagaaaaacattactttttttctctaattttttgtctccttttggcgtactatctaatatttttattattaggaaaaacaacattcacttcatcctgtttaacttttttcctgcttgttaaatccacaccaaatattgcaaatcgatagagaaaaaaattctgcatcggttaataggtcaagttaatattaaaataggtcgaattagagttttttttgtgctaataaataaaaatatagattctttaagtatttatggcaaaagaaaattattaagtaagctaatcggcagagaatctgtaaaaaagcgctggaacaagcgagaggagcgacaagcgcaaacggtcaaggcgagacaagcctatttggccaagagaagtaattttttcaccattttttacttaaaaatctttttttttgtattccagccgctccacagccgaatcccaatgccgaaatgccaccgcaggacgaagcagggccgtcaacatctgctgcatccgtcgaagaagcgatggaaccgccgccaaagactggatgaactgcagcgcagcgccaggcgcgacatcgtcgaccaaattgtggacgtcatcgatcgtgatcgctcacgttccgcgagccgcgcatctctgtaccggatccaccgagatatccggcacaaattcgcgcactacacgccaaagaagggcaaggagcggaaggaggggatggacgctgaggatgggcttttgctgctcgctcaacttggaatacagaaggcgtacaagcggatgaaggcgattttacggccattgtttgtgcaccattgctgccgtccatcaatgttgagcagatgctgttggctccgttccatgtcttccaaggcctcggaaaatgctctgatcaaggagtggaagcgggagaaatgccgaagtcgcccagaaattcttcagacggataggggcaaggagggaagcgttcagaaagcgagacatgacggggaacggcatccggaaaatcctcgtccacgccgatcaaatggaggcccttttcgagacggaatggggcaaaacaatttgccaaacgatggcacatttggggaaaatccaaatttttaccaaagtgattgtcttcattttttgtgtaaatattttttaatttaaggcccagctattgtccccaggtgatttggacggaatggagacggcagttgatcagttcaaggcatttctcgacgaacaaacaatggtgcgaacccttctttcaaaaaagacaaaggcccatttgctgcttcaccactttgttccatttgcgcgccaacaccgatttttggggcttttggatgagcagggtgggaccatatcattttttgggttcaattttaaatgttgtgatttttcaggagatgaggcattgcattccgtgtggcggcgacttgagcaactgtggaagacgatgccggactctgaacaaatgcgacagcagctggagcatcatttcgtctcgaattggctgctggacaccggcagactcgacgaattgaagctggtgagttgatggaaggggctttaaaaccttgtccaactaattaagcgggaggaggaacaacgggagcaagcggaggaagacaaaacgaatgaagaaagtgatcaagaagctgacgtcgatgtcgttgactgatcgaggattaatggtttttatttcattacaagcggtagataaaatttttaaaaatttgtaaacaatttttcaatcattttggtcacttttccttttatttattcattaaaatcatcgaaatacatcaatagcatgcactgggaatcgaacctgggactccccctttggtgaccttctcacagaccacttcgccacacatacaaatcttttttggtacaggagctcagtttccggacgccgtgtatattaaattttaaaaaataagccgattttttgcaacttcttattcaagtttatttaggtattcaaatctacagagtagtgtaagtaaattgggatggaaagttgtgaattccaatgttctgaattaaaaacgaaacggattcttcttatcacttctaatgttggatcgcttttcgcaatggtacatatttatatttgatcaaattaataagcatttaaacttttagaattcgtcggaaatgcgaaattactggttgggtcaaattttggctattgtcaatcagaagaagcccattttctttgttttgcatctccaaggcattttttaatatttgtacgaatgaattaaaaagaatttttagagagtggcggtaaaaactaccgacaacacagccgagaaatgcctgaactcgttgatgaattgcagaataaaatgacggctttagattttaatttttctcgctgttttttggacattgacttcgaattggtcgaggattttacagacggtttacttctcagtcttttcaagttttgttttttaggc

SEQ ID NO: 15719 - DNA, 1185 bp, Heterodera glycines
  misc_feature (1148)..(1148): n is a, c, g, or t
tccgtttaaatgtcaattgctttagtaaattaaatattggaagaaaaatatttgcgtttttttattaatatttataaaatatttagtattttcagagttttataaaagaaaatgtaagcaaaaataaagaataataaattaattatgaagaccaatttcaaaaatatcaattacataaaattaacccgaactttttgtcagcattttttcagtaattattttggcatttttcttaaatattttttatgttatatatttcaactttttgtttgaattcgcactctaattcatcatcacattaatttgcaaaaagtgacacaaaattaagaaatggaaatgaattgcaaaaaaaaatattattattttttaaatttagcttttggtaaatcgtttgtctgaacatgccgataatgcgtctgcttctgttgctgctgacgatggtgttcagcaggacattggtccgttgctgatccgatgctctttggacattgtcgcgggtttgacaatcatttaaatgttttaaaaatgaaatctaaatttatttatgagcaaaccaacagcacatattgccttaaattgtgcatattatgaaaaatctcctaagatatacagacagataattaatataataaaataaatgataatgttcaatgtcgaaatgccgatttccgattttttgggctcggaattccgattgccgaaattttttgacagcgttggcacacatccattgtgctataaaaaatgctaaaatgttacagagattagcccaactcaaaacactaattacttttaaaaagtcccaaaatttattttgcttattggcattggatgccgttctgcagggggtttattcagatttatacgttttccagaggccataatgggcgttcgattggacgctgccaatgccaaatgccgcgaatatgtgcaggcggtcaaagagttcaatgacttggcacacatttactcgaccagcgcactgttcacgtttattccgatcagttggcatttgtttggccgtgccaaagagacgaaaaaatgtgtggccaagctgaagcagttcaccagaggggtaggagaacaggcgaaaatttgcaaaaaaatacacaaaatttggtatggcaaaatgcaattggaatgaccanagaaaatgataatgataaaattggataattttattaa

SEQ ID NO: 15720 - DNA, 1270 bp, Heterodera glycines
gatcagagaactgatcactttatggccaaaacagtttggagagaattaactgacaaatgagtaccaaattgatcggaactaaagaattgtgataaatcattacataaacggatcaaatcgattttgcaagggctaaccaagttcaaatcagataggtttaagaaaagtgacaagttttatgcagcttaattcccagttgattgaataacgaatgatcagtcaaagcagtgtgacaagaattatcagccgagatgtatcaaagtgatcggaaataaacaatagtgataaagtcattagacaaattgaacaaattgctttgccaatgtatgatcaaattcaatcctaagtaggcttaagaaaagtgttcaatttgatgcagctgctgattttccaggtgattgaagaacgaatcaaaatcagagcagcagcagaaaaaggccaaagtgaagaagccgcgggcaatgacagaaagggggaggcatttttggaccttttgttggagatggaacacgcgctggacagggaggagctgcgcgagcaggtggacacgttcatgttcgaaggtgggcccggcagggagggggagagaaggcaagtgcccggggcatcacctaccacattggggtagatccactcattcataaacccaactcatccatactaaacttatgtatatccaacttatcaatactatcatcccatataccacccaactcatccatgtacaataaatgccaaaacacagaccgcataatgcaagaaatgccacggcacggactgcatattaatgagatggatatggatgaattggatttggatttggatgagctggatatatcgatgattgagtttggatgaatttggatgagttgggcatgattcccacacatttgtcacattcataacggaatgccaattttttaagcaaaatcggttcatgatttaattaaaatttgtgaaaatttcgcaattaccgttcgcctagtcaatgaaatactttttatttgcccaattaatgaaattaattaataaatttttggccatgacacctccgcccacgggttgatctggacactgtggtgtttggccacccacgcaaagtgccaacaacagctgcacgaagagattgtccagcactttggagcggcgacagataaaaatgtgaaaatgccaattaaataatataattataatttttaaaacctaaagaagtcgagacccattcgagtagagactgagattctcgaaaccagtaatgctgctgctgtct

SEQ ID NO: 15721 - DNA, 4059 bp, Heterodera glycines
  misc_feature (1294)..(1294): n is a, c, g, or t
aaaatggaaattgaagagatcagatccttaattctgcacacctagacttgtaaatgatgccagatttgctaactttaactgaaaacgaaaaaagttatcgcgtttcaaatttggcggcgccaaaacggtccgcgccaaactgaccacgtaaatgccattggacgcgtaaagccgactagaaccgaaattgcaatcaaaattaattggaacaatttaagtggccatcgttttagactcaaaaaatataaaactttttgttattaagttttgctttcattcgtcatttaaccattaaaaagcatagaaatcataggcatacaaaaagtaaacaaaacaaaatgtccaaattgtcttccctgagcaaaagtaacaagaaaaaagcactccaagtttatttctccgatggcattgccatttcaaccgccactcgctcagccagcaacgtcaaggtcagatggcataatctcagcaatgcctatgatgccccacgccattttctcggactcgtcagacacggacagtttgattctcttctccgatgggccagcgactaaaagtcattgaattgccattaaatgaagagcaaataatagaggaaaatacccgagccttctccggttttgcacgggaccgagccttctccgggtttgcgcagaacaagcgcacggccaatgatggagttgacaccaaacaaagaaaagtgatcacatgaaaactcaaaaatgtcctcgccgccaatggtcgaagaagtgtcaatttcaatgagaagtgaattctgaaaatggttttaacatgaaatgaagggcggggggtgggggtccgaggttcaagtacaactcaacgagcagctcttgtctgttttttgtaaggctaacggagcatgtgaagagatgtggaatgataccaagattattaaattcagatgacaaagaaaaatatatagtcaaaagagttgggctcgcgccgaaacggcggagccaaaacaaccctccccggcaattctcgcccaacaaaaccttctgttcgtcagctgcgaaaggagtaccgacggagacggagccattggagatatcaccgtaaactgaaaacatataaatgaacggaacacatggcgatgcacgaaccgtaaacgttgatttggtaaacgttttggcgggagagtccaaacaaagtgcctttaacactcaaagaaccaccagcatactaaaacattttcaaattaaagtcagctaacaattaacataaatgaattataaacctgcgtaaatgcgacgtggccgtgtattttcgctgngaggacctcatcggacaacttacaaaacgcctttttgaaagaaaattggagttcctaaattaactaacattaatcatgaaaatcaaaaaagcaggtgaaaaccaccgggaatcccccgctttttccgaatttttcacccctctaatttttgaaaattcacattaaacaacttacattggctaagcgcaagacagcgcccaattccgcaaaaaaatttttgcagtcgtcgtgggaagtgcctgacacacactgccacacttcagcagactcggacacaacaatttgttgataaaacccaacaagccgcatgaaaccctgaagaatcattaatttgaaattgtcttatgatgatgccaacagagatgaattccggcggcacgccgctgccaagagtgccacctccgctggccgtctttttgcttccatccatttccaaaagatttttcgtcgccagcaccaacagcaaacgagaatcgggatcgaatcccgcggcttggcctgacccagccgccacatttccaacaacgccggcatggcgatcgtcctaaacgttcttttgtaaatattccgcaaatcatccattcattcggctcagcataaacattcccatcccattttaataattgaagtttatttaccactggcagttggtccaataattttgcgaattcgttcaggaaaagggaacagttcgtgtcggtggatgcgccagccaaaacaaatttccaggccgtggaagcgcgtgcttttttcagcaacggcggtaagcttttaacatcctaaatttacttgaaattatgcatagttaaaaacgaggtaacattaatttaaaatcacatttaaggaaaagggaaaaccaacatatttacagcatttggaatttaaataaaacaggaggataaataaacaaaacaaaacaggaaaataagagacagagcgattacgagcagagaaatcctcagaacaaacgcaaataatcaaaatcaactcgataaaacaagtttcagaccaaacaacagttaaacagcaataacaacagagacacacgaaaagcgaaaaaccttacagaaagccaaactttccaccacaacgcaacccgaggtagcatgaaatttcttaaaatgaaagacgagaaacaaatgttcgaaaagttgtgtgctcgacggacacagaggaccatttcgtataaaagttcgggtgggatcggacgaggggccattttggtgttagtgggggcgattaattaggacaatgattaattttttgacattgtaagaggcgtggaggtcattgacgaggtggtaactgtaatcaaacaatttattctcatattcaaatttaacgcctgagggtactcggcccacccaactcatttattttgggaaaaatataaaattgaaactcacaatgagttcacccattgcctgcgtcaaggatggcgagagaaataaaaagcaaataggtatttaaacgctaaattaaaaaatgctaatgaaatgtcgaatgaactatgtacccttatttggtagctaacaaataaggaatcttttccgataattcaaatgcaaaaaccaacgaaaaaaagaattatttttaaagaattttgtgggaataggataatcatgagcagcagaaatggattctgttataaatgataatttcctgcgtttgactgggcgaaagatggggagggaggggcggataaatggattgagaaaatttgaatagaaagacagtggaaaaggagggggagcgaaaaacgaatggacaaacagagggcacaaagaacacaagtgagacaccaagtgaacggggaggggagagagagtgtggaaaaagaagagggcacaaagaaaaaaaacacaaatggggtaccaagtgaacggagaggggacagagacggatagagagagtgtggaaaaagaagagggcacaaggaatacaaataggacaccaagagagtgtggaaaaagaagagggcacaaagaaaaaaaacacaaatggggtaccaagttaacggagaggggacagagacggatagagagagtgtggaaaaagaagagggcacacggaatacaaataggacaccaagagagtgtggaaaaagaagagggcacaaggaatacaaataggacaccaagagagtgtggaaaaagaagagggaacaaagaaaaaaaacacaaatggggtaccaagtgaacggagaggggacagagacggatagagagagtgtggaaaaagaagagggcacaaggaatacaaataggacaccaagagagtgtggaaaaagaagagggcacaaagaaaaaaaacacaaatggggtaccaagttaacggagaggggacagagacgtatagagagagtgtggaaaaagaagagggcacaaggaatacaaataggacaccaagagagtgtggaaaaagaagagggcacaaagaaaaaaacacaaatggggtaccaagttaacggagaggggacagagacggatagatagagtgtggaaaaagaagagggcataaggaatacaaataggacaccaagagagtgtggaaaaagaagagggcacaaagaaaaaaacacaaatggggtaccaagtgaacggagaagggagagagacggatagagagagtgtggaaaaagaagagggcacacggaatacaaataggacaccaagagagtgtggaaaaagaagagggcacaaggaatacaaataggacaccaagagagagggaaaaagaagagggaacaaagaaaaaaaacacaa

SEQ ID NO: 15722 - DNA, 1379 bp, Heterodera glycines
ttctctgatgaaaattggaaataaatttgatggatctttttaaaaaggaacaataatttgtatgcaaaaaaatttaaattaacaatttcgatcatttaaaatattttaattttccgcttttccattggcatttttaattttgtaagatttaataaaacaatttttacaatataagggctaattatgtatttttcggggttgttggtcacaaattgacattcatttcaaccacaagccgttgagccaattcgaacaaaaagtctaattttaagaaattcacagtcgtgggttaaagccaatttaaatcctgttgaaaacgatccaatggagatcattactgcaatggttgttatattaaaaaaatgtacagcagggctcgtatagttgaactcggtttcagcgcattttccattttcttagtaaataagggcaaattttaaaaatctttctttgtacacattaaaatttattcagatccaataaaaaaagatatgtaattattcaaatgaaatgttatttttcgtcagaatgtgtttttcaaaacccgatgagcaatttcgccttaattaatttttgcaacggggaggggagagagtggcgatgctaatagaagcctccggatgaattttaaattaggtaatgagatttgttgacagaaaatttttttcataaaacggacatctttacattcataattcaaaatgccgacttccaaatgcattattacatacatttatatacaaatattatgaattcaattttagggcggggattatatgcatatgcatatttttcctgaactgtggaacgccttaaaacgtacgaaaaacttattttgtgtagcttgctttgacacttctatgacgaagttcacaatatgtatatcgatcgttggatttatatgcattttcatgtgcatagccaggcctgtaaccaaaaaaaaaaaaaaaattcgggagaccgaagagcactgtctattttttttgtccagtgctatgattgagtaaaatttaaaaaattacccatttttcggaaaaaaatttattctttcatttcggagggggggaggggcaattgcccctggtcacgggcagcctcagcctatacatagctcacacatttgtacacatccatattttgctggtcagttttctgatgtatttgttttgctgttattgattaattctctcattttgcattcgtccaaaagatgaacttttgttaatgaatccccaaaaatttaaaaacgcgaatattttggttctttggtgccgattgacgcgcttgaatgatttaaaagaaaatcttatgccgttttgttaacaaattttgcaccaaattaggcaaaaacaaattttcgaaatttaaatttgacgtaa

SEQ ID NO: 15723 - DNA, 1054 bp, Heterodera glycines
gaagaattgcaaatgttacgagcaaaaattgccgaattggaaggggcgacgtcaattgcgagtttcgatgttttggcaccgaatggaaatggtgaaataaataaatgatttcttttttagtggattttaatgagaattaattactaatagaagcgatcaatgaaagtgacacgtgctttggaaaatttggtggtgttgatcagcagctgaaggtgagttcccgaatgtacttattctgagatttgaccttgtataaaagtcgctgggaaaattttcaaaaattttttcatgaagttttattaaaaaaacagtttttttttcttgagaaatttctaattgtaagtttgaaaatttaaaaaaaaaattcgcgcgggtggcagcaagggggaaacgagctgcttccaaaaaattacagacgaaatttgttgttttcatttagaactttcgtggacaatttgtaaaattggaaatggaattgagagaaacgaaacaaatgaacgtggtgacaaacttggaaaatgtgagtttaaaaattagacagagacagttaaaaacaacaaagttcaaattttcagaaggctcttcaggcggagttgaagcatcagaaactgttgatgttaaccgaacaaaaagcgatggaagagaaaattgccaaaatggaaaaggaacagcagaaaatgggtgggagagaattgacaaattaaatttttcaattttttgtttaattttcatttaaataattgcctatttgttccagctgatcagttggcacaacgacaaaatgatcagcaaatgaagttggagcagttcaagcaaaaaaatgcaactgatttggaacagttgaacaaatcacaagaagggattctcgtgaaaattgatgaggtggaaacgaacgaacgaacgcacaataattattaatgggaaaaataattaaaaattttccaaaaattgtttggtgttttcatatagttggcccagcaagtgacgaactccgagctgtttaaacaggcttttcctgccaaatttgctggaatggaaaattttgttggcgttt

SEQ ID NO: 15724 - DNA, 1226 bp, Heterodera glycines
tttttgactttttgtttccaagatatgaaattagtagaaatggacgtcgattcgtgatcgtcgatcctgaaaaccttacgaaacatatttttattgtgaaaacaattttttttcaaaaaaggtgtgaataccatcggcaatgttacccctaattcattttaaggtgttttccaatcctccacagaattgttgggatgtcactgcttcgcacaatgaattggaaatttttgggcccgagtgtctgatggtccattacaaatcagaaggaaatagcggcggtaattattttttttaattaaaatttcccattatttttggatattgttttattcttttaattagagattggacaaagcgtattgaccggtaaataccggagaaaatccaaaaaacgcagataaaattaagcttgtagggaccgggattttgccgagactcgtggttcaggtccacggtttttttggacaaaataccgggagtcccggaaaacgtgaatctcgggaccaagtccctgtccattttctaagtaatggcaattttaaaatccgggctctaatagaaatttcgaccatgctaaacaactaatattggagaatttgtgtcacggaggaaaacaaatttaaaatgttttttcatttttttgatgtaaaaatgcgctgattaccaacctgacaatagctcaaaattcttatgaaaaaacatactgagttttttcttgaaaaatttctaagttagtaaattttttaaaaaattcacggggggaacgatgcgggaggggggggggggacaagctgctcccgagctacggacccgaattcgaacaaaaagtcgaaaatttcggttttgtgtacacattccaaaattttaaaaaatatgtacaaatgacgcacggagtttttgatggaacaaaaggaataatttgccataaaatggcaaaaaaaccctctgttttgtcttggaaaaattatttcttttgtcccgtcaaaaaagtgtgcatcctcacatattttttaacattttgggatgtgtacacaaaaccgaaaagtaccttaattttaaaataaaaatgccaaaagatcatgtgcttgatgaaaaacttacaaattctgacaatcagctcaaattctttaatcaatgcatttttacacaagtaaaattgaaaaaaaattaatttattttccgccagggaggccaattcagcaatattattattaccttgaacatta

SEQ ID NO: 15725 - DNA, 4016 bp, Heterodera glycines
  misc_feature (1790)..(1790): n is a, c, g, or t
tccacttgggaagtagtcggccaatatgagcaacgaaaggacatttttcgcttaaatttgaaagtaaataattgcatctaattaattattgtaagcaaatttacgatttggcaaaattggaaatagaagagcattggtcgaaattgcctccaaaaagtccatgaactgctccatgtcgatgcccaattcgttcaaagtgacgacggctgctgcttcttcttcatttccacgctgagcattcgacggaccatcggcaattggcacataaaccaagcagcggacaccgtaatctgagtatccgtttaccaattttttttcaactgaaccaatactcttcctttaaattctcaaatgatcagtgcttattgactcttcacctttctgttaccaatgtgcacggtcaaatcgtcggctggcgaactcagcggagggcaagcaagggctggagaaatatttaaatgaaaaaatgatttttttttaatggattttcacttttcgtccatgttttcacgttttttgaaaatccgtaccaacactgagtgaaaatattacaaagtaagcaaatcactggcgaaaaataagttgttggctcaaaaataaggcattttctaaaggcgattataatgccagcagagaatttgcacattattgatcaaaataagtttattaacaaatcaattttatataatttatcattttgagtgtgattagatgcatctgaagtgtgatacaacaatcagtcaaaaaccatcaaatgaagtttttttgatttaactttgctcaaaagcaactaaattttaaaatagcgatatcttcaattgcgcaaaattttaaaaaatttcgctaagtttcaagaaagtaatgaaaaatattcaaaaaaaaactaggtgtgtttgttttgtttctcaggaaaataactttttcggttgttgttaatttgtaagctagttttcgagttagccaaaaatttggaaaactattttcaactattttggcgttttgcagaaaatttgttttaaaaaatgcaataaataggaaaaatacaccttaagaatcaacccaaaaattactgaaagaaaaagctaaataaatcaaaaatttctcaaaattttatcgacaaattttttatttgttattaaaaacaatgtttgattttaaaattgtgtatcttaatattgaaatggcttaattttgttactttttggatacaattttatgattttccttctttggcacctattttttgggtttttagaaactaaaaattaactattttggcaatttttaccaactgaaaaatagtatccacaattattaaatttgaaaatgaacctacagtatcggaaaaattgttttatgcgccgacctaaaattgtttttgtctcgaaatgtctaacgactgaaaattatttcatatgaaaatgtacgtgggggcacttcacaaaaaagtgcaaaattcaaaaatttaattttcatttgtttgagaaaatttttaaaaggtaatgggggcggggtcaaaatgttgaccaaagttgaaggaaagaaaaaattaaaaaaattaaataatatttattttaaaaaagactaataatttcttctgtgtcgtagtggttagtttattgtattctatacgttctttcaattttgtcacttttttcaataaaatatgttaacaagtaaagcgtttatttgtaaaacattatagtatttttcatgcttttttaaaagtaaaagcatttacacaaacattggcatcccaataattttgtcggaaatttaaaagagcctanaataattcatataaaattattttaaaatgaaattgtttaaataaaaatttaatgaaactatttaaaaaatatattttttttacttcttagctcacctttctctgcttttgttctttcttcaattcattgactttctccaataaaaacttttgatcattttgcatttttgagaattggtccgaagttgctaaaattaattttaaaatataatgggcataaattaatattcttaattcaaataaattccttctataaaaagaactttttaataattgataattttggtattcttcgcttaaaattcccccgcctttggtcgtgttttcgtgctgctgtttttgctgcttctccaattcactgactttttcaaatagagtcttctgatcattttctatttttgagagttgatccgaagtagcttaattaaatttttgaataaaataccaattaaaaccataaactcatttttcagcttttgaatttgttgtcattaattttatcgaattattcaataagaattccataaaattttttcaatttctttcattttttttcatttttctgttcaattttgatcactttttccttcaatgccttctgttcgaccatcatttcctgatgctttaacttttgttcaagtaccttctaaaaataattttaaaaatttcttaattttagtcgaatttttatggcaaaactcctcacaatttcgagttccaatttggccaatttcaattccatttccatttttgcaaacttttcacggaattcctgaattttattaattaataaaaattttggtacttatgtgtagggtgtgtaattattagagctcggataaaaaggcaccaaaaatcgcgaaaaaggcactataataggcaccaaaaatttgaaaaaaggcaaaaaaggcacgaaaatcccgaaaaaggcaaaaaaaaaaggcataataaaagtcaacatagaagcctcaaaccaagtggaaaatgcgttatttatgcttaatatatcgaaagaagtgcgcagaaaaaaaggcatatgcctcaaaatgcgagctctagtcataatttagactaattgaccaaattttttaataaaattattgataattttaaagattttttgaaaatttttgtgaaaacctttgagcttctgaagaaattctcgagaaaaacacagtaataatcattcacataattaattatccttttgaattttatatcattagaaagaggagacttcattgtataaaacaaaatttttttataatttatattaaaatttaaattttttgtgaattttttaattttacatgacgggaccaaatacatgggttgcaccacggatgaatttacgatttcttcccttagtttcatcgtatatatgatgtcggatatacgatggtcggttgttaattgaaacaaaatatacgacatcggacgttttttccatgatgttacgatgatcgtatatacgacatcgggacgatgaattgaaacagaaatatacgacatcgcatgttttttattgaaacagaattacacgatgcgatgtcgtatcggagatatgacatcatatcggagatacgacgggaattgaaataggccccggatattcgataaacgtgataattcaactttcgtttgattccaagaatgtatgtaggtaggcattgatcagtaacaaaaaatatatatataagacgaaaaatatttaaaaaatgaagagataaaatatataggtatttgttccaaatggactgtgttcaaatgcgaaggagtcggagcagtatcagcacagttccttcccttccttcacaagtatttcacaatggacactgtccgtttgtcgcccttttggcgtccgttgcgtttggcttcgtccgtcgtccgttcactcttctgcgcccattgccattgttctgtttctctcccttccacccccttttcctcgtttcgtttccaccgttccgcccgggtgcccctcgggcagtgccgtgtacatctccaggcatttgcggaattgcgcgtttttgtagcattggctggagcattgggcacgcaaattggggttcacgtgggagaacattccgtggcacagttcacacaattggtccgccattatgcgcattatcgggtcgcgttcagcctgccaaatttcccccatttttccctaatttttctcctttcaaatgccaaacatttcttcgtcgtccgattgtgcagtttt

SEQ ID NO: 15726 - DNA, 2472 bp, Heterodera glycines
ccttggcatttgccatggtattcattcccaaatcaagtattggcgctttatctatggcccccaatttgcccaccattttccgagttcgtccgcctgtcgaaggcccagcggtgacagaggcgagtcctcccgctccaactcgtttttgtcgttgctccagcttttgtcaatgatgtccagcttttccgcatggcgaaccaaataaagcgtttgccgcactaatgggcgtttatctaagaaaaagtgcctttggttaattggcttattaatccgatgttttttcgcccttttcaccgatcgtccaaaatttgctggcctctctttgatcattttctgtccattccaatttgactttggccaattcatttttgatcttcctaatggtgtctaaatgttcttggaaggaatagccgatttcattttcgaattcctgtggaaaaaagtattggtaaattactgtaattaaaattgaactcattttgtttaaaattggtctccaattggaaagtgatactctccaaatccgcttcagtcgcctccattttcttctcatatctgctcatgtcgaacacttttctctgcttctccaaaatgcgtattatcttagcatttttaaaatttgtttatttttatttaataattttaatttgatttatttttaacctttcccaattgtttctgttcagtgttattgagaaacatatcaagaaaatattggacaattgtgatgttttgggcacgaaatatcagacgaattgtgttcaaaagctattcaaaaaaaaaactgaatggaatgggtggataaagctaacccggaacttcttgtagtaattgtgaacatttgtctgaatgaaatgaattcaaaagccgatttaggcactcaatttggaaatccgtacacatttcttcaattcgcttagtttggcattccatgcgtttattttgctgcgaatttgccggaagaaacgatttggcagcgaaaagtgtttctgagcgtcgccgaagcattgcctctgctcgcccatccagtcgagcagcttctgctcatcccttttgatcactcctcgcgaatggtcatcggaacagtgcacaaatcgaagtccatccaacaccgacaattgccttttggtggacaaatttgtgctattttcagaatgccaaaaaacgactatcaatagcccatatatcccttggtctcggacagatgccattcattgttccagcctatcccttccccaaaagccgtcaaccttcaaattctaatctgtgctctcgggaaaatgctttggtataggtgcattaatgagagcacaagaagcagttaaataaacaaattttatgttaatcagtgccattggcagatggcaaatgatcatttgtgattatttgattagtgcactgcacttaccaggaaggcctttctgagtcggagtttaccccaatattagaggaggcaaaaacgacagaaaaacgacaaaaaaaggcagaaaaaggcgcagcaaattataaagcatagcaaaaaaaaagaaaggaaaatattaaaaagcaaaatgtgaaaatgactgaaaatagaaatatttaattagaaaagtcaaatgaattggggagggatttggtgggtggacagccaaagccacgcgaattggaaaagcatcattaacattgaagggattgattttatgtgcatgacaaaaatattggaaattcattttgtacaatttagaaaaataagaaaaaagctttttacgaattacataaatcaaagaagaaaaaaaggaaattatgcaaattggactcaaatcagttggtaacatttttttgttgagggcaccgaaaatggacaatgaaaaatttggcatcatgaagattggcgcccggaaaatgagtcagtggaaaataagtcattagaaaatgctaagtgataaaaaatattaagttcatgggggtttcgaggtcgctgatcatgaatccggcacacggaagattagacaaatgttttgttaaaaaaataagaattaaataaaaaataattggtgtatttttcgttttttgaaaccccgaatatggggtgtatttgacaaatttttttgccgtttttcaccaaaaaattaacattttttgccattttggtctccatttttcaaaaatatggtaaaatgggcgtccggcggtgccgataggagccgccgggaaaatttttgagaattttaatgcaattttgtgaggaaaattgcttaaaatttcaaaaaaaattactgaaagtttttactgcaattattgtaagtattacccatgctgtcataatcttcattttgctgctaaaaaaccctcatttgggtcattaagtctcattaaaaaatttcaaaaaagaagcaacagtgggcatattattgtgtcaaaatgataaattatgagaattttttttagacttaattggaaatttcaagaaagcgtcacatcttttctgactat

SEQ ID NO: 15727 - DNA, 2265 bp, Heterodera glycines
aaaaaacccctcatttgggtcattaagtctcattaaaaaattcaaaaaaaattactgaaagtttttactgcaattattgtaagtattacccatgctgtcataatcttcattttgctgctaaaaaaccctcatttgggtcattaagtctcattaaaaaatttcaaaaaaaattactgaaagtttttactgcaattattgtaagtattacccatgctgtcataatcttcattttgctgctaaaaaaccctcatttgggtcattaagtctcattaaaaaatttcaaaaaaaattactgaaagtttttactgcaattattgtaagtattacccatgctgtcataatcttcattttgctgctaaaaaaccctcatttgggtcattaagtctcattaaaaaatttcaaaaaaaattactgaaagtttttactgcaattattgtaagtattacccatgctgtcataatcttcattttgctgctaaaaaaccctcatttggggtcattaagtctcattaaaaaatttcaaaaaaaattactgaaagtttttactgcaattattgtaagtattacccatgctgtcataatcttcattttgctgctaaaaaaccctcatttgggtcattaagtctcattaaaaaatttcaaaaaaaattactgaaagtttttactgcaattattgtaagtattacccatgctgtcataatcttcattttgctgctaaaaaaccctcatttgggtcattaagtctcattaaaaaatttcaaaaaagaagcaacagtgggcatattattatgtcaaaatgataaattatgagaattttttttagacttaatttgaaatttcaagaaagcgtcacatcttttctgactatgaatgttacaatacattttattcaaaaagatgatcttgaaatttgcgagcaactttttgtgtttaatcataaaaaaaaataaaaaattaataattaattaaattccgtccattcatttttatttaaaagatatttatttactcgcaaccttttgttaattgattttcttatcatccatcattattcattcacagtgttttctcatccattctcattcctttcgcatattttgtcaaagcaaatccaaaccaaaacaaaaaattgcattccgacgaccaataaatgttgaattattattcaaataattaaaacgttttaaatattttaattatatatagaatttaaataaaacatttatatttgtatttttatttgttaaaatggcggacaaccaaaagcagcaacgattcaaagggaaagttgtcatcataactggtacaaataaatgttatttcaaattaattaatataataataaataaaaatttatgtgtgtaagaaaaatctcattatcactgaaattaattgccaaatgcaaaagcattgattgattctttgtgaagggtccagtgcgggcattggccaagcggcagccattgaatttgcgaaggatggcgccgttgtcgttattcacgggagagatggccaacgaataaatgtaaaaaataaaaatgaattaaaatattcaattaaacaaattttatataaattcttaattcttactcaatttggagatgaggaaaatgggaattgatatcaaacttcgaaccttttttaggagactgaacaaaaaattttggctttggaagtgccggcggatcgaattttgaaagtgcaggggccaattgaagaggaaaaaacggcacagaaattggtggaggaaacactgaacaaatttggacgaatcgatgtgctggtaaagtatttaaaagtagaggagaaaatggtcattctgtacaaattcaatcacaaataaaatttaaaaaattgaaattttcacctttttgttcgaattcggttccgggattcggaattagtcaaaaagaatgtttgtgataggcgaccccgaaaagtccctataattatgtttttacaactttttaaagcaaaaatttttgtgccaaaaaaggggggtggggtccattaggcagtattaccattgccataaaaaaatattggatttaatatacacaataatgccaatatttaattgtttcactgctgtttcggataaacaatgccggctgcacctctaagccgggcaatgatgagccaatggacatagtcaatttggaccacatttataacgtaaacaaaaacaggtccaacatttaatttaattcagaaatttcaaaaaaagagatttaaaaaattaatttgaatgacagcttttatgaaa

SEQ ID NO: 15728 - DNA, 1959 bp, Heterodera glycines
  misc_feature (36)..(37): n is a, c, g, or t
atagaagccaacttttgcacgctgttgtgatgccgnntctgcagttggacaagcgtataaatgctaaaaagtcattaaaataaaattcgtttattgctttaactttattttcttttcgaagtttcagtggaatgccaacctgttcagtgccatgtccaactgtttttccaaacggcaaacccgcgaatccaattggctaagcatctgaaatgaattatgaaatgtgataaaagtgttttaaggtccattcaattcataattgtctatttcgtcctttgtcggctttttgcttgtaattacttctctaattgattttggtcctttgtaggctttttcttagccatcctttgtttcttctgatcattccccttttgacttgcctgctccaatttgttgctgctcccagccgatgtccgaaggtcggccacagtgttgcgcaactctttcagttcgttggccaccaattgctgctgatgatttccatcatcgccagcaccgaaattactggcttgtgttgttgtggccgttgttagcgatgtggccggcgacatttccttaaagagcgagcaatttatgagttcaccaattaactaattggtcaattaatatttcccaagttcttaaacttgtgcgttcaagccaaccttaaaaagctgtccgaccacctcctgcggttgctgttgctgaacattgtgtaagtgcgtttgttcagccattggcgttccgtttgctgaggaaatgcgcaacaatgggttggtgccgttgttgctgccatgtgtccagtttggcgctgttgctgccggcggtgtcgaagcggggaatttgtgtgcattgcttgccaaatgggcgatcaagtcgcgtgcttgaatttgtaaagcataaattaatattaggctaacaaaatggaaatacttaatacaaattgtgtaacaattttattcacatttcagcaaattccctcttaaattcagcccatttttaatggtttaatattttatacgttttctgaagtgttttccgcacagctgacattgggtggccaatttgctcgaagcagcggcagcagaaacagccgcagttgaagaagcatcattttgatgattctgttgttgttgttgttgctgctgctgatcagtcaatgaagaaacttgctgcaaaatgcgcattatctcatcattggtcgcctgcatttgcagcggattggacagatcggcggaagagtctgagaaattatcaaggtaaacaggcacaaaatatcatgtttaatatgcccttcttaggagaagcagtgcattcaattgtggtcacttttaaaagcggtgatcactgatcagaagcaaaaaaaaagtgggaaaggcatttactgaagaagtcatgaactaaagccgggaattgccggcctaaaccatttttccgaacaagtaattttaatgatgggtgaatgccacacttccctcacctttttgttgtcctatggcaccgcaaatgttcgtagcccgtgaactgctaagcagcgttttggccaaaactttgctgtccatttgtccaaaaagaagagctttgcacgccgccgcagccaaagcatttgtgccggctgaagattcaaccggcaaaatcgggctttgattgcccgaactttggcattccgcccctgaacaatcttccgcactggtgccatcggcgtcagactgagaatttgcatattttaaaaagcccaaaatttgttttaccacttcattaacgccagcgtcggaagtacgcctttccatcggttcggcgtctccgctgcaaatggcactttcgcagtgctccaaaaggcgttcgttggcggtggcgctgttcatctgctggtactgcttgacgacctgtcgttgctggctgttgttctccggcatgccgttagtgtcctcattcgattggaaatatgcaaaatttgtttggtcctcctcgcatttgtcc

SEQ ID NO: 15729 - DNA, 1668 bp, Heterodera glycines
  misc_feature (24)..(24): n is a, c, g, or t
  misc_feature (74)..(74): n is a, c, g, or t
  misc_feature (1528)..(1528): n is a, c, g, or t
  misc_feature (1606)..(1606): n is a, c, g, or t
  misc_feature (1633)..(1633): n is a, c, g, or t
  misc_feature (1647)..(1647): n is a, c, g, or t
aaatttgtttcgtcctcctcgcanttcgtccatcgcttcctcagccttcagatccaatgagccgaatcgaggcncaatgacaagagaatgccggggccatcaaagttctgaatgtaaatgtttcaatcgcatgaaaagacaaaaaaaaaaaaaatgcatttaaaatattttctcaataaggtaaaaattattttagggtttacagtcaatttttacaaaccctaatactcgagccataaaatcgtcaataaagcctaatttgtaggaaaaattcttaaagacccaacactgccaactttgaggatttttgctgaaaggctaaaactacaaaaaaaaaccaaaatttttaaaaagataatacaaaataataatcatttcctatataacaaaaccattattgattaataactcaaaaagattagaatatccaaaaaaagaagttaaattataagaatctgtaaaacttcaaaaactaaattaacactaagatttatgccgtgatgtctttgcttccaaggacgaaacctttaaaatgtcaatactaaatctaatcaattttaattatgtttgggtgataaatcacttaaaatgatcgatcgattgcacttacccccgccgttttgctgatctgtgccgccactgtccgccgattggttgctgccaggtgcggtgtgcataaagtgttgctgttgtgcgccattattctgttgactgttcccgccattgttcaaaatgatcattgacttctccagaaattcaatggcctgaccaaaaaataaaaataaaatcgtcaaaatataaataaaagagattttaaaataattcgtttatgtaaaattaaaatgtgtgcaccgaccgcggggtctttcaccgattttttgccctttttgatgatgtaatcctcggtgccgatgtattccttctgctcaattttgtggtgtttaaggatgtgtttcgtcaaattccctgaaaaatttaaaaaataattattatataaaaataaataaataaaattggtttgaccctttaaatttacagttatcccgtttaaacattcctataatcctcccaaaatcacctttaagccgcgatgatttgccacaaaatttgcacacaaatggcttcaccgccgtgtgcaccgaccgatgctccgccaaattcgaacggaatcgaaaagccttgccgcagatttcgcagacaaaagctttgtgctgggggtgctgctgcgacacatcgccgggctgtggaacgagcgaaatttgttgctgctgttgcagcattaaatcacaacaaatgaaactgaaaaaatatatttaataattaattaaaatgttcaaatgatgaaagaaaatcaaaataatttcataccgtaaatattaaacagaattaaattatttcgtagtttttaactttttaaaaactgccgtttatatgtgtgaaataaatccaaaatggaacttataaatcgaacaaagaaggcaaaaatgtatttgtatgaatgtacacaaagaataacatttttggtganacattaaaaaatgcagaaaaataaaaatgtaaacatttgtaaacagctgcaggtcaacctttttttgaacccggttgngaaaataacaatgggcaaatacctatntttctggaaaacangttcacacataacacataatg

SEQ ID NO: 15730 - DNA, 4429 bp, Heterodera glycines
aaatcattcacgtaaagaaacattcacaaaaacattttcccctatttatttgtggcaaaaaatcagaaaaattacatattcattccgaaggtcatcgaattagcataaaaataaggacaaatcttcgaataaggacatatttgtgaaccctgtgttatgcgaccactaatagagataaactgagtcataaaagccgaatcctgcggaaatgccggcttcgttcacatgcgaaagttttgtgcggaagtggtacccctgctggacattgtgcagcactcggcctgctttcaaatcgccgatcaaaaagccgtaaatgccgagttcggggatcacttcctccaatctcgccgcctcatagggtctaagcacgtaattctaaagaaaggccagtttaaaattggttaagaattttgttgtaagaacccggttaacttgatctctctccattccgcgtaaaattaaaatgaattattgggacaattaaaatacggcaaatttttaaaggcgtaattgagcactgtcatcataaaagaaatgaattaatttgttaaatgatggatttgtttggtatcataaaaattcaataatttcaggcacaattagagaagtgttgagcaattctaatagttatccctattttataattttaccttcacaaccattgggcgcagtttctgcatcaaaatgtgcgcacctcgttcagtttgcgtgaattctttcagcttttccaccaatttatcgtcataataattatgtcctccgcattccctgttcggcttcagcacataattgcccggattttcaatggcatcctaaaaaacagttttttattcaaaaaatgattaaagggacgaaactcatttgaaatttgaccaacttttaatgaaaacgaaaaatggttaaattaaacgaaaaaaatattaattgtatgaatgccttcacatacaaaaataatttcgatgggtctaagacaggaaaagggagtgaattatttgttgacctgataacaatttcagaattattattaaaattaaatttgaataattcaaaatatattccaaatcgactcattaagcagatgttttttacttcaattagcttttccgtgtcgttgtcctcattctccaggccccaaattttggcaaaagtcgctctgatttgtgccaccgttgccgcgtcgctaggctccgggaagaaacgttcaatggcacccggcatggtgagcatctcagtttttaaaataatcgatttttaggtttttacattttttgaagcctaacatttttcctatttcaaatttattttcttcaattggtcaatttgttttttaagttcagctcaaaaatagcacctgctgcactttcttagagctgctaattgccacagccaaggaaggtgctttctgtgaataaacaaatttcataaacaaatttttattatgttttacaattgccgtggacagttcaatgatttgtcggaattccatgccgaggtcgtcaaatttgcacccaagggcagactgtcccgaataaacaatggcaacttttcgaccgtccagacgaagcgaaaagtcctccgggtccaattgcaatcttaattggaaaaaacaacgtaatcttttgctaatctataaatttataatagccattttcaccgttgtgccaaaaaaataataaaaataaaaaagaattaattttattttggtatagattaataaaattgtattgaacatttatacctggttctatttccgtatttaaaatttgctcagtttcttataaaaatttaaggcaaaattaatgtatgtttaaacgtttaaaagaattttttaacctatttttcacaattttgtgcgattttaaaaatgcttttctgccaccttttcgtgctgttctctctttccgaataatcggccaacgaataaatttcgacgtccattttgccgctcgatttcttttccagttcctccgcaatgtatcgcaagtcgtattggaatgggtcgttgctgtatatcagacaaaccattattgcttttgggtcatcgaatttgcgcctaaataaatttaaaaaatgaaattttgaaaagtgcaagaatcagaattgccgccgacaacagcagcaaggttttagattcaaaaaattgaaatgtgtttttaggaactaataattccgctctaattcgaaatttgggtgtttttaacaatttgaaaaaacaataagtaaagatcgaaaaatccatttaaaatatgttcataataatttcactagagcgttgcttacttttaacttttaaattccttcacttgtcagtaaaaccaaatggttagaattaaaattgttaattaattttggagagggaacaacggaaaagtgcctaatttagcattaagaaaaagttcgaaaaagttagtgaactgatgacgatattgtgtcaacggatccactcgtaaaaaagctacagacaaaagaccacaaggacaaaaggcgctcaattttttaataacgatttagaattcaaaaagcccattaatgaaggataagaaattgcacaaaaagcacattcttaccatgccatgtaaaatgtgtcgatcaaagcagcgtccggcttgttgtccgggatgttcgctgtcgttgcgtccattccggtggcctttttgagcattcgccggtgaaattcggtggtccgtcgcttgagcccagttgctccgatggcaccagtgttgacttcgacctaaaagccaaaataaaaaatgcatataaaaatatgagtcaattaattaatttaaattaatgtcgctgattttataaaataaataaatgaataacaataaaaaagattaacgaaagaaaatgttagaatttgctttttcacctgttttggctcatatttgacttcgtttgtttcattgttctccacaacatctaataaatagtcctgaagaaggaatgttatgtttcatttttaagaaataggttttgtatatttttaaagcatcttttattcgtcaaaattattatgaaccgtgaaaattgaaatttatttttgcaaatattagtaaaaataaaattgagtaaatatttttcgcaaaacattaaaacatttttaaaattacaacttactttattattccaatgcgaaagaataattgaagcactattttatcattttttatacttaaacatctctcattaaaaatatttggtatttaaattcagtttctaaaaatatttgccataaatagattattttattccatttttgtattatatttcttatatttttttctgcccaccgctctctgcagcatcacagtgatcgtctgccgaattccctcctcgtggactttcttcaaaatgtccaccaatttggcaatatgctcgtcccctttgatcacatctttgtaggcattcatcaaaaattcatagtcacgcgcaacgcgaaaataaagcaaattcatcgcctaattaaattcaagataaattaaattatattaattttgttttgctccgaatttaaatccaatttattaatgatcaatcatatcatttaatattaaaatttatttcatcaccttttgtgctttcagcgcttgttcaaaagcgtcgcgtgggaatggcgacggaaacaaagtcaatggaggaaatagggcagcatcgcctcttaaaaatcatttcaattagaatttaaaatgctaatttggattttcgtccacctgttgccctcatcctcctttcgccttaaaatcagtgcattgttgtggcaccattctatggcatactgtgccatccttttaagttcaaatgcgcctaaaaataatttaaaacaagtgataaactgttgattattaattaaaatatgtttaagttattcattattttaatttaatctaagcatattataaattaattcaattttgaaagttgtgcaaaccaatggccaaaagttggtctttggcttcattatcatcttcatttggctgagtggcatcggcaaaattgacacagcaaatcacaaacaacaccaccaataatgcgctaccaaatgcaaaattaaatttcgccattagaattttttaattaggaaggattttataaattggattttttgttgaaaaattataaatcttgtccagtttaaataggaaaattaggcggaaatgcacaacattgagatattttatcaagccggaagcaccgaattgtttggctttttattgggaaacggatattcaaaaaactcggagaaaataatattggaaataatatttttatataaatttgtcgcctcaattaataaacatccgaaaagaatgagcaaacaacccatgagaatatattgcatatttcacgtgagcatgcaattttttctcaaaaaataaatccaaataaacgaaagcccatttctataatttttattgagtatttgaaa

SEQ ID NO: 15731 - DNA, 1138 bp, Heterodera glycines
gggggaagggcagatgagtggggaagggcgagaagaaatgccgaggacagagggggacggacgcaggggagagaaacgagcgacttaatgccaggaacagggggcgaaggaggggaagaaatgccggagacggaataatgacagaaattattctggttaaagcgttggaaaacgacgcttcttctccatctcaaatggagcaaatttcggcacaaattttaggcatgaaatgcaatgggaggtgcaaagcttggaggtgaaattatggaaatgaacagaaggaagacggaagagaggggaaagggcgtaggggaagagagagtgttacgggtagagagagcatgagaggaagagaagcatttgaggaagagagagcattaagggggagagaaagacttagggggaacgaaagaggggggggggaagggtaatgggatttgcgcggatggatggctttaacagaaaaacccacaaaggaatattcccaaagtttgagtgtgaaaaaacaccccccccccctccctttgcccccccccgccatcaaacgctttttcgggctcaactaaaatcgaataaatctgaagaacaaagattgggttgtgcgagaaagtaccaaaataaggcggccaaatgccataagtggcacacttaaattgtgcagaattctttttttaagggaggaaaagaaaggaaaaaagggggagggggaagctcaatgagtgccaaatgggaaaatgaatgaattggctgctgctgtgccgctcccttttggtgacaagatgcttttcctcgtggtattttcgtggagagacaatgccaaattacataatagccgagaagggataagagaggcggaaggaatttgtcaacagaaggaggggaattaaattaactaatgactaatgacataatgggccagtggcatattttatttttgaggccgctgattgaattggtcgagggccaaaggagtatttttatctagcaaaatgaatcaattttcccatttgattttatttttaagttccatatttgccaaaaatttcgattgtctttgattggaaaagcagaagaagcgactcagatcatcgcagatttgaggaaaatgaggagagacccataatgacggccttgtttt

SEQ ID NO: 15732 - DNA, 1681 bp, Heterodera glycines
cccccccccgcccattcccatctctttgccgtctcatatttcacccccccccccccccgcgggggaaaaggttgattttttttctttgctcgcgtgaatgaacaaatgtatcccgagcaaagaaagagcattcattcaaaggaaggccaaaaagaacaaaccgcgcgaagggagggaaaaaggagaagcgaaaaaactaaattaaaggcaggtgaatacagaaggggtctaagaaagtaagccgattttcgaagagtgaaaaagacatgcagcctaaggcatcttcgaacggagtcttttgccaatctctcccccttctctctctttttttcacctttttctctctctccccgttttttcccttttctccctcccaccctgctctttcttttcctctatctgtctgttccaaattcccttatccgtctgtttttcataaagttttttcttcatttgtttcatttaaagtttgctaaagttaatttttggaaataattaaattaataacggggagagagaaagagagagtgtgggagagaggggaggggaagggagagagtaggtgagagtgagaggagaggggaaagaggaagggagagaaaggagaggaaggggcttgacacctaatatataactgattattttaaacgtgcttaaaaatttaaaaaatgatcgatttgattgtcgaaataatcacctgagaaagtgagttgtggtataatacaataattgaaatataaaaatcacagttgttgcacaaaaacattttggcactgcaacgaaggaaattggcatttcaaataaatgacagggaaaatgccgctgggatgggtcggatttcgctgcattgggtgcggtaaccgcctcggcttggaagaaattggagaaacggaggaggaggaagcgaattcagacgaaacgcaggtgaaattagcggaagaaatatgcagaagaagcggtggcagcagtgcctttcttcatttctttttcggcattggcaaattgccattcattcgacgagcaaaaaaaaaagaataaatacatatggcattttcttaaaatggcaattcattgccgacaaaaaatgttgtgagaagtgagaagactcaaatgaattggaaaagcctcaaaaatagagatcggcacggtcgataatgttgagttttaggtatgtaggctttgctaccccccataaaaatgtcataatcacgacaaaggaaagcacttttcggctctattccagggatgcgatctgttctgatttgaagggtccaaatctgataaaataaaaatgttctgatttgtcagaaatgttctgattttggggtagcgaccaaaatttgttctgatttcttaaacaaactcataattttaaaattttatggcctaatgtcactattttacaaaaaaaatataaaatttatggcaaaatttggtcattttttggacaaaaatctgttaacaaatcagaacgaaattacaaaaaattttccggcggcagcctatcggcaccgcgcgaccctcccgccctcgcctcatttcccaataaagttttttcggaaaaatgcgccgcaaaaaattctgtaaaatctgattttttgatcccgattccactgaaatttacgatttgttaatttcctcaccaaactttttaaagatgataatggaggcgaaaaatata

SEQ ID NO: 15733 - DNA, 2241 bp, Heterodera glycines
aatacgcccctaaaaataggaattttcaaaaggctattcacaaacttgggtaacttaattggaaaattttttgttatatatatatgtgtacaaatttctaattgaattgagattttgtcattataaaaaacattaattaatgttaaaattgaacacaaaaactgatggggtgaaaataaaattaaataacgaagacaacaaaattgatgtcactatcggtcactagaaatcactattttggcgcttcgtcactaaaatagtgaaaattcactattttggcgttttgacactattttttcactatttcaagattttggaaaattccttaacaaaaatgcaataaaaacaaaaaacacacccctaagaatcgacctaaaaattttaaaaaatacacccttaagaattgaaaaattttctcaaaaattcatccgctaaattttttttcttgcaataaaaacaaaaaacacacccctaagaatcgacctaaaaatttttaaaaatacacccctaagaatcgacgaaaaaaatttcaaaaagcactcctaagaaatgaaaaaaattttctcaaaaaggtattttcgtggcaagaattttaattttaaaaattatttttttatgtacctattttgtttttttgcccttaaaaatcccagccctactcatttgcaacgggaccaggtcgttttggcgccgacgatttgggatttggcgccgacgttttggcgccagggtcgttttggcgccgacgttttggcgccaagccaaaaatgaaaaaaaaggcaggaagaaattgtaaaaattataaaaaatgaaatttttcgttaaatataataattaacaaaatgaagaaatggaaacaatttatttggtagaacattggaggtgccaatgagaatgtgccgtctccgaaacattctttcatttgatcagcccaccggccgaagctggccttcatgcgttattttaggcttttgttttttcgtatcaatttgacgattcattacctaaatacaaaattaagagaacataagccaaagcgaaaaagagaatgaagaattaaatccggctctttgatagacttcgtcagaaaaattataacgatttcatcatttctacctcctccctacatggcgccaaaacgtcggcgcaaaaacgttttggttgttttaatctattttagaaacaaaaagagaattttgaaattttttattttcgattttttgttcgaatttcggctccgggttccgaattggtcgaaatggatgcctggttcgtgagcagcgaccctgaaaaccattggaagcatgttttcatgacttttgaaaacaaaaaaattttcttcaaaaaaggggggcaaccaaccatcggcagtattaaccttcgcgaaaaatacgtttttttttgttgttttacaaaattcttaaatttgggtgtttttcttttttttattatagcttggcgccaaaacgtcggcgccaaaacgaccctggcgccaaaacgtcggcgccaaaacgatacggacccaatagtagggattagagtgccacgggaccgggccgggaattcccggtcatccgaggtcccggtccccggtcccgggtttgaaaagctcaggtcccggtagggcaaccgggaaccgggaaaaacaagcactggtaagaatgggggtctgagtgcaaaaattagtgaagaaaattggagtcaaagggaaaaataaaaaataataattaatatattctttaaaagtaacactggccaagtgtgcaaatggcctaatggctagtctccttgactttcccttcttctttcccctggttcaatccctctacagaaattaaattattttgaattttctttttgtatactcgtgggtttcctatagagaaaatatgattactcatagttttttttaaattgatacatttttatcattttttaaatgaaaatcctaccaattgagcttaataatcgcaaaaaccaacctttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaa

SEQ ID NO: 15734 - DNA, 937 bp, Heterodera glycines
taatttggggcgctgatcacgaatatgacatttatttttcaaaattccgaatcccgaacccgaattcgaacacaaattcgaaataataaattacacggaaatttttaaatcttttcgccataaaatcattaaggcatattatttcttttaaccacttttattaaatatttaaaaaaatttatttatcaaatacaaatacaatctttttgaaaatttatatgataaatctattttttagagcgcagatatttttttaaataaatttatcaaaattttcgtaaatttttccgttttttcaatccttcaaaatttcttccacaaaatgtttcttccattttgaaatattcgttttaccaattttcaaaattttttcaatttccgtgtcactcatttttggattttctttttttattttccaataaattttcattttttcaattttttgttcatccgttattcttttacagcgaattccaaattgtttcttccaattttcaattgttctatggctaactctgactttcttacaaatttcggcataatttttctcccattcatttggcgaatattttcttttttgcttatattcatttttcatttcaataaatttctgcacaattttaaatttttcttcatcactttttgatttatgacatttatttttttgaagaccaaattctttgatccattcataaattttacttcgatttgtgcccaattttttcgctatattcgcattgattttatgccattcttttgttgagtattttcttcctttttgctttattttctcttttattttataatattttccaattatttctctttttttgagttcatttcgtttttcgtcttggaaggcttgccatttttctcctaaatatttcggcaaaggacttgaaggcaatttttctttctgatccaatttgacaattaa

SEQ ID NO: 15735 - DNA, 3789 bp, Heterodera glycines
  misc_feature (1034)..(1034): n is a, c, g, or t
gtcggcgccaaaacgatacggacccataattagcattcccaaaagatgattttttttatggttatgaggatacaagtgtaattgattcgctgaaattgctctaaagcagttacttatgcttgactattgacaaaacgcacacaaacatacctggacacaatgctgttgaacaccaagctttggtaggcgtggatgtacctgtaaaaggcaaaaattatagaaaaaaattgtaaaaaaaaaaataattttcggcgccgtacattgtccgcatgtcgcgatgcaatgccaaaatggccgccttgtgcccagccgggcatttggccaacgcggacaacagcgcacgctccacggtggcgccggcggacgcgttgctgcgctccaacattcgcaacgcggccgacgcgttcgcggacgagccggcgtagcagcgcaggcatgcgttgagtgagcctggacaaaaacaaaatgttgttgtttaatgaggcccccccaatcatagaaaaacaaaaacaagcaaaaaaatatatttttttaaattttcttgaatttttgtttttattttgcggcgacattatatcccggcgacgttttgtgcctactccggcgtggtacaagcacaggagaatgatttattgtttgaaatatgtttgtaattcgttgtaaattgttgttgggaaggtgtgatgccttcccggggggatggcacgaaattccattccaaacttccgatttttgaaaaaaattttgggccttggaatccgtttagaaatttttcgtggtctgggttccatccctcgcgcaccgtttgcctccgcccgcggggccaacagcgcagcggtggccgcctcccattgttcactgagcaacagacggccaatgtgtgccgtgtcgacgccgcaggtgccgaagcgctgcgtgccaaaatagttgaggaacccatcgcgcgtccattgcgcaatgcgagcaccgagttgggcggcatcgacggacgacgcatcgacatccctgtgggagaataataaaatttatacatnttttcgggggggggggggggggtaaagggatgaaatcagagtttaacacacacaaaaaaaaagtttaaggatataaataatcaacatggtcatggttagaaattttcaaaagaaaaaattgatgtaaaattattcaaatttattttttaattgaaaaaattggtttaaaaaaaattttttctaggggggaggagggcatcctgttaattttcctaactgctctggacggaaaagtctaaaaaaaatcccggcaaccgtaaaattttatcgtcccaaataccgactaaaattttgtgaccgcctcgatatgaattttttttcttttggcatcaaacccaacaattttctcaactcgcggcatactggtaccaactcaagacaaatttccgtaaaatttgttctccaaatgttgtcccgtaaaacaacgttgaaacggttgccacacgcgtcgcccaagcgcagcggtgcgctggcgtagcaaaagtcgcgcagccaaatgccgcgcaatgagcgtgcggcggactccaagcggcccggctcgacgcggaaggcactgacgcgttgggcggtgatcgcacgccggtccttggtgccgctcagtgccaacatggacggcttcaacctgtgccaagagggggtgggtggggggggggggtaaaaacgcgttttgtatcgaatttaatatagggacgaaacacacacacataaaacgaaggcgcaaaaaaatgcagaaatttcacaaattcaaatgaggaatttttgggggagtagccggccccggaagttttttttaaagtgattttctaattatataattttcgtaaaacaatgatttttttgaaaccctgaaaaactcaaagaaagttgtgaaaattttttttaagttgcaaaagaaacaaacaaaaaaattttttttttttggagtatgagggtatggatggatagtccgacccaacattttgcgcccgcgaaaggaaaactcacccgaacatgaatcaaattccaatttttcaaaaaaacagacctggcattccgtgcaatcagatggacggccgcctgcgagtccatgttccgtttgaccatggtaaagtgcacaaaatcgccgcgcccctttggccactgtgaccaccgttttgttgaactaaaaatcaaaagggcaacgaaccattgtcatcaaaaatcatccgaaaaatggcaatattgtttttggagaaattgaatttctgcagggctacaccataacaaagaattaaaggacccaaaaaaaaaaaaaattttttttttttttgaaaattgccaaaccttcgtccattggcgcccattcggcgaactgtcagttgtccgtccacacattccgtgtccaatgcggaggcgtcaaaattggcccggatgaattggtacaaatttttgcgctcctcttttgaccaatcctaaaaaagaaaaaaaattgttcttttcaaaaattaggtaattgggtgaaaaaaatttttttctggaactgcgacccaaattggggtaaaaagtcgaactcccttttttttttgtaagaattcgggtccgagactcgggagtcggaaccgagcgacccaaaaagacccagcaaaatgatgcgtcaaggtatatcaatttgaaatgaaaaaggtcgccaatgcgaaccctaattggaacaaaaagttaatcggaatttgctaattgtaaatttaaacgaatttctttgaattaagtgtgcattttaaaacattttgatttctcattcgaattcggcattcgagttggtctaatgaatgtcaaatttcgtgaccaacgacctcgaaaagccctacaaaattttgaaagttgaaaactccaacaatcgtccaaaaaacaaaaagaaaaccttcaaatcgatgtccattttcctctcttcgtctgtcccagcggccacccgttgcatctgatcaaattgctgatcagtgagccgtgtcggcttctcccctttgccatcgtccgacggaggcacagtcgtagtcgttgttgcatcttcttggcacttttcacattccgtgccgggggcacgttttgggccgctggcgccgccgcactgttcggcctcaacacgtggccatcggacggaatttcgatgacaatgaaatcgctgtacaaccgcttcagcacacaacgaatttcgccttcggcaaacgcggacgaattggacgcaattcagtgaggccaaacattttgaaactccgaatttaatgatggcgctaaaattgaataaattctttatgagttttatgaaaaaatgtaagggaaatagaaattgtagtgtttatgccaggagtgtcattcgtccttggatgccaaggacgtccctggattagggcgtcgacgattgaaaaattgaaaatttccaagatgtccttggaaaacaaaatttgaaaaataaacattcagtaaaagcgttgccaattgtctcaaaatggcaaaaagcggtgaaataagaaaacgaggagaaattaaaaaaaattggaaaaaattcattccggcgaaaaatacaaaccatttgaataaaacttaatcaatttttcattgagtatgataaaaattttcatgcgtccttggatttcacgattttttccatttttatgtccttgggaatcataataccagtcttggaaagcgagtttttccaaggacacagccctggcttatgcagttgtaaatcaagaaattttggaaaaccacaaaaaatttttaaaatttaaatgaaataaaa

SEQ ID NO: 15736 - DNA, 1199 bp, Heterodera glycines
ttggcattgccattcctccgtcattgccattcctccgcgttgccattcttctgtcattggcattgcaattcctccgtcgttggcattgcaattccccgtcgttggcattgccattcctccgtcactggcattgcccttcctccgcagtgccattcctccgtcgttggtattgccattccccgtcgttggcattgccattcctccgtcattggcattgccattcctccgtcattgccattcctccgcggtgccattcttctgtcattggcattgccatttctccgtcactggcattgcccttcctccgcagtgccattcctccgtcgttggtattgccattccccgtcgttggcattgccattcctccgtcattggcattgccattcctccgtcattgccattcctccgcggtgccattcttctgtcattggcattgcaattcctccgtcattggcattgcaattccccgtcgttggcattgccattcctccgtcactggcattgcccttcctccgcagtgccattcctccgtcgttggcattgccattccttcaagtcccgtgcttccaccacgagggcgtccctccgcattgaaagggcgtccctctcctccagcaatcccaccaactgtttgttggttctgctgaccttcctgtccaattcgtcctttatttgtcccaattcctccactcccaatttgctcaattgctttcgcgtctttcgttccatggcaatgcgatggcttagcaaaatattgtctttttgaatgtcctcaattcgaaaagtctgatgaaaaagcaaggataaattaaaagaaaaaggaaaaagaaaaggaagggactaaaggacggccaaatggaaaaagaatcgataggccgaaacgggcgaaatgggcaaaaagcggaccaacggaacaaaacgaaacggcactaatcgaaatgactaaattcaattaattttggattgatccgtcccttcccttttcttcccttcccttcatttttctctcagttttgacccaatttcactcatcgaaatttacttagattgcgtaaatcgcacaactcctcgaccccttcgcccttcgtccgtcattttgggtcagtccttccccccccccccccccctcctcttcgctgcgtcttttggttggcgaatgcgatttcgaaagacttcaatgggcatatacgcccgggggg

SEQ ID NO: 15737 - DNA, 1838 bp, Heterodera glycines
ttcctgcggtggtccgttggtttgccccagcggcgtctctgtcgccacgcgcgaccctttcaaatgcccgcagaaagcgtcgacggcgaagggccgccgatacactgataaattgggacgatcattgtacgcgttgactttggcagctaaacagaaggatccgagttactgcttgaagaacagcagaagcgatgtgaagtcagtgggaaagaccggcaatttaatgagaattttgggtggaaaagaaagtggggaaggaccaaacaccaaattaagaattacaaggacttaaactcttttaagacggctacttattgctaaagttattagagctcggtattttgaaaatagcttgggcctgaacccgtattccaaccaaagattaaaaaaatatatgtagattaccgtattggaaattgtttgttattttcttttcatgaaaacttcaggagtccttttttcggggtcgatagtaaaaattagccattctaaaagagcctcttgtccttgaataaatttaaagtaacatattaaagaagcaagaaaatggctttcctattttaatttttcttatatatgtttcggacccaaccataagcagtcatgtccgagtggttaaggagattgactagaaatcaattgggctttgcccgcgcaggttcgaatcctgctggctgcgaattttttttttttgtaataaatattttttcagagtgatcaaatattacgaagttgaatgtgatcaggccaaaaatacttgtgccggaatgatagccgtgtcggaggaagccaaagctttgtacgtcatttatcgtgactcgaccatcgatcgccagctattgcaggtcgaacatttcgcagttataaaatagtccgactttttagagaagtcccctgacgaatgtgccggcactttttggccaggtgaaagggacacttttgttgtcacattaacacaaaatcactttcagagtatttgattttccaattttgtattttaaatactttcaaattacacttcattttgacagatcgctgcgcaattcggcgcctgggaaaaattcgtaaatgggtcgggagtaatgacgtatttccatggagcatttcgtagccttttccttgaaggaggaatgaaatcgcaacttatgaagttgaaggagacgcatgagagacaccgaatttgggtgggaaatttttcgacgctttttctctctctcgctctttatccccttctctatgtccctctctcttctttctctctctcactctctctctctctcccccagtctctatgtctctctctctctctcttctttctctctctcactctctcccagtctctatgtccctctctcttctttctctctctcactctctctctctctctcctccagtctctatgtctctctcttttatttctctcactctctctctctttctctctctctctccttctctaccagtctctatgtctctctcttttctttctctctctctctttctctaccaatctctatgtctctctctcttctttctctctctcactctctctctctctctcctccagtctctatgtctctctcttttatttctctcactctctctctctttctctctctctctccttctctaccagtctctatgtctctctcttttctttctctctctctctttctctaccaatctctatgtctctctctcttctttctctctctcactctctctctctctctcctccagtctctatgtctctctcttttatttctctcactctctctctctttctctctctctctcctactctaccagtctctatgtctctctcttttctttctctc

SEQ ID NO: 15738 - DNA, 1399 bp, Heterodera glycines
  misc_feature (1244)..(1244): n is a, c, g, or t
ttgacatttaaaaattattttctgatgaaattaaatttattttaatacaaatatatttaataaaattattaattaattattaattaattttgtaaattttttagtgatgcgtttttttgtcttcgtgtctgtcgcgcctaattaccctaattaccccccccctgcggcgattgttttgtgactgacaaataattgtaaaaattttatgatttatataaatttaaattttttaggctttaggctctaaaaagaaaaacctagaaaataggccctaataactcgaaaagtaccttaacaaccaccaaaaaacaacaacaacttgtttttcgtgtatttcagaccatagggagctcagcaaataaaaattgaagccctagtgatgaagtgtgaaaacatccaatgggacgtaattacgaaatggcatttgaaattatgatgaaattcatggcttttaattattttaatattatttattaatattttattattaagaaaatctattgatgatcagtttcacttattgatcgcatttttggcaatgcttctccacattcattaaaatgaaataaaaaattattttccgaagaaattagcttaattttaatacaaatatatatattaaaaacttattaattaattatttattatactttttttagtgatgctttttctcctttttatatttgtgttcttaatcataaacaattcaactgacaaaacattgtcagttaatctgtgtaaaaaatgtcgaccaacttttgctgaaatatttggcgaagaatggcaaaatgaaataataattggaggagatgaaaatgaaaatgagactgatcaaaatgcaaattttcatcaaaatgatcaaaatgaatcaactgatcagaacgatcaattggatgttcaacaaaaaatcgaaattattcacaaatttcacgcaattagagaaggaattaagaaacggggaaaatattcggcaaaattttgggttaaaaccgagcaaaaaatagcggaaaaattgggaattagtcgacagaaaatttacaaatggaaaaaagaatttggaatttattattataaaaagaaaaaacaggaatttattgaacgaattgatgaatttaaaagaatgtccaaaaatggaaaacagaagcaatttgcgaaagaattgggcattagtgaaaaaacattgagcaaatggaaaaaggaatttggcattgaaattggcaaaagtaaattttaatttaattttncattttattattaatattaaattttattatattcttaggtcgaattcgattcaccgatgaacaaaaaatgagcaaaatgaatgattattatgaaatgaaaaaagcaaatcctttctttaagtgaccaaagaaattgctggcaattttgaaaattg

SEQ ID NO: 15739 - DNA, 1280 bp, Heterodera glycines
  misc_feature (126)..(126): n is a, c, g, or t
atcacgtatgaaagcgaccttacctttttcgagtgtgtacgagtagctgattttcgcgttgcccagatgacggaaagtgggcacgtgaaaagcacaaattaaaatggattcggcattgcaacaatntgagcaatcttatagaggactttgcaaatcgtgactcgtttaaatatttacgggcctgttcttatggctcgaatttttgaatttttttagctaggtgtacgcttttttaataattaattttcactgacgaaatcactcactgacgaaatcaccgggaacccattaaatgaatgtatttagagatgcaattataacatatatttaggccaattccttctctgctgttcaactttcgttcgattttgccaataaattgttcagtgtggcacttccacttcgcgaattttaagagttggccgcgagcgttgtcggggtcggctcgagctgaccatatcggtcggggcgggtaatggtctcgctcttttatttaaaaatacaaaatggaaaaagaccagatcagtcattacgaatgtttggcaaaatttgacggagatcattggcaaaccgtcgctttggcgcgactcaatcggacgcaagtccaatgcaaaattacgccgggcaatgcacaattgaaattgttggccaaagccatttcctgtcaaaaagcaaatggattaaaattgtctttcacagctccgttctacacaacctccctcctcattcgggttccgactttcagccgttcattgattgccttcgccagtgcactaaacgcgggcagagacatgggagggtcggatacataactgatcagccattgaaacgggaggagacccacctaggcgggggtggcgggaattttgatcactttagagtaaactctttttttgcatgagttgccttttgtacttccctcacttctttgtctctcttccgcttccctctttcagtctctcttttctctcttccccctcccctctttcagtctctcttccttctttctctctcttccctgtttgtctctcttccccttcccactcttgctttccctaccgagtagcagagcaaattcggatgcgcagtgcgcagcactgcgcatttttacgggcgcaataaaccgaacgattgacggctcaggaaaatcactacagaaaacagcggacagcaggtttacaaagcaatgaacattgtttgttttaatacgatctcggaagaattaatttctttgaaatttaattttagaaagattcatttttagcatcagctccgccacg

SEQ ID NO: 15740 - DNA, 1092 bp, Heterodera glycines
  misc_feature (17)..(17): n is a, c, g, or t
attttaagaaggaaatntcggctctaaatggtccgggattcggaattggtaaatgccggattcgtggtctgcgacctcgaaaacctttagaaacatgttttcatgatttatgaaaagaaaaaaaacttgaaaagttaatggggacaaaccataatagagtcagaaattctgttatttccctgaattgaacataatagataatttgatatatggaaactgtcaatattattgttatttgttatacattgatcattccgttaatttaggttgacgagcatgcggttcgtattgccgacaacgtttttaagttcgttgattgggccacttttgtcactgcgcgccgtcatttgaagtctgacccgaacattcgtcatttgttttacagtttggatcctgcaactgctcaacagcttggcattgcgttggaaccgaaaataacgacgaccgttatcactttttggtcggatgtttctacccgttaccagtctattccttatgagttcttcgaattctaaaatgatctgttttgttattcatgaattttgttgcaaacaaagattatttatattttaattttgttgtggtcccttggaattccaaatccttgaatactctaatttgcttttcaacaatttaaacgatttgcgttttccacgaatcgccatgcctctgtttgttgtcatatacatcgagactaagaaagtcaatagaaatatttgaaaaaatctaattataaaaaggaagaaaatattcagagaccggttaaaatagttttggtacattcatattcaacttttttgttgtttggtttatttttttaaaccaacaataaaattaaataacaaatctggaaattttgtcagtgaattgtagagaaatttgataaagaaatgattaaatgataactcaggcacaaagacaataaattagaaaaatcaaaagctatggaatatttccaattagacagaagacacggagatgagctttacgggtgtttgttgttgcttcttttgagcatggcttttacaatttgcgccacgactttttcacaaatgcagcgcacaagcgtaatttctcaaatgcacgaagcga

SEQ ID NO: 15741 - DNA, 2716 bp, Heterodera glycines
accatttcttcgatgtcagagtttacttcgtccgacggatcaggaaaagggttgtagttttttttagttttagcaataagaaaaattcttttgctgtaaaataaatgaaaatcaaatttcgtttttagcgttagcagtaaggtcaatgagtcggaaagctacgacgcgaccacgcttggtaaattgatgaacctcgacgccaaagtggttgaatggctcgagaaagggccatatactgacgacgatccgctcttggttcttgacttccttggtccgtttatcaatcttcatggcgactacaaccaaaacaaggcctttttggtgcagaagttggtatgtcttaacagcaaattaacatgaaagcgggatcaaattcaaaataaaaatttcaatcagaaagtagaaaatttcatggaaaatttgagggttttatcacaaacaaaaacgtgtcgtgctacgtaattgaaagtaacataatagaacactacgtagtacatattatggttggtataaatcgatcatttcgttattaggttgccgctggaggggctataatcgccgcgaacgtggacaacgttatcaaatttgcgacctgggacatgttttacgaagcgcgtcgcattttgatggcggacctggaagtgcgtcactttttctacaatccaaatccggcaattgctcttcaaaacaacattaaccaatttccgatcgtctctacaaccgtggttacgttttggtcagatgactcgcttaaattgaagacgcagccgtatcagttcttcgagttttaaaggatgatccattgttcattcatcattttttgttgcaaataaagacttattacatacttattgcctttaaatcatttgagtaattagattttaatcatgtacctaaatttttcaaatagggttggtctgctgggtccaaattgatgcttttggacccagtcaatacagaatcgtgggtaatactgacttttactggtcccataaaaaaaagaataaaaaggctgcttttctacggttcttctttccatccgggggttatcggggccgctgatcacgaatatgacatccattcgaccaattctaaacccggacccgaattcgaacagaaaatcgaaagttcaaattttcgaaatttggatttatgtttcgaaaatggtttaaatgcacggaaacaaaccgaaagacatcattcctgtaataaaaagtcatgaaagcattttaagacgaaaaattcgtaattcgtaaaaatgtcaagtttcaattttttgttcgagttcgggtcagagtttgggagttggtcgaaatagatgacatattcgtgattagcgaccccgataactccacaaaacatattttatgcctataattctaaaaaatgaaaaaaatacttgaagaaaatcaaagacttgacaaaaaaatcaaagattagatgatgtcatatgacaattatgatatcatattcgtgatcagcggcctcgataaccctcgaatagaacgaataatcgtaaaaggccgtctttttatttcctttttttatgggaccagtaaaagtcattattaccggaaattttaaaaattttgagcggtttttttctgctcttatttaatcttaaaaaaaaattttttttttttggaaatttccaaacatttaaaaatagatttttcaatacttttcaagcctttagaaggtcaggaaaaagtaggacaaatcttaaaaatccatgtctaacaagtttaatgggttcaactttgggtaatggtggagatcatgagactatgaatatcacaacataactgcatctccttccttctcagtcgtttccgacattcgccacaaaattatattaagaactttgctgttcttttagcaatacatggacgaatatatgtgccgccagttttatggaaaaaaacccttttggcattcgaaaatatttttgtccatattggtcagttttatgttgtcaatgcttaaatattgtgcatttttcgtgcaataaacaagccgagctcatttttgagctaaataattgagttagaattggaaaaaatacttgatgaaaaatcatagacatggcgaaaaatcatagatttgatgtcgtcatatgacaaatctgatggcatattcttgctcagcaccctcgataacccccgggtgaagtgcaaaatcattaaaatcgggctttttttccctttttttatgggaccaatgatctccaccaactttgtacatagctttttctatagttaggaaatcctaataaagttgtttttacgtgtgtgtatgtgtgtatttaaatgttttattaaattaatttaagaaaagtttattttaaagcgatgtcaacgtcagaagtgaaaccggaagataaatcaatggatgaaactagcaagaatgaattgcgggctgaggacacttccattaaggacaaaggcattggaagcgttaaaggttttattacttcgttatcaattttctttcgtttttagaaactgaaacaaatggcgcaataactactgacaatgaacctaagattcacgcagaaaagaacgagactggtgatgctgcagttggccaaaaatcaaccgaggaacaattcgacaaaactgacgagaaagcagagcaacaaaatgtgcgtcacttacctaaaaacaactgcctctttaattaatctgctcgacttttcttaattcgtttcaaaatc

SEQ ID NO: 15742 - DNA, 3767 bp, Heterodera glycines
attaaacactcaattttaggcaaatggtcaggactttagctcattgttgaagcccgttgtgtacgagagcccagcttacatgtaaaaattaaaatttaaataaaaacaaatttttaaaattattttaggcccctcaaagactttggcatcgatttgaatagcattttcccgcctttgttcaattttaagcgtcgttgattcatttttttgtttctgtgatacaccaatatatttgtattcaaaatgaattttatttgttgtgaaataaatttcaattcatggaatttcgaaaggattgaaatggcacggcattttgggcgatgcgcgacaaattgatggggtgaccgggaattaaaatttagatttttaaagttttaaattgaaccatccctttgttttttgctaaagatttttaataattttttaagtgactaaaaaaattaaaaaaaaaattatttaagttttgccaaattggagagagtttttgagcaatttaattacatatttgaattgtttaaattcaaattttactcagtttgagcaaatatttgtcgaccaaacaaaaattaaaaagaaaataccgcttttatataataataaaagaacacaatcaaataaatagctaggacagaatatgtaggcacttgaggattcgagagtgaaaagcctattccgaaaaaaaaacaataacagaatatcaatggagaaaaatgaatgtgttggcatggcacacaattagagtacgacctgaatccaggcttggttttttccaggaaatccaggcccatgccgtttttcggcaacctgggtttttgtccgggaaatctaggttcaggtccaaaatgaaatccatgtccaggaccaagttcggcacaaaaaccctggattttctggataatattttagaatttaaatttcgagtcattcttttttatgtcaagttgtcaaaaaatgattaaatcgattttaaacatattattattgacaattaattacttttttcatatatttagttacttttttaaacaaatttcaaaaaatccaggtccaaaatggaatccagcaggtccaggcttttttcaaaatgtcgaactctaaacacaatacaacaaacggactccggcggaacggcgatgaatttgaaacattttttaaattcatttttattatttttttaatacaatttgaaaatgcaaggtgagcaattgtttttcaggtggacatatcaaatcactcatcagttcacaaacacaaataaaataattaaataaaacaaaataattgttggcaccatttgagctttaatagagaccggaaaaaagagaaaactggcaattgtgccattcaaaatgatcagaaacggcgcggagttgaaacgtcgaggggcgcaagggactcgttgtttttgacctcctccaacccctcctcttccttctgctgctgctcgtcatgttcatggccaaagaagcccaagttggacggcgcgccgccgtcgctgacaatggccgagtcgaacatcactccgccggcactactcgtcagcatttcggcactgtttgagcacctgttgtgtgggcaaaagcataacatttttggaaaccttgggacccgtatgcaggtcatgcccccaccgccccggcgtcgttttccgccctccgaaaattaaaataaaaaaattttcttataagtaaattgaagaaaaaaaaattgaaaaattttcagaattttttggaaaaatttagtaattaaccataacattttgaaaaaactttaaaaaattttcacttttcactcgtgttttcgtataaaattttttggaaattttctaaattttggaaattaaaaaacaaatgcatggacaaatataaatagtgtcgtgccggtgccacctttgctgcgtagaaaaagcggacgtcgatgccaacgaggagtggcaactgatcacactgtccaccattgccgaggaagacgacgtggcggccggcgtcagcagcaacgacgacttttgctgttggcacggcggcaatttttggcactgagcaaaaatgccatcctcctcccaaccgtcgtcggtggtgtcgtcggcggaatgttgttgttgtacagcgaaaatgccatcatcattgaccttgccctgcttggcatcgttgttttgcttagccggcattggcgccgaaaccgcttttgctgctttggcattgcgcttctcgtgcgtaaagcgagaatagaatgccggattattgttgcccccaaggtgctgcttgtcatcgttgtcaacggcgggcgtggacgagaagttcaagctggtcagctcccagaggccgtgcgatttgtgctggtgatgatgatgcgggtgagggagaagttgtttttgggtgatttcgtgaaattgcaatcagttgaggtcgtgaacagatggaggaggaggacatctcggagatgtccaaatcgcttctgaaaagcacaaaaaagtgcggaaaattttgatatgttttttgcagaaaaaatgccgtaaatccaaaatctcgtaggagtgccgaaaggggtgaaaaagggggggggcaataatacgggaggagggtgaactgctcccgcattgtgattgattgatcagccccactttgagcccgctattctgtacgccgccgagccgggtcctcgcgtgccaccagcgccctccatgtccaaccagcagcgccgtgccagccgaccgccgccactgttgctgaccatcgacgaggacacattggtgttgacgtcgagccggtccaactcgcgcaactgaaaccgaatcgaacaataatttgatcaaatttatttttgggaggaaaaacagcgaatcgttttctcttgctgctgatcaattagtttatcaattctagccattaggagatgatcggttatggaaatgctagcaaacgaaaatgcctactaataaatcagttttttatgaaaaatggacactgatcagtgttttttttgcatgtgtaaattgttgatcaaagcattgttttcagaatttccttgtcaatcaataaaaaaactcattgtaagtcaataaaaaatgaattggacagcaacagttttgtgactacggttttgttgttgctgtgatacattgtcaagggcactgtccaccagccgatgctccgtgccgtggcattcgtcgccgccggtcgtccaattcgtcgtttcctccccgtcgccgtgccgccaatccgtcggcgccattccgcggaacattcgctccaaatttttcattgccgacagctgtgagaggctgcccaaacttgtgcaccgctcacggaacagaaacagtccttggagagagagagagagaaagtcaaagaaagtgccgaaaaaagcgtcgtttccccccccccctccgaaaaattaaaaaaaaatcgctgataatgttttcgatatttttttcttgtaattttcttaataagaaatttcctattttttagaaatttttcggggggaaggcctggaggggtctcgacttttcagacatacccgagaatgtacaatttgtaagaaaagtaagttaagtgatttaagccctcgaaaagtatgcgaaaatgtttaggtattagctccccatttagaaaaaatcattttgatttttaaaattttctcttcctatttatttatttgttaatacaaaaaacacctcacaatcagcaatttttaatttgaacgatattttttatttaatggaaaatttttgtgttttttagatttaggaaaaattatttcaaaaa

SEQ ID NO: 15743 - DNA, 1307 bp, Heterodera glycines
ttcattttttcaagagagttcggcggcgcaaaaccccgattcggttcaccacaaaggactttcacgctttggtggacagcgcaattggcagaggtagcgaaattgttcaatccaatcaaatgatccatagttgggcattacaaaaagaatatagaagaaccaatacctccgatagcctccgaaaaaacgggttattcctcctgcctttcgctgttaatttttttaatttttcactaaaacccctctaagaaatagaaaaattcttgtgaaaaacaaaacactttttgtggggcaatttacctcgaattccggatttcttcattggggttgttgtacaggattactgtccaactttggttgattaatccggcggattttgtctaatattgcaaatcccccacttctttttctttcccatttaatgcgaattcaatgcttttcagttacataaccctaatttttagtgttgggcagcgccgcgccttcatacgcaatttgttcatttgatgggcacgcaatgcgcggcgcactgctcgccgatggtgccgacatgcacttgttgtgggccgccctgtccatctacggaatgcattttgatcaaccgatggcattccatttgttctccattcacaaatgtggtgatgatgatggtgatgaaacaaatgtgatgatgacaggacaggcagaacaaattgttattgattgatgagaagatggacagagatcaccaaccatttttccatttttgtattttattgacttttttgttttactcaaatttcttttcacgccttttttaatacagattccaaattttggcaatgaaatattttttgttggccatagcatttaaataattattttttaaatttatttattatttttttttgctttcctttttcattcatcaaaatcataagtgaccttacaattaatgagttggttcatcataatcattctgctaattttcttcatttttctgcttgttgtcttcttcagtttgccaaaatcattgccttttgacccttcgggcaaacactgtcttatcactggtccgttttgagttctattcaaattcattaatttttggatttctgtttattataaaaaaaattattcagagtggcaaattaagtacatttcatacatttccaagattaaaaagaagatacgatttttggcaagaaatttttgtaaacagaaaatgaataaaaatattttctttatgaaaggcaaaaatattttttatatttatgaatattaagtaaaacgcaaaatttggctaaaattgatgttttcatgcattt

SEQ ID NO: 15744 - DNA, 1293 bp, Heterodera glycines
  misc_feature (39)..(40): n is a, c, g, or t
  misc_feature (102)..(102): n is a, c, g, or t
agtccatcgacgcgcgaattttcaaaaattttatccgtnntaatggaaataatgaattcaatcgctttttaaatgcctcatttttatcccaacgcaatattngctccaggtgtatgtgacgcgctctgttgttggcggtatgaaacgacgccgttttggccacatttcgtttgtgtgttcagcggctggccaattggcaatttggtgaatgaaatggccaggcccacccattttagtgttaaaaacctatccaaatttttgggggggggtatattctcgagatcttgcttgattcaaaaacaaatttccaaacgccaatatcttttttctaacccacccaaaatcttcagtttccgagtggtacccagattagtccagcttggttgagaaaaaccttcttaaataattttcgaaaaagccgtttttaatttttcggtaaaaataaatttttaaaaaattcatgtcacggagcggactcgaacctccgccctctttccctttactatcttacaaaaccactgacaatgagccacatgtgcaacacttttttgaactgggaggtcaaaacgctgtgttaaggggttattccgcctattcgccatcaaaatttgcactccgtggctttgccaacgcgttgcacatggaactgttaccatggaatgtcggcgtctcaattctatttccgcccaacacagccactgacgggttccgtgacgaattgcgtacaatgccaccacaggtagaaagcgtcgccgggaatacttttcccgtaatgccgggaaaagttgacccggcaaattccggcacttttccgaaaacaataaaaaaaaaaagatccgtgccatctctggcactgccgggctgttccaagccagcgatgtcgccgcacgccttgtccaagccattgaaaaaggccattttgcaaccacggttggcatggagggatggctgctgggcacactgagtgccggtgccagtcctgagccgaatggcatccaggcatttttgcaggtccgacctaatcaactatttatttgtttatttattactgtttgatagggaaaagcaaaaaaaaatcttagaaatttgttagcgatttttccaaaaaaaaaatcttagaaatttgttagcgatttttccaaaaaaaaatcgctgagatatttcaggtgatgttgggtggtcttcttcgtggggtgctccttatttatggaggcatttcaaccggttggtacgaaattgtctccatgaagctgtcgaaacagcagctgatccacaagattcatcgtgaaaaaa

SEQ ID NO: 15745 - DNA, 1194 bp, Heterodera glycines
tgtgatgtccttttctcccccacccaataattcaccccatccacacacttccgccgcggatcaaaaaaaaaatgggattcaggcggtgggtacttcatcatcttctcgagagtcccgtccagcagcagctgttctattgtcgttgccccatatgtcaaatgtcgccctgattcaggattttctgttctttccttctcttcatcttcctcatccctccttttcctcctcctccctcctgctgctccccctccttctcttcctcccttcttttcctccttctcttccctcctccctcccacctcctcctccctctcctttcctcgtccctccttttcctcctccttctcttttctcttgctcatcctcttctttcctcctccgcctcctcctttccgctcctcacttaataccgcacacattaattaatttgggttggtaagtagcacatttacgagacattcattagcagagtattttttggaatttttttttgtttgattgcctcttttttattcctttgtttgcttgtgctgattgagtgagtgagggtggtgggtagcttaaattgttcgattgcttcatctttctattccaagtgctcctctttccccatcccagcagcagcagcaagttcatccgtaccccagctcttcatataaaaatttttttggagaaaatggcaaattttcgaaaaaaattttttgccaatattaaaattctttcccgcggtagtcgattctcggctctgccggagtgcccattttaaaagtcatgtgaaaaaaaaaacattgatttattcctttgcgattttttttctagcgaggcccccccccttcccccattaaaaagcccttgaaaacaaaaagttcactggataattttgaaattttaatgaggtgattgattatgggatattttgggttcaattaatcagcagcagtttaaagctgtcgacaaatcacttaagagttcattcacaaaacacatttgtttactcctcctcttttggtgcctgccgctggacacaaatgtgtataaatggtggcaaatttggacacttggacacaaataacacaaacaaatttgtacttttaaataaaaatagaaaaaagtggtggtgtaaatatgtatatgtaaacattttcctaaaaacatacaaaaaataatgtaaaatttttggtttagaattttaaa

SEQ ID NO: 15746 - DNA, 3196 bp, Heterodera glycines
agacaattgtaaaggccgagcatcagcgagaaaacggcgcacagcgaacttttgatgattcgccaggccaacccttcgcgtttgtggtgctgtccgaagagcaaagaggtgccggacgactgccttttgccggccgatgaatttgtgccgttcatcatttgcactgttttatggaagcaaatattatttccagcaattcggaattattatttctaaaattagcaaataaaaacaattttattatatgtaaataaaaaaaattcgctttgctaaaattgtataattttcatttttaaaaaaaagcaaattagaaaattgaaattgtgcatggttgaaagttaaattaatgacatgaaaaccagattagaatagggtaagggcgtcgtcagttacatcaaattgaatttacagctccctaatttccgttttttcggtgaaaagggggaatgtcgaggtttctccatctccaggcattttttaatgtccgtggcgtgccatggaatttggacagaaaaacggaaacggctgagaaaaataaacttcaagcatgaacattttgccaaataaacaatccgctgagaacaaaaaacaagaaatcaccgcccaccgctgctaccaccgctgactcatttttgcaaaaatatttattggatcaatgtgattagaaaaaggccttgaaactgggcacagaataatggttaaatgggatttacagatacatagttaattgatatttctattagtttttaccaatctttgtacattttttcatgttttatggaggccgatcttttccaagacattttgtccgccttacaagtgagttaccaatttttgaacgcattttgctattttataaaacaaaagagtaatttgaaacccctccaaatttgtttcggtttcagcaacaaaaaaaaagaattcgtcttccattggccaatccgtgcccaatccaaaagattgtctggtcctcctttgactatttgcgggggcccgagttggaatttgtttgggaggccgactttttgccggcaccgacggcggaggaaggcgccgatggggagcaacaacaaaattatggccaaaaaagctattgttgcacaaatggcggcaccgatgggacgacaaatgccattttggaggacgccgaaacggtggcggacgtgtcatgtaccaacagcagcaccgactcgtccttttcaaaggtgtccccctttttattgcattttcgattttgagactcagaaaatcagattaaaacatttccaaaaaatatttttgtgtctgtaaatttgttctcgaatgatgctcccaaaatattagtttttatcacaaattccaatgaatttgtactttcaaatttaatttatttccgctattttaacccaatttttcaagaaatgtttaaaaaatattttgttaatgaattgtctttttcaagaacaccggcgcatcgggtacaagcaccgcacaatacgaagagattgacgaattttataatgtaaatgaataaatttttcttccgatgtttgccccctaaatttttttggcggtattttagacgctgaatatgaattatgctaacgcaagcaaaaagactggtccatggaaagttaaactttacctaattatcggtataatgtaagttcattagcgcatgaatgagaagaaggggactcaaattgaatgacatttttacaatgttactaaaatgtgccatgccttcgcctcacttttatacgaagtgtaagctaattagctgatcattgatcagagcactcgaatgtgtcaatcacagaatatatatgccaatctctttagtttcatctttgctcactaataataggccgtctttttgaatttttaatcaatgctcattcacttatctctgtttcttctgataataacttttcacggaacatatttaaatttgcgttagcataaaataaagatcagattcgttttgcggtgtctaaagttaccctaaaaattgtcaaaaattatttcatagggttcacaaaaccctaaaatgtaccaatttttggtataaattcctttcctatttttagaatgaacttttgcagctgtccggtgacacctttcataatgccggccaatttttggtttcttcatccacctccgaacattgcgctggcggaccttctgtaaattaaatatttgttttttgggcccattttcgtttttggtcctctggacgactgtatttccctatctttattttaatcagcaaactttactgcaatttccacttcaattcctgccccccccctcattttcagcaacaacgtttaaccgacgagttgagctccctgaatttatcctgtcaaactgacgacactttgcgtgccgtcccttccgccagcagaaggacggacaacgccacagcttacaacagccaaaatgccgacggagatggtgaagttgtggcagtaacaacagaaacagattttgctactatcaccaccaccaccaaccacaataatccgccgtcctcgtcgtcgtgtgccgatgcgatggtcacttcgtgcgtggactccggcattggcggcacagtttccattgagagcaatttgagcacgtacacaaagccggaacacagagaaggcatggaacttggggaggggggcaaggggacgaaaaaatgttttcttgttaaaaaattttttagaattttcctataaaaatatttaatttttattgaaaaattgcatttgaaatttaaaaaaaaatcagtggcgaacgaacccgacgaaattttaatggcaaaattttggggcgcactcatttttttgctaacacaaaattcaaaacacagatgaagtgctgttcaattcggatgaccagcgctgcagcatcaaaatgcgcagcagcagtgccagcagaggggacgtgttcgactatcacattccggaagcggaggaggtcatcgagttcagccaggtctatgccgacacgtcgtccggcgaattcagcgatgggaacagtcccaatcgcaaaaggttggtgcgcatttattgtgcaataagaaaaaactcaaaaattggctaaaaactttttttcaatcgggtacccacaaacccaaaattctaggatcgtcgatgtcgggtatccctatttcccagaggattaaactaaagatagatcataccaggttccactttcgcaggactaaaat

SEQ ID NO: 15747 - DNA, 1028 bp, Heterodera glycines
cgccgatactatgtttctggatttgtttctcggcgcgttggttgggaaaaaatttgaaaaattggctatctcttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaattttttct

SEQ ID NO: 15748 - DNA, 1629 bp, Heterodera glycines
  misc_feature (1584)..(1584): n is a, c, g, or t
ggggacctctagagctattaattaaaaactgagcaaatttttgttagttggcctctagccaaagaaaaatgcaaataaaaaaggacagagcaaacaatggataaatttttgcttaacggcgcttaatgaaatggccaaaaaacactttgagaatgaaaaaagagaagtgaaaaaacggataaaatatataataaattataaaatattttgactaaaataaataaatatggtcggtcagcaattaattaattaactaattaattaattgactaaaccccaaaagaaaaacaaaaactgtgaaaattaatgttgatgaaatgaagaatgggcataacgaaatttaaaaagggttctcagttcagccaatgtcagaaaggaaaagaaaacgagaaaagagagacaaaaaacataaaataaaatttggaatcctcgaaccaaaaaagaaataaaccgcctggaaaaactttacaaaaaatgttttcagaaaatgctgtctcccctacatctcacacagcgaaaggctaaaatttctaaaactttccaagcttgaaaccaggagaaaatatcttgatatcataacagcctttaaaattatcaaaaatactactcaccttaacccaaaaaacctttataatttttcaaataggaaaagatcaccttttcctattttggtaaccaaacgaaaaattaccaaaacagaacactcctttactaacagaaccacaaaacatctacaagaaatctgcaaaaattcagatatttcaatatcaaattcattgcccaccttcaagaaaaaagtaaaaagcattttacaagattaattttaagttggagatctgacattatcatgtttcccggactatcattctcttccgaaagtataagcggcctttgtcccttcttttggacttttattacttgaataaataaaaaacataaaataaaataaaagggatttatgagcacaaagagatcggaattgagaagagagaaagaaaatgaggaaacgaaatgcttaaacttggagaaaaacgaaataaaataaaaatcggggcatggaaaaagcgcagttaatggcagaaatgacagaaacggactccgtaagctgggcttgttaagtgtggcacggagtgcgaacccacctgagtctgaaggcgcgtcagtccgcggatccacagaatttgcccggagcgtttctcccgcgcctcgccgccctcgtcgcccgacagaatgttggcggtgtccggctccacctccccaccgccaatggtcaaactcttcggaaggcctttggttgggattgatgtgaccacctaaaggaaaagccgtgaaaagccaaacggaggggagggaataatcacttgggcccagaggagagagccgacgccgaaggccacgcaccaaagccattggtccaaagtcagcggttcggtggaaaaccaacgaccgccgaattcgacgattacaaattggacgatgagagtgaacacccaaatggtgcagtagatcggattggtgaacacgccctgcggaaaaacaccaaaaatggagagaaacacaaaaagcggaaacaaaacccccggnggtcgaagctgcgatccgtagcacagttaagttcaaaaaaaaata

SEQ ID NO: 15749 - DNA, 1452 bp, Heterodera glycines
gtcgtccgtgagaattatgtcggacgcctctttggcgacgtctgtcccggcgattccctaagtgattttcgggtttgacgccaattagtggggattaattggccaaccatggcaaatcccacgtccgccttcttcaaagcgggcccgtcattcgtgcttaagcatccctttgatcagaaccgacccctccaaactcacccgtccccggtcactgctacaacttcgcggttagcgctcagtttgctgtcgatgatgcctttgaccagaatgtatttgtccgtcggctgtgcccttgccaaaacacgcagtttcggccagatttggtccaacttctcctgacaaacttcgccgtgctcgtcccggatccgatcgttgaattccttcccctcaagcgctaagaaatcctccccgggcttcaaaatgccacaagaggttgcgatcgaccgggccgtgtttatgttgtccccggtgaccattcggacaacaatcccggaccgttgacctaaaaaaacggacatcagatttgccttaagcaatgctttcggtgtttcaaatgaatgcttacattttgcaattgcctccggcacctctgaaatggacgatgggtaattaagaagctaaacggacagacagaggccgacctggtctgaccgggtcctgaatgcccacaatagcgacgactgtcaagtcactaatgaccgcattttcgtcgtcccaatcgatttcgcctccaaatgccagctgatttccctccacttgtgctgttccgtccgctatatagtctttgtaggccaagcaaatcgttcttaggccgtcggatgccattggctcaatcacttctctcaccaaacggtccaagtctttgctgccaaattgtgacaaatgcccgtttcttccgagcatccatttgcatctgtaaaatgggagcacaacaatcagcgaattccgttggatccgtccgactttttcagaatgatttcggatgcccctttgctgaacacgcggtagccaaaggtggaagaatcgtattcgaacttcttcagctcgatgaccgttgacattgactttcggacggagttgaaagtgtacacctcaaacaaacaaaaagtcagaaaggcgcgaagcgaaaggacactttgaaaatgcgctcttcgggaaaagcctcgcggatggcctggtaactctggccaagccccagcacgaagcccagcagcccacactccgttttattgcccaattgctgcatttgctcgcccccctttttcgggggcagcacttgcgtggaataactcgagttgatggaaatgcaatggacgagcaaatcgcgcgttttctcatccaacggctcccatttaggcgtttctttatgatgcgtctcttaaatgtttaaattcaaaatcaaaatcaaagagcatcccgcaccgttcagatagctttgcaccaccgacattc

SEQ ID NO: 15750 - DNA, 1503 bp, Heterodera glycines
  misc_feature (20)..(20): n is a, c, g, or t
  misc_feature (443)..(443): n is a, c, g, or t
cataagtctgacaaattatntttgttaatccaaatccctctagtgaatttgaacaaaaaatcaaaattcgaaaaattccctctttttgaaactcggcctggctagggacctataatttaagcagctgtaaatccgtcagtacaccagcagtgagcccccaaaaactgagccacggttaaatttggccacaataaaatttgaggagtatagttacaaaaaattaggctcaacggataaaattaaaaaattgacacaatttaaattcctttccttattttttaaaaaggcaaaggtcgatgaaatttaaaaataaaagcacaaaacacactttgaaaggccattcgccaaaaatttatgtgaaaaattatatatgtttatgacttttattccccccaaaatgggcttggccaagtgcaaacaaaggaggcacactgacgcagcgngaaaagcttcacatcccacgccgagagtgacctttaaaacaaattttgcaatacgatatttaaactttgctccgtcccctatttttggaaaatttcccaaaaatccttaaataaatgttctaatttctaaggcggttgccttggtttcttgggcccgtgcgcatcaaaatttttgttctcgagtttcggttcgagaaaccgctcgaacatttggggtcctgctggtctcatctcgagaataaaatctcagtctcgtttttcgagaaacctcaaaaatttcgggttttagcgcccataatttccaatatttcttgccctttttgaggagggattcgtagagcctgagaggtacatgacctagtcaaaacccggaccaggccaataaagccgggccgtccatctgccaaaacccagatcctgtcaataagactgggcaacggaccccaataaagccagggcctgggcacggccaactgttagaacccgaacctggccaataaatcctgggcaagggacccagccaataaagcctggggaccggccaactgtcaagcccccgacccggccaataaaacctgagcaagggacccggccaataaagccggggcaggccaactatcaaggcacgggtccgacaatttctaaatttattgatccattttttgcatctaaaaatggcagacttactatataaataacaaactaatttgaaccattacactttacacgcgccctcctcttctgtccgccacttctgtccgccaaccaccaacagacagaagacaaccttcgcccttcgtccttagcccccccccccctcacccccagcgggggtcggcctttttcaaccttttccatctcacatattcattcattcattcatcagttcagcctcctccgccgggggatgggagtgcgaaaaatgaatgaataaacgaatgaatcatcatcattatatataatatttgttgtatctgttgtgccccaccactgttttcctgtttcactgcagcaaaagtccatcatcactttggtgattggtggctgtgtgtgtactttg

SEQ ID NO: 15751 - DNA, 1907 bp, Heterodera glycines
attattattagggcctgtaattatatggaaatccatatttttttcctggactgagggtggcctgaaacgcacgaaaaacatgtttttagcttgtttgaagcttctaggatgactttccatatcaatattttccatatttcgcgatttatgtccatatttccatatttgtccatatttccatatttgtccatattttggcattttgtccatattttatgtccatattttggcatttttctaaaaaacctctattagaacggcccccatcagctaaattttccgttttgaccccaaaaaccagaaaattttccaaaaaaaaatcatttttagcaaaattttcttgaaacttgaaaaatttaaagaatttaaattttcttaaaaattgataaatttatatcaaaaatgagtaaaaaaacgaaaatttcgcttttaggtttgatttttcgccaaaaatgagtaaattttagctgtgtcttgtttttttcctctaaaataatttttaataccatatttagccatttttgaacgttttactttacatttagcgaatttgaagaaaaattgagaaattacaccctcaatttggaaaatgtatgtccatatttttgccattttatgtccatatttcgcgatttgttgtccatattttatggccatattttgcgattttatatatcctacatataattacaggccctaattattattgtttttttattaattttaaattaattctaatttttggaatttaaaaaaccaagcactcctgcacggcatcccgcaaattttaagtgcgagatttggtgggattaatacccgagtgatcccgccccgaaacaaataaattttgagttcatatcctgcagcaggatccgcaaatttgaaaaaattaaatgtcatttcgtcataaattcaatttatgctctttctttttgcttttgttggttggaaattcgaaaaaaattagttttttaggcttttcactgcgtacattttattatctttgcttacataaataattctaagcgtacatattttttgcagtaaaagatttttgtttttgccttttttgttccatttaaaatactcataaaattgcaatttttcaactgtcccattttaggagtgccttagaagtcaaaaaattcacttttatttttgtttttgtgccgtcatttcccattttgtgccaccgcgctccgttcgcttcgttttgtgccgtccaatgcaaaagggaggatgccaagtctgctgctgaacccgggcccgtcaacaatgaactttttctcctcctccctgccgttgccttcctttttcttccgtaaccgaaaaaagtgttacgatttgaacccggcggaagagagccaccaagtgggccaatttttgtattacaaaattttgggggacggaaattttgggtaaaaattttttggattaactgccaaaatttaatatattggctatggttttttggagaactttaaaaaaagcctaaattgtcaactatgtgccggttttcatctcaaaatccccagaaatatgttattagaatttaaaaaatttcgggaccttaaaaagatataatataattaccaaaaatttggggcaatccttggagtttactggtcccgttttttttttgttttttaaaatgtttaaaaaatattcttaaagttgtttcataggttttcagggtaggagaacacgattatgacacctatttcgagaaatttcgaacctcttacccggattcgaacaaaaattctaaaattcaattttcaaaaaattcaaaatatgaaaaaaaccagttcaaatacacggaatactatatcttgccttatgaatcgattttccgttttatttcatgcattattttgcatgtttggaattttttcgaaaattgaatt

SEQ ID NO: 15752 - DNA, 1213 bp, Heterodera glycines
acatggatttcaaacaaccggcacggcatttgcttctaagcgtaagttttgatgtaccaaatttctatttgatcattcaccattcgtttttaaggacgccgtggcactgtgcgcactgctggaacgtcgtcttccattgctggcacttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaatatcgtggacatggatctcaaacaaccggcacggcatctgcttctaagcgtatgtttgatgtaccaaatttctatttgatcattcaccattcgtttttaaagacgccgtggcactgtgcgcactgctggaacgtcgtcttccattgctggcacttcgacacatccgaaacaccaacatcgtggacatggatctcaaacaaccggcacggcatctgcttctaagcgtatgttttggtgtaccaaatttctatttgatcattcaccattcgtttttaaggacgccgtggcactgtgcgcactgctggaacttcgtcttccattgctggcacttcgacacatccgaaacaccaacatcgtggacatggatctcaaacaaccggcacggcatctgcttctaagcgtatgttttggtgtaccaaatttctatttgatcattcaccattcgtttttaaggacgccgtggcactgtgcgcactgctggaacgtcgtcttccattgctggcacttcgacacatccgaaacaccaacatcgtggacatggatctcaaacaactggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaactcgtggacatggatctcaaacaaccggcacggcatctgcttctaagcgtatgtttgatgcaccaaatttctatttgatcattcaccattcgtttttaaggacgccgtggcactgtgcgcactgctggaacgtcgtcttccattgctggcacttcgacacatccgaaa

SEQ ID NO: 15753 - DNA, 944 bp, Heterodera glycines
attcttgaccatttatgattgataaaaagcaaaataacaaatttgcaaaataattattaaacttataagtggaactcctgaaaagtatacaaattcatagtcgaatttttaaaagatattaaaacttatcagaataacttgcaatttacatgaaattccattcgctaaaattcaaaatattcgtccaagaataagttttttttttcaaaatccaaaatatataaatagagataacaaataaatgattgaaaacactaattattcccaacattagctagttatattttgaaaatttaaaaatacaataaatatgcataaaaataattataaacttttttaactcatgtaataaagtaatccagccaggcagctcagaaacaagtgctaattgcacaagaaatattgaaaattaatttttacaaaaaaacagtcaaaaacaaacatcacgatagcaatttgccataaataatacaatacattttattttctattcaacgagaactttttactaatatatattaaaacaaaaatctttttatgaattatatatatagcaaatagatttaattaaaaattacaaatattttaaaataaatagaaatattttgactaatcagtgattgaaaggaaacagcaattcaattaaaagaagaagcgattgacgacattaattaaaaggccaaaaattaccagcaaactaacataatatttaaaacttatttttgcagataaaaattattttaaacagtaaaaacaatttacactataatttaaaataagaaaaaatatttatttctcgaattaggtgttattgtttagaaaatgaataattaatttttaattatcactttttatgtcgatccctcacaataaacaacagcaaaatttagttatccacatgctttcattgttaattctatttattattaaactaaaatatttcc

SEQ ID NO: 15754 - DNA, 2677 bp, Heterodera glycines
  misc_feature (11)..(11): n is a, c, g, or t
ttggaaaaaanattcttcgtaaaaagtgaaataggcacaaaatgccataaaaatgaccaaaataggcttagcatcacattttagtattttaaaaaattaattttgatatatcattttttgaaaaaaatcgattttttagggatacattttcaaaaaaaaatttttaaattttttacaaaaaatttctataaattctcaaaaatcctcaatatgtaaaaaaatgaaaaatatgtacgaaaaattgcgaaatatgtacgaaaaagtccaaaatatgtaaaaaatgtaaataaaagtcccaacttttgttcgcaaacacaaaaaaagaaagtgtttttcctactaattaggctatggagaatctaggaaaaaagtatgtatttacataaaattagcatccttatttatgatcagaataaaagatctgcatgttttttgaggtggaaatgagatcggaccggtcggttttttttcggtatcggtcggttttttcggtatttttcgattttcggtttcggtttttaaccgaaaaaaaccgaccgagaaatttttgagtttttcggtttttttcggtatcggtttttttcgggtttttaaccgaaatcgttcgaccgaaataattaaaaaaccgaaacaatcgaccgacttttttgacaagtcagttggccatttttttaacaaaattcattaaaaattcttaaaattttcctccggcggcgcctatcggcaccgccgaccacccaaaaagctatcttttcttaaaaaattagccaaaatctcaaattttggtatttttagacaaaatctgctaacaaatagcattaaaattacaaaaaaaattcccggtggctcttatcagcaccgccggccctaaagttatggcttgagctcgcaattaaggcaccaaaaagcgcaaaaaaggcatgaaaaaaggcatttaaatttttttattagtgatttttagggagcaaaacacgtaaaaactaaccaaaaaactaaattttgctgatttattgataatttaattttataatgtttttcaataaggaaatttttaaacctaaaattttttatcaagaaaaaaaaatgaattttggcgttcaattcataaaggtatattctctgaatttttttagatcatatcttaggggtgtatttttccaatttttttgaatttttcggggaaaaacgccaaaaaaggcaccaaatcgctaaaactaatctttgtggtttttttagaatcaaggagcaaacacatgttttttggctgccttttctatcattttccaaacctttagtacaccattcaatagagtttcaataggtctagaattttactcagaggagatttttcgctttttctttaatagaaatagtttattgcttttttgaaaaaataaacaaattcaaaaaaaccgaaaaatcgaaataaaccgaaaaatgttcttcggttttttcgatttcggtttttttcggttttttaaccgaaaccgttcgaccgaccctcttgtccggtctctactttttgggctctaaaaataaaaaatagaaaataggctctaatatctcgaaaagtatcttaacaacccaccaacaaaacttgtttttcgtgtgtttaatgtcactgggagatcagaaaaataggctaaatgctcaaaataatgaattattttcaaccaaaaaaattttaaaattactaatggaaataaaaagaaaattggtggagcagtaactttattaataaataaataacacaaatataatagaaaagaagaaaacatttttttgaaaaatttacataataacagtcgtataaatgttgatacgacaaaatattaattaatattaaaaaaaattccactaaaattacaattaacaaaaaacaataataaaaggattgaaatcttttaaagatatttaaaaatactgatacagttaaaaaataataaatattcgtcattatgaattatcaaaatgtaatattcatttggttgcttattttatgctatacattctaaggaatatgccgtatttctcgtttataagccccggggattctattgaactgaatttttttttcaattttgcaccttggaaatttatgcgaatataagcaagcgtaacaggcaatgcgcaggaaacaatttattatataataaaataaaaaaattggaaatctttaattttgtaaaataaatgaatatttaaacgaaaataaaaagatctaagaatgacgaaattatgaaaacaataattactaatccaaatcatttcattttaacatttttgcaaatccataaatgcgatactatcagaaaaagttcgacggttttattcaataaatgtgattagacaaataattttctaaaaataaattttttataaaataaatatctaaaaatttaattataaaatttaaaaaaagcggcagagaaagacaaaataaatatatttttgaaaattaataatgtcggtaataagccaataagcttaaaatgtttatatctaaatttatgaaagaaaaacacatgtaaaacaatattaaacgaaaattattttaaagtatattttttattgaatgtttttttacggtatccgaaaaagtcataaatttaagcagcgaaatcaacattaaatatcaaagaatccgaaaaactcacatataaaaaattaaaattat

SEQ ID NO: 15755 - DNA, 4547 bp, Heterodera glycines
  misc_feature (60)..(60): n is a, c, g, or t
  misc_feature (136)..(136): n is a, c, g, or t
aagatgctgctgttcggcgacgcgttcagagagctgacaatgcgttggatcacccgcgtnccagcatgggtgccacggtgcgtgaagtaacggtacagacgctctttgatgctgcggtttgcacgctccgccatcncagcgtgccacagtggcgatgtttccatgcagtggtgacgcacctccgcctcgtcgcgcaagtagcgttggacagcggaggcggtgaactcgcggcccttgtccgtcaacagacgccacggcgtgtagccacagcgggcaaaggtgcgcttgagcgctgcgatcatgtcgtccgagcgcttgctcttgaccggctgcacatacacctgcctgctcagcgtgtctatgcacaccaacaggtaggcgtacccacggttttgcgcgcggagacgttggaaatcggccaggtcggcctgccagtcggtgtgtagaccggaggccagagtcggcagacggcagaagcgtcgtcgcacttgtcggtgcagggtgtagacacgttggcccgccaagtagcggctgatctccgcgcgcgtaagacgggcgtccgggtgccggcgcttcgcctcccgcagcaggggctcaacgctggtgaagcaagctggcgaccgttcgtccttgtaaatcgggtccaaaagactttccaccgtcagtgagcggacggcgttgcttccaatcaccataattgaggcttaaaacgtttggcagtagaatgctccgcagtgttgggcttcctcttgctcgtcgcacttttttgaacagatttatgtgcatgatgatgattaggctgtagtaagcggctcagggaaaagcggcccgcgccagttttcttttgtccgcgcagaggttggtggcgccgaggttgtccgcccactgttgacgctgaatcactgcccgccgccgccgctgccgccctttcatccggaaacagcaaacgccacatttgtaaatcgtcacgcgcattgttgacgaaggttttgtagcccggtggtgccttagcgacactggcggtgggggtggtagtggaggaccgcggctgctgctgctgatgacgacccacaaagtggtagcggagcagcgtgtcaaggttgctgccccggatggggcgataagcgccctgggcaaggtgcaaaatttgctgaccgtcttcaccgccgacgccaagcaagcctgggttctgttgcgcgtacgccatcgcggcatgcatacgcggctcagcttgcttaggcagaccgccaattttttgtggagcaacagtctgctgggggagcggttgttgttgctcgtcactgctgctgctgctgctactttttgttggccttgtcgaagaagaggaagacgcgctcggcgcttggttttgttgctgtaagccacgtcgcctggacagaggtgtggtccgttgggggcgagctggcgtcgtcgtcgctgttgcaggcgcagccttctgtagcacagtgtcacgcagtgcgtttgttgtccgttgcgatagctgtacgttgagcggtcgttccgcctcctcctccagcagtttctggtagcgcttgaactcctgttggtagtggatgaggcgttcgtcatcgttcatgtgcttgctcgacgccaccaccattttgcgtgccgtgcgctcaatgggagttgcgggcgtggcaacttgttcatgcacgtggtagaagacgtcgccaccgctgcactggggttgtccatcagacgtcgataaacatcctcggggatgagtagcatgcgtacagtgtgcttcaacgtcattgtttctgcgtgggcaagcgtgcgtgtgggtgcctttcagctactactgctggttgtctcgaaaacgcgttggacgagcacgggcaccagcacgctggcgagcaacccgaccagagtcggtatgccacgaccagtttgcgctgttgacggtgcgtgggcgttgagcagaaggcgacgggcggagcgtgtgctacgcaccctgctcagtgtgcggacgtcgctcgcacgctgtctgaggctggccagatgacggcgttggatgggcacacgcgcgcgtaagatgttcagtgcactctccacaaggcagagaagctgctcgctgctggctccggcgaccagcgcttggcagcgggtaggagagctgcgtgctgccttcagttgtcggaagaaatcaatgtggcgcctcacgtgttcgctcagcactggggggcgagatggggcgagcttgcggctgctgggtcgtcttttctcgccagacccttcggtcctcttcttcaatgtgttgttgttgttggctccgccttttcaatttttttcggtgtcgactgctgtttgctaattgtgctaagcgtttgcattaaaattcgcgcgcgctcgtggcatgtacaccacgcacatttcccccgggtatatatgcgttttcaggcgcaactgttgctccgtggttgggtgcatgtcgaccaacaggtagccaaacggttcggccgttgcgtcctcgtacgcttccaagaagtagcgtagcgccccgcccggaaacagttgtgcgccgaggttgcggatctgaagtgcgccgaccgggttccgcatcaacaccatgtagtgacagttgttgcgcgctatccgaagctcacgagtgaacagatgctgcgtgatgagcaccacgctgacgccccagttgtgggagccacgggtgaacaccgtgtccagaaagctgcagcgtagaccgccggacatcaggtcgtccaacaccaacaggtgccgtccgcccgtagcgcgtgcttcccgctccacatccctctcctcgggcgctccgtggcacattctgatagaatgttttccctccgtggtgttgctgtcacttgaagtggtggcggtgttctccatacgttgtagccggagcacattgtcgttcacttccccataacagtagagcacgccagtgatagggccttcactgaccatcaggtcaatgtgagaaagaaggcggtccacccactgcgatttcccgctaccggtgcatccggcgacgcacatggtgaacgggtgcttgaagaacattttcccttcttcggttttttgcgtccctctgtatttgcacacacacatatatatataaatatgtagataaaaaatttcttcctccattctactaaacccccacccccaaaatggattcattcggaactgtcgcctggattctgcgaccaacggctcagacgacaggcactgctgtgggctcaatggagttcgaagaggaggaaaacgggacaggaaagttggtccacagtgacacagctactgtcaccacacctaccaccgtcgagtttagactggaaaaaagccccctcctccaagaaggacggtgctgaagaggcagcgacggccacggcacactgctgttcatcgaatccgatgatgtggaggaggaggatgaggacattgaagacacccccgtcgccacagactccccctcggctgcgacggcaaccgttgtggatgactcctccgacactgttaaaggggtggagcagcagcgctccagtgaacacaccgacgtgacggacggagcgggcggtggcggtggaagcgaaggcgcaaaactgctcggcggaggagagaaagaggaggtaggtggaggccagctaattttctacctcccaccactgtttgtagcctgttcgaatgccgctgctcaactacctgtgcgcgttcaacgactgttcaatgaaggagctgcaactcctcttccacagtgtccacgcacgacagcgtatggtggcgcatctgcaacaacactgccgacttcataccgcgcatctgaaaccggcggagcgtaacattgcgctccactgtcacgacctcagcgtgaaaaacgcgaaccggacgttcgcctgcggtggctatctggagcttaccgtaagtcggtgagtgtgtagaaccagtcatggtgcggccttctgtccaggttcgacagtacttcttcgccaaacacgggctaaagctgaagcacccgtacatgccgtgcatgatcgagttcgggggcggcacgcacgcctcctactatccgtaagcggggggtacgcaaaaatgggggaaatgagcgtaaacgccttcagcctggagctcgtccatgtcgtgctggagcgtacgaagcgcgccaaacaggagacggtgaagcaagaagagccataccgtcgtgaatccggcgacgtggctccgacaaagtcgatggcaatgccggaacgacattggtgccgctgttgctgtcgatgcgctaacaactagctttttgagagacatggtcattgtagatttgcgtgcgtgatcacgtgacttattgtgctgttatagtttttgtgcactttttttgaaataaatttacaagcccatggatttgtagatgttgaatactatccgaaacagtacggtcacatttacattttgccaaaacaatcggccttcagagtcacgtttgcgaggacaacaacaaccgcagagcgtggctccgccgatcaccgtcacttttctgctgtttgtcaactgccagctga

SEQ ID NO: 15756 - DNA, 1994 bp, Heterodera glycines
attttactttagaggggttgaacaatagaaggcccccccttggtagaaggcccccttctaattaaaggccccttttttggaggggttgaacaatagaaggcccccctttggtagaaggcccccctctaatttaaggccactttttggaagggttgaaaaatagaaggcccgggccttcaaatacaggaaatacggtatattgattttcaaaaaagcatttgactcagtgccccatgaattacttttatacaaattggaaaaataggtataaggggcaaacttttgcggaccgggtcggttgggccccgccgattgggccccgccagttgggccccgccgattgggccccggtacgattgggccccgccgattgggccccatagagcacatggacaagggggggggtcagaataaaaaagttatattgtcaaatgttattgttttcgtgtttcattgcatatttgtaaatatatttggtttcatatttgttttctaatttttttatattttcccttttcttgattgcctaactaaaataccattaattcagcttattatttaatatattaatatcacgatggaaaataatatcttatcgaagatgaaccacaaaaaacttgaacatgaaggtcatctttatgttttcgccaaacttaacgcggatggttttatcaaattttggaggtgtgagaacaaaaacaataaggacatgaagtgccgagggcgtctgcacaccaatttgaatgacgtagtgttgaaacaagtcaatgagcatgtctgtggagcaaaccctgcgcgagtggaagcacagcgcgtcgttacaggttaggttatatcaaatgctcaagattttgcatgcatatttgacaattttaggaataaaacgtagagccattgaaaccgccgagccgccatctacacttcgctcaattgcactccaaaatgtaagaacccctgtgttgtctgaagtcccaacaaaaaatgcaacaaaacaattaatttctctgcgctcattgtattgccttttttagctaatcaaaagggcccgcaatgaaggaattactcccgcaatgccgcttaatctaaaccagttacaaatcccacaacaatatcaaatttatgcacggaacgaaaacgaaactgaaaactttttgctagccgattctggtacatttttgttgaatgaaaatggacccccgcaacggtaggcaatgcgttttgttcgattcaccattacttttttttgttaggattttgattttcgggcgcatgtctcataatagctgggccaatcaaatgacagaatgttacgctgacggaacattttcattaagcccaccactatttttacaagtttttgcagttcttgcccggtaggctttaattaaatttttgtagtaaatgttcagttttttataggcgcggcaagtgggtcttcccggttttttacgctcttttaacatcaaaaacttccgccatttaccaaagaatgttcagtatgatcaaagcagtttggccggccttttcacctcagtccatgtcgttggattttgaaattggtttgatgaatgctgtacgagaggaattccctaattgcaatttgcgatgttgtttttttcacctcgtcagaaatttcaaaaagaaaatggccgaacaaaatgttattcaggtcccattcttccccccaaaaaataaaacatatttttagcggtataatcacgactctaattttgttgaaatggcgcgctgcatcacatcattggcatttgttccgttgggtacactcactcaagcaattgtcgcgctcgaccaccacatccccgccgaattagaccccgtttttgattggtccaaacaacgaaaatttaaaacaacaaatttgaaaaaaactacttttaacacattcaaaacaacatgactttatattttctgcaggtttatgaccactacacgggtagagtgcgccgaacggaaccccgaccaaccctctttga

SEQ ID NO: 15757 - DNA, 1563 bp, Heterodera glycines
  misc_feature (1474)..(1474): n is a, c, g, or t
tctagagtcaaaaaataaaaattggaatatttttttattaattaaaatttaattacatcaaaatgatcaagaaaatatgcaaaatattgtatcccagctgggaattgaacccaagcgaaaaataatgaaaggcagaaagtttagccaatagaccacattccttctcttttctcacccagaccctccctttcttaccagtgcttatttagtcccgcaggacggactggcaaaaccggggccggaatttcaatttttccaaaaacctggaccgggacttacaaaaaccgggaattcccgtccaagtcccgtgcaactctaaataaacacaaacatgacattttaaaatgatcattagaattaatatttatttaggtattgtagaataaattaatgacttctcaagtgattggccctgctttgttcgttttgcatggaaaaaccgaagctttaatttggttaccgagaaaggaacaacattttttcattaatgatgaaaatgttggcagctacaaattgggcgattgggttctcttcgactacaacagggaaaaaatcattgaacaacagaaagagactccgtatgaaacgaaagtgttgtattcgaaagttgtgaagcaaaagttcgtccaggtacagagcaatttcaatgaattttaattattttcaattaaattaacaattttagattaaagttccacttgtttttttctcggataaacattcctcagaagttatcgcctattctcctggctttggacgtgttggtgcctttgttccgaatttggcgatggatacaatgtgtttcgcttggattgctttgtatgttgatttttcagctcataattcgcaaattttatactatgtatgggtgccaaataattgaatcaaattacaaattaaaaccatttttaaattaagcgctggctttttcaaaaatgccgaattgcgctccctcatggctacctttgagttgacatggctcgtagcagaagttgatcgtcttatggccaaatcggaaatagtacaactaaaatattcattcatttttgcgttcggctccttcattttcatttagattgagtttcccggaaaattgggactcagcaactctttcaaccgctgttttggcattgttatcggtcgcgagtttcgggatggaaaacagaataatcttatagtcaaattcttcactgcatccaatgggctgtgtgagtattgtatgccaatcgcaaatgatcaacaaccgaattttcatatcggaagctgggcacgttttctgccaatgtgataattgtcagcttttatttctattttctaaattcagaagaaattactccaatcaattcactgcggtaaatgcgtcgactattaacacaccaaatggcatttctttgattgagacgcaaccgcaaattaaggttaattgttactgctctgatttaaataattgagtaaggtctttcttagttgtatntgtttcacgatctcttccaccttgacccagacccatacaaaaacataatccatgcagaatttctgggagaattgcattcaactgatgat

SEQ ID NO: 15758 - DNA, 2543 bp, Heterodera glycines
acatggaagttgggtcactttcgatttgtgagtatttgcactttaattttgaatgtcgtttttttacaggaaaactgagagtaatggagaaaaaaaggtcattcgttgcgacttggacaaatcaccgccaaattgggcagtgacgccaattagaaacaccgtccaggcagttgaacaacgtttgcacaaaattttatctgcattgttcaagatcgaactgactgcctttgtcccgaggaaatggcgtcccgagataattgcacccgaaagtcgtatggtaccgacaaattggtttgatgaaatgttggatttcggaatgctactgaccgaagacatggcggacaaaagtgttaaggttttggcggaaaggaacaaggttaagaacgctattgtgagactgacgttacttttactttttatttaagcattcctcaggcaaaacctggcacctggtgaaagtattgggagttttgtaagaagaagggtcgatcgagaaaacttgtttctaatatattattattgtttctatattcactcttacacactttcatttttaaaaaatatgttcttttcgctttataatatttgaaaaaaaaatttcatttcaatgaataaagaatgaaactttaacaactcaatctgatttgtcataacggtggggttgataatgtggaaattggttggccaatcccactgcaacagttgtggcttgtgtaacgatggtaaaaaccactaatggacaagttcctccgtggtcttcgattcgttcttcgacgcctcctcaaaatcgccaatcaaatctaaacaaagtgggggaagagtaagagaatgtaaactctgctaagtttatacccggcacatcgtcgtcctcagccgatggtttgaattgcgtggtctgtaattataaagacaatccaaaaaagtttgaacaaacaaaatgaaccacgttgttggcaagcttcttcagatgagtaagcgactccgccccgagttgattaagaatgcccggcaacatgtccgtgatttctgaagagggaaaggaataaaaaagggtcttttagttgtaaatttgaaatttggtttccttaaatgccgttaaaattaggtgacttacgcttgttctccgctgtcccagtgatcgagaaggtgcttaagttcaagaaatattattgctttgcgccgcaagagaacagtaggcactgtttgttttgcttgtgtttggcatattaaaaagagcggggaaacgaaatttaattgaattgatgtacccaaatttaactcaaaaaaggcaaacaaacagcgcaacttttgttttgtttactttgccggtaccgaagcctgaaccttcgggttgttaaagtgtatcactgtcccgtcgtctttgatcatattgacctcttcgatgccaggaatgttagtcaccgaaagctttttcagattcgtctgtaactttttgtcgtccattgcagtagttttgtgcacgactttcttcttccttcttgcagtaccctaaaaggggaaatgtcaatttcagtttataaaaaacctaaaaacaaaaaattaatcaacgaaaaattaggtaagttttacgatgaaattatacctttccacctgtgcgcacatgttctgcattttgttgcagtttctttattttttctgcattcattgccgaataaatgaataaaacaattaacgtattctaaatttgacagatatttaaaaaaaacagtattgatctttgatcaaaaatgattaaaggaacaaaaaattgaatattttcttctaattgaaatatcaatacaaaaaatgcactaaaaaaataatcgctcaatgtcttacgggcggttgactgtcggggccttgctcctactctgatttttgtctgtcgacccctactccgattttttgaaccataaaagctctcccctttgggtttcgacctatactctgggtttttgtcgaccgctattttatggaagtgccaggattttttagcacatttagcggggcgctgccgttcgggcgccagcgaagttcaaccgcactaactttttctttatgactaaatccaataaactttgtattagataatagcagggcgtggatctctccagatttgtcagaaatgtactgatttaggtagtgagtgactagagcccggagcaggaccggaccctgcgcaggattttgcaggatcccagtccgcaatcctgattttttggaaaatgcaggattgcaggaataatccggccggatccggtccggcaaaaaattttaaattccaatcctgcaacaggatccgcaaatttgatttttgtgcgggatcctgcaggatccgcatacattctttgaaaatgttaaaagacggaatgccaaaatttttgaataaatttataataaatcaatcaaaataaattcaattttcatctcaaatttcacctagaatttgcaaaaaaaatttcccagcggcgcctatcgacaccactggatagacattaatactgtagaattgagtcaaaaggtgtgaccatttggtcattttt

SEQ ID NO: 15759 - DNA, 2025 bp, Heterodera glycines
ttaaaatcaaaaaaatcatcattcttctctgtctttttttgcatacgggaggggagatatatcgtacaattaatcacaatgtttccttttcctgttcagattcctttacttgggctttacattttcgtggagcttctaaaatcattgagaaaataaatgtattttgaaaaaatttttttaatccatattttaacggtataattaaataaaaattttatatattaaaaataaaagtattaagtaaaaataatatctaattttttagaatatgtttcatgggttcgagctccagaaggttgttatttggcacttctgccgtggtcatcactcatttaaaaaaaaaagtcgaatgcatcgttattatcccataagaacaaataataaaaaatattactaacaataataaaaaattaccattttccacttttattttatttaccatttgttccacttgctccatagttggcttcagcaattcctcatatttatgtacataatggctgtttttgtgaacggttttaaggtgccgaattgctttggtcggtctgcgaccaccttcgcagcctttatttggctttttacacacgatacattcaatctctttgtcattgattttcctatagagaccaattttccaaattggattttccgatgcttcaaataaaataatattttaatgaataatttttttaatttaaaagaatttatgtaaattttttaataaaaaattacaagtttgttcccggtaggcccgaaccgttttaagcccccttgaaaaattttggtctagttcatggtttttctagtatcggtaatactcggtcccgcttttcataaattcaaaaccatccatgctaccctcggcaataaattttaaacaggttactgtctaaacgtaagcctcgtgaattaccggctatgtaccttctactataattatattttggaaactttctaaccaggaaggtcaagcagcctactttaatagacatcatttagtttatctaaaaccataacagcgctagcaaaataataattaaacctttaaaacgcttagttttttgtctgtgcacatttttatgatcagaaagatcatccggatgaagcacatattcatggttattcgctgacagaacttcatctgtcaatagacgagtgtgtgaaaaattcattgcatccattctgttcagaatatcttcatcagcatcatcttaactcggcatttttatcatcattatatttatggaattgttgagctatttatttgggtgggacagcgtaataaacaacaattatattccgttaaaaagattttccataaccaaaatatgaacaaaaaaatttaatccgtattttttaccgttttaaaaaaattattttatcgttttgcgtatctcccaaacaggttttggaatttcccgtcctgtcacactacgaaaacaaccttgcatagaatttgctgatttggttggactatcttgattgggatctggaaatggatgatgattcgcaatcttttgaaccaatttgtctggtgttgccactttgccaatctgttgattaattattggatcgagctcagatgtaaaagttgtagaacagtaagaaccattgtggtaatcatttgacagcgactgtgtgccatattcagccggtttcttattcttcattgtcgcattgtttaaagcaatattagttgtaatctgtggcataaattcactgccatagtgataatcattcgggaatggtggaagattatattttgtctgatcatgacccattggcactattacattatcatggttatttatagtttgtacgtcatcaaaattatggtaataaggtgcaaaatttgtatgatcagtctgagtcaaaaaattaccagtagttaaatcttggccataattgtaataatcaaacgctttggatgtgattattatccattgcattgacaatatgccaaagtgagcaaattaattgcaacaaaaataaaattttctttgaaaccatttttttgttatctaa

SEQ ID NO: 15760 - DNA, 2270 bp, Heterodera glycines
  misc_feature (2114)..(2114): n is a, c, g, or t
  misc_feature (2227)..(2227): n is a, c, g, or t
ttagacaaaatttaaaattatctgaactcgaaaaaaccaatgcatagatacatagcaacacaattttaaataaaaattaaattgttttttggagcggaaattcgaactaaaagtgaaagagctctttaaacaatgacaataagacagttttacgaataaaattgtttttatataaaaatatttttgttgattatgcccaaatcattattgagctaataatttttgcaatcaaaaattctcgtcaaaaaataaataaattttggaggtgaatttttgagaaaaatttttaaccgattattctatttctaccgctaaattaaaagttcgttttttaattatttttgataaaactgtaatttggtgtaatattttttaattttttgcttaaacgaatgattagaagatttgtcatgataatcaataataggtttataatacggaacttttctgaaggtaaattcactttgtttatctcttcatttttcataatttaaaataattctgactcattatgtgcaaaaaatttctttcatcgaatcagttaggttttaagaaacaaaaaagagaaaaagcctaaaatattataaattcgtttgaacaatttgaaataatttaaaaatactttcgaaaataattttaaattaatttaaggaaatattttttttatctgtttgaaggcttagttttaatattctagaaaaaatttttaagacaatgaaaacgagtacatatcaaagaattaaaaaatcaaaaaaaaatcgcgcaataaagtttaagctacaatagaactggtaaacaaatgcaaaaaatcaaaaaggataaataggcaagaatatattttttaaaatataactatgttttaacaaaaacaaatattttgtttgctttgtaatggtgatatttatgatatcccagcgataaatttgctttggcaacaacattataactgaacattccagtaaaataaatagattagtccaataaactctaatttcttcctatatttgaaaaaattcaaataattttttattttccatgtttttgtaataaaaaaagctatttaatctgagatctaataattataataatataatttcatatggtaaaaaaatactttctaaagaataccaaaactaagaaacatgatcaggttataacttgaatatattataaagcagattcgatttaactgcacatgtatggccgaaatgaaaaacaatagaaaataaaaattattataataaattttagataaaaaaaaaatatgtcataaaatcaatttcaagttgaaatttttgtaacctgaaattctatgcaaaaaaaatcaattcaatgaaaatgaatactatttaaaattttgattttaggtatagaaactcataaactttttatttattaaatattgttgccatattactttcatctcatgatcacactattatcgacatttcaaacacaaaatattatatttttttttgtaaaataataatcaaaaaattaattaaaaaatataaacctaaattaaaaaaaaattaatacagtgaaagatgcgatttatgtagattattaaattttttgaactttatttaaaaataaaacactgagaaatttaaattaattattaactccaaaaacgaaattaaaattcatttgatacatatacaaaataacagatgcaaatgacttgatgttttttattcatattcatttatgttttcagcaatacgacaaatttgagtcattttttgtaaagtaattacataaagaatttaacaatgaatataaatatttgttacaaaagatatttccataaaaaattttaaagttagaatgctaacagtgaaaatttcaagccttaccaatttaaaaagattctggataataatgaaataaattcatacaaaaacataaaaagttaaagtgaagcaattaatttatcagcaagaaaataatgaatcaatttaaaacaaaattatttaaaaaataggaaaaatcaaattgtactctttgaatatgcttaatatatgaatttacatattaaaatatcataaaataacataatactatttgagacaaaaatatgaacgatttgttaatcataaatttctttttanagaaaatcaataaaccgataaataaattaaactttaaaagaatataaaaaaataattaatttgatgttatattttgaaaaaaagaatttaaaaatttaatatgtaattataanaacaaaatttcataaagttattaattcttttcattttttattt

SEQ ID NO: 15761 - DNA, 3319 bp, Heterodera glycines
atgacgggctccaagtgaatggattaagaaccggacccggcctgggagatagcccttaaaaaactgaacaaaaaattgttcttaaccgggccgggttccggatcaggcacttttggtgcccgaaagtggtgcgataggcttccggaaaatgaccaatcaatcactgagttttttgtggatcgcccacactgagattttttgtggatcgcccacactgagattttttgtggatcgcccacactgagatttttgtggatcgcccacactgagtttttttgtggatcgcccacactgagatttttgtggatcgcccacactgagtttttttgtggatcgcccacactgagtttttttatggatcgactcagcacgtttttaaataaataaaaatgattaaaatattaattataaaaaatgaatttaactcttaaattttaagttatatttatttctttgaagagatcatttaattttaatttctaaatttttaacaaaaaattattccaattaaacatattaatatttaaaattttgtgccttaatttcgattaatgtttcgaattcgaacagctcttcagatgtgccacattgttccgtcgatggtggcaattggaattggaccggtgttgacggggacggcgcttttgatgaagcggcgctgccaatgctttgttgttgccgacgattgaatgcttgagcaaaacagaacaatgcacgagcggtctaagcaaaattaagataacattgaaaattaattaattttattaaataaaaatatattttcaattattttttcattaaattggtgagaaataaaaactatgaatgtctttttcagttaaaataaatataatgttgtaaataatccaatatggatgagattaaacctttgtctatttttaaaaaaataaatatttagattaaaaaaaaaatttatctttaaattgaacaacaaaatttttataaataaaaaataactttctttttacttttttggaataaaaagaactcttattttcctaaataacaagtttttttgaattaattctatgattatgatttaaaaataaaaatatgaaaaagaatgtattaaattataaaataattaaatagtgattttctctttttaaaaattaaaaaacagttaaactatttttaaaacaaacaataaatctaaaaaataatgtaaaaaataatatttaatattaaacaatttttttttctaaaaaattagattaaacaatcaattcattcacctcctccggaaatacgcaacgaaaaacgtggcattgatgaagtgtagcatttttgcccgccaattgtgtaaatgaaagagcgaaacagctactaaattcgttttaaattaattattaataaataatatacctacatacataaaaaagaaaaataaaaaatatatataataaataatttcatttttaggacctttccgatgtctcgggtttgcctcgtgcacaaaaacgaatcctttggattggaaatgagcaaatttcggccgggcattctttgccggtttccaaaagtctgaaaaaaaatctgtttaaaaattatatttaattaaaaataatttatatattttttaatttatttttacagtcacctaacaatgcctgttgggccatgaggaatgactaaggtgaccgaaaccgcatcatgtgccttttcggcattcattgcagcaacaatgccaagcatttcacctgtgagttaaatggggtgaacagaggagggggggggggggcatatttttctaattgattattttggggattttttggcatctctgaatcagtgacggtttcagtacgggatatcggcttggagaggctaggagtacccgaatctgaccatttttttttcttttgctcttcagaacaccaaattttcctctctatttttaaacttttttggggagagggaggtcagtgcattttgtacctcatcgcccatttttgaatttttcacaaatctggaaatcaggtttccgacagtttacgggatcactgaacatgaagttaacatcacacatttcgaccaattccgaaccccgaaaatgaaatcaaaagttgaaaattcaaattttcaaatttcgcacttgcttcaaaaatggtggtttaaatgatcttttttttcaaggcttgatgacttcagtttgtttctttgtatttaagctgtttggaacaaaaatgtgaattttcgactttttgttcgagttcagaattggtcgaagtggattttgtttgatatttttctttgtttaaataaaatttcaatattttttttcactttcgctcgtcgggtcgcccatttttgaacagcccaaataggacagtctttcaatgattgattcagctgcttcacactttttgttgcaatttgttaagttcaacggacgagcagtggtgccatcatccgaaagttgctcatttcgcttgctaattgttggtcttggggctgaggcatttgctgaatttcgaaaattttaaaatttattatttttttaaagtattgaaaaaaataaaaagaaaaaacaatatttccttatttaaaagataaaatttttttatttatttcaataacaaatattttgattatataaacaattttataaaattaaattaaaagaataataaaattatatttttaattcattttaatcattttaaaattatttataaccagttttataaaaattaaaataataaaacaaatcaaaatattcaaaaattaaaaaaatattccataataaaatttaaaaaaaaaacatttttttaaaattttagataaattaaaattaaatattcaaaacttatttttatgaatgtaaaatttaattgcttacatgccgatgccgatcgattgcgagaattgctgctgatgctgttcaacatcgaattcagtgatcgacgcgagtgatcagcaaaaaatgtgctgctgatcgcactgcgaatgggcgacgaatctctgcgccgttggtgctgttctgctgctggtggtggtgtaattggcattggacatgaaaaattgttggatgcttaacaataaaatttaaaaataaaaaactgcttatatttatctaattttagcaaaataaattttaattttttaatattttaaaaggaataccatatttcccaaatagagcccccggggggcttaattttttcaccccccctcaaaagtggggcttattataagggggggggggggctaaattttaaggggggggggggtattttttaggaaaaaacctaaaattttaaaaaaaataaaaaaaattttttaataaaaaaaaaaa

SEQ ID NO: 15762 - DNA, 1760 bp, Heterodera glycines
ccccaatccgtcccctccccatttgccatccgtcctccttaaactccgatcgatcattcttttttatccatataaacaaaatgcatcatttttaagtcccccgccggtcgccccccaatttctgccgggaacgacagcagcagcagcccaaacaaaacggcctctgattttcgttaaatgatacagggaatacaaaaaaaaatcggatttacaatttacgtcaaaatcaaattcaaaaaacgtccaccgaaaaaaagaaaaaaaaggggggggggggggacagatgggagcactcaaaaacagaggaaataaaatatgttcgataaataaataaatgatgaataaaaaaatatttgatttcccctctcttcatcctcccgttttgatcatgttccatcatttttgttctaattctgatccgatggatgcttaattagctgattttttcattttttaaaattttttctcttcggaaagtcataaatttttttttctttgtcagtcactcttttccgtaacatatgcgcttgcttttatttccaaaatgcttcattaacttttaattactacataatttcttttctaaaatttttaaatttcattttaaactaattaaataaattaattttaaaatactattaattaaaataaatttactttttgttaattttgtactttcttcggattattctcttatcagacagactatttgtttgatctgctgattgatccccgatctctccttccttatcactcatcagcagatgaaaacacaactactcttgtgatcactgtaaaaacattatgccattctctcaaagcatttgccgacttttcttctttgcatttaaattattaataaatgcttttaaatgtgccaccaattcgcaaaaagtccattaatggcacggcaccaacagaaaaataaatgaataacccaagcggatggaattattcaagagcttttatttgtcttttttgctggctttttggttctgatcaaaaaaattctcaaatcaggaaattttgtttggtcacttctttttgattaccttttcctctttttttgcgttttaatcaaatttcgctaattgtccccgatcagatcacgcacagtcaattagtccattccgaatcgaatcatccaccattttgatcactccccaatcagatcagatcagcagcaattaaaacctatctgatccctttttcttttttgatcaatccaataatttacgcccccccccattaatccgatgctttgtccgttaagcatttctttgctttgttccaatctgatcgcaaatgattggtaaatcttcgtcagatcagccaacaaacatttccaaattctgctcacaatcagctcactcactgatcaaccagcagcaccaattctcaatgaatccttttgtgcattgacgcgcaattcgccgaattctccccccccccccccgcgggcgaattgctcaaagaataaagtgattggaggaggagggggaaagagcaattgcgcccctccccccgtttatttctccctcaaattcgctcatttctccgcccccaaaattttcaatgattgaaaaatacacagaaaattcaccacttacatacacatacacatgtaatacgaattacttactagctgtctgtctgttcccccttataattttattgtcatttatgccaattttttggtgccaacggcgccttccctagccatttttgaatgttttggcattaattaagcgacaaataaa

SEQ ID NO: 15763 - DNA, 965 bp, Heterodera glycines
  misc_feature (57)..(57): n is a, c, g, or t
aaaagtgtggcagtcacaaaaataaaaattgtcggcgtttgcctaaaattcatttgnccggcactaatggggggccaacgccaacggcacggcacacccagcggaggagggcaaatgtcagcagcaattttcactgatttgtccaaacattttgaagcttctttttgaaaaattcaattacattttaaaaattttatttaaaaataaatgcttaaatttgaattacgaaagcaattaaattttttgttgagtttaatttaaaattaacaaccaatggcctttttagctctcattaattacccccccccccccccgcattttttattgaataattgcatcatttgttaattgattgatgagcgacgcgcccgccagtgccaacaaacggcgttccgcgctggcggtcactgcgccggtcgcgtggcgctcgcacagtgcgccaccgcgcaaaaaatggtaccggagaggtgagagaggcaggcggaagcataaaattgcaatttaattttcaaaaaatagcgaacgaacttaataaatattagctgccgcgccattgctgaaccgccaccggtccaccacgcagcagcccggcgccgagctgtacgaccaaatggtggcgcgtcggttggtcagtgccatcgcagcatggcacgacctgcacgcgtcgttgctgcaactgtcgctgcgcacgacggacgacgacgagggcggcgaaacggcggcggacgacgatcaccgtctgctgagtgccaagcgcgtgagccgcgtctcctcccgcgcctcctccatctgttcaacggcaggtggtggcaaacttccttcttttttgaaaattaaatttttaaatttgctaattaaggccgaaaatcggcgagcatacggcgagtgagcggcagacggaaaggaggccaacggcaagcgtcggcgagacgcgccgcgcggaatcagttgcgcgtcaacgacag

SEQ ID NO: 15764 - DNA, 733 bp, Heterodera glycines
  misc_feature (8)..(9): n is a, c, g, or t
  misc_feature (40)..(40): n is a, c, g, or t
gcctgcannggtccctttagtttcaataaaaaaaattttntgaaaaaatctgctcattaaaatattcaaaaccaataaattaaatgctctaattaatccatgccactttcagaaatcttttctgcaaatggtcgaacaatttcaattagaagaagcaaggatgaagaaacacatggaagaggtgcggaaaaaaatttaatattcaaaaaattgcaaaaaaattttttgtcggaaattggcactgccaccccttttctccctcagaaaattttaatactttgtagatttttgcatactatgaaactgatttttgtggatttgggctaaataaaaatttaaaaaaatgcttgatgaattgtgggctggcgattccgctaggtgccaccggggaaaattaagattttttaaaaatgaaatcataccttttttagggggttggggtcgaccggatggatattttcgaaataaagaaacctgcgagttctgataaaatgataattattaattaaccacaaacagagcgaacagaagtgggccgagattttgctaacaaacggaagacaattggagaagggaattgcgaattctgaagaagagaattggagaaaacaaatggaaggggtgaggaaaaagaattttaataaagttttctaaatttaaataattacgtaatgattagcatacgttaaaaaagtgggggggggggggtcggtttggcgggagcaggtggggg

SEQ ID NO: 15765 - DNA, 1509 bp, Heterodera glycines
tttaatccggagaattatgccaaaaaaagaatttattattactattttatcatttttttgccatttttcgtattaaaaaaacaactgctagaagctgtgctgtttatagcctctttattattttaatggcaaaatttgcagagcgaacggcaatggacagttgggcgtatgaatgggaggcaattgtcggaaatggaaattgcaaatcaatgggacccgccaaatccctgtcccgcctctcttttgctcacatcgcctggggcattgtgtgtcgaacacaccgggcccaataacggtaaatgcctctaatgatgttcgagaatcggtttttcaacactcagtgccgagtaatcattcaaatttgatcaaagcaatttgcaggggatcggcattttcattttacccctcattttatgggtggggagctgcttgaaaatttataataattttgagaaagggggtcgggtgattttcaagttttcctcggcggcgactggcggcaccgccgaacccaaaaattctatttacctttaaaaattggctcaaaatctcaaaaattgccattttttggtgaaaatctgttaacaaatcacacccaaagatcaaaaaattttcccggaggcgcctatcggcaccaccggccgcccccctgttcccgaaattttttttggaattttggaaaaagcgcgccgaaaaaaactgttttgaaaagcaaaaaaaagggtcattggcggccgatcccccttcgcaaaaatttttcccgacccacccccctttttaatgtatggtgattttttaaatttttgtaaaggcatccgattgggggggggcggggttgacggtaaaattctcgaaggaccaaaaaaccaaatgtgtatcttttttgctttttttctgaaactttcttaaaaaatttaaaaattaggctgcgtgaaaaaatattacaaaatcgctgaaaaatttttcaaaaaaatctttttttttttttggaatttattatgaaaaaatttgaacttttttttcttattttaatagtttattcgaaactcttggcatttttgtaaatttatttgtttttttttcatttctcagagtgtttctctgtccttgccaaatggccaattccaaaaacgggcacattttacttcgaagttaaatgctcgagtcggcatatgaaaatggggtaagtgaaaagcatggccaaccccattttgctttcggcattgctcacattcttccatttttaagcgcggctattggtttgtccaccaaacaaatgccattggacgaatgggtgggacaatgccggggcacttactcctattcatcccacggcattttgtacgggcacaatgttgcgggaaaggatgaacaatgttttgctccatgcttttatgaaaatgtgccaccatttggttactacgatgtcgtgggctgcggcattgaattggcgacacgccaaattttttacacgaaaaacggacggcgattgggtgggcaaacaaaaaa

SEQ ID NO: 15766 - DNA, 1129 bp, Heterodera glycines
tgtttattttaatttgttgctattcgcgggctttctttggaaaagtgatccatatttttattttttctggaataattttgaaatttgaaataaaaaaaaatttggtggcgagattttgtctcggcgagatttcggccgggcgagattccggcggcgagatttcgtcccgtccccggacagggagggggggggggcaattttgtaaatcgtactggggtccgaggcaattttgtaaaatttttggccaaaatcgaaaaagcactggtaaagatgggaaaattttacgaaattggaaaaaaaaatcaaaattttgtgccaaaaactcaacaatgtttgctgggctataacttttgatcgagacatcgtagaactaaaagatatggcattttatttatttttataatcattgataaaaaaatcatagatttttgcagctttggcaccagattcttgattagtgtctaaaattatcctgaaaagatgtttttctttgtttggcttatgacatttttagaggggcgcggcataacggaaaagtaccaggaattttgaagcgatatgagaaatttttaaacaaattttttaaagaaatttataaactacaaatttttataaaatttaaaattcgtttttgtttagattttaattgcttaactattttttcccctttaaatccacttaatttttcccctttttagtcactcccattttgcttgtcgcccctttgtccgtcgatttgttcccatgtgtttcgctgtgttgctcaaaaatggaagcgaattttggccctaatgatttcatttacaaaaattcaaatgtcattccgaaaaggacgagtgatgaatgagaatggagggagaacaacgaagatgaatgatctttaccgaattttatacatttgcagattaagcaaattgaacagtccaatcaatcaattatcatgctcacgcgactgtgaaatttaataaatttcttcaaaaaatataaaattatttattcaaattcaaaaacttaattatccatcaaggaattaatctgatgtacacaatgggaactgtcattatgtttttcttttcttttttttgtaatttggacagcacagaaagtatttctgtatgagaatcaaaaa

SEQ ID NO: 15767 - DNA, 1625 bp, Heterodera glycines
atgtagtatgtggatggatgcttgccatcccacatagatttaggtatgtggatggatggttaccatccaccattagatgtcgtatgtggatggtatgtactgtaaattaaatcgtttaaggaccatcggctggagcaagtctcgcagggctcgacttggccaccaaacgaagcttttgcgagtgcagcttatcgtgacatctatggaggacagactgcagggtcacagactgcagctgggatcaggaaagtgtggcgccaaagattgctgcacagtttttatcccgggagacgtgcagcggcaaagagtgctcgccttggcctatacaaagccatcgatgaaaacgacaaacgcctcgacaaaaaccgacctcccaagtataacaagctgataacgtatcgcttggacaaagccttggtggaacatccgacggcgcaggcacttatggcacaacatcagactgcagcagttgcggcagtagggggtggcgaggaatctgaggaggaacagcagccatacttcgtggatccggtggaacaattcgaagcgcaggttggtttatctatccccataatctctatgggtatggcgcaaccagcaaccatccacatagcaggtggtatgtggatggcaaccatccacatagctgttggtatgtggatggcaaccatccacatagctgttaattaaggggatggttcccatattaggtttacttgggaatgtgattcgtttcgttaaaacaatgaccggtgttttaaagggtggtgtcattaccgctgcagacgtgcaggatttgaagcgtggttggacccagcttgagctggatgcgaaagttggagcattgaaggcgaaaaatgaccggatgtatcagtccatttgtgcgcgccttcaaggacaggccgccacaattcagcggctgcgggcgacaaaaggcttgaaacgatctcgtggagacaagagaaagacttcagttcgtggaaatggtaaggaaaatgcaaatagaaagtggtatgtggatgggatccagatactcattacagtggtctttacagaatatataccaacatttttcacgttggcgccttgctaaccctgttttaaagataagatgagcctggtgacaaaaccttccgcagtaagtactgaaataaacatcagatcgttgaccttataaaaagattctgatgtaccgatgtcaatcacggaataatttctctagctgaaaccgaaaccctttagaaagttccctttctggttgtaattatgggttagaattttaaaatttgacctattataatattctattatttatatttttgcaaaaaattcgaactaccaacatttttcggggcgaaattcgggcttccgaaaaaattttaatttcgaacccagacccgaatttgaacaggaagacgaaaattcgactttttttagttttactttttatgtttgaattgcatacaacataaaaaatgtacacattttaatgttgaaataatttgtgactaaatttagttggtgtaatcacgtttaaaaaaaaatttgtcaaatacacctccgggctttgaaatttatcaaaatggatgagatctaaaaccccaaaaaggagccttccacttttt

SEQ ID NO: 15768 - DNA, 1392 bp, Heterodera glycines
tgcatccccttaacaataactcctttaagggtccacgcatttggctaagaagaaaactttggcccaagtgttggcgccgcctaagaatgcaggcaaagacgtgcagtctggtaagtagttttaattttcttgcccgaagaagaagaagcgtggtaccattgatgatcgggaacattcccgttggtaggtcggtcggagcagaagatcggagagatgacgaaacccccgccaatctggcccctttttccttttcttcccagttttctcctttttatttaaatcatcattttcaatttcatttctcattatccaatttgtccaccatttcacatctgcattttctccatcattcttcgccccatttgcattttcacattcattcacattttcaaattccttttgttcggcccgattggggatccatttctctaaatgtttatttcgtcctcatccaggcccatctcggtgatgctgcgctcggaggactgcgcaagaacgccatcgggattcaaatgctcgggatccgtgggcacgatcctgactctgttgccatccgatcagtttatctcatttctgatgaggtcagcccagtacgagctcctcagggcagttcggctacgtttgagctcaataacaatggtctgtgtgccaaaaacggagaattggctccgttcctatacggtttcaacagttgcggttaaaagatgcccagcggcgggctcctgtcatgacaatgagatatttctcaggccgaaaacgccaccagggcgttctttgcgtgttcaaaaaaggctttcggcatcagcaagccgttcgccttcacccgcactaacagttcggccacgaactaatgtgctggggccagcaacagcgttaacaaaacgttgccttatggtgcacaacggctggcactgcgctgctgctgcagcaaaacattttccggaatattctcattccggaaatctttgtgaccacaaatgcccccattgtggagctcttctcttcctacacgaagacagcagcctatgctgccgaaaaggaagggttgtgttgccaaaattgaaccacaccctcaagagcttatggagcttatcgttggtgaaaaccaaccaaaacagggaaagagtttgtgcgacgcatgtcgcgttataataacttgctccaattttcaagtgtttccgctggaaacaagccgagccctgcttgtggtccgatggccgttatccttaaggcatccattgggtgtgcagctattttgctgccgtatggcaagacagcccattccaccttcagactggtcagagatgtgtcactggacaagcatccaagcattccgcttgagagcttcttaaagcgaaggattcgtgaggcacaactcatcatcattgatga

SEQ ID NO: 15769 - DNA, 1034 bp, Heterodera glycines
tccaaatcgtatttccatgcacattgtattgctgtatcattgtataatatatgtacatattcatattgtgttatattgtgtattatccattttgtttttcaacaaattaaaatagattcttagcatgtcttaaaaaacaacttctggactgaattattcaacttattattcacagtatgtttgcaagggtagtacagtatgcctatgagatacagattaaatttccgccaaaaagtcaaaaatgccaaaaatctctccatttttatttttactattcaaatgtttccatttttaattgcttttgtcagctcggcagcctttcttcattcaattgacccctcctcccaaacctcactaattaggaaattgtctacaacgttttcatctccgtttttgttttactgtcctctcatttattgacatcttccatccaattaagctttattagggtcatcatcttagaattgaacaaacaccaacgtcagatcgagcagagattgtaattgctatttctcacttttatttattttattctgtatttgatctccaacccaacgaattcatcagaaattgtcgtgccaattcgatggttgttggataattgtcgttgagaagcatttcgcggaacctttgtgtaaattggttcctaagatactttcgggaacacaaaatttgcaaagcgataagcttttcttagatgatcatttttaaaaaattgaatatgattcgaaggctttgcatattttgagctggcaattattataagctttcctatgtcgttgacacgaaagttgtgactcgaaatgtagttttggttgtatttttttggtgattgcttagcaattgctagacattttctcattttttcttacaataaaatctttaaattagtcatctaagacaaagttatgggattagctaatttctggcgcaaaaagtgcagccaaccgccattgggtgtcccctcgcgttcgcttttcatgtaaacatatggtgaactccattttttctacatgtcacacccttcttctcta

SEQ ID NO: 15770 - DNA, 1506 bp, Heterodera glycines
aatgatactaaaaatgtaattcggaaggttccagaaaatttttgggacactatagttgtaaaaaaattatggtcggtcttttttttatggtcgtctgaactgcaaaagagctaaattgactcactttcaaaactgagatttttttccttttttttgattggagtgaggaaatgggtggtgtaaacggagtgctccactcgcaccacagacgtccgtccgtcgtcggggagggggaagggcaaaaatgtaaatcaataaatccgattccttcccactaaaaaacggtgaccaccattaatgaatgctactaaaaaagaactgatatttatttctaaaatgaatcttgtcctttttattcattgcgttttaagcatttcccaactacttttcaaaaatgatggttaacaacaaaaaattaaaattgccgcccgaactgctcgcggaattggtcaaaactctgcgctttgaccttcgctgggcccgggtccgggtttcctcagtttttgactattttgcaacaaaaatacaacgtctgtggttcgaggagcagaaaaaagaaaaagaaaaagtcctttgcgttggagaacaccatggaattacttaatttcgattttaagagcactgccgaaattggaggcgttttgtccaattttacaaaggtggtcaataagtttgaacctgcccaacggaacgtactccgaggcaagtgaacttttcgaatttttgggttttttggtcgaactaggtcttaattagctcggtaaaaatattccgggaaaactaaaaagacagcccttgttttcaggatttttaaaccaataaaaattttgaaaaatctatgaaaaaatatctatttcataagattgttaaaattttaggaagcgagtgaaagaatgataaataaattatctttttaaaatttatcttttcccccaattagaagtggaaacgatctgttccgaactcattcggcccaaagacaaggaagccttccagaagggtaagtttcataagcaaataatatttggaaaaaaatttttccattggaattgactgagtcgatgattatttttgacatccatttctacctattctcgaactaaaaattgattgaactgttgttttgagttttgatttggaattcggaattggtccaaatgaagttagaattatgatcaggacctcgaaaatacaaaagaaaagtatcaaattttcatttaaaaaatacaaaacaaaaatcctccattggttaaggaccactttttaatgtttccaatttctgcaaatccttaagacaaatttcctttgtttaagtgcttgtagcattcacgttagcggttgattccattcaaaattgtcaccgtttggaaattggagcactaagaaggcggatttcggagcaagacgaacttatcgccggacaaagtgaacttatcacccaacaacaacaacgaatcgcccgtcaaagtgaacttatcgcccgtcaagatggacaaatcgcgcagc

SEQ ID NO: 15771 - DNA, 928 bp, Heterodera glycines
aaatttgtggaattttgagtgagatttgttaacagattttgtccaaaaaatgtccaatcatttgtaattttatgggtctaatgctgttttaaaaataaaggaaaattatttttgtgctagaaagttttctttttaattaaatttcaattaaagtaattttaaaaaatgtgaaaactatcctatcctaataggaaattgaacccaagggacaaacaatgaaagacagaaggcttaactaatagactacatatatatgtgtagttacttaatagaaaaatcaatttatttatttaattttttcacaaaaatttttgttttcccaccaatttcctattctcgtctcaataaaaattccctatataaaatgccaatcacggatcaaaatcacggaaaaattgaaaaaatcgtgtgagccatgatccgtgatcacggccagccttggagcataagcaactgctaaggaaataaattattgtgaatgtcataaatctcctaatcatttaaatttttattttttgatatttgaaaatatttcagaattgtataaaatttaatatctaaaaatctataccttaaaattgtttgctaatttatcttttttagtataaagcatttgcaagtattgacgttgatatagtatgtaataatactgataggcttttacacttgggtgttcatccttgactagattagtgatgaagatgagtagtaagcaaaccagcagaacggctttatgtgtttgacttcatcagatgtcattttcattgctttgttgatgccatttttggcttgttgataaaaaaaaaattttttaattttttcttttttatttccctacaggttttggggatcattgctagaagtagtacggtagggaccagctcctgtactgggcggtaattactgctttttatagtgccggcgaaac

SEQ ID NO: 15772 - DNA, 1570 bp, Heterodera glycines
tataccgtaaatccgctatttgaatgcccttgcattctattgttcaacgcctccaaaaagggcatttaattggagggggcattctaccagagaggggcactgtattgttcaacccctcaaatctcggaaatttttttgcgagtcaaaaaggggtgaaagcatttttctaaccggttttatagcgcagagcatgaatatgagtattgttttacgttttacaaatttttgaatttttaaaaaatttcgaaaatttttcatttggccctcgggaatttggactcgtatttgaaaattcataactcatttcaaagtggataaatttaagtacaataaagctttaaaaatagagaaaaataaggagaattttatgaatttattttaaatttctatcatcaaaatgaaaaattttttccagaaattctggaaaaattcgaattttcagacaaaaaatcagaactcggttcttaaaggatgtttttgaaaattaatatactcaaaaaacccgcaattttttgctctatagaactgtatttatttcatatttctactattttttttggaaaagattagaaaaataaaattgatttgggaatttgggaccaaagggggggggaccaaatggtttatgagtggaaaaaattttttcacccaaatttagctgaaaaatactttttagaggtattttagggtgttgataacgaatctgtaatcagatttcgctttcggcatcgacaaagccccagaatccctgcggatatactcgatccctcctggaggggggcattttattggagaggggcattctaccagagaggggcattgtattgttcaacccctccaaaaaagggcatttaattggagggggcattctaccagagaggggcattcaaatagcggatttacggtaggcaattttcgtaacaaagtgcactcaaattttctacattttttcaaaaaatttcctcttgggaatagtcccggcatttctcgcggtctcggtcccgggcgaaaaacttggtcccggtcccggcttttccggtcctggtaagtcccggtccccgttttggtcaaaagtcacggtcccgctcaactctagttaaaaatgatcaaatattatattttcagcagcctcccattatcaatctttaacatttttgtagaattataagcagcctggtttaagcttaagttttttcaatccctgatagcttaaacagttttgaggattttttacggaaattcttggaaatcctcaaaaaatcgaaaatttcgtcaatttttcgtacatattttcattttttacatattttgagaatttttgaaaatttatagaacttttattgtgaaaaataaaatttttttaagctattaaaatgttattctggcctatttaggtcatttttatggcatttttcacctattcatccttaaacaaagaatttttttccaaaaataaccatttaaaaattttatataaatatttggtacatattacatattttgggttttttgtacatatttcgtgattatgatacatatttatgtacatattttgtctttttctattaat

SEQ ID NO: 15773 - DNA, 225 bp, Heterodera glycines
tactatatgtagcttttctatagaatggcaatttttattagaaatttaaaggaattgagttgtcggtgagttcgacaagcgccaacggggggaattttttttgccaattttaacaaattaataaattgtcaagaaaattgttttttccctcaaaatttttttggggtggggcgtgcctcggtcccccccccccccccccctttactgaacacggtgaaaaatctt

SEQ ID NO: 15774 - DNA, 2366 bp, Heterodera glycines
  misc_feature (10)..(10): n is a, c, g, or t
  misc_feature (105)..(105): n is a, c, g, or t
  misc_feature (160)..(160): n is a, c, g, or t
aaaaaaattngaaattgaggtaaaagtgctaaaaacctcgaaaaaattaatggtgaaaaaacttgaaatttttctggtttcttgaattttcttaatatttttttntgaattaggctagataattaaaattttagatgccttttttaaaaactttaacatnttgcggcaactttgtgtcctggcgccgtttcggctgtgaggttttgagctctcccacaaaatttactctaaaaaccatgctctatttgtctcaaaaaagaaaaacttaccgtcgccttcgtcctcctcaatttcatcgtccggcacaacaaaattggcttcttcttcttcgtcataggagccagcaccgatcaaatcctcctcatcactctaaaaatttagtacatttaatttttttgcatttttccgagaaaattacatttaaaagattggcaaaagtaaaagtcaccaatattttcttaattaaaaacaataaaaaatgaaattagtgctatttttgaatattcagcacactcttattgttagttgacattttttaaaatttgaatgtgcggcccccaaacagaagtaccctaaatttcgatagttgcgactatgtccaaaatggattcgtattttaaacactgcgataatttcaaattcgtgtttcaattagcgtgctttaggcagtgaaaagctattttaaagaacgttttaaaaaatgtcagcttttaaggtaacgtaaagtaaataagacccaaaactcgaccaaatttattgaaaattcctcgttagacaacaaaaaacaaacaaacaacaattaacctggtagtaattggtctggtagcggaccattcgctgaatgtttgtggtcgctttcatcggcgtcctttgctgggacgaagaggaggaagaagactttcgccgatcggaagaaccctcatcagtctaaacagcagggataaaggaagtcatgttaaatcttataaacaccgcttcttcctcctcagattcgctgctgctgctgtgaatgaccattggcccactcctcccaccaccgtttttaccattttcttcctcctcttcgtcttcaatgactgctcgaactcgtcgtttcattgttaagaaaaaaaggaatttaacacaaatctaaattcacatagtatgtataatggtgagcaaaataaggccgcgcatgcaaaaaaaaagtgctatatttatttatctaattgtttatcatcattagagaccggatttttaaaataccggcttagacaattggccgggaccgggccgcccgttcaaaaaaagccgttttaccgggcgtaccaggcccggtccaaaattttggccggcgggcgttttttcaaaatttgtggaattttgatttataaaataaaatgggcagtaagccataaaaagatctttttttttcaaaccattttttacggcgcatttattttgccccaaaaatgaccaaatttggaacattttaaaaataggcaaggaaaaggtgaaaaaggcaaaaaagggtacaataattacaaaattatatgcctcaaaagcctgtctctattaataaattacgaactcaattttttttgtcgttttacttacttaccatggcccctaacaagcaaattatcttagattaagattacatttaaaaaacagaaaggatagaagaaattttatgaatttttcccaagaagttcccaaattcggcgttacgaaattatcaactcaatactttgaagacatgtacatttgaaaaattcatacatcataactttttttatgctcatcaaaaaagataatatttataattcgatcggaaaattgaaaacggagtaaatacggaaaaacattcacgtggaaatgaataggacggatagaacgagcagaaaagcaaaagaaagatcacaagtctctacaacttttttccatggagaatgaaagttcgaaaataaaactacagtattccaagggaaaataagcaaattttgtgctatttcttctgcgcgtcctattcatcttccacgaaatcccttgctaggtcatttcgtcaaaagggcaacgcaaaaatacaaaaaaaaaaacataactaaccaaattagcaaatttaaaagtttaacaatttattaaggattaaaaatatttttggataaaagtgtaaaatatttgttaaattattttattttcgtttggctaaataatttagttaacacattttaaataggtaatttaaaattattttaaaacaaaagagacaccgactgatgatgaggcccccgccctcccgttctcttctgttaaattcccttttcgcgaaatgccctggcatgaatttttaaatgcgtgccaactttacagaaagtgattttatg

SEQ ID NO: 15775 - DNA, 622 bp, Heterodera glycines
  misc_feature (618)..(618): n is a, c, g, or t
aggtcccattttgtagtacagcaggtcaaacaatttgtcaaatagtcgactaattcacaacacaaatttcttccgttcgaccatttgtcccatggattcgtcgctcctctgtcgtccttttgtctccatttgctcccacatgtgccttttaaactcggcacattcactttcgatttctaccagaaattgcttcatttttccatctttaacggacttcaaatggtccaacattgattttgttgtattttccggaatgttttgctctagccattgaaagaattcgttcacatttattttgtcggcttttcgctctttgaactctttggaattggcacccaaaaaaccgatgcattccatcgctgctcttattaatctgactattttttctgtcttttccgaggatgattcaacggtattctgaaaatatggacaacaatttatgcaaataaatgaacaatgaatggaaaggggagtttataattaattaattatttaactaaatgattaattacctgatttattaatgaattattactaattaattaattaattacctgctgctgagtgttgtctgggggaatgtccaattcattcaactttttctgaatctccaaatgngtat

SEQ ID NO: 15776 - DNA, 1479 bp, Heterodera glycines
cgacagcgaaaattggtggcactggtgccggtcagcagggccaaacatcggcttctggcaccgctgcaacaacgccggcggcggcttcggttccaatttcaccggacacacagccgttgttctaccggacatcaaaaagtggcggctttttcaccccaatcgcgggttccaattcgccgcagcggttgaacgcgtttcgcaatgtgggccggtgagttggggaagggaaacaaataaattttctggtctctggcgttggcgataagcgccgccaggaaaattttaaatttgtttactttttacgaaatgttttttttttcaatgtccaagttggcttgaccaattcgtacctaaaatttttttaacaaaagaattttgaaaacaaattcaattccctctatagcgttctcccccaaccacagaaaattttaaaaaaaaaaatttcaaacaaattttgtaacaaaaaaaaactgagaaactgattcgagtaataatattttttttcaagaattattggattctgtcttcaaaacacggagatcatcccattgccgtaagttatttattatctcattttttacatttttttaaaatttaattccattctctacacagattgtgtcggcatgtgctcaaattcattctgaaccgtccgctcaattggttcgacttggccttctttgacccgtcactgttcgactcgttgcgtcacattgtgtacaatgagcagaccgacgcctaccatccatccgaattttatgagcaattggaattgacattttcggtcgatttgccggccgaggaggtgcgttttttggataaaatttgaaaaaaaaactaataaattcatggcttcccaggcctgccgccataggtggacaagggggggcgtcaatttcgtaaatcgtacgagggtccgaggcaatttcgtaaaattttcggccaaaaccgaaaaagcactggtaaagatggaaaattttacgaaattgaaaaaaaaatcaaaattttgtgccaaaaactcaaatttttacgattttgaattgcatttcgttaaattttccacaaaattctgttttgtcttttcctattcgttaaaagttttacgaaattgaatttcgctttcctatttcgcaaatttttaacgaaattatattttttagttaaaatatgttaataaaaattcacgaattcgtctaaaaatcgcaaaattcggtcgttttttacacaaaatctgttatcaaagtgcactgaaattcaaaaattttcatcgcaaccgccggacccccaccacccaccctccccccaagttcctcaaaagttttttggaaaaaacgtcgcaaaaaagtgctttggaaagaagaaaaaaaaccgaaaaaagtagtaaacaaaaaagaaaaaaaggtcgtagaaaaatttttgagcgtttttttttcaatttcgcaaaaattttggcctctaagggggggtgggggtgggggg

SEQ ID NO: 15777 - DNA, 2236 bp, Heterodera glycines
attgaacacaatcgtttcaaaaaaatttaatataaattcttattttgtcccgaatcccgcccaaaatcatcgggttgggattcgggacgagaaaaatattgggtttcgagtgacccgaaacaactctggtacgcataaacaaatttttggaaatattttttttaaatacgccacctgccctcggaaatgttcaaattcacagcgggcaatgttggatcgtcctccgatgacatgaacacaaatttattgcaccgttttgcccaagtcgccttcacgtgaatggcccgcttttggtggttctgtttgccggtcaaaatccaacagaaaatgcgaacgcgtcgagcaatttcgttggccaaagtgacaacactcattcctgggaaaagcaaaaaataataattaaaatggaaaattcaattgaaagttgtggattaaaaaaacacatgagaagaaagcccaaaataaggtaaccccacaaccaaaatgtcgaaatatttttaaattttcatcatccggagatttcgaagaaaccctattattaaaaaatttgtagtcgaattgagttttctataatattatagacatagaagattctagttcgccttctatacagcaataacaccattcttctataaggcatttgtaacaaatgtctagcgttagggcaccagacacatatgtacaaacaaacaaaaacaaacaaacaaacaaagttttaagctgaaaaattgggattttttaaattttggtggttcttgaaatatataatatttggctcattgttgttgcccaattgttgttttgttagccttttttaatcttagaacattaacatttccatgatgtatatgttaatttctctcatttttgcaggagctgtgcttcttttggaccggttctccaaatctgccatcttcggaggtatgtgtgtgtcaattaagtaatgaatttatttttcaactattttttttttcgaatttgcaacgaatctgtttaaatccctcctctccacattctttacaggagggtttccgaccgttgccaaccatcatgattcgcccggctgatgaccagcatttgccaacggccaacacgtaaaaaaaatttaaaaaaaaaattgtgatattttaactcttttttaatttaatttgctttttcaacaggtgtatttctcgtctgtacctgcccatctattcgtcaaagaagctgttgagggacaaactttcgcttgcgatcaaagcacgcaactttggctttgtctgatcatttaaagatggacggaagatgatgatcagacgattcaacatttgttttttgcttatttcttctcttactttttttcctctaaagttttttgattgacttatgttcaagtgtgtgtgttttattgacatcatttcgagttatccaaataaaagttttgttgctttgcatttttgtaaagggaggaaaaaaattaattaatataagtagggttgcaaccccgaccccgacgcttcataccccgaccccgacgcttcataccccgacaaccccgaaccccgacccttaaccccgatcggggtcggggttaaatatacacccctaagaatggcattttcgtgggagaaaatgcaaaaaagttagacgaaatttggatttttttaaccatttgccaaatttttattaaataaagaaaatttgctcaatttaaacatctggaatgtggtgtagaggttagtgcgtcccattgacattacgttctgtcgtgagttcgataccgtttgacgttttcttatttaattattttctttgtgacaaattgtttttttaaattaaatactcatagaaatcgaccaatcttggcatattttgacaaaatacatatcgaagaaaaacaaaaatttaccgaaattcataaatttttttggtgaaaaatcttagaaaatagagcttaattccaaaatttagcgctgcctatcggcatcacagggcccaaaaagtcataaaccttattaaaaaaattggctcaaaaccgcaaaaatttagcatattttggacaaaatctgttaacagatctaaccaaattttcaaaattttttccccggcggcgccctatcggcacccgccgagaccccatttctcctatacggtctttaagaaaagaagcgacgtcgaaaaaaagatgtttttggaaaaacaaaaaagtaataaaaaaatattaaaatttcaagaaaaaaagaaattaagttctata

SEQ ID NO: 15778 - DNA, 894 bp, Heterodera glycines
  misc_feature (797)..(797): n is a, c, g, or t
cctatagacttaatttatgggctaaattattttctctcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgtgtgtgttgtacgctttgaaaacaaaggtgaggaaagacaaaatgaaaaaaaacaaaaatcatgaaaattgatcaaaacaacggctcccgaagtcgatgaccgggggccatcagttgttcaaccgtttgatgctgttgttgcggcggttgttgctgaccgtccgaataatcgtcgatggcattttgttgttcgtcaacaacggcactcaaatttgaagtattgttggcaccgacgagcagacgaagggcatccatagcaactgtttttatgggcaatttggtatttttttaaatataaatttaaaaatctgtgaatttttatcaaaaaattatttccccacttgggccgcgtctgtcagaaagtcggcggccagcttgaaattgttggcaaaacagtactccaccgcaatgtacaacaacggctcgaagtggccttcgagaattcgggaggcctaaaaaaattcaaaaaaatattattaatgttaatccgtaaaaattggggggaaatttcaccataaacatttcgtgctaatcttcggggctggnccactttccctccctttttttcaccagtaatcccccaggaaattcgccatctcaatgctatcacacaatctcggacggatttgttgatggtcgccat

SEQ ID NO: 15779 - DNA, 2313 bp, Heterodera glycines
ccatacatgcacaaggggtggtatgggccgagggccatacgatgtacgatcgtaccgggggggggggggggggtacgaggccaatttttcttacgatggggtccatgaccaacaaaaattttaacgaccttttttttttttttgctcatcgctgatcttttttcgcttgcgcataaaattgcgcttaataagctcgcaatttaccaagaaatgaaaaaaataacaaaaatgaaacgcaaaactagtcgtccaaatcgtctgtcaaaaaaactgttcagggtcccatcagatttggcaggcgcagtcggaatcgccactttcttttttggcaacaaaaattttttagaagaacactccgccgtccacggcacatttaaccccgaagaacactcccccgccaaaggcacgtccgaaactgagtacttttccgttttggggccttaatttgaatttaaaaaaagcaacaaaggacgcgctcttaggcccaaaacggaaaattacccatttttgaagaacactcgccgcccaaggcatctgaaagcgccgagccgaccattccgaagcccatggcatttccaattgcttcgtcccccccggcaccgatggaacttgattaattttattaatttattaatataaaaaaaattaattacacaccggaaatgttaatgtatgggttgtgaaccccagcaaaatcaatccggtccgcaccaacacgaagtcgggaacggcgccaacgatagagaaaacaaatagacacaacattagtgaatgaaagaaataaaataatcaaataaagtgccgaatttggggatggtgaatcgacggggggaaaagcagcgacagcaacggccgaatcattattaaggcaatatgtattacaaaattttgtaacgttttgaaacatttttctaaatagaaaaagtaatgaaaaattaataaaggcaataaaattttattaaatacaatttgttctagacaaaatatttaggaactaaacggaaatcaatgttaatggaattatgtgaaagtagaagacaaaaatttttagaaattaaaagcctatttacagtacgatgggctgcgtctgagcttgaagcaataaaaacaatacttagattgtggcctgttttgcatgaattatttcaacacattagtctacaagttaaagaatttgacaaggaacaaagaattcgtgcatatagttattttctgtctttatcgcatctttctttttatgcgttagtttcttttttggctgatattttagaaattcttaacaaggctagtttgaattttcaaataagcagcgcatcactgattggacatggtagaaaaatcagaaacttgatagatcaactccaatcattaaaagaagagaatggtccctatatgcataagttttttaattcgataacttgcataatttccgacagaaattacccacagcatccatgtcatcaaaaaaatattatggataatgaagaaggatattcacatgttcaaagaatgtatttaactggttattcgggctctgattatgaggccgattttgtttttgctacagatggaaggaaatatgcaaatgcccaatttttaatgaaacagcaaataaatacgcggtcgtccgcagatgaaaatatagttgtaggaatatctcctccaatccctgagtttaatagaagaattcgaaggcaattaattgacaatgtcgtagaagaaataaaaaattattttccggtcgggaatataattgatgatattgatttactcgacccttctcgtttaccaactcaagcatcaaacataaataattacgcaaacagtattaaaaaattggctatatattttaactatgacgaaaatttgatttatctggaattttcaacaattctatctcaaatcttgaatgatagtcgtttaataaatttgaaaaacaaattatcaccacagagattttggaaattaattattgagcaattgggtgacaattttggaaatgaattcaaaaattttttacaccatatgcttatacttggcttggggtctgccgacgcagaaagagcattttctgttttattttatatacggggcaagaggtataaaaatgcgtggttttcttgatttaaaatctttgatattttgggcatttaggtcggcacgtcttatcgatgaaaatcttgatgcaaaacttagaattcgccttaatggacccccggttgaacaaatttcaatggattcatttaaacaacgatggttattagaagaggggcattatgccagtgacagcctaatgcgaacacatgataattc

SEQ ID NO: 15780 - DNA, 2149 bp, Heterodera glycines
aggcctttacttttacgagtaaagcgccacacggccaaaactcaaaataattttttccataggatagtaagaaactggaataaccttccagttttagcggtgcaaattaataaggcaaaggaattcaagggtttactaaaagcaatgagttctgagtaggaaattttctgtgccacatatacactatattttaatcacctgtgaatttttaacatttgatttatttttattcatttttattacggtattcattttgtattttttatttgatcatttttatttgtttgtttttggcaccatataagagcactaatgtgcctttggtttgctcgataaattaaattaaattaaattgatgaagaattgatagcaaaaaatttttttaccataaccattttttttgtttgtttaaataataaatttaaaaaatttaaataaataaaaattccatgaaaaaattattcaaaagcatatatcaaagacaacttttattgctgtttttaaagttaggtttttttccgcgaagctttgcacaatgattgacagcaatttacccccgagggatttattcaatgggctttgccccattttttgaatttggcactaaatatgccattttttggcattttatcactcccattattttcctgaaataataatcaaagaaattgtttttttttattaaaaactttttactcggataagaattggtttatttttacagaaactgaaaatttttattattttatcaccaatttaaattttaaaaatttaattttcgatttaaaaaattttatttaaattgactttttaatttttaaatttcttttggctttaattttttaaatttcttttgacttttaaattgaataaaaaatgctaaaataatttttgaatttacgaaattttaaattattctaaagccctacgattccatcaatcattttgattcactttttaatccctcaaggccggccaactcattagagcattattcattggcgttttgccttttgccattgtgcaataatgcctccggcgtcaatgcccttgtgggcgcgccaatggcaaaaatttttcgttgaacgtgccggaattgattctttacacttcggtttactccttcttatgcttctttcactgctaatgctttttgttagttaaatttaatggaataataaactaaataaattaaattttattttaaattattcttttttgattttaattatattaattgaatagtattttataatattaaacttaaaattttattaaaatacatttaaaatggataaaaatatttaaaaaaatgaaaaatcgatataattatttgaaaatattttaatttttatataagttaaataaaatattcattcataaagttgacaattatgtccgtctttattcggttctgctgttgtacgcattgtcctcctcggcatcgaaaatgttcaacaacggaaactttgacaaatcgaacaccatcaaatggcggctttttctctggcactaacgaagaacgggtcaaaaaacaaacaaaagaattaattacctaattcactatggattttttaactatctcagcggtgccttctccagccgaatggcatttgtgccggacaaacgcaacaaaaacaacaaaaaaatgccaaaacagaagaacagcggaaaatggagcaacgcgatgggcaagcagtaacaggaacgaatgttgttgatgatgatccagaacaatcggccgcccaatcatttcagcaacaaccaaaagcaacagaaaatgttacgatagttgatgaaacagttacggtggcaattttaaatattctgttagaaagttaaaataatttataggccttaaaattaattttctctgaaatttcggacaattccctgaatttcccagtcgctaaatttttccatcaaaattaccaatctttgtttaaaatgtgttaaaaattcagggaattctaaaaaatgctttgttttcttatcctggtaccctgccagatcagcatgatgtaatccaatttcaaatgaaatcccatttatttttccagccaccaacaaaatgccagtctagcttaacaccattgatggcacatcgtggccaattgttgccgccacatcgtacgacggctcatttgcc

SEQ ID NO: 15781 - DNA, 1491 bp, Heterodera glycines
caactgaacgagaccatcatggtaaaggaatattataaccaacgaaaacccaattttgtttcgtaaaggatcggctgacaacggtggaaagagtttaccacgcggtaactctccccgttgtggacaaaactggcgaaagtgacttggacaacatctccgccgacgccaaccacgagaacctgtgcaggatgacaccgcctggaattcctgttgcggaggctattggcgaatgaacgtttcgctgcatttggtggaaagagaaactgtaacaaaacacacaactaaacagatttctatttttctttaaaaatggatttaacaatgaatggccatgtctatttttgcgaggttttctctgtcgagtcggagtcgtcgagtttcgccttcttggccacgccttcgtcttcggttgtctccgcctttttctgctcctcctcctcccctccctgctccatcttctcttctgccttggctgcctccttcgcaatttgctcatcattcatcatcgccctccaaccccaaacatttaatgatgagggtcgtttcctctcccctccctactcttcccctccctgtttttctgttcttcctttccatctctttcctctttttccctcattttttatttttgcccgttctttaatatgacttttggcaattacctaaattaattaatagagttttgattctaaataatcttgagtagcattttttatttattcactatgattggtcaaattcttcggtggaaactcttcttgccttttcccctttcgttttagaacttcgtgccgactccaccgtggccccacagtttacgctttttattcgcttgtgctgaagcatttggagcggaaagtgtacgccgaactgcacgagttggacaaattggaggtgccaaattttggaattttgagggaaaaccgtccatttaaggtaaaaaatctgctgacattgcgaaatgtgtgcaacgaactgaggacgaccaccactactcgctttcacaaattgaacggatgactggcgtttctcgccgctcctgtacaagaattattaaagcacaaaatacacaggtcaattggagtgggtgggggaaagttagaacctctgccttcggactcttcttcttcctcttctctctctgtgccttcttcgtattgccctttgagggctggcaaaacccaattttgttcatctgggacgaaattgcttatgaaacacaccataaaatcaaattgcagaagaggatgtcgttataaggtgcacttttatcggatactcctcttttctttctccccccccccctccaatttttttcattgtccttgctcttatcagcaaggttccaaattatatgcacatgcttcaattttaattgagtgacaaaattctgtttaattccactcttctaattattgtgtggaggggccttggggaaaaaagagactaaagcgatgggaaattgctatttttcagtcaaacgcaaatgag

SEQ ID NO: 15782 - DNA, 1500 bp, Heterodera glycines
agcacccacaaaagcttgcaaaatttagcagcaagcgaatatctatccgttttgttcaggaccgctacctttcgaaagccataccgattctctacaaaatggcccgtctgaaataattggtgacaagcaggaatttttgagaaaatccagattttgacagcatgaaaattttaaaaagtaattatcactctttgcataataactttgagatttttatagagcaggtcccgagcgggtcaataggatagagcgaatcgagttctacagaaattgatatagcaaagaattcgggattttcggtgtattttttgatgaacagaatttgccagtggagcccccatttctgggcacacagccgccgccccaatctcatcccaagatcaaacagttcctttctgacgcatgttcctgttaggacagtaataggatgataaacggctaggctcggcatttaataaattcattgcaaatatcggtagctgctgctgcacgaacatccagacacgcatctgcgcctgagctgctactgcactaacaaccgcgacggtgcacacctcacacttctacccctcgtgtggcctaccagccgaccccatcaattgcgcagccatctaccgggacgcctagttttctttattataaaattatgtggggagctaaccactaaacgaaaaagcagcaaagaactacgcaacggatcgccacgagaccggtaccattcgaaagagctcggttttttctatctttctatccttgtggaaaaattagtcatatgcggaaaatttcgagaaaaacgcgttcgaacaaaaaaaacccggctttttacaactggccaaaaatgggttgtaaaatgtgtgttttcaccttatttctcgggaaccataagagctacgcttttgcggtaagcgaacaatttgtagagctcgtcgagctgaagggtgagaaaaaaattttgtagctctacgacaaattcgaacaaagttataccccggcaaaggtcgaaaaaagccgattttttttgtgttttcctcttccggtttacaatccgtttacaattgtaaatttatccggaatgtccggaatttcgaccgaccggatggattttgtgtttttgcatgtgttttcaaccggtttacgtgtgttttcgacgtgagttctttaaaccggttccggtttttcacgtattttcttcacgtttacgtgtattttcgacacgtttgcatgcgttttcaacatttcacgtgtgttttcgttacattaacgtgtgtttcaacatgttaccatgtgttttcgaataattttacaaatttttgctttgtgttttgctttgtgtttttgcataaaattcgagcgagcgaagcgagcgacacgacgtgcgcgagcgagcgagcggtgcgagcgtagcgagccgcgagcaagcgagtgcacggagctatttaacgacatagtagagctccacaggcctggtacggggcgcaccggggggaggggggggcgggg

SEQ ID NO: 15783 - DNA, 1547 bp, Heterodera glycines
gcacaccgcctacccgcaccccgcctcaccgcatccgcctccccgtaccccgcgtctccgcaccccgcctccccgaaccccgcctccccgcacccgccttctcgcatcccgcgtcaccgtaccccgcttccccgtaccccgcgtcaccacaccccgcttccccgtccctcgcttccccgtatccagctttcccatccctcgcctctccgtatcccacctccccgcctacccgcaccccgcctctccgcacccgcctccctgtcccccgcttcctactccccacttcaccatcccccacctccccgtacaccgcaccccgcttctccgtccccacctccacgtaccccgcaccatgctttcccccgcttcccgcttttctttatataacggaaaatacatgcattttctgttattaaactggaaaacaattgtcttttctttataaaccggataacaattgtcatttctttataaaccggaaaataaatgtattttctgttattaaaccagaaaaacaattgtcatttctgttgataaaccggaaaaaaaatgtattttctgttaataaaacggaaaacaattgtcatttctttataaaccggaaaataaatgtattttctgttattaaactggaaaacaattgtcatttctttataaaccggaaaaaaggtattttctgctaaaaaccggaaaacatttgcctttactttacaaatcggaaaacaattgtcttttctttataaaccggaaaacaattgtcatttctttataaaccggaaaataaatgtatttaatgttattaaaccggaaaacaattgtcatttctgttaataaaccggaaaaaaatgtattttctgttaaaaaaacggaaaacaattgtcttttcattgtaaaccggaaaaaaggtattttctgctaaaaaccggaaaacaattgtcatttctttataaaccggaaaataaatgtattttctgttattaaaccagaaaaacaattgtcatttctttataaaccggaaaaaaaatgtattttctgttaataaaccggaaaaaaattgtcatttctttacaaaccggaaaaaaatgtattttctgttattaaaccggaaataatttgtatttgtttagcacaaaccggaaaacaattgtattttagtaacaaaaccctaaacaatttgtattttctttaacacaagccggaaaacaattgtatttttgtaacaaagccagaaacaatttgtcttttcttagaaaatttaaatttaaatattaagccagtcataggcttttaactaaaaataattattttaaagaagctgtgagcaatttagccaaaattttggcattttattggtccatatttggtgtaatatttctgaattttatatccatattttttccccggcccctactgatcagccataaaaatttattttaactatttatctaattaccattttttatataattataacaaccatttcaaatgttttggaaaactaatgagaaaaaagaacgagcaccaagagatggatttgttcaaaaaaa

SEQ ID NO: 15784 - DNA, 4607 bp, Heterodera glycines
ataaaaacaacatcaacatacttataatcaatttactgtagagcagtgttgtttttattccatgttcgcacgcttgctcctgtcaaggttgtgccaaaaaaataatgacacagcttaccaaggagtgcccaatctgccgtaagaacatcactaagacggccgaattttacctgaagtaaaagcaacagatttatggggggaaaaacaaaaattttgggcccccggccgttgatgaaccaacttttaaacacggatttgaaaacagccccctccaaataaggacaggtcttgggaaatttagagtttgcaagaattgtgcgtaggaatattttttggctaacagtacgaataaaaaatttaaaaaatagttcatccctttcaatcattatacagaaaagaatcaaatatcggtgataaaatatggaattctttggggagaaaaaaaagcaatgcggaacaaaatatcgaacaattacagtgcctaaaatgcaaggaaaatatggtaagagaatgttaaaattaatgtccacttaacagtgttctaatttgctgtagcgccgtgttgtattttatccatgtaagcatgccagcgtctgtgtgcgttgtgccaaagtaatggcgaatcctggaaaagctgaagccaagaagtgcccaatttgtaaacagaaaattgaaaaaatactccccttttatctatcgtgactttataacactttagcggttcgatcagggaataaaaggcctttccataccatggaattctcgaaccgactaaactacggcttttccttttagaatttttcccattatcacttgtccactttctcccacactccgcttcataatggcaacacctttttcttttttatttacccgaaagtgtaactcagcttaaactaagaaacttggtattaaatgatagctctgcatgtcccctgtatcataggtaaatttttgctatatcaaaattatatatagtcgaagaaacttagagcttatataaacaaatttttattatatgaataaatttttaatattagtttttttaaattttttttttggttattttatggttttcaaaactattttttttatttttaatctttttttttatttaattttattttttataatttatttttccaaaaagaaggaagccccaattgatcagtaggatgaaaagttaaaatccgataatcagtgagctaatgatcagaggaagtagacattttgcccaacaaaagatcactaaggtcatagaaaaaaattctcgcaactaatcaataaatttatattttctttatccaaaagtctctctcgacctgaccagcagtacaaaggattcttgacacaatgatcggttcagagccagaaaaattacacccgggtgctcaacagaataaaaaaatacatttttgactgttcaaacttcatggcacagggcctaaattatcgggaaacccagtcaaatgcgtctgatcaattatgacaagttcattgttaaataagtgcgctgctattgatcagcccattgattggccctcatcactcacatgtgcgtcacactgttgatcagccaagttgagtgcaatgtgaatgtgtagcgaaacagtgaagcagtaaaaaaatgccacacttgccgattcacgccataacaaaagggaaaaggaatgaaaattaagtttttgggtgaaatctccggcctaattttatcgaaataatttccaaaaaaaacattcaagaactaaaagtcaattcttgactattttaaaattaaaaatacattatttttaaggacggttttacggtaatttattgtttaccattaatttgaaaaaaaatcgttaattacgatttaccgttatcaataaccctaatttccaaacacaaatcaaagttgctagatttgtcagggcttcgatctcaaaattttgaaaatcctcatttcagccataaaaaatcctaatttgccaccaaaatacctcaaaaaaatcctcatttggcatgaaaaatcctcattttttataagcataaaagcaaacaaaatcaatgaagagtcatatttttcgtttgaaacaatcacggcgcctatcagcgccgccggaccccaataattcctatttttttcttaaaaaattggctaaaatcgcaaaattggtaatttttggttttatcaaaaagtttaattaaaaatcgaactttttttttacttattaaaacttccaaaaaaaaactaaattcgatgtcaattgttttaataaattgacatctcttattttttgtgctttttaattgctttatttgtggcgtggttttccaaaaaactttttggaaacattgggaggaggggtccggcagtgccgataggcgctgccggaaaaaatttggaattttgagtgcggtttcaatgaaaatcatcatcatttttggcccacttaattagtccattaaattcttttcgtaagaaagaagattaatatttattttttatcataagaccacaaaaatccgcaaatcctcattttccaaaaaaatcctcattgaccctctaaaagaccacaaaatgaggaaaaatcttcagatatcgaagcactgagctaagccaatataggcgaatggaaaatgaaattttttcttttaaggaatgctataatttctatgaattcgaatgaaataaagttcgtcgtacaaattgtgtcgattagtcgtcgctctgtgaaagaaaatttaatgaattttatattttttatttatttcatattgaaacatgttttgctttaaaaagcaaataatttttttaaatttaccattaataaaagggcaacttcaatttagtaagttttttttagaaaattaaaatagtgaaaaataacgcaattttttatacgttaattaattgatagatcataccgagctcaaatgacccgtaattaatagggatgcaatttttaggcaaaagcctatttttttcctgagctccccgtggcttgaaacgcacgaaaaacatgttttttcggctgttgttaagctacttttcgagttattagtgcctattttctaggcttttatttttagcgcctaaaaagcctaaaaatttttgaaagagcctatttttgcctattttggcgttttgcccaaaatttgttaacaaaaatgcaataaaaacgaaaaatacacccctaagaatcaacgtaaaatttttttcaaaaaatatcccctaacaaccgacccgaaaattttcaaaaatacatccctaagaaatgaaaatttttttcaaaaaatatcccctaacaaccgacccgaaaattttcaaaaatacatccctaagaaatgaaaatttttttcaaaaattcatctccaaaatttatttatttattttattgacaagaatttgtgatttaaaaattatttatctcaatactgatttagccatttttttatttttttgaatacattttggcattttacaccactaaatttgatgattttagtgcctatttttcattttttagtgcctatttttcattttttagtgcctatttttgcagtttttagagcctaaaaattgcatccctagtaattaatccattggttcatggattaagtgatttccgaagtttttaattcaaaatatatttttattataataaaatatggcatctttttaagtaaggttgacaacaaaaaaaagaccgagaattatttgatttaatatttgatttagctgcgagaaaacaggtaaataaaaataaacaaaaataaatatgcgtgcatgcgggactgaacccgttagatttattccggtggcgcgccttaaccactgcgctattttacacgacaccaacgtcggttctttgagaacatttatctccatttttttctcttcattttatttggcagtcacttactgccacgaatatttgacggaatttataaaatgaatttttgttgtttttttcggtagagatagtaattttaattatattaaataatgggcaaaatatggtttaaaggtcctagaaaatttgtagaacaaataaaaaacaattattatttatgcattatttttttttgcaaaatttttttactattttcagtatttcggtcatttagaaggccaattaaatttgtttgtttaacttttaaaaatattgaacattaacattaattgaaaatctttacatatatcaaacgtggtgacatttctctattttataattttatttagattcttatttcgctgatttttgtcaattcccagcccacctaaaatatttttaatattttcagggcaaactcttgagggcggcggggggtaagaaccgaaaatgtttttggcacttcaccacgaaaatttttgtgtacaatttttcaaaaatttttggatttaaaaactgttttttaaattttggtatacgctctgtatctttagaagatatttgtaagccattttctaagcgtttagctatacataaaaatttaaagcttgaaaactgcaaaaaagtccaaatttttatatgtttttattttaacgcatctttagaaccattacaaatttggctatccgatagagcttgttaagagcgtccgaattataccaagtttgc

SEQ ID NO: 15785 - DNA, 2420 bp, Heterodera glycines
tgctggttttcctcctgtccatcagtcattgttccttttttatatggaaataaataattcaatgtgtgaagctaaaaattggattgcattaacaatcaaacaaatcaaacactaagcattttacgacaacgaagattcgaatggggtcaaaaaaacaaacaaagattcataggaaaatgacaagaaagaacaaaactaacaagtttcaaatttagaaaaaatgttttatggatttgtagtagagtccggcgggaaaacacattaaatatgtacaaaaatccacaaatatgtactaaaatatgtaaataaaattttaccccgtccggtctctactggtaagaatgggagtcagtgaaaaattacaaattttaggagattttttgtattttttttcatctgtgtacagattttcaaaaaaaaatttttgagataaacttattttaggggttttcagggtcgggaaaaccgattctggcatctgttttgacccaattcgaaccccgaacccggattcgaataaaaaagtcaaaatccatttttcaaaaaaaaatcacattttttatacacaaaattgagtcgtggcctttttttggttatacccggcagtgccgattggcgcagccgggaaaaaatttgaaatcctcaacccgcaatccgtaactcaaaaaaattgcgcccagccctgattgaagtctgatcaggcgactaaatcatgagaatgataaagcaaattgaaaatattttgtggtgtatgaaagacccaagtattgtggtaaataaataatataaacaacaaataattagctaaattccagtcgaaatttaaaattctataaacatctttctctaaaatttgtcctttgccccaaatctgtcaagaatttttcacttttattcccgtttttcgagaatttttttacgggaaactgtaaaaagaaaaagcagaattcccggacacaaacgagaatccctcccttttcttgttcccaaaaatctggtccgtgaagacgggattcccgggttttcccttgggaattcctttcccgccggggccctactcaaaacggtcaaatttacaaatttcatgacgtttattccgtttgcctttcccatggttttcgctttacctttgcttttggttttccattttcttaaatttcgtttttcgttcattttctttctcgaaagtaatttcttccaaaaataaaaaaagttctcatgaaacttttggttaaaagctttccttcatacgcaaataaattatgagaagcaaagaaacgatttcatgtgaaaaaacaatttccttggcaattaattaattatttcctttttctctgacaatttttcctcttatcgaatttaagtaaattcacattaaaatcttgaattaggccaattgcagacgaataaattaatctttcgtaatatccctaattatgttcgttaattcgtcctccatccccccaaatgtgtccacgcccaatctggctgattgtgccaatgccaaagattacgtgaccgattttggctattttttcgtccgctgggcccatctgatcaccgggtcggtgatccttctgttgcttctcaacatttcagtgtttattgccaagaaacctgatttgccattgcatggaaatttaaaagtgaaataatattaaaaaataataattaatttcccctaaattttcgattgactttttttagttacttttgctaaatgtgctttttctgtatgctattttctccccgcctccccacccaattgcctgccgaattgcaaagaagtaagccattgacaacaaaaacagcccacgcagcccaattgtgctgtcgaccgtccacaatgcgaaccgcaaaattggcaggcacttgggaaaccttcaaatcggcatgcaaaactgctgaaaaggaggagaggcatacggtaggctgacacaccaaaggacaaggcattacggtaatcggatgagagaaaagacagtagggcagccagcagataaaatggaaaagggcgatccttctgaaacagcgaaactttgttttcactttccattcgtttctttcccttttccccaagttctgtgccctttaaattccaaaatgccattctttcattgcttcgtccaattgggcgtcatcgagtcgaattacgcacgcattgttttccatgtcaagcggaagttttggcagcgaaaagcacgtggtaagccttcaatgttttgccacaatttctcaccgccctttgcctttcagcggtggccaattcagtcccgagaaatgttcccgccagcccaactgcgcgtcgcccacttccgtctccggcgttgcccagcagtgcgtctgtggccgtccggcaaagagtgcttctcccccgcttctgttggtgcagatggaaccgcgttaccccccattatatg

SEQ ID NO: 15786 - DNA, 2255 bp, Heterodera glycines
tccgtcgcttcgtttgccttttccgccgtcactttgtccgccatttctctgatcacttcgaccgcttattcgatgttagtttcgcgtgtctttgaactgcaaacgacgaaacggaggaaaaaagtgccgtgagtgaacgaagcgaccaaatgaatgcggcgatcgtcgttaatggccaaaaagagcgactcgttcagttcattgctggtctcaagagaagggacaatgggcaaagagatggaaaaaaaactgggccctacagtaaccacgacagagttatcactagacatacagtaaccacggcatgttttgccagacaatggcattgacacattaataaattgtcattaattagtcttagtgattccttttaacgagtgattataccttcatccgaaagcagaccaagcccaaatgctggggaacgaacagctcaaaacggtcgtctccgagcaaaagatcggcgaacaatttgccaaatttgttttgctaatggaaaatacagaaaatttgaaactttcccaaatggacgcaccattctcaaaaagtcctgaattcgctgaatgccaatcgcacgaaacacaaaccaaattttcagtgccctgaagcgacggccaagcgcaacttggagatgcttaattaattaaggaaagcgaaacgaatatttgggaaggacgggaaaatggagaaaaatcacccgaaaatcgtacgcatccctttgatgttcgtgcttaaggtaaaccggatcgacgttgaaaaatgcgattgcttcgtctccgtttttaaacctcaattgacaaatgccaaatttccttttttctttcttagcttaccacatcggagaacaatcaaaattgatcatcaatgctttgtgagcgttgaaattgaacgaatctgccaattcaacaccgtccgacaaatggcggaattcgtcgcaaatgaaaaaactgcctaaaatagccaatatccaataatataataaggcacgattaatctgatataaagacgatgaatagaaagtgatggactgattaattatcaatgattagctaattagataggttgattgattagctaagagcagatgattagattgattaagtaacaattatcagtgattagctgttgatcagttctgattaatttcactcagctgtctttggtctcgtttctcacctgcataagcggcgtcgacgtgcatccaaatgccctctctgttgcatatcggccccaactcgcggcacgattccaccgcgcaagtgttagtcgtgccgacggtgaccaccaaaatgaaaggggtcagtccgttggctttgtcctcctataaaatcggacaatttgaccctttccaatgtccgcttttgccacttttatcgccgcctccaacacttccgccctcagcacgaaattgccgcccttttctcggtttgtcggcaattttcgcatttttacgccgcttagcattatcccctgaccaaaaacattaagaaaatgtgatgcttttctgttactcactttgtcaacggatgaatgggactaaaataataaaaataaaaagagagaaagatttgaattttaagaaattgccgttggtatttttagaatgatggaaaatccatccaaaaccggaaaacccaagtgaataatccaaaaaaaaaaacgcgtgggtcctagagaccggacaacagggatcggagggatcccgagtcgggatcccgaccgaatcccaatcccaatcaatcccgaacatgttggaaaaacgatcgggacggatcccgagtcgggatcccggccgaatcccagatcccgatcaatcccgaagatttttttcgggatcccgcgggatttgctaaaactcaaatttatttatgttttgccaagttttgttcaaatgcttatctaatattcgtaattgaacaattcgattgagaaaaatagggatgggaattatatcagttttttagaaatttttcaaaattaaaatatcatgcccaaaaaagcagattttaggaccaaaaattagaacatttaacaacagatgtagctttaaatattgggttggtaatatttacctacctgaatagtttctttttacaatttaatcaattaatatcaatttttgtattttcgcctcctatgatcattttaaacagttgaagaaaattagcaaatcgtaaagtgcatcggaatcaaaaaatcagatttttaagaattttttttttgcagtgcatttttaaaaacttttagggaacaag

SEQ ID NO: 15787 - DNA, 3591 bp, Heterodera glycines
  misc_feature (3551)..(3551): n is a, c, g, or t
ccccccccctctccgccctcccgcccactcaatccattcatttctctgtctctctgtctgtctttcatatttgtgatgactgtccacagtcaatcagcaacactgatccctcctccctgctcatttgctcaaaaattagtttaacccactgcaaattttgacgagacattggcactgacattgccaatagccaataaagagccagggaagtcatagcaattcgatgcattcaacgagttcacaatcaaagccatgcttctcttcccccagtttatccagcgaaaaagtcctttcatccaaacagatggacaacccttccaacgcattccatacgttcattcattcaccaatccttcccacctcccttcttttgtgtcccaacattttttcacttttccccattttgacaaatcgtttcccatccttttcatattgttcaattagaatgggcgctaaagcgaataataagcgcaatggccgagtgcaatacgaaccggccaaagattttcgtgggaaaagtgagtgggttagtggaaataaatccggcaaaaggcagaaaattaatcaattaaatttttttcaaatttagtgttggagctcgtctattggcgtgacccccaaaagagcggtatgaatcatttgaaaaacagtgtaaattcgaaattcgttttcaaatgccttaggcaattaaaattcgttttgactgactgcactttaaattgggcaattaatctttgtttatttgacaatttccctactgttcaggtgccgttttggcctctctctttctctgcgtttacgttttccaacacttttccgtcctttccgttctcataaatggcgccctttgccttttgcttgccaccgtcggcttccgcgtgtttaagctggccgaagcccacttcaaaaagttgcccgatgccagcgccaacccgtaccagcagtacttggacatggaggtggccgtgccaatggacaaactccaccaccatgtagacttggccgtggaatacgcactgttcctggccaagaaaatccgtcacatttatctgtccgatgctttgctcgactcaattaaggcgagtcaattgtgttgtcccctttccattttaaattttgcccttttcagttcggtttgattctccactcgctgtcctacgtggccagttggttctcgggcctcagtttgttcgtcctctttattctggccgttttcacagttcccaaaacgtacgaactgtacaaagaggtacattgatttctctaataatcactcattgttaaatatttgccgtttaagcccattgacggttacgtgaacttggccaaagagcagttggaactcttcagcaatttgtgagtttttccaattacaaaaacgtaattaaattgcattgttttaaagacttcaagagaagttgcccttcctcaaatcgcccgtggcagagaaaaagggagaataaatgaatgttcggaaggaaagggacaagcggaggagaagcagagaaaagaacccgccaattgcgcttaatctctgctttatgccactgacaaaactttgcattttcgcatcggccttttcctccctttgttgtcatcaatgcttgggatcaaaagacaaaatgagggattgattggaatggtgggctctaatgcagtttacgcgtccaatcgacttttacgcgtccaaccaatgaccatcctcagtttcttaagccataacttttttcttacttggtcaatccatacatccttggtatcaattgaaagcttaaagtctcgggaatttataaatacaagaaaagagtaaatatttgcattacgaaaaaaatttcaatgaaaaaaacctgaattcatcatttttcgcgtatattcaacagtaattttttgtctattgcttttatccaggcatttttctatacaaaaacttcagtgaactttaagctctcgattgataccaagaatgtaagttttgaccaagtaagaaagaagttatggcttaagaaaccgaggttggtcattgattggacgcgcaaaagtcgattggacgcgtaaactgcattaggagccaaattacttagactaggtaggcctgtttttggcttaagcctaggcttaggctttttttgcaaattttttactttctgttaacatcattaagtgtacttagggttgcttttgcacatttcgataattacgattcacaaggtatagttttgattgatggttcgaaaaaaactatttttgtgacgtctaaactgttgttgggacgcgcaaaatatcatgggacgcgtaaaatgtcacgggacgtgtaaaaccgactagaaaccccaaattaggtttaacatgattaatgttattacgggttcataaagctggcagtgacgacttaccatctgtttacggaaaagaagtcgattgttgagcactttgcgcgtgtgcaatgtgataacaccaccttcgaccattttcactttttttattagctttaaattaaagttgaaaaaatgtaaaacaaaaatatataaaataaatggtcagtgaaaaccaatgaaattcagtctttcatagggataggtcatttttatcaaaaaataaaagcacacattgtaaaaaaagatcacttcaggtgaaggaaagagaaagggagagatgaggtaaactcagacaagtcaaactttgaatgaattagaaaaaaatggaaaatatttcaaagcgaaaaacaaaactcaactcgcactaaaattcagcgaacatttcgaagtttaaataacccaaacaattaagtgtaacaaccaaatagagaaatgaaccaaattaagccaaatgaatacggtcacggattgacatgcacagcttcatggtctgccatataaggtgattagcagcaacgaatacctatcaaacaaaacggggctgctttgttcgtttttaaatgtgccattattattcttcgactgaaaatctgacctggttgggctcttggtgcttaaaataatccttcaatgtgctgctgaaccttttgctaacttgtacaaattccctcttacgtttctcaacaactaaacaattttaaaaataagaaagaaaaggagttaaattaatctgacgaggttggtagcagcgaggcacaagagcaatgatcgcgtttgtcgtgtccaacaattgcttaatggacgaagcaatctctttgatggtctccagaaatggccttctgaaaagacataaaaaattgctatttataaacaaattataaagccataatttcgaaaaggagcttgtaaatttgagaaattagggcagggtcccgacaaaattcagggcttgaattaagttaaaacctatcagtcatttcgtccggaattctggcaagcaccttgcacagtgaaacagctctgaattaaaatgaacaataaaggctttatattttacaaaaacctcattgacaaatattgaaattctgcaatgtgtgcaaattgtggcagttccagctcttctgtggccgcgtttgcatgcattcgaaggtacgattcctgcacattagttcctgncacgcccgactcgatcagcaaaagtttgagaaatcataaa

SEQ ID NO: 15788 - DNA, 783 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggagagggttggagaaggaaaggaaaaaaaaaaatgaaggaggagaaagggtgggggcaatgaaggaagggaaaaaagttgaaagaggggatgcatataattaaaaaaatatataattattattttaaaattattagactgtgagtttcttatgggacaaaaaatgatttaagatcttaaagtgaaatttatgtttgagtaaaaaatttataagatcttgagactcacaaaaaggtgtttaagattttaatttgaaatctctccatgcttagttataagacattttttttaaaagttggttgtctctttttataagttgtttttttaatttttaaatacattaattatttttttcttatatatttttatttaattattttttcttcaaatattaatgaaaagtaattaaatggatataaagataagaaatggatttaaaataataatataagtaattaatatatttaatgtgattaattaaattaattatttttttaatatacatgaattaattgaaaaaatcttataattagagaccaagaaagacatacttgtctttcttttcttctcacctctctttatattgtaagaattgtgaaaaaaaaatgaatctaaattatattactttaatgtaactctggtcccagacaaaca

SEQ ID NO: 15789 - DNA, 2192 bp, Heterodera glycines
  misc_feature (2022)..(2022): n is a, c, g, or t
  misc_feature (2048)..(2048): n is a, c, g, or t
agtgaacaaagagcggagaggagaacaaagcaccgtcggaaaggcgttttatgacgacgaaatcggaggcacctgacaaatgggtacttttctgttttgagacccccctgaaattttcaaataaaaaatcatttatacccatgcaataaaaaattatttaaaccatttttatacttaaaaatatgaaattcaaaaagttgtactttcgactttttgttcgagttcaagttcggggttcgaaattgatcaaaatggaaccctcattctcttaattacgcaaatttaatccatttcttgacgccaatttaaattgatctttcatttattggcctaccgcgcagtttcaaatgcttcactgcttttgagagtgtgccattgacttggtgcttaatcccatttttgtaagtgaatacaaatgaatttgcgccggtgaaaaaaacagtcgatgaaataaaaattgaaaaagcgaacaccgaaatgggagttgagctgaagctggccatgacagaagaagaagcacgggacaattaatggtcaaagagggaaaacaaagcacaaacgatgctttagcgaattgatttgctaataattatattattattattattaattacgtaaaagccttatcaaaagtcaattttcatttggcaatttatgcattgattgaggcccctgtgagcagatgacagccgagtaaatagcaaataaagagacgtcaaaccaaagttgaaatgttttttctgctgtgtttgctttggtctgtcgttgttcgcatttccttttggctattttttgtcttttttgtgtgccattcccatcatttttcggattgcctctgtcggaattggcaccacaaaagtgcgatttcggaaggtggaaatgcgagtaagtgtctgcaggaagcgaaggtggacggcaacgggggaacccgaaatttggtcggccgcgtcgcgtagggaagcggaggcctgcggattttggggatgctgagcattggcattgacattggcatttgccactgcttacgttcagctccccctccgcactcacaaccctcgcgctcgccctcctggccgcttccgcttcggctgccaacgctcggagaaggcccttgggcagccgaatgtccttcagctccaccctctccactttgatgccccacgggtgagtcccttaagcgtgcttttagctgataaaagatattccattgaccagtgaatgccatgccaacacttgccttcgtccaaaatctcctaaacgattcattttgccctctgcagttgtgccaatgtccacctgaatcactttggaaatgctttccctctccagcattatttcggtcaatgtcctcgtgcccaaaatgttgcggagcgtcgtttgtgccaattgttttgtgctcagtgccgagtccacaatgcacgagatggccgcgattgggtcgctggtgcggaaataaactgccgcgtcgacggaaaccgtgacggaatcctttgtaagcatttcctgtcaattggtcactcatttgggagaagcagcgaaagctctggcctgcctgggaagggacgtcgtacgatttgacgcgcaggtcgatttgggtgtggtggtcaatgcatggcagcagaaagacaatgccgggcccttttggggggccgacgagcaaacggccaagccgaaaaacgacctaaaagtgccaaaatgggaaggaaagtgccaaagggcaaagggggaccatccgtttgtattcgtggacaattttaacgcagaaaagcagcgaaaagggaaaggtgagcaaaaagagcagaaaggccagggaaaggacggcgtaataattgaaattgaggacaaaggcgagcaaaggacgacgggggaaggacgaaggacggccaaattggggacgaaggcgcaaattgggcaatttgtagtcggaattggctaattgcattctgaaaaccaaacaatcgggggaaaagccacttgctaattatgagggggtgaagcagcaccttccccttcccctcctcnccttcctttctatgccgggctctgtnctttttggcatattcccctccccctctccgctctctccctgcctcctttctccgtcggtctctctcactttttccctctcccgcccccgtttctttttgtccattttaaattctcttttgtttttctttcttgcacacattcct

SEQ ID NO: 15790 - DNA, 1905 bp, Heterodera glycines
cttttcctttaatccttgccgagtagaccggggggacggggggggggggtgagccattcattcgtccctttggcccctttccgccgctttctctctgctttcaaattaactttgagatgacttaccgagtttatttatacaaaattgtgaaatgtgagtaggatgattatgccattcagcttattttatttgcttttccttttatttttccctttgtttttttcttttgcgcccccggcgataaatgtctcttttttattttttggtttatttctttttaataggctgaactattaaatttaatgggagcagttcacagcaacaaaaaagatgagagtaaactgtcactcgctgatcgacgttaccgcgtcagtgccgcctcaaaaggttgggaaacgaaagcaaaatccatgggaacggtaagagacaaaaaaaaagaaaaagaaaaaaagagaataattacggtaattagtaaaataaattccgttttaattgcagttgctaattcaatgcaaaggagaagcacaaggaaattgggaagtgttgcgctggaagttcaacaagaaaacgaaagtcagccatcggaagggaacagcagcaaaagggacgagggaggagaagaggagagggaggaggagcaggtcaaagttggggaacagtatcagcagcaacagcaggaggaaaacaacagcacggggacagggagagatgacacaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaaggatgacaaaaaacagatgagagagtgagtgggatggagaggaaagggggaaagggtaaaataaaggcaattgaaagaattagaacgacatttcccgtctgttgctctcatttgtcagacatttgcgcctgaaaccttttttttaatttccctgtagtaaatcaatttaagtgaaatttacccaacaattttttttattggtgtattacttaattagatagttaaatgatcttgctaaaggaccattcgattcaattttcttaagcaagaaacggctcgcttcactcttaaatttgtcttttaatcatttcttcctcggcttttgacctattcttatggaagtttcattattaattatatataatatagttgtgtttttacctcactttaagctaatcgttggttgaaatagaattttgaaataattttagaagggttcgagaaatcaaagaaacgaaaaaagagtgaccgaaagcaaattgagagagagaagagagtcaaagagataatggtaaaagcaattaagaagcccccccaatcggcaaaatgttatgtccgaagataacaaattaaataagtttatttgccgaagaaaataaaataataaataaatgcagagaataaattgggaggtcaaaatcggtgggcacaataacaactgaatgaggggaatgggagggggaagatggcgaagtggcgtggggtcatacacctaatcaataattacttccttctctaacacctcccctcttaaattcgaaacccgtggtttaagcctaaatttttcatctcgatggagagtaaaattgtgtgggtttcttgatacggctcgatcggcg

SEQ ID NO: 15791 - DNA, 1727 bp, Heterodera glycines
tgatagttggaatcatcaccaggcggttattgatactttttgtagaacaaacaatgcccaggtatcctcaaacttgaggtgtcaaaccgctttgttataaaaataattaaggaagcatttcatcttacattgcgaagaaaattccaaaatatgcatcctccattatcaaagtaactattgaattttaaaaaataagacacaaagtacacatttttagattaattttagttttgaaagaggaagaaagaattgctcaagacaaagttaggacttatgagttggacccaacaagcggtttgaatttgcaacctaggcgaaggacatactataataatgatgtggccatacgcactcttgtcactagatttgatgcacttgcaaaccccaaaccagaccaaattatgcatcacttaagagcccttcaatatcgcttagcatccaatggatttgacaatttaatccatgaataatgattttatattttatcgattaataaatttaaaatattaatcaatcaaaaaatttatttgctttgcttttttttgtttgtttgtgtgcgctttttaagttagtgtgtctacggttgggccgaaacacacgtaattagttgctttttaaccggaagagaccgtactgacgaggcccactcttccaaaaaattttcttaaaaaataattttttttattcagaaaccgtccgcaaaagtccgtccgcaaatgtccgtccgcaaatgtccgtccgcaaaagtccgtccgcaaatgtctggacgcgttttagcctcgtttgtcctttttttgaaaaaaaaaaacttggcagccctgtattacactcaaaattgcataatggaaaaattcttcgaatttctccccacaaacgagaattaaaaaattttatgggtacatttttgaatataggcaatttttcgtaacaaagtgcactcaaattttcaaattttttttcaaaaaatttaacttgtgaaaattcccggttggtcccagtcccggacgaaaatcgaggtcccggtcccgacttttctggtcccgttaagtcccggtcccagtttttgtcaaaattcccggtcccgtgcaactctaatattaccttttttgttaacttgctatagcctaatatgcacgaaaacgagtttttaacttggtttgaagcttttatcttgaactttttggtgcatttttttaccttttttgcgatttatttttttgaaaaacagtaaattttttgaaaattttgcaactttccctaccatattttattacaatttccaaaaaattttctggcggcgattatcggcaccgccggaccttcattttaccttaatttttgaaattttaattggaaaacttcccaaaattgcaataaaaacgaaaaatacacccctaagaatcgacctaaaaatttttcaaaaatacaccccctaagaatcgacctaaaaattttcaaaaatacacccctaagaattggaaaaatttcacaaaaattcttcccccaaatttttttttcttgttcatatttgctaagaaaatattttgtaactgcaattttccttaattttaaattattttcaaattaaaatagctatttaaaaaattacacccctaaatttggaactttttcgccactattttttccactattttggcattttttgtcactatttagttaattattttgggattttttatcactaaaaataccatcactatttatgt

SEQ ID NO: 15792 - DNA, 1578 bp, Heterodera glycines
gatcctccccccgccgcccacccccccgaaaacttagagggtaaaatagcatattttttttttgctcaagattttctgattttccttattggtacccctctccaagagacctccatgacacaaatttatcaaaaaaatatttttgctatttttcaaaaaaaaaccgaaaatgttggtgcaagtctgttaaaaaaaagcattgcctaaattctcaatttttccctcactcccgaatttttttttcggaaaaatcgccgtaaaaaatgattgaattgtaagtaaaaaaaaaacaaaaaaaaagtcgtcgtcgcccatagcggcggtaccacctccaagccgaaatccagggaccaccatccccgggtccccacaaattttaaaaatcagttacttttctagtagcgactaaatttctaaggaattcaaatttttttttatattttttccataaatcctttccaatttgtctctccaaatgcaaatttaagcctgaccctttgggaaagttggctattttgttgcgcaaaaaaatccgaacctgagtcgacagtctctttcaaaaaaatgcgtccgactgttcgatagacggtccgatctttgggcaccgtttccaattgtgacttcacaatttcggcaattcgaatgttctgaatttgtttttttaacgggttattagtcggagaatttgtcggcaattttcaattaataagtcaaaatccgaggaaatgattttcccaacaatttaagggcgaatagttaaagctagtcagtcacctcccaattttttgagttttttactttataaaaagtcgttaacacgagtccctggatatgttcgaaatatctctgaccacaatctgacacccatttcgaacaatccctgattcaaaattcaaacaaagtcgatgattttcgcgtttttgttcgaattcaggtcagtggttcggaagtggcaaaaacggattctggatgggaatcagcgagcccaaaaatccccaaaaataggtaataggtataaaaaatttcaaaattaagggagggggtaggaatttttccacctaccaaattttttgaacccttaaaatgatttttttttgattttttattttgttgattttcacttgtttcattgccatctttgtgagttccgcatttttttgcttgtcacggctctccaaaatttgtgcctgcaactcttggaaagcctttcggagttgcgcgtcaaagtcctcagcagccagtgttgccatttatttatgcgtaatctaataaaggaagatctaaaaaaatgtgcaataaatttcaagaaattattacatttttttggcacttttacgggataaaaactagagaccgagccgggccgtgccgtgcctagtttttaccgggcccgtaaaaccgaatcggcgattttaaaaaaacccggaatggtaatagtttagatggtaccccccccccttttttaaaaatttttttcaactttcaaaaaatcataaaaacatgtttctaggggttttcggggtcgctgatcacgaatccgacatccatttcgaccgattccgaacccctgacccggat

SEQ ID NO: 15793 - DNA, 1277 bp, Heterodera glycines
atataacactaagaaaaatgttagaattcagtattttggccgaaaattgagttagccattgattgggttattgatgactcatcaatttggtcactctgctgatcaattacatattcgcagcgacacttcggactctaacgagcagcgcgagtccttcgactcgcgcctactgccgcggcggtcctccaaccgtccgtccgcggacaaaaatgacattttgcgtccgtcgccgatggatgggcgcgcggcagtgatcagaagccgaggcaagtgattggaggacatggacacgcgacggttgcacaaacgatgactgctcagcggaagaaaaggggacggaatgaaaatggaaacaaaggcatttttggcatcgcaatttttgaatgccaaaagtgctccctccccgttttttcccacctccccccgccgttctccgctttcattcggctgtcatcgaattcataacgcaactgttccacaatgtccaacagaatgcgcgaggagctcatcacctcaaaattggagaaatttattaaagtttcaaatgcaattgaatgttttcacatcatcaaaatgtgccggtgacagttcgggcaacgcaaggccaaggacaagctaaaaatttgaatacttatgttaattattaattaattcaatatttactgccctttaattgcttttaataattttccaaaaacaacccaaactcattaattcattaccgggttcagcaaatgatgcgcaataaccaacgggtcgcgcagacggctgacatcgcaggtcaaaatgcgttggacgaggcctgaattttggattaaaaaaaagtcaaaattggtaaaaaaaaatttgccaagaatttgtttgccaattaaaaagtggcggaaattgaaatttaaatttgaaaaaataaaataggattttaaaaatgtcacgtgattttgagtggactatggccgggtgcagcgtcgaacacaccgatgtcaccgtcagcaaatagtgcaatgtttgcgcatcgcaacggtcgctgaggtgcgcgaccgcaaccaacaggtcaatttggcgctaaaccggcacaaatgagtgggggaatttttcggtaattgactattaattagataattggcaaatgcttttccaccggaatgtgctcctggaaaaacggggcctgactctgcagcacaggaataagccgtttgttgacgaacccatgcgggacgaacgcggcaatttgcgggatggagcggacggcactttgctggaaaagcgaattttcaaaa

SEQ ID NO: 15794 - DNA, 1005 bp, Heterodera glycines
agaaaaaaagaaataaagaaatttaaaaaaattacaacaaaaaaattgaaattcagttttttcgagtatattccagaataattttttatctgttacctttagtccagaatttagttataatcttctataggcttaaagctttcaattatactaagaatatagtccttggtcaagtaagaaaaatttatatcctatgaaaatgggaatggtcgtcgatttgatgcgaaaattgttgacaatagttgtggcaacatttgcgtgagaggcttcctttttaaatatgtaattggcactgtgttttggcactttcatcaaaaataaaatggtcgaatttccgaatttcgtgcgaatttaacaatggaatgataattcctagtttcaactattaatgacaaaataaaggaattaattgagtgcacttttataaaatgaaatggaaaataacaaaattaaaaaatgactaattgatgcactaataaattattaattaatattaattaactaattaattggttcgttaatggatcataaactgttaaaaaaattaactaattaatccgagttaattactttccatttagcgcgctctcaatctcggccggcagtggcggcactttgtctgcactgccggcacgtggctgcgagtgctgtcgcggtgtcaacgccatcagtgcggcgcgtgtgtcgcatgcgatggacgcgcgcgcggtcgcacgcggcgaattggatattttggcattcattttcagccaaattggccaacatcaaatggaccaaaaatggaaaattgaggaaaaaacctaaaaaaaaataaacaatttaaatttaaatttgaaatagaaattaaattttttgaaatagcataaagaaaaataatcaattaacgcatcagaagaataaatgaaaacttaaaaataaactaaaatttgccgccaaaacacttaaaagcatgccagcagcactgaaatagtattaccaaaccgactgaatattccaattttacac

SEQ ID NO: 15795 - DNA, 1739 bp, Heterodera glycines
gccaactcggggccgaaatgccgttgtcgctgcattcaccgtctgcgaccggtcgccacaatcgccgccagtcgtggcgacggcgtcgatcaccgatgtgccattgtcgacgctgtgcgacgacagacgaatcgccgatgccgctgaacagtcaaacagcagcgatcggcgagcggtcgccgatggctgctgttgttgccgctgccgcggagatccgtcgatcagtgccgggaaagcggtgcgcggggagtccaatggcacagccgtgccgacgtacgcctcgtacatggacacaccggcgctgctggggacgtttgctgcaatagcagggaaatgagtggagttgtggaaggagttgtttgtaccgtatgttaccgtatcgcattaaaattgcgctaccgtgtgatatcggtttctcgccctaacagcaatttttgtcctatcgtattctaccgtgtttcattagttacttattaaggaaaaagtaaccgtaacccaccaatttatacggtaactatcacgttgcaaatgagaaattgcaaaaatattaccaaatgaacaccgtacctgttaaatcaactcgcaaagctttacgctaccaatgaggttgttcaattcgttaccgtaccaccatgaccacccacagtttcggtcccaaattgctaccgtactgctctaccgtaaccatctcaacttaccgttcgtgttgtttggcattgttctaccattttcatgaccatcaatacaattattgttgttgttttggttgttgttattattgggtccaattttcccatttccaccgtaactgttgctgctgttgtccaaaccaccgtaatcgtaataatactgtttctgctgaccccgaccatcggacgatggcacattggcaattccttgaatagcaaatttaaaaaaaaacataaatttcgtataacaattaattgctgcaaccgaataaaaattttggtacttttccgttttggggccacagattcaaatcggtgcaaattcctttggcctgaggactgaaaaaatcgtcatatggacccattcaatgatcttttggcccaaatggttgcctttatgactctcaaatagctaaagggctgtatttgaatattcatcccgttctttatttatgttattttttaaaatttaaatgggtggccccacaacggaaaagtaccaaatatcttacgaaaacgcctatacaaattaatatctatatttgctacaaaaattggatctttctattatgctcataaaaatacttttataaatttactattatacaactagaaatgagctactaaccatctagaatctgtactttctagaagctcacactgtcgcgggtcattggctgaagagatgcctgagtagacccaccacgatgcgcgaactcgcccgtacatatgccaatgtcttcgaagtcaaacgatctgacgtttcagcacactccgggccatcctaagcctggttatctctgccagcaacattcttaaagcaatcgactcttgcatcaaaaccatgaccattgagcacgaacctttctgaacactatgttgtcgcttacagtttcggatgcggcactcataataaaaacgattcaatagaataaacgatagattgagaattgaaaaataatatttacagagctcatcctaccaaataattaatgttatggcaaatgtcgagactatttacttgggagtaatatattcctaactcaacaa

SEQ ID NO: 15796 - DNA, 2731 bp, Heterodera glycines
cgaccgtccgtgccccgtagcagcgcaagtgcgttttggtgatgctgcgagatggacgacggcgagcaattcgagaggacagaggcggcgggtggagaaggggagacctgttgatgtggaatttttttcgttttttttgcgctaccgtatccctcgaaattcgagacagtaatgcaattttttactattgcgtgaactactgtaaccataaaaaagtacgatgcgataccgtaccagcacactactgctgatatgaacagcttataaaaatattatgtacaaaaaatttgccgaaattttggatttttgaggattccaaaaatttacctagataaaaaatcctcaaaatatgtaaaaaatgaaatatgttagaaaaaagtccaaaatataaaagttaaagctaaattagattaataaaaattttcaaacaaatttctttaattatttcaaacaattaatattttttggactaattcccggttgccctaccgggactgggacctgagcttttcaaaatccgggaccgcgacctctgaggaccgggaattcccggtcccggcgcactctagtttcttatattgtttaagaatttcgattcttaaacccacttcctcagttttttaatttgtagtaaaatggtcaggttttatttacctaattagtattaatgggccagtcaattttgaaatattcgaactcggtccttttatttgtcttgtcgacattttttttttgatcgtcaacttatccaagagcgtgtccgacggtggccaatgtcccagccgaatgtacgtggacatgggctaccggacgaacccggcacggactgacaccaaagtgccgtcctcgccatattcattatcaagacaagaaaaggcggcagatacgcgaaccaagcgggatcagcagcagcttaagccgaatagagaaaggtgggacatattttatagaattgggaaatttttaatcaaatgccaaaaaaactgatcagcgggcgggggagggaatgatcattgctttcaattgatacgaggatgatcaactgacttttgatctgatcagcggtgaccacgataatcatttgaccattgttgatcaactggcactatcaaaatagtgaccaagatgttcaattggtaccaagatcggtcaattgaatctccgttaacttatcaatctaacacggtcaattggtctgatcatgttttaccaaattgatcagtgggaaggaagtatttgtcattttctgatcataattttgtattttttaattccaggataaccgaggaggaagtgcggatgttcggcatggatgtgactgatcagatggacagtggtgatccgacggagagtgatcagatggagagtgatcaggaggggaaagccgagaatttattgcccaagactggggttgaaaatcatcctaatttggcggtgaataattgcgccgttccgtcaattgcattcgatgaatgttcacttttgtaattactagcggggaaagcgccttcggcgcatcccccgctacgtagtacgatgtattattgagctatgaataataaaaccgaaaatggctcggccgcttcgcggcctgggactcaattcttcggcattccaatcacttggaatcactcaatccacctgcattccaatcaccaacaataaatctcgccgattcttctgcataccaatcgctgggactcagttctacgacctttcaatcaccgttactcaatccatcagcactcgaaacacctggactcaatctcaccaattctacataggcaaaacattttaacattctactggcctttttgtttcttgtcatttcttaaacaaccctcggcatttcaatcatcggaactctatctcaccaattctccggcattccagtcactgggaccaacccaccagcattccagtcactgggactcattctcctgcatttcaatcaacgggactcaaccctccagcatttcaatcactgggactcaattctccagcatttcgatcactgggactcaatcctccagcattccagtcactgggactcaattctcatgcatttcaatcactgggagtcaatcctccggcatttcaatcactgggagtcaaatctacggcattccgaacactgggactcaattctccagcatttcaatcactgggagtcaaccctcatttcaatcactgggagtcaattctccagcatttcaatcaccgggactcaatcctccagcattccagtcactgggactcaattctccagcatttcaatcactgggactcaattctccggcattccagtcgccgggactcaaccctccagcatttcaatcaccgggactcaacccaccagcattccagtcgccgggactcaaccctccagcatttcaatcactgggactcaatcctccagcattccagtcactgggactcaattctccggcatttcaatcaccggcactcaaccctccagcatttcaatcactgggactcaacccaccagcatttcaatcactgggactcaattctccagcatttcaatcaccgggactcaatcctccagcattccagtcactgggactcaattctccagcatttcaatcactgggactcaattctccggcatttcaatcaccgggactcaatcctccagcattccagtcactgggactcaattctccggcatttcaatcaccgggactcaacccaccagcatttcaatcac

SEQ ID NO: 15797 - DNA, 2073 bp, Heterodera glycines
ttttagacgctcaaatttttatgacgctatacctaattataacgaattgctttcaatttataacatggaatctctccaaaaaaggagattaaaaattgatttaagacttttccatgaaataactaatggttttgttcaaattaaacataatgaacatcaaacccatttttctaatagactgggtaatttaattaagcctagctttccattcgacatggataaggtacaaaaaatatgagacctaaattataataaaggaacgaaaagattggacaccaaatcacgctgtttttgttgtccatcaacagtgtaataaccaacgaacgggtcgaagaaccaatcgaagaaaacgctgctgtacacggcgggtttgatgaacacggcccagcctaggatgtacagggaacaagcgaaaaaccatgcgaaaatgagatggcggagaacaaaagatggcacagtttgacgaagccgaattcaagacaacggttagtgccaacgccaattttcgctttattactgccatgatgagatgttattatattaattacaaaatcagcggaagtttcagcaatccaaagagcttaaaagaagcgatgaaataacaatataccatttagcaataaaaagcaaatttatttatgcaaaagagaaaaaagtccacaaaaaggagtaatccacttactctgcggacatgtcatagattaagtcgtcctcgagtaatatggatcaacaattaaacaaaattaaggaatcacaacaaaattaaataaaagaatgaggtcaatcgatcaataaaaccaaatcacatataaaattataaatagctttaattaattaatcaaaagagacaattcacttttccggtcattttattcgttaaggagtttaattttagttttaaattgatttaaagaatttattttaatgatttctttatcaagttgattccacaattttgtagccctccccgcaaagggaataaattttttgcctaatttatattttgtgttaaacctataaaaggggacattaaagcgtttagaaggtttgaaaattttaaataaatctagatctgttcggccataaacaattttatgcgccatgaacagatcaaatagctttcgcctattctcaagtgttggtagttgtaggtattctaatcgcttcaggtatggaattggtggaaggttacacttgaaaagcactattttagtgaaatatttttgacatttctctattttttaatatttttttgaagagacggattccaaacctccggagcatattccaataaaggcctaatataagttttatataatgtaatccagattttagaagatttagatttaattattctaaacaaggaacgcatacgtaaataggcattccttgttatttggttaacatgatcggaaaattgtaatttattatcaatatttattccgaagtccctaattgtatccacagcatttattgtattcccatcaaatttgtatgtttcttttgggttttttgaacccaaatataatacaaaagttttttgaattgaaacctttatttgccatttatttgcccattcgaataaattatgcaatgctttatgcataatttccgtttcagtttttgctttataacaaatatagattttaacatcatcagcatataatttaatattcactcctgatggtatgacatcaggaaggtcgataatatatataaggaataataaaggacccaggacagagccctgggggacaaaattaagctaattaatgtcttttaaaagagaaatcgaattttaaatgaatgaaacaaaaccaaaaacaattcgtcggattgaatttatatatttttaatgattattaattaataacatcatcaaataacaaaatttaactaatgatcgaaatacattaatgaattttagcaggaaatgaagaaaacaaattgcgtaatattctcgttgattggtgtctgaccacttttcccaatggaaatattaaaatgtagaaagaacagaaaaacaaaaaaaagataaattatcacagtgtaaatgttatatatttattttat

SEQ ID NO: 15798 - DNA, 524 bp, Heterodera glycines
gatttaggaaaaatttgtaatttttcaaaacttgcccaattttaggtaaaattgcatgggccaatcgctgccaaaattcatttgaatttataatttcgtacaaaaatcattattttaacatcttgtacgtttcatctcttatctttcttccatttgctatttttgagctacccatttccttttttgcactgtcatcattttttcgtacaaatttaatttgtttttttgccaaaaaaaaatcatttttcaggaaatgttcatttattactgttgccgaacaactgaaaaatgtacatagcaacttcaaagtcttgcaatggaatatcgggcgagcccagtgagttatttttcatttccaaaatccaagacattaaattgtgatggccatggatttgacgctgtcccgacatattcatgggaaggaaatccttggggtacttatttcgtgtatctaggagaatttttcaattggtatggcggtcctgccactacggatgccaatccatgaccacagagacccaaaa

SEQ ID NO: 15799 - DNA, 2206 bp, Heterodera glycines
cccaaagtttttgcattgccgttgacgttgtcccattgccacaatttttgactggcagcgaatggtggtgatgtgaaaagcagcagaaggcacaaaaatattttggagaataattgggcaattcttcatttttttaaattttattgaaacgaagctttaagttttttttatgatttttgaataaaatttatatttaatttatgattttttcgtagcttttatatcgaaaaagttttgctattttttaaataaaatgaaaattaaggccaaagatttaatgtcaaacaatggaaaggtgttaagcaatttttcgtgtgcaggaatttttttaattaaattttcgttcgagacattgtttacgtttatattattgaataatatcggaaagctttttcattttttatttttcatttcttcgatgaaaaattccgttttttaaatataaattcaaaatttttttttgaaaagcaaaaacaaattattacattaattatttttatatgtaatttggagaaaaacaaaatttataaattcttttttaaatgtaaaagataagcttatacagtaatgtaatccaatttatgcaaaaataaaataaaaaatttgaatttgatcaataaatgcattcaaattaaaataaacactgataattaattgatttggtcgatccattattatttgccttttctagtcgtagactcactatttaaaaggcaattgtagagaatttttgctctttctgactggcctactgaaattttacagaaaatttttcacaaccccctagggattcttttcggaaatttccccgattttcaatgtgttttgtggtgtcccggtcactataaaggagtgatctgatcaagttgctgtaaaagacttttttgatcagcatcaaaagttagcttagcagaataaaaaacgttcttgtacatcgttttttcgtaaaactggtaactttgcggtatttgaagttgttcaagattcaatggcacagctggtggcgcatctactagatgtcttgctcggtttatcatctaagcgaaagatcttttaacaaattttatgattgaaaagatttaccaaatttgttgccttttttgacggcacttctgaaagtgcaggcgaactaatgctttgagtagaaaccgcacgaattacagagggagctttctcaacagaacgccttttgatggcagtcgtgactttttgcgcaacgacgtgacttggattccgttcacatgtgtgaggtgtcgccatgcggatgaattcatctcgaagtgaagtccaaatccgtcctttgcacttgtccacaccgctgtctttgaactcacatcgccaaaatttaatcgtcccgtcggtacttgtcttagcaaatttgtaaagatggccatcatgttgtagcgttgacctgtttcttttggcgtcaatttgatgttgcatacggtacataataaatcttaaaaagtttaaatttatgttcgaattaaaattaaaaatataaaaataagaataacactattaatttaaaaaagtcattttgcttgctaatttttgcgtgaaattttatttgaaaaattaattgttttatttggggccgaaacgtgctggggccgaactgaggtagaccggaaaggagtgataaatgagggggagggagagaaaaaagaaaagagagagacagagagaaaaagagaaagaaaaaggagagatgtatgagagggagggggggggggggagtggaaaaagagagagagagtgagagagattagagaaaaattagaaagagggagattagataaagagaagtattagaaaaattcgcgaatcaattttggaatcagcttatgtaattggaatcttaaatataataaaatatcattatactttactttctctggctctttttacttttaacaattaaacaaataatgtggtaattaatttaaaatattgaataaaatcataacgaagtgttggaaaagaatgaaagaacacgaaaattgtaagctgtgaaagtcacaaccaaaataacaacaaccaaacaaacaacaacaataacaattattaattaaacaatgagtataaaataaaaaaggttcaatatgaaattttaattaaaataaaatattattgatactgtatgatgtttagattctcattaaatttcttgcatggcataacaaacatgttgtgacaaaagata

SEQ ID NO: 15800 - DNA, 2300 bp, Heterodera glycines
  misc_feature (2249)..(2249): n is a, c, g, or t
  misc_feature (2264)..(2264): n is a, c, g, or t
ttttcatagttgttgatgcatcatttccaaaacaacaacaacaacaacagtccagcgatgatggagaaaatgttagcaatgaaaagcagcacgatgaaggtgaaaaagtagcaaaaggtaaagccgcaaaattttaatatatatctatatacatattattaatttttttttgttttaattttctttgattacgtatctccttaaatagagcgcccgagggctttatttttcaaccctctgctgaaagggggatttttatttcaggggggggggggggctctaatttaggagtggcctgtatttttattttattttaagggggagtactaaatttttatttttttgcttcatttcgagaaagtttctctagttttttttttttggtctcagtattgttttctgctggagttttgaaaattgctactacgaaagcccaaccgatgaatttttaataatttttaaattagaccgtgacatcatgcaaaaggatggccagcctttgtatttgccgccattcaatcgaccaatgctaatgccaggcaaaattcacgaaattttttaaattttataatgccaaaaatatttggggaattcagatgggagagaaagtgacacaatgccatacattggggagacaaatgatttcaaatttgagcaaaaggatgttgaacaatcattggtgctgatggacgatgatggggccacagatgtggccaaatcgtcatttgatgtggaggataaaagtgcaatttaattttaaataatttaattaaaattaatatttaaaaggaaaaaaaaattgaaaatatggaatcattaacatcaataaaagcagtacaatggaaacatcttcagttgaaataattatgacttcacaaaatttaaaaattgggcaaaattaaagtaaatattaaaaatttttaattttctttcttaaattgggtttatttatgagaaattttttagattattctataaaaatgctaaaattaaataaattaagatttataaaaatcaatgttttaaaaatattttaataatccaaaattattttattgaaaaaaaaaatatttttttttgaagatacaaggccaaagagtccgaaaaagtttaaaaatttaataaatactttaaaaaacagtacaaaacatcatgctttttaaattttttaaagcatttttatgaatccaaaacaattttatttattttttcaaataaaaaatagttgttttagcagcacaaggccaaagagtacgatcaaatcgaagaagaattagtacatttacaactccatcgacgacaacatcattatcatcatttccaacaagtacaagtccacaactcagcagtacaactaatggcgaagagttttggatgacaacaaggagtacggtaatgacaccgtaccaacgcgtggccacaacaccgtatgacattgccaagttttaccgtatgccaaatggaaactcaagacagcgtgaaacaggtaaattttataggcacacaccccggtacaggactaacttaacctgaaaatatttcaacgcttatttgatttaaaagattttttcaaaattctgagttttccattatttgatttatttttttttgcaaattaattacataaatatttttaagaaagtgcttctgatttctgacaaaatttagctaataagccaaaaaaaaagagagaccaatattaatgaatttgagtttatcctctttttataagagttttatataaaattgaagttctattaattttaattaatcccaatttataaaagttattttttttaaataaaattgaagtgctaacattttgctcaaaacgtgccgccatccgcgactcggccaacatggtgatcgcatgtgccggcgaagacggcgacgtttggacaccgttgcgctgtccgcccggcaccgactgtttgccggccgccgattcgacattcagaatttgttgtccagtggcagtgggaaaaagataaaaaataatattttatttttattattattaatttatgcattttatataccattcaataaattaatttgtttttttttcgtcatttctttttttggaaatacgttttcttttaatgaaggcataattaatttatttttacttaataaatagagacggatttttagatgctaaaaatcctgacatatataataaaatatgtgctaaaaatgctgaaatatgtgctaaaacccaaaaaaaaatgccaaaaatatgtgctccnaaaaatggcgaattntatatatattttttaaattaatttaaattttaatcg

SEQ ID NO: 15801 - DNA, 1589 bp, Heterodera glycines
  misc_feature (71)..(71): n is a, c, g, or t
cgccattcaatcgactaacgctaacgccagacaaactatttgaaaattcagatatttaagccgaattcatntataataaaaaagacagcgacgggtgggcaaatgactgctgattttggatgacctaaaatgaaatgggcaatggcatatcattcgccgccccgctcaaaaaatgcctttccaatcattcgctttccctcctcttttctctctctctctctctctaaaactgtgccaattcgccggttcctgaaatttcgaaaggaattatgcaaatttgtcgcgtctctccgttttattggcgcgcgtcactttcaagagtgggcagtgattgatgacagccattcggtgccggaggaacaaaacgaattgggcgaggggggcgggcgggaggtatcaaatgaaaaatttcaacaaaaaactacacataacttttgtgaaagtcaaccaaattaaacattcttgatatcattagatagccctaagagttctctatcagttcacctaaatttcaaaaaattcatcatgtttgaacaaagttatggccaaaagtacacaaggaaccaggttttcggacattttttggttattacttttttgaagcttagccaaattttttggaattttgcaggctaatagaaaaaacttagggctatagaaagatatcaagaattcctaattttcttggttctaagaaagtttttgtcagaatttttgatggtcaaaattattttatgtctaatgcaaaacttttcgttataaattgtttaagagaatgaatttgagttatttgcaataatttattaacaaaaacgaaaacaattgaaaataattggccaaaaatttgttgttttattacttttttatatattcaaaatcaaatataaatacaaaaaataaataaaaaatatgtaaaaattctgttctttctgggtattgcaattttcgcctttgaaaatatcgaaaattgaatgaaagagcaaagcaaaaagaaaaaaaaacacaaaatcaaggcattggcattttaggaaagaaaagtgggcgaaaaaatgctgaccatcagaaaggtttgagtgaaaatggccggcgaaagaaatgcgggggaaaacacggcaccgccgagcacttgcggcgacagtatatccggggacaatgcttaaggggacaaaggcgaattaggcaccgggtaacgcggggggagatgagaccgatcggattgagaatgattggagataacgcgtaagggttgagaacgttgggagagagcacctgaaagggggagggagggacagagttgaagagggaaggaggagagggatcaaagggcgtagccagccagacccattgcttcggggggggggggctcaagtcaaaaattcgattttaggggtgtatttttctttttttcagtcgatttagggtgtgtatatttcattttttgaaaacacgaattagggaatgtattttacaaaatttctcgccgtttttggccaaaaaattacaattttttgccaatttggtctccagggtccgaacatgccgataggcgccgccgggaaaaatttttgagtattttgttaacaaattgc

SEQ ID NO: 15802 - DNA, 1415 bp, Heterodera glycines
ctttttttgatggcctttttctttttttcagccttttactttctttttttgatggcctttttcttttttttgacggcctttttctttttttcagccttttactttctttttttgatggcctttttcttttttttgacggcctttttctttttttcagccttttactttctttttttgatggcctttttcttttttcagccttttactttctttttttgatggcctttttctttttttcagccttttactttcttttttttgacggcctttttcttttttttgatggcctttttcttttttttgatggcctttttctttttttcagccttttactttctttttttgatggcctttttctttttttttgatggcctttttcttttttttgatggcctttttctttttttgatggcctttttctttttttcagccttttactttctttttttgatggcctttttcttttttttgacggcctttttctttttttgatggcctttttctttttttcagccttttactttctttttttgatggcctttttcttttttttgacggcctttttctttttttcagccttttactttctttttttgatggcctttttctttttttcagccttttactttctttttttgatggcctttttctttttttcagccttttactttcttttttttgacggcctttttcttttttttgacggcctttttctttttttgatggccttttcttttttttagccctttactttctttttttttgatggcctttttctttttttgacggccttttactttctttttttaaaacttttaattttgatgcggtgccgattagggggtatattttcgtggtctcaacgtgtaattgggttgaggatgacaaatttcaaaataaaccgatgaacaaaaattaaatgaaaatcattttaaatatttattattcttctctttttcaagccaaagttgccatgcgacagtgtcaggtcgtgtttcgcgtgctccatcactttcaacgccttacattccaaaatagaacaaaaaggtgtagagcatgccgaccatcgaaaagaagctaaaaacacctatttagaataaattgttttttgatgtgttttaattttataaaacttttttactacacaaaccatcgatggggatggccatcattgaagggaggaaagggctcctttaactcaattttttctttgttgcacactggcaatggttctttgcaaataacacatgacgcaaatccatcatattttttacagattttctccaatttagatgaacaactttttgtttcggcgcatccatttcaagacaaatatatcattatttttgttctgaaggtggcatgaattgaaaaaatatatcaaattaataaatatttaaattgaaaaatgaaac

SEQ ID NO: 15803 - DNA, 2003 bp, Heterodera glycines
  misc_feature (25)..(25): n is a, c, g, or t
  misc_feature (48)..(48): n is a, c, g, or t
  misc_feature (55)..(55): n is a, c, g, or t
gttttttgccatctcagtttagcanttagcattattacgaatgaaatntaaaganaattaagtattaaattttaacaaaacgctaattttcaattttagtcaaaataaatttattattcaaaaaatgttttgaaattataaacgaaaaataaagaaaatgtaaacttaattctaatagcttaagaaatgactggcttcgtcactctgctgtttttattataattttaaaaaaatttaagaaaaaatctatgttttataagaaaaattaataaaatattttttaacaaagaaaagcctcgaatgtaagaaaacttcagggtaaacaccataaattaatattcgattagttttcgttatattttatatttttaaaaaattattaattcaaaaacattcatttttaattcaattgaaattgattttaaaagtaatttcaaaagactaaaataattatggagttaaattctataaaaattattttttgaattatgttttatcattaaactactatattttttacttaataggtagggaaaagatctgaaatatttattttattattttattgttttcggaaaccaataaaacattttgttttttatataaataaatcaattaatgtaaaaatatatgaaacaagaagaaaatcgaatcacttaattatcgaataattaaaatcatttagtccaaaaaatgattaattgtttgaaataattaaagaaatttgtttgaaaattttcattaatttattaaattttgtattattttcacttgaaataaattaaaatttgaaatttttaaaaatcaaaattttaactttaataaaattgcagccctgcaaaataatttttaaattttttaataattatgttaattctaatgcacttcgtgcgtcaaaagaattttattaaaaaataataattgcttctattaaataattataatattatgcagaaaattgcttaattatttcaagttattgtcagttacttcgccaaactttatcaaaaaaataatatttgcatttcaatttcaactattcctgaaacgctttttggggttgctgatcatcaaccaagaaaaaaacataataatttttttttgaattattatatttttgaagttcaagacggcgaaagaatatatatatcttaatttattcttttaaataaaaaatttaatacaaattaaaattaaaaatttattatttattttattaagcatttaccaaaatcaaagcccgttataatattaaacaaaataagtctgcaagcacgagagactttcaatgtaagaatggatttatataataatttataatttgtaaaaagaataaaattaccaatatttaataatttgttaaagtgtaaatcagactattaaactcatttttataaaaaaaataataatatatttttatcaataaatttattaataccattgcataaaaaaaaattgcaaaaattcattaaaatttcatttttataaaattatatatatattcttatgccaaaatataataaaaattctataaataaacaaaacactaatattcaacttaggagttctgcacaagaatgaaaatattatattgaaaaccaataaatatttattatcaattcaattattttgaaaataagttttagggatataagaaagaaaaattaaaaaagtaatttaattattattaatcgataaaatttatcaaatttaatatttttaactagagtgccatgggaccgggaatttttgcaaaaaccgggacttgccggaacctgataagccgggaccgggacctcgattttttttcgggaccggaaccgggaccaaccgggaatttttaaaattcaaaaaaattcaaattttaatttttttcaactgaaaataatacaaaattaaattttaattttgtttttttattaaataaaatccacaagttaaagctaaattaaattaattaaaattttcaaacaaatttctttaattattttaaacaattaatc

SEQ ID NO: 15804 - DNA, 1719 bp, Heterodera glycines
aaaacgaaagcacgggggggggggaatggccaaaactttacattcgctttttcgccatttcagtttaattttttaatttttttgtttggcaaaatgttccccccccccccccgaaatgtttaacaattaatgcgttgactttttgcagtctccgcaataattcatgttttttgggaacattcttcgtcaatttgaattctctccgctgataaacccattgctaaggagtaattattgcgcagcatttatttgtttaaatttgtcgccgtcggatcatttaaaagttgttaattggcgaacattttttaattgactataaatttaaattctcatttctttttaataaatacttaaattggagacatttttcaaacaagcttccataaagattaggataattatcaattaaaattttcaaataaaaaaaatacaattaatttgaaagtgcgataattattattttgtttttttatttgttttttaaatattttgtgaacaatgtcttcgctgatcaaccttttcaactcatttgaaatgtatcatgaaaataacacgaggaatatgcactcttcctacaaacacaagtgagtggaggactgaccagaagtgatcggctcaatcaaaggcaatatttaatcgaatggcctttgattggtccctttgcctttgtccctaattacccaattaattattcgcgcggtgtttaggtttcaatttccctatgaacggattgaggacccggcgggtttgactgcgtactttcagaagtattgacatcaaaccatcacaattggcattttgtactatgttattgtgagcaatttatttattttttaaaacactaataatataattattgaaaaggtaaaatccattgaatggacaatgcgtgacagaaagccgtttgatcttcggaattgtctgtttgtttggaacacggcattggcacttttcagcatttgtggattcatccgagtgggagaggtcaaacagattttagagaattaaaaccaagccgttgttaaggagtcgctcatcaatttaatatacgagggattcactttcacaatttgccacacggtcaatgcacgcggcccgggcccattttgggggtttctgtttttcctttcgaaatttgccgaattcggagacactcttttcattgttttgcgcaagaaaaggtcagtgtcccaagcatacatttttccgttttcaactttcaatgcttttttgaattgaaggttaatcttcctccactattatcaccacgcggccgttctgatttattcggctcatgtcggtgagttaagggacatttgacgccttttagttgcaaatctctccctatttaaatgtgtcgcgctttttgccagccaattccccttccctccctcctgccatgtgccaatttccccttccctccctcctgccattgtgccaattccccttccctccctcctgccattgagcaaattcctctcccctcccacttgctatatgtgttttattacaaccgaaactcatgccatctactagcaaaaagctcaataagcgtcattttttaaattttttgatccaaaaatgttgtcgtgaggcggatttgaacctccaccatttttcccttttgttgagttatggacatgcaaaagcaaactctaaatagaacaaataaataaatataatccctacttaagctgcgcaccagctaaaacaataaaa

SEQ ID NO: 15805 - DNA, 1732 bp, Heterodera glycines
tctatagaatagtccgctcttccgtttggcttgcatttgtcgtcctccgccccctttcccctcccctctccgtgccatcgtcggtcccttcttccgatttgttggtcaatccgctgtgtgaaatgccaattttcaatgccttttaaaatgccattttacgtctgaactcggatcattgccaaatgaaatgccaacacgggaccaagcaacacaatgcgaagcttttgtctgtagatcagctgttgttgtttgttgtaatatgaagtctcaatgcaaaatgccaaaatagacagagacgaaccgatggagaaaaggaaaaatatgccgaacattgcgatgagatcttcaaaaaaggtccaaattgggtgaattcccttcggtacttggcattttctattggttttcgcctcttcaatagcaaagggtcggatgcgaatggcatttctttggatatttcgccatttcaaaatgtctttgactccgctcacccaatggcttcatctccgggttctctccgcgtcctctccgttttgcgaattgcttgtcatacagacgagtggccttgtccttcctgaagccgggtgtctttttttaattctcttattatttgactaattattttttaattagtctctttcacccgatgcattccgcgggccgttcgccatcctcaaatcggtacccgtacagcatatactttcggtaagtgcgtcgaataaagtcgcggttcatcactattgctctgttctgcataaatgcggaaatagctgtttaattaactttggtagtttgggcttactaatgctggcaaaatggccgcatttttggcgaatataaaatgtgccggcattgatggcaatccgtcgcttataagcgcaaaattgcatcgactgcgcacgctcacctgagagcaaaaagacgaccaaagttaaaggacaccgactaattaagtgaatcggctaattaatggaccagttaattgagtggtcaaccgttaattggtcaattagcccaaaacccctcaaaatggtcagttgttctcctttcccaatgttaatgagtggtccttgccatggtcatgctgttctcctgaatcggcgaaatgtacccgcccttctccacaaatttgaccacctccattatgttcttcgtttccacaatgttttccccaatcgccgctctcagtgacatttcgtacgaactgttggccatgagaatttcttcgaaatacctacaacggtcagtcagccaattcattgtttatcaattacctttttactcttgctaattttcctcatttttccctttgtcattcactaattgcggtttcaacccaaaaacacaccacacaaaacgtcaccaccccaaaagtttaccaatccaaaacgaacgtcaccaattccaaatgtaacaaacagcccagcagaacgtcgttttggtgggatgagttttaaaatatattttttttaatattcgtgaagacatgtttcctatggttttcggggtcaatgaacacgaatcggcacccccttttttgcgaattctgtccatatttctggctaattaattttaatcttaaaaatggtatttcttacaattagttagatttattgttttttttaattttgtgacgtttttgattgatgaaattttgagtttgtggcattttggctggtgaccttttggaatggtgacgtttgagttggtggcattttggctggtgaccttttgg

SEQ ID NO: 15806 - DNA, 265 bp, Heterodera glycines
ttatcagcattggtcattagcctatcaattatcacctttttctctctttgccattctccgccgaatgtgactaatctttttttgtaaataaatgcttgtaaattagctgtcggttttggtatgttaagaggggagaaggaaaagaagaagatttacatgaaattgcgagcggtgcgatgagtgcgccgccccggggcaaattggggacgaatgaatgcgcttttggcttttgctttgtgctaattgccttccccggggggggggg

SEQ ID NO: 15807 - DNA, 3262 bp, Heterodera glycines
actaattacttaattactactcatttaccatctccttcgttctgatcactttccctaattggtgtttacaaaattcacatttaccctacctacttttattgcgctcatttaaggccatccacgtgggccatcccggctttgatttggccgcgtcactccatttgaagcccaccgatttggtgcttttcgccgctttttcttccggcgaagggcccgaaaggaatgtgagcagaagagactcggcaatttgtgcgtattcgctacgacaaatcgaagccaaattcttcgagaacattcgcttgtgttacaacggaaacacgcgaactgtgagaacaatttccattttggaacaatcattacttggcattttaaacagaatttgccttggtttaattcggacaaaatgtgcaccgccacgcgttaccccgactcggagataatgtgcggaaaggtgcgatttgttggattagggggaggggatcgaggggtcattagttgtttaatggtccctcaattaactcgttaattgcctctatttgccgtttctttcattgttttttctcatctttgttattatcccacaaaaattgttcataggatgtaaacagttacatcggaggcgaaattcccatctccgcgcgcgctttgctcgtcgaccgcaccgcccaaatcaccgctttggccgtcacttccgtccaaaccgcaacagtcgcattcgttggcacttctgacggcgttttgcacaaagtcaaagagagggaaagggaaatggcaaaacaaaaggaaatgtccaaatgttaagacactgattgagggcgaagagggaaagtcgcgcattttcaactccgtccaactgagtccggacggacagccgctgctcggcgacatcgaattggacgagaagaacggactgctctatgcgatgagtgcggaagctgtttataaggtgggcaaattaatggactaacaacgagaaaactccatatgaccataattagctctaattgcccaattaaggaatggacatagggtatttaatgggtgccgtttctcttcaggtgaatgtgcgtctttgtgcccagtctcccgattgccattcttgccttcgtgccggtgaccccttttgcggttggtgccttaagccttccgcttgtaccactcaggtcaaccaacgcattcaatattattgccaatccgtctgtttttgtttttcaggaggtgtgcgacgcggatgcgctgaacccccgcgcggattggctcaattacaaatcgggccgatgtccgttgtgagttttggcactttttcgattggcatttctttgattggtattttcaactgattttgccaatgatttatccgctctcttttcagcatccgttccattgaaccgcgtgaacaacaaattaccatctctcgtcctctccacgttcgcattgaaaacgctccgcccgctttggccggccaaaatggcgggacaacggcgggcagcagcgaattgtactgctcgttcatgttccccaatcaacaattggtcaatgtcagcgccttgtcacgcgacaccgatcagtgagtgccattcatttgaatttaccataaaaaatgccatcccatacaaaccgcacccctctctctccccctctccaaagggtcgtttgtgcgtcacccactcgcccttcgttgctccctttggtcgccgcggggcaatcgtcgccgcaggcgttggcggacatcgcacggcacggactgctcgcgcgactgtccgttgtgcaggcggcggacgcggcggtgctcgcctcgaccaacttcacctttttcgactgtcaacagctgagctcagtgcgttcgtcccactttgcttcctcccaatgcttttcctcccccttttttagtgttccgcttgcgcttccgcgcgtttcccctgcgattggtgcgctttgtccgcgcgatgtgtgccaaatgcggaggacgtgtgccaaggagagacgctggtcaactcgatcagcgtaggctttacttcgcaaagccttcattattcgcttcccatttagcgagttggcccttcttctcgccgtggccctgagttttgcccccatttcactgtccccggcggtgatcagtacctttcgtccggaaagcgtcgctccgtgtcagtgaaagcgcacaatctccacgaccaaatgagcgcgttcaaatgccgttattcactggaatcgtcggctggcgtagtgcatgagaaattggcacaacggcaggaggacaaaataatgtgaggggggggggggcgagaggggaggggagggtgaagaggaaaggggaggaaaagggcattcgctgcattaaaagaaagagagagaaacatggaccaacagagaccatttcgttcagttgtgaagacatgcttttcgaattttcgggtcccggtgatggcaatggcactgttgtcgcccgtttcgacatcctttgggcttcatcgtccgaccaaaatgccaaccaattccatccgttggacaatgcgcagggaatgcgaatggtccgtagttatttttttccaattacaaactcacttttcactcactcattcattgctcagatcatctacaaatgcgcacaattggcatcaaattgtggcatttgtttggggttggatgagcgccgcttcgactgcggatggtgcgacgaggagacgcaatgtgtgccgaaggacaattgcgacaaagggggtaagttttggagggggggggggtggtgagttttgatgatgtaacagcgttggcggcggagatagggcgatttgataataaattggacgaggtaattggcgaattcgttttgtgccaccgaatacgcatttttgagaatgggctccatgagaacatgcaatatttggatggaaatttcccttaagctttacgaatgataacgggccaaaaaaagaacaattcacttttccaagctgttgttggcattcgcagtgccatggacgagttggacgacattttcaaggacgaattggatcacacgacagccgtacttattctgcaaaaaagacacgcaatcagtcaactaaacagtcaacgaaggaatatcctggtgaatgattctatcgacgtgacgggatttaacttccctcccaattctttggattgtctatacctcctcatccactaccctcccctcaatcgaaattcgaaaacggcgctccagcgggtgggacagttgggcaaggcgaggataaaaaggccgtacccctcgggcgcaaaa

SEQ ID NO: 15808 - DNA, 1719 bp, Heterodera glycines
aaccgtagcatatcatcgcaatcttatattatcaatatgtattctgtgtttttgaagtgtgtataaattatttacgaactgtgataaaattaaaatatatttattaatgtagagattttcataaggttcttaacaaaaataacaaatatgggaaattgcaaaagtattgaacagaatggaaaaagttttttataaataacccattaaaattaaaattatcctgataaaattaaattttacatgttttgctaatttataaatttttgatttttaaaaattatttatctcaatttttgaataaattttgtcattttacacccctaaattttaagatttttagagcctattttccatgtttagtgccttttttgctgtttttatagcctaaaatatgccttcgcgggggtaccttctacccctgctgaagtcgccagcgagaagcacatttaccaccaaacaactcgttgatgcttttagttcccgtattttaatctcggcgctattggtgcttcgtcaattacaaaaacaatctttattatttctgctgctgctttattattattattattattagggatacggtttttaggatttaacctatttttccctgagctcccattgacctgaaaagcacgaaaaacatttttttgttgattgttaagctacttttcgagttactcgtgcctattttatagttatttattttagagcctaaaaagccttaaaaaattttgaaaaaactattttggcgttttgcccaaaattattaacaaaaattcaataaaaacgaaaatcacccttaagaatcgaactgaaattttttttcaaatacacccccaaagaatggacaaaaaaatttctgaaaatctaccccccccctaataaatgaaaaattttctcaacattcatctccaaaatttttgacaagaatttttgattttagatcccctaaatttgaaaactttggcaactattttcccttttagcacctattttttcatttttttaacctaaaaactaaatattttggcagtttttaacaccctaaaaatcatatccctagttctaatcaaggatttattaactttcttttcgtgtttttattaatgagcttccagcagcacaaaagttccatccgcatatttttgtgcgccatttattatttttttctcgagttgttggtctcgatcggacggacgaaaggagcatggcttatcaaatatttgttttcaaaatttgtgcgactgcagttaaaattaatttttaaataaaatatgcgaaatataaaaatgcgtatctgggtcaaattttcccggtcggggtcgttttcgcgccgtcgttttcgcgctgacgttttcgcgccaggttcgttttcgcgctgtcgttttcgcgcgggggtcgttttcgcgcgggggtcgttttcgcgcggttgcatatatgtaaaataaatatgtgtattcgtgtttttttttttactaaataatgcctaatcttatgtaggcccaaacaagcctagcttaggcctaagcctaggtctaaagcttatgcctagcctatgtacgaaataaaataaaacgatttttcgaatttcaaccacggggggaggcacggtgtttttgagtagataattttcactcagaatttttcaaaaaatagtttttttttagaaaatttatggcgttgataaccaatctctactcacatttgcattacgacatc

SEQ ID NO: 15809 - DNA, 1623 bp, Heterodera glycines
tttgcataattccaaaaaatttgatcaattaagaacaaagttatggccaaaagtacacatgtggcctggttttttgaattcttttagtcataatttttttgagcatcaacgaaattttttgaaacttagcaggctaatagagaacacttagcgaatgataccaataatgttagatttggttgacaaagaaaaaagttatagtccaaaaactgggctggcgccgaaacgagggagggtgtcctttatgatgttacaaaatccatttaaaagtcccggacagcctttgctttttttcggccgcgtttcaacaaatatcccaaaaatttttaagtaaaatttgagaatttctcgcacttttggaatggatcccatcggctccaaataacccaattgtgccagacaatggaacggccttcgctcctggaaccaatttgtgtaaattgagtatgcaattgacaaaatgtaggtgagcgccacacagattttcatgttccttaaattaatgagaataattttcttaaaataattcaacaaatcattatttattctatttaaaaatttaatttaaaatttattttaaaaaaggaattttaattgaaattagtaatgcttaagtttttatttgaattcccaaaattaacggacggacttttcgcagcaaattgtgttgtaaaggcgtgggaacagaaaagcaatgcatcggttgaacgccaattcaatgtaaaaagtgtcaatgcaaaaattgacaaaacgaaaaagaaaggcatccaaagagaatttgacgatgagacgagtgccgatcagatattccagggaaagccaaacgtactcgaacagccagatcagatcgaacacattcttaaagaaaaatgaacacaaattaatgtaataatttaaaatttcgatttatttaaaaaagagaagcggcatttatttatttaattattaatattattttaaaatctttttgactcttccctagagatttgcaggaaatttttgcggttttgattcaatttcttaagagagataaagagttttgaggccggcggtgtcgataggcatcgccgggaaaatgttttttttttggaaatttagaacaactttcgataatattttaaaatacgaaaattgtcctttgatttttttttttttttgataaaattggtcttttttagatagaatatcccggtcgttattcagttgtgacgtcccaaattccaatattcgtcatgcaaatattgtcatttaactttcattttctctttcaaattgatttctataacgcagtaattaaattattttttaaattttaaattcttttgttcacgttcaaaaaatctcttttttttttggaataccaaaactctaaggttaaggcttttggctgtaaaaattctgaaacagcaaatttcatttcccaacactcaaatgttaaaaattatgttcactcacaatgtgaagcagaagcagaaaagcggagcgctgctcggacaggcgccaatttgccggcagcacaaccaattgggacagaatgccaatcgcgtaaatgacgaacaaagcgatggccgtcagtgacagtgtcagactacggtggttggggtcgtcacaaaatgcaccaaa

SEQ ID NO: 15810 - DNA, 1994 bp, Heterodera glycines
ctcgaaccagaggagcccgaacttgagccggaagagctgccggaacttgaaccggaagagccagaactcgagcccgaagagctgccggaacttgagccgctacagcttacgcctgaattcgtttagttccagcaaatggcaacgaatttgggaaaaaccggtggattttttcttgtagtacgaagcaaccatatttccggaggatgtccaacgggacgaaacaccgacctttcaagacaatttatcattaatgtcccgaaattccgcctctttctcacattggcagcagttgtaccggggctcagtgctgagcaggcctcacttttgtcggagattgcccagttggcgtatgaaatcttcaagctgtccagcagagtccaccagctggacatcgagtcagtgttcaagttgccgttgcccgacgcttcgcatgtgccgtactcagtgacgaacacaggcaaacctttagggaagcagtttagatggagaagaagcttcccttgaggagcccggcacgtcccagacaaatattagcacttgccgttgttcacggctgttttgagcttggcaccaagatcattcgtgaagtgactggacgcgtaaaagtggagagtgtaccttaaaagggatgtcgttgttaaggggattgacaattgttttttgtcgttttgatggtcgttcattttgccccccccccccatattggcacactttcagtgtaaaactgatcgaaaacgtacatcagattttggtagtctttgattgggttctgtgatgccacatccacgtcttgggaccatgttggagtgccgagaatgatcacatttttcttgtcaatagctcggatggcagcaatgaccttcagcagatgggttccttttggtcaccaaaaatgttctcttatgactcgcctttttgtggtatggcaccagcacatcggtccacgaaacgctcagcggctcgttgaaatcctcgtacaaaatgtgagggtaggagccgtacgcttgagcaattcgggtgaagaatttgaccttgagaatgttcaaatttgccatttgcctcagtctcggcactaatcaccgcttcgtccggatgtggattgtgggcatgccaatcgacgatcacgtaaatgccattggaaatggccgcttcgatcactgccaccatcagattgtaagccgtgttcgcgtcactcagatagccgccctcgtccacgcccatggccccccggatgacattggcattccaattgcatttgagtgcctatttaacattaacactttgcacattttgatcaaatatgtttggcttcttaatccattttgaaaagtgagtgcttttatggtaccttcactgtgtcagcgttccaaaactgcgggtaccattggtgccagaacagtgagttgccgatcagctgtacgggttgtccgttggcgccgaccaaattggtgccggaaacggacaattggccgaatggcggggcaacagcagtgagagagctaacgagagcagtgcaaagcgcaaaaagcagaaagagtcgagcgagcagatgagttgcttggagtcggcacatttgaacgatgaaagcgaattgaatggcgaacagtcatttgcccgatatttatatgccaatctccacctctaagccgaccgaactcatccgccggttcttggctcactgtgactttgcgtatgaatacgcatatgcccgattttttggaaatgacaaaatcgtgaatagtttagaatctgatactactccccttgcattctttgactcataaaagaacaatttccataaaagcacgattatctcatattttggccatacctgcatcataactaatcattatttctaggctaacaatcgaaatgcaatcgtttctccttctcgtaaatattttgctttgttcaattgtgttgctacatttattgtcaaatgaacatggattggtcaatgccatgccggtaaatatttttataaatttgatggg

SEQ ID NO: 15811 - DNA, 1087 bp, Heterodera glycines
aaattcggcacttatccctttttctgcaacggaagttgcatgggcggcgcagcagaacaatcggttgcaatttacacgaaaaatggaaattataaaaaaaaaataatgcttttttagccgtcgcaatacgccagggctttgttcgacacaacatacgcatattttagagcattgaatcgcacaatggaaaagcgcaaatcgaatgggagggatttgttgcgcaacggcacggaattgaacgcagaaactgccgggacgacctttcagggtgaagtggagaggaagaaaaggaggggggggggtagaagcgaatttgggagaggaaccaatggataaagcctggcaaaatgatggagcattaaggcgagaccggacgcatcacttttgacgcccacggcaaccgccagccgaccttttttgtgacgatgctaaacgcactgaatgtgcccactgttatggtgaaagtgaacattaccaacggagtattggtgcgaatggattaagcggcggcggattcttatttttgaaattcaacagaaaatggaacggctgtacggcagtgaggcgtcgctgtgggtcaattggggcggctttcggccgatgaccacgccgttgtgcggctacaacggcacaatgtgtggccaaaatgtgacggtgtacattctgatcggcgttacgcttatgttgctgttgctggtcgccgctttgcttggcatcggatacgcaattcggtaaacagaggaaaagcatcggactgtgccgatcaaaaattgatttaaaagcaaagccaatggtcgataattggaccaaaaggaatgttaacgccaaaatcactcattaattataaattttaagcttttaatgcattaattggaccgaatttctccgaattggcacaacttaagcccattaatccgccgattttgccatttgcagggagaaaatgcgcgagaagcagcgcctgacacgcgagtgtttgatcccatttgcagagctgcgcaacctgaaagagctgcgcagttcggaggaactgaagtcggagacggagaagagcatgcggagcatgcgtagcagtcagtcgggtgag

SEQ ID NO: 15812 - DNA, 1555 bp, Heterodera glycines
  misc_feature (6)..(7): n is a, c, g, or t
ctgcannggtcccatttttagaaaatccctaaattattcggttttttctcgaatgttttgctttgattgaatttgaattaaaactgaaaaggcaatggattctttcgtcttaggttccacagcaaattccatgggactcatcggaaaacaacgaaaagcaaagcaaaggatgagcgattagagatcggacaaaatgaggcaaaagcaatggatggaagctgcgacaatgcgaagtcggaggatgacaatgcggtggaacagcgagacgaagacgcgcatttatagcgaaagaggggggggggggggggacgaccagtttaagttgcaggatgagaggggggggggtatcagtgctggcgcaaccccaggcgatggtcggccactcattagcttccccccccctcgcccggcttctcataattcctgttctgctgttctttctgttctgttgtgtctgttgttcgtttgcctttggtcgtcccaccgacaaaactttttaattggcctaacaatttcttcttgacgacattccctcccccccctttttttggcttttcatcacgctaatttcctcttcctgctcctctttctgtttttattaatgactttctctcgagggtttgtcagatagcgaaaaaaacggataattgcgacgaaaaaaaaacatttgcagacccacaaagtgtcgtcactcttcagtcagtcattcgttgatttatttattgtattttatttttaccgatttttgtctttttttataatttcaaaattcgaataacaaaacattggttcttcttcttcttctcatttttctcctgaaagcactgtctttgaacacggaataagccaaagtttgctagtttttccgttgtattatttttagacattgtcaaatcattctctgattatttccgtcaaatcattcgacgataacattgacatttatcaatcagtccgttttataatcgaatacacttttattttctatttttaccaattataaattatcacaaaaagaagcaaattgagcaaattggattagagaaagatgggcggtggtggcaattctttattcgttcttcttcctcttcttctgtttcttccttctcctctcgttcttctcttccttttcctcttttcctttttgtttttccttttccttctatcccctccctcgttcctcttctcttttccaattccgtcgctgcttccttcgcctggctgcaagcagagattattttgccgtttgtccactaagagtgcccttgtttaaagcctgtttgaaaaaacattaatggcggatcaaatcacaataaccataaataaatgggtttaggagagcgtttaatagcacacaaatacgaagaagttcaagatggacactgatggtgatttgcagttgtttggagaagaaagttgccaaggcaagaactaaaaaagagaggggaaagagggcattaaaaccggtggaaagaaatggaaggaggaagagagggggagggcgagcgaggggagagagtggaagaggggagagaggggaggggaagagaggggg

SEQ ID NO: 15813 - DNA, 1590 bp, Heterodera glycines
tcggccatggaattggcttgttttttatgcataaattatccccacgccggaggcaatagcaatcgtcaagaagaaattcgcggccaattatcgtttccgaaccccgaacccaaattcgaacaaaaagtcgaaaattcgaaattccaattttcgactttttcgttcaagttcgggattccgaattggtcgaaatggatcgccatattcgtgatcagcgacctcaaaaactcccggatattcatcattatgtgtaaaaaaacaaaaaaaaaattaggccaaaaaaaaaagtgcaaaaaaatttcaaaaaggaccactttccatatagcgcccatttttccgtggttatgaattagtcaaaatggatgtcatattcgagctcagtcatatctaaaaagcctcgagaaatattttcatcttatttgaaaaacaaaaatatttgatgaaaagaaattttgcaaaatttgagttaataattcttaattagcgcatttcggccgatgggagccttgtttcataacttattgtttaattattagggatgcaacttttagtgatttaactatttcgtcactaaaatagtgaaaattcactattttggcgttttgtcactattttttaactatttcgacatttttcagaaattttattagcaaaaatgcaataaagtcaaaaaatacacccctaagaatcgatctaaaaaaatttcaaaaaaataaacccctaagaatcggccaaaaatttttttttaaatacaccactaagaattggaaaattttttcaaaaattcgcccccaaaattttttttcttgacaaaatttttgatttaaaaaatgtcaatatttgctaagagaattttataaaggaaatgtagctcatttgcaactgcaaccagtgaataaaaattatttttgcttaatttttggctgaaaattaggtcactatttgtcactatttcggactttttgccactatttggtcactattttggcatttttactcactattttagttaacgagatttttcgtcactaaaagttgcatccctattaattattatcataccttcaaagtttaatcgtcgctaattggcaagaggattcagtgggtcaaggatttagtcttatgccgcccaattgacaccgaatggaaagtgatgaaaaaacagtgacggagggagggaaaaaacgggggaaggaggggaaaacgtacagtaatgacggaagagagtgcaagttaactggcagagaaaaggaaaaacaaactgttgtatggaagccaacagatcagataagcagcgatgacgtggaccgtcgtgcgaaagattcgcgagcgcatttccaatcgccaggcgggcacagcttaaaaatgaaaaaagaatgaaaagtgcaaaagaacggcacgaacgattcgaatggggcgaagaattggagttgggacagaaattgcactgcgcgaagccatgctgggggaaggaggcgtcagtggcagcggaccctccgacggaagtcgcttcaatggcacaaaaagaggccgaagtgccggcgggggacagagaaagtgccgaagtgggccaactctggctgagttaag

SEQ ID NO: 15814 - DNA, 1137 bp, Heterodera glycines
  misc_feature (1114)..(1114): n is a, c, g, or t
cgttcgcctataaaactttcctgaaattgggcgaagttttaaaaatgatggcgccaacccccacccaaaccgttgactcttttcggtcgagaaactcaagaacgcgaagtttgtgccaaatggtagtgcactgagaccaatccttcaggtcaatggtcgtccacacgaaccattggggaagagagacgagagcagcacccaaataacaccaaatgatcagacgctggaggaaaagcaaaacaaagtgatcagctgattgaacacccccggccaattcactctgacaaaaagcatttgctgcgagggacggcttattcgaccggtgcgctccattcgcatcagtccgtaaacagtgcggagacgatcaagcgcaatgctgacgactccaaaggacatctttcggttttagtgggtaaaacgggggaaaataacaaaaaaagggggggggaataatggaaaatgccaaaaccaattaattgcaaattttgaagagggaatgtgcaaaaagatcaattaaaaggagtaatttgaatatttggacaagccaaccaaatggaagcagaagtccctaaattggaagtgaaagcgaagaggcaatgaatgggaatctgctgggactgactgaccacgaatattgcatggctttgcaaaggaaagtgccggcactccaagtgtaaccgattagccaggcaatgtgagaagggcaatagcaggcgatgaccagcagatcgaccactgtcaggtgcagtttcagccacaggaaattggtacgcgtcacttcctgctgagaattgaacagaaacagcgggaacgaagcactcggagcagtacccgagagacgcgtgaagttttgcgaggattgaacagcgacgaacggccgctgaactgcttggccagggcgacaatattgagagggagtccgagcagtagcaggacggccagcaacaccaactccacccaatcggtgagcaactgggcaagggatccgttgaaggaattcattctcttttggactcttccggccaaaacccgcccagcttatcgttgccttgaaaggaatggccaattgccatccgctaaatccctttccaattaattctttgaactcgccganttggtgcgctttttctccgactc

SEQ ID NO: 15815 - DNA, 1357 bp, Heterodera glycines
  misc_feature (29)..(29): n is a, c, g, or t
taaattttaaattttacttttcaaaactncggaccaaatttaaaaaatgcactgattgatttaaaaaagaagggtgtggccttttgtttaaccctaaaaattcaaaactcagcccaaattatgtcttcctggcgcagtgtgttcgattccgtgctgatctcattcggcggttggccttcgctggaggcgtcctcagaaccgaacattcgaattcgcatcgaacgcctctacggaataatggcaaaataaaaataaaaatggaaaaatttaaaaaataatttaggtaattaattattgttttttatttacaaattcccataaaagtttatggtttaaaattttttttttcgttttctagtcataaattattattgttttctttttaatggaagggcagtaaaatgtaaatatacctaaattaaattttaaaataaaaatgaaaacacttttaaattaattattttttttctaatttcaggtggccaagttcagagccgactccctcttcaaagcgacggtgcaacccgacgacaaaaactcggacaaacacgtgcttttggtaattattgtacatttacctaactgatcattttaaggaaagtataaaattcaaattttaaaattatttgaaattgttaaaaaaattaaattaaattttcaaaaaatattttttcaattttcttttcttttttattttattaaatgggaagaattttgcctcttcagattgaccagccggcactgaacctttttgcccgcgacttttacatgcttttggagacggaggacgaaaggctggcctaccggacattgtaaatttgaatatatgaaatccattaaattttcaaattttttgagttttgtagaattcgtgacgttttggtgctgctgggcgctgacccgcgaattgcggagcgcgactcgctggagattctgcagtttgagacggagttggccaatgtcagttgtggcactttttcaaaaaccgaaaccccctccctttttttgggaaaatttggcccattttgccagcaaattttgataatttttctgagttaaatttagccgagaattatttcggttattgctgccaatttgcaaataaaatatttcattttaaattttcacattttgtggaattggttaagtcagtgatggcacttttggaaaaagaaatcccttttttgggcatttgccaatttggtaacaaattttgcaggccccgaccaaagccaaaaattttttaacaccctattaaagtgcaaaattcatttttacctgatcagaagcctataaatgcataagaaattgatgaattgattttttttaacgaaaatgacattgccaaaatgatttt

SEQ ID NO: 15816 - DNA, 1878 bp, Heterodera glycines
aggacaaagttccaattttatgaaatgtatcagcgcgacattttggaaggaattggaatgcccgtggacagaaccaggcaaaaaaatggggagaattaattaattgaaaaaaatgggaaattaattaatggaaaaaatgggaaattaattaattgaaaaaatgggaaattaattaattgggaatggaatcagaaaaattcaaagttattggcaaaaataaatatggaaaaataaatttaaccataataaaagttagaattgcacgttgaaagaaaaataccattaaatgaggacaaaaaatcagaaaaatgtcattaattggcaaaaaatgggaaaattaaaattgacctaattggatttatttgtataaattgaaaggcataattttgcacaaataaattttatctaatgaattaattaattaattgatttccttccttttaattgtttgtttgttcagatgggtcgccggcgccgctttggttaatgcgttttattcgccgaataccaacgaaatcagttaaattaaaaaaaaattaaattaaaatttttatttaaaagaaaatgattaattaattacccattaaatttgctttttgtcttaatgggttttcgtttcagttttcccggccggcattcttcagcccgtcttttacaacaaacattttccacgctcaatgaattttggcggcatcggagtggtaattggacatgaaataacgcacggtaagtgccgaaaaattctgtaaattactgtaatgcagttatattttttgtataacaattaaaaaataatctccacaggttttgacgatcggggccgactctacgatcagtatgggaacattcggcaatggtggtaagattttttgcattaatttttgttggcattttgtcacttttttaatttaaaaaatttgagggacaatgcaacaattgtcaaatttgaagagaaggccaaatgcattgaagatcaggtgaaaatgaatgagggaatggtgtaataaaaattcaattaaaatttgagaaaattaaatttcttcctcagattttatacaaaaaaaatgagttaaaacaaataaattggaattaatataaattttactgattttgtttttttagtattccaattacattttggaccaaatttcaatgaaaatcaacgggcggagtacaaaaggggaaaacattgcggacaatggcggactgaaacaaggcaattaattaattaataattaattaaacataattgttttttcattttttcacccaatgcttcggttaattaatgtaaaaatgatcttaaattatttaccattttagcttatcgtgcctacaaaaagtacgaacgctttcacacaatgccgcagcaattgcccggcgtcaatctgacccaggatcagctgtttttcctgaattatgcgcaggtaaaattcggggaaagtttttccaatttgatttaatatttaataaaatttaatttaaatccacagatttggtgtggcattatgaacgacaaagaggccattcgcaaattgagaacgtccgaacattcgcccgggccaattcggtaattggacgggcagttttttattttgcgggaaatacagtaattgaaagtcgggacagaaaattttgcaaaaattttcaaaatttgcaggctccaagtatttttcgaccaggcacatagcaaatttaggagggagaatccgaataccttttgttgctcttcggatttttttttcagtattattttaaaaatggcagtgccgggaagaaaaagcaggcatttgtatccgcttttcgccaaaaaatgaacaaatttctgccattttgggtttaaaattttaaaaaataaggtaaaatgggggttcggcg

SEQ ID NO: 15817 - DNA, 1363 bp, Heterodera glycines
  misc_feature (72)..(72): n is a, c, g, or t
  misc_feature (74)..(75): n is a, c, g, or t
  misc_feature (96)..(96): n is a, c, g, or t
  misc_feature (1255)..(1255): n is a, c, g, or t
  misc_feature (1312)..(1312): n is a, c, g, or t
tatttgagtgaaatggcatcgcttaatggcttttccttaaactttatgccgcagcgagaagagaaacgccangnngccttaactttaaagatggtnacggatattatgaggaaattaataaaagaattttcaatattaaaaaaaatggattccctgtggcatttttttaaaaataaaaaccaaattaaaattaatttttttaaagtctaaaaaaataattaaaaaatttttttagtcagttaaaaaataacatattcaatcttacaataaatttttaaaagcatattttaatataaagaaaaaatcaaagactttcttaaacacataatttcattgtcattattttaaataaaattcaaaaacaaataaataattttttatcatttatacagtttaaaaataatataacaaatttatatttaaatcataaatgatatatttatttttatataatttttttttttaattttttgaacaaaaatttaaaagcctagcttaaataatgcaaatattccattaaatttcaataaataataataaatatttttttcaaattgttattttgaattataaaaaattttctttgtgtgaatttttgcgcatatttctctccgccgccgatgcgttttgttcttcctcatgctccaaaatcaaacaaattcgcgaacaccaccacaaaaatgctttaagagctaaaaagtgataaattatactcaccatgacaaccaaattactgacataaaatgtaaatgacgaatgttcttcgtttcggtggtcgcttatgaaaggcaaataattaaaatgcatggaaatatttatgggaaaaatgccggaaatattagagaaaaatttaaaataataataaataaatttaaataaaatgggtttatttattcaatattttttgttatgcccttaatttttgaactaaaattaaattaaatatcgaaataacatttaagattggagaaatcaaatttattaaaaaaaaataaatgaattaaaaaagaacaatcaaaaatattttaaaaagagaggataattataaaatattacaaataataatttagaaattaaaaataaaaacaaaatttggaatttagatgatttttgaatttaaataaataaataaaagcaaaaaatatattaaaatatatttgcttgccgttttcataaaaaaaataattgccaaaaaatataacaaataaaaaaagcaccatcttttttacacttcgccaaactataatggttccgnttgttattggttgctctgtacataccataccaactacataaaaaaaaagtcaagtanattttccgtgacggtttctgcgcgccaaaacttttttttttcaaaagtaaa

SEQ ID NO: 15818 - DNA, 3288 bp, Heterodera glycines
  misc_feature (2243)..(2243): n is a, c, g, or t
attacttatttttaatttatttttgaataaattttattttattcctttgattattatttattatccatttgagaaatacaattattcaaatgctaccaaattaaaattatcgttcattttttatattttcatatttaaatgactaaatagaaaatatttaaaattatagagaaaattttgaaagtagaatcattgatggctaagtctgaaattttgccatttaagttgtcatttttttttggcattggcatccccaaaatcataattattattatttttttaattttaaataaaaatcggacacaagaaaacttcgtagaatttaattgcaatgaaatttttttaaattttttaatcatacaataattaattaagataataatgttcactgtgtactcaattgtccacctcctgctgacgtgctgccttttgctggccataacagacgtggtcattagtgatccactgccacaaaatgcaacggttgctgatcaaccaacagaaacgctgaccaatcagactgtcaccgcagaaacaacagcagcaactgaatcaaccgcggaaacggtaattgcagatcaattactgtagcaacaattttttctcatcattcaatgccttccagacaattgccacaacagcaactgatcagcagaacgttacggtcaatgagagcattgagacggtaagagaaaatatcagcatataaaacaactgatcattgaaccgtaacccattttaagacagtaactcaaacggcatctggtccgactactgtcatcaattcgaccagcactgaaccggtggaactgatcgccgatgtcgacggcggaactgatcaagcccttcaaacatttaatacaacagcgcaacaaagtgatctgggcaacatgcaactgttcaggtgatcatgatgctggtatacggtattgatcagccataaaatcaaaaatttcagtcaccagtgcttacatccgagattgatcagcagaatgttacactgcagaatgccaccgttattgaacctgttgctttgatcgctgcaactgtaaacggcactgatcaagcagccgctcaaacacttttcaatgcaacagctcaacaaattgatcagaacaacaacacaactgtaatggtatgatgtgtttaatcacttttttacagtaaccgattttcgctcttttactgtaaatttagtacggtcacgatcagaaattgaaaaaaaacacctttaagccgttgcttgcttcgacaaatgagccgaacattacgctcaatttcactgttgaatcaatgcatctgatcacggacaatgggaccgatcagaatcgtactgatgaggccggagctgcgggtccttcagttgctggtggcgaactgggaggtatattcttgaaaaaatattcaataaataattttaacaaagtaatataatttaattaataattccaattaattaataaaaaggaattttaacaacttcatctcatggacaattaattatgtacttagttcattaataatttaataataaaataaacattggattcaacaataattaatggacgctcaataattgttattattgttcaaaaaatcatataaattatgatcaaaaataaattgttaaatatcattaaagaaagcaaaaattatgattaatagaaacgaattcaattaattataatttttttcttcaggcgaagtgccgcttgtgtcttcagggcaggcggacgaacaaaatgccaaaaatgagagtgccagtttaaacgggactgccagcgctgtgtcatccggaactgtagttgacacaaccaaattcataccacatggggacgacgattgttggacagaccaaaatggggaggacacaccacggtggtttgccaacggggaccaggtatttattaacattaattaggtataattagtcaattaattaattaattatacaccaatttatgtcctattcgcacagattgagcgcggcattgtgtggtacgagtgccaaaagggaaagcttgtgacacaaggatgtattgacgagaatgggcaagtttaaaaataattttattacaaaaagttttttttacagtaagcgcctgaaattaaacggtacctaccagttccgggcgttaccgtatgaaatgtatgccgtttggcgagaatgcgcgtcgacaagggatccggctgtgtgccggacggacaattggacaaaacgtacctgcggggcgaaaagttgngtgaacagcgaggtaattagcaatattttaaatgggcaagtaaaaataataattaaattgtgtgtgtagaaacaaatttggtggcaatgtgtgctggaaaatgcgtggcttggcggttgcgttgatgaagcaagtggcaatcggttaaatgttggcgatgccattgaccgcaatttgactacgtatgaatttatttcatttttcaccgttttgccaaaattggcattttgaattcagttacgaatgccaacacaaacatttttgacggtttccgaatggtgcccattggatgcatttttgacggcacccgttacagtgttggattgtattggcaggtataaatataaataaattaataacaatattttagcattatttcatccaatattaacaagaaaaaatattattattgtattaaaaaaaaattctggctcagaatgttttttttctaaaaagatttaaaatattttattatatttatttatgaaatttaaattattaaataactaaaattcttatcataggattaataaaataaatgaaataataattaaaacaaaatttatttgtcaaaatttgcaataaataattttaatgtccttttatatcttagaaaaataattaaataattctattcatgataattaaattcaattaaattattttttatttattttttcaatattaatttaaggacgatgactttgtgttctattgcaaattgcaacaggatgatggtggagctgaagcagcttcttcctcatgcatcgagtttttaaaaaaatgaaattttttttaaattttaccctttcccctcaaaaaaggtgcattcttcgaaatcagcgtttgttcaatgaggaccacgagttccaggatgagcatgccaagaaatgtgcgcaacggttggcacccgaggggtacacaatgtgcacgagatgaacgaaaacagaatgccaatctctcatacaattcttttttttaataaattcattttttaaacttttgaatttttttactgcccattagtttaattaacgcgttaaat

SEQ ID NO: 15819 - DNA, 1223 bp, Heterodera glycines
gaaggaggcaggataacgtggcgatggatgtttctgtctcacaccattcatttcatcccaattcccttcatcgtcactcaccctacactttggtctcctaccgtttgtcgttcagaatggaaaacttgaacttggcgaactcctccttctttttgcattggaccagcaacaaatacacggacaaaaattcgttggactcttttgtcgaggctcttcggctgctggcagtcaccatttggtgtcgtgggggccgtcattgaaccagtgtaatggagcgggaggaatgtgatggaaatcaaaatccacgggcagtgagtgaatcgtattttaaatctttttgtcccaaaatacaaacaatcaacaccaaatcaaaaactgtgaaaaaactcgaacttaaggttttgaaaaagaaacctgaacgtcgaactctccaaaacttcgcccattccctcgtgcaacaaagaaaagttacaaatctaaaaaggggaatatatcattttcaattataaaattcatttgtataattaaagaatagataagtgcaaatcaaaacacaattcaccgtccacacgtagtatacttgcgtgtagtatacttgttggttcatctgttaacaaattacagatatatactaaagaattgtcaataatggagcctaattaatctttcttcaacaaattacattcaatttggattttttgaaaaaatctttaggtaattatatttcaaattatataatttttcgccataattttttttgacgcgatctggcggtgtctttgtgaatcatttgaattcctttgcagtctctccgaattggtaacgctgtacggaggcgacgccgatggcgagaagaattcaccagatgaccaccaacacccaggccaattccaacaaattcgattggacttcttttttgttgttaaacacaaggttaggacgtgatcctgacaggaatgaatctaattcagggcattttttagcgatcttttctaatgaacgattggccatcctcgctacggtaattggcttcataattgacgcatttgtcatcatcgttgttcaagcaaatttctctaatcacccatttgccatcatcgtcgtcgctacagtaatagaaatctcgattaaaaaaggtataaagcggatccaaaggcggctgcctgcgcaacacttcgactgtcgctgcgcctaacacctaaaataataaacgatcaaatgaa

SEQ ID NO: 15820 - DNA, 1310 bp, Heterodera glycines
attttatcttttcgttttacataattaatgcattgtcaaaaagataaaataaatttaaaaattaataaatatattaactgaatattcagaaaaaaatttttttaataaaatttaaaatgcctccaaatttaatttttttttcattttaaaatgatattattgaaaataataaatctaaatttaaaaataaacacccgaacacaagttcccatgtcgggaaatcatttgcgtataatcaatgttgaataataaattataacaattaattataaaacatattacataatgaagctatacaaaagagaaaaaacaaaaatttaagtaaaagttattattaatttgaaataaatcattttaaatattgtttaaatatttctaagtaataaaagattaaatttaattttataatttttaatattattttaaaaacataaaatgcataagaaatgcataagctcgatcagtttttaataaaaagaacattttttaataataaaatatttattttaatattttatttattatttcttaaccaaaaaacaataaaaaataaattccctaacaaaactcgccaacaataatgcacgcacgtaatgggaccaaatgacatgatctaataatttacaagaaaaaattaaataccaatagcataaaataatttacctaaaaggatggcgaggggggaaaggagccgccggactacgacactcctcaagtgaggataagctaatatattcaattaataaatataaaaagtttaataatatatttaatattaaaaaaatagtaaagacaaaaatggaaaatgaattattactaacaaaattaaacctaattaatagcataataaatgtaaataaatgtgttaactcatttctttatggaaaatatatttttattgatattgtgcattaaaaaaagtattttcttgaaatcatttataattagggaacggatttttaggtattacctttttttgcggatagtacttgatgagcgaagcacgaaaaacacattttctccgaacaatttttgatttagagcaaaactttttagcacccaaaaacgggaggggggggggggttagcacgtattttgacattttcgaattttagcacttattttggcatttttcaagaaatttcataacaaaatgcaataaaaacgaaaaatacacccctacgaatcgatcccaaaaaaaataattaaaaaatatacccctaaaaattgaccaaaatttcagaaaatatacccataagaaatgaaaaattttctcaaaaatttgtctcaaaatttatttatttattttc

SEQ ID NO: 15821 - DNA, 2467 bp, Heterodera glycines
agttacctgaataaaagagtacatatttaatcaaattaaatctaattttataataaataaataataaataaaataaatttattttttattaataaatatgaacaaaacaattaaaataagaataagaattaaaaaagattcattcaattatttataaatatttaatttaaaaaaccgaaaatttaattaattataacttattagatataccatataataataaaaaaaaagaaaaaagtttaaattttatatattgaaataattattttcgtaataatttgattttgaatagttgaaaactttaaaataaatattaaatctgttatttttgaatattttctaaaaatattccataaaatttgcattatatattcgattgctttttcttctccaatttaaaaattgtcatctccctttatggttgaaaatttactccaaaatttgtcttcacccgcttccttttgaattgttttcctaaataattatcaaacaactgcttttacacattatcaaatcactgcttttacactatttgcctttttgcagaaacacgaaatctctagtaaatgaaaataaataaacaattttaaattttgaatattttatttaaaattgatagaaattagaaaatgatgaaattaaaatgataaaataatagtcattatcaacttaataaaaaatatatattatttttaatagtcaaattgctaaaatatttatgaaacattttattgtaataaaagtgaaatttttaaataatcctatcaatcgcggattataaaagatttatttattttatttgtaaatattatatttaaattcttaaattaatcacaaaatatttaatggtttaattatgtttttaaaattcaaaaattatgagaaaataacaaaagtataattctccaccttcattagattgatcttatgaaaattgctcattcattcatctctgaacttcgcattaaaaattaataaaaaatgattgctcctaaatttattaattaaaaaataaataaataccgaattatcggatattttcagcaaagttacaaaaagtgatcctttttgaagccacaataaatatgataagctaagaataattgtaaaaaatgaaaaaaaaattataaatcagcgaaaatatttgaagaatacataaattttattaaaagctgtagtaatttttgaataaaaataataataaaataacagagataaaaaggaattttaaaagggcacatataaaatgaattgattctttattttgtaaaacttttaatttatgaaaagaaaagcataaaaaataatagacataaaaattaatcgtaacaaatttaaaaacgaataatatctgataaaattcaaatgaataactaaaaaataataacataaaaccaaaaaattgaaaaaaatatacatataatattataaaacctttttattataattaatattaatttatagaataaaattttagtatgactgtgacttatgtataatcaaataatttttatcttaaaatttattgaaacatttttttattggcatcagaaaaataaaatctgctcatgcagtaaatcaattatcagaaaactttaaaataatcattaatattaaaaaatgaatatattattaacttacttaccgcttatttaatttattgttagcgaaaacatacggaaaacgaaaaaataaatgatataaaattaaattaaataaaaaataataataataaatttttaatttaataaatatgttactattcttaaatgatacgttatttaatcaagtttttaattttttattaatttttattttatttaaatttttattaattatttattaaaatatcgcatgaaaattcggagacgcctgaaaccaaagaaataaaaaacaaaaatgtgatataaaaagaattttttatgctaaaagttgtttaaaaatatcccattaaacaaaccgaattaaaccatgaaaatgataaattttaggtaaaaaatttatcatttgaagcctggtaacagtttcaattatatttatcatttaattatgatcatataaatttaaaagcgttaatagaatttaattatctcataattacctcgagcagtacgagaaaaaataccaagattatttaaatgccaaatatttcactgtaatttaagaagcagttggattcatttaatatttttaattacattattctcacaattctactaattaattattaataaaaaatatattgttattaaaaattagaaattgttttaaaaaaaatagttttaatacacattctgttacgcaaaataaaacttttattaaataaaacaatttatcaattagtgatagctaataaatgtgattaaaattataaaaaggcaaaatattgattaataagaaaatgaataaacaattcacattaataaagtatgaaaaaacaaaataataaaatgaatagaaatagaca

SEQ ID NO: 15822 - DNA, 2398 bp, Heterodera glycines
ggtccggtcctgcaaaaatttttgaattctaatcctgcaacaggatccgcaaatttgaaatttccgggctctagtgattagaaaccagaaatatgaacatttgaggatggaatcaaaatttaggccaaacttagtccgccgaagtttcaaaatttgagatatttccagtaaaaactgtgtaaattttaaatttctaaggtttctacccaatttttttctggatttttcaacttttaagtcaatttcaataaaaagatttgaaaatttttaaattttgtaaattttctatccagtttttttccgatgaattatcaatttcttataataaaaaaaatcattaaaaattcaacgctgcaacatgggaatatgttaatttaattaattaatttaattaaaaaactcagattttgttaattaattacttgcaaggcatatttgaccccaatgaacggctctcgtcgcgcgcggattgtcgcggtcgaaggcgactccatcagaacgcgttgtccttgttgagcatgttggtcatgctgcacactttgctgatcatctgctacttctcctatgaatagagtaatgataagtagtgaattaattcttaaatatttgatcaaaatgcccggtaaattttgcaacaaacacagtgaataaaatgtgtttgtgccaaaatcaattctcatctaatcagacagtctcatcaagcaacaaaaatagtgaaaaaaactgagcagtgttttgaaatttttttaggtccaaaaattgtatatcaaattctgattagacagaaatcatggtaacaaaaaaaatactgcaactgatcagtataagaaaattaatttgtccaaaaaagagtatacagtttagcgtcaattattcattatccaaatttctgctgtcacaaatttcagaccagccatgagaaataagcttttaaaaatttataaattttttctgtcccaaaaggatgatcaaaatgagcttgatctatgtgcaaacaaagatatgacacgcgttagccattagcagactgactgactctcgattgtcgggatcacggccggcactttgatgaacaccacgttgtccatgccgagcctggccaagcgccgccgcctcttttcatgcttttcctccggcatagctgccaacaaagcgttgccatccaattttcttccggccacaactcgttggcacactgacgacgcctccggcacttttgcatgcttttcccggcgtgtttttggcagttttttcttgttggcatttcgtttcttccgcttttcagcctcaggctcattctgctgatctgtcccactttccggtgccactttatcttcctccttctttgcatcttgctgatcagcaacagcagattgaattcgttccgctccgtccaggagtcggacttcaatctttaaaaaggttttaattggcataatttagcgataccggtggcattttgatttataatttacattgtcgatgacatagcgtgccatccttgaatcgatgtgaaatgagccgacaatattctcgcctggcgaatacgcacttttgggcaattgaagttcggcatggattctgtgccgacagcaacagccgcagcagcaacagccgccataccggacctgaaaataaacaacacatactaattgttgccctaaataccgtgctaagtcgtttcctaaaatccgccattttagcgattttttcgacaaaacatggcataacattgcttaaatgcaatcgaattttacatttttggtatcattcgatagccaagctttttctcaattagcatgcaaaatttaaaaaatttggttaaacattagaaaaagttgtatgaaaataagtactatttcttccataactcatgttaagcttgacaattttatttaaagattcgcaagctaatagagaaaaagcttggctatcgaatgataacaagaatctgaaatttgactgcctttaagcaaagttataccatgttttgttgaaaaaatcgctaactaaaatggcggattttactaaacgacctagtacccctaaatactggggttaataagcctcgaccctgagctccccgatccctgctgttctccctttcccgtgaccccaaaatttcttcccgaggggttggagcttaaccctactaaatactgtaaggccataaaagaaatttttgtttttaatggcgattttcagtcgctacagtaacccttcaaagctataccgtctccttgcacgtgatgggctggggttgtggtgggaccaattgatcaagaccgggagaggacccaatggtgaaggccttctttgcgatgaatttgtcctgtaagtggttaatgaaataaaacaattcaagttggttcatgtgtggcaaaatgaaagtatgaca

SEQ ID NO: 15823 - DNA, 798 bp, Heterodera glycines
aaatgggatgaaaatggtaataaatattggaaaaaaaagaaataaaataaaaataatttttaaaatatttattaattttaaataattaaaaaattaatcaaaaaataaaaataaaataaataaaattttaatcgtgaacaaattatttgaacccccacttgccccgccccccttttttgaagccaattcactttttgccaaagtgtcaatccacacaaaacgtccccaaattgacagcccccggccgcccccgcggcggaggtgtcacacccaattaaggggatggactatgatgaaatatgggggcggcagccaaattaatagctgtggtggttggtggtggttgggccttctgttgatgggtatatcatcggtcggtggtggtaattggtagggtagaaaataatgggagattggattggaagagcgcccgggggggggggggagggggtggaggctggtccgaatcggaatggttgttattgttgttggttagttggggattgttgttggcgagagagtaaaatgatcggcgctcactgggtgcaaattggtggagagagggagggagattaagagagattgagagaatagaggagagagatgagaaaaggatatgtaaagaagagtgtgaggatttgaagggagagagagtgtgtcatggagagagcgaaagaaagagatagagtgcaattgttggactgctgagagcgagagagagagagcggcgggtggaacataaaaaagggagttgacgaaaaagatcattccgatcgagaaagaaaatggaatagatca

SEQ ID NO: 15824 - DNA, 1662 bp, Heterodera glycines
  misc_feature (1600)..(1600): n is a, c, g, or t
tttaccttaaaaaataatatataatttcttaatataaacttatatttttcttagcttaaatttggaatatgacatttaatttatgatcaaattacagaattaagtaaattaaataaaatacctaaatatttattaagcgtgatttctaaaattactaatgaacctttctgaagtaataactcaatattggttttacaaattgattgaaggcattaaatattgtagtaaacatatttattgtcaaaaattggaaattcaccgtaaaaaacaaaatgcgatcaaaggtcagaggttatatctttaaaaaagaaaccaagaatacactcataataatctttctttcaaatttcaaaaacgcaattccgaaaaattaactattcataaaaattgttaaaatatgaattttaaaatttgaatttaaaataaatttattaagagaaacccactcagtaaaattcatataacagaatttttatttatagaaaaatcaaattactatccttagcaggagccttttatgtttgccgaatggcatgaggaaaaatttaaatagaaccaataaataattaaaaaacaaagcagtaataattgtaagtaaaataaaaaatcaaagtaaaattattttcaaaaaaataaacattagtaatacgatttaaaaatatgaaaaaatttacatcaaaaaatttattttcctataaaaaagcattaaattgcaaaaacataatcaaaataaattactcataaaataaaataatagacatccctaaataaccaataataatttaatagaatttatgacaaaattttaaataaccttctgtggtgcaaaaagggcaagcaaggtattggattatgcatgatgtaataacagaaaatataaaaatatataaataaataataaatctaaacagtctacaaaaacgtatgttgatgattaccaatttatataaataattcattaattagaaaccagattgcgtttataccacgaggaaaaatactgggttgcatatatcacatcatgcccatgagaaaaagtaaaatgaaattctagataaataaggaaaaataataattcattttacaaaaatttataaatggatgagaatgttacatataaataaaaatattgagctttttagacaaaataaatgcaatgaaataaaattatttgcaataaaataagtcaaataaaaataaactaaaaattttgcgactttaaataaaagcaaatgacccttttacaatattctgcatataagttgcgaaaataaaaataaattatattttatgcctcgaataataaaaaatgtaaaaaattaagaataaaaaacaataactttataaaagataaaacaatagattattttttaatgattaagaagatataaactaaaatattaatttaatgtaaagctttgaaaattttaaacagaagcactcggagcgcttggtacagaaattcgcctccctatcatgaaattctaatattacagttcttgaaacttcattcggttatatattgaaaataaaatgaaatcaaaatcatattaaaaatttaagtctaaggatttatataaaaaatctaagtttattttanagagagttaactttttcaaagttaaacaaattttgtgagtaacttttgaaggtcttcttttt

SEQ ID NO: 15825 - DNA, 2660 bp, Heterodera glycines
  misc_feature (902)..(902): n is a, c, g, or t
  misc_feature (916)..(916): n is a, c, g, or t
  misc_feature (969)..(969): n is a, c, g, or t
  misc_feature (982)..(982): n is a, c, g, or t
tttttaaataaattatctagtagtttcaaaaaataattatttaatttattttaccatttgaaaaaattggtgatatatctggaattttaaatagcagcaaaaaatgttttttttaattcttttatattactaatttaattctttatttgcaaatgaagtatagaaatgtaaaaatagtttaatgttgcaagatgccacaaatctgaattttcagaaaaaaagatttagccacaatatatgaaaaggacaacaattgagaaataattttataaaactgataaagaaagaaaatattaagaaattaattttattcccaattagtgtaattctaattaatttgatagttcttttagtgattaaaaatagccgataaattttttacttttttctaaattttctaaaattatttaaggattgcaagcacattctgttcaattttgatgaagtaaaaaagaaaaaatgataaaaacataaaataaatatttaattattgacatatcaaaataaattattaactaacagtaaataataaatcttgaacaaactccaatctaattcatatattttttaaataatttaaatgctcatttgatatttattaatatttcctttttcatagataaataattaatattattttatgctagtctatttttaaaatttacatttgtaagaaaaaaggcttaatatatttaaataactaagtattatcatataatcatcaaaattatggaataaaaaatagattcacaatttttttatcattacgataaagaagttaataatagacctagattggtaaattaataaaaaaagcagtgagcgtcgagctagaacagcgtcgggaatcccgacatggcttcacggacacccgcactatgactataagaaatttataatanaattcacaaattanataatcaaaacgttgaataaatgcataaaaataaagattttataaataagaanattaactaattanaacaaagaaaattaatgcaaaaaaataaaggtgtttttcaaaaaagtaaactcaaaaataaagaaaaaatattttaatacattgatggaattcagatgcaaaaatatggaaaataaattgttacaaatacatattaaaacaaaaacttctgaaagcaagaatcgagattgcttggcgtcaacactaaatgtcaagattaaaatgaaaaaatagaaagtttattaaaaatattgataaaatatagtttcaaaaaatgtaacaatacctaaattttccattcctaattattaaattgaacaatatataaaatcatttagcaaaccaaatttaatgtgctaatttaaaaaatattttaaataataaaattcatgcttccagctgataaattgacatgaactgtcagcatataaaatcgaaaagtataaaaaaacatatttgtatattgtaaagaaatctagctaccaagtggattgtaagtttaaagtaggaaaacatgaacaaaataaaagataaatacaaagtgaggaaattatggatttctaacaaaaaaaattaaataatcggatttaatatttacttttaggttctaattataatgaatgaaattgctaaactaaagtaaatatttttaactttcaaaacaaggcaataaaaattaataaatattggatctgcaaaataacctaaaatacttaattatttaacatgacttggatttaaactttttgcaaaaatggacattaaccgttaaagcagacaacctgcaagtgcagcttttggagcactcagttcgcagattacaactttatttgttcaagaaggatcttttcgtgttaaataaaaataataaacactcttaaaatacattttaaaatatatatatatatataaatataatattatcaatgaaattttaaaaaatgattaagtaaagaagaaataagtgtgaggaaactggcaacgatagaaattttttattaaatgcttaaaaattgaaaagaaataataaaaaatacagtacaattaattttttaattgaaaaattataaatttctgaatagaataactcggactaggataattaaatgatatatttccacatcaaatgcaattatttaaaaacaatagttttgatttgtataataatttttttgttaccaaaaagcaaataaccaactttggcttggtcaattaaatttaaaatttaaagatttacctacaaaaaattctattcattttaagaaatattaaataatgttatcttaaataattgatgaactcaaaatttaatatatctatttataaaaaattcactttaatcaggattaatataactttaattaaagaaaggtaaattttattggtgtttttgaaatgaaaaaacaaaaataaataaaaaaattattttttataatctatcaatgttttattggttgaaaatcaataagacttaaacaaaattataaataaataactaaaatcattataagttatgttttatattctgaattcgtattatcattccgaactcttcttgctgacggaataacaagcatttaaaaggaactaaaaataataaaaatgctaaaaattatctaatagaaaataaatgagtaaaagataggttgacttcaattgaaaagataaagataataaaaataatcatcaacttagtgaa

SEQ ID NO: 15826 - DNA, 987 bp, Heterodera glycines
cttttccaaatttttcgctttttaaattttatcaaactgtttttttgatataaatcgaaaaagacattaaaaaaatcgaacaatatcaataaaattataatgtgaaaaatcaaattacgcccatctcggatttatcaatactatatttcgcaatttttttagaaacatgaaaccgaaaaatttctttgttctaatttttccgcttttcgtttgcttttcgatttttgaagggatttcgtcttacaaatgggactcgaaaaacttgccgaacaatgtccatacatttgccggatttatggacgatctttatgaggattacagggtcaaaggacagatgggtgagtgactttattgcagcaaattcaaaaaataattatttaaaatttactctttttaaaataatatattcttaataaattggaaaattaattatttttgaatgcgtttgcttttgaatttaaaaatttttgtataaaattgtcagactttttcagacatacattggctaaaccaaccaaaattgtacacggaaaaaggattttcggataagcaaaaaagaacggttttcaatttgacatttgtaaaatgtgcggcagaaattgcccatttccaagtgcttagccaaaacgacgattcaaaagatgcttatctgaatttaaaagtggttactatcagtgaaataaaacttgtaaaagatgaatttgttggttttttgcattttgaccaaacacttggccaacaaattgcaaaaaaattcaaagacgaaattttttctaaagaaaaacaaattcccgaagaagttgtgcaccaaattcagcaattggccttctcatttgccgcccgagtcattctcagcataatgtaaaacattgaaatttttaaaattaatttgaaaatcgtaaacatttattttattggcatgagacgcaaaatcattgccagagaaaaattcttttttaatttcataatttttttgaaaattttgaa

SEQ ID NO: 15827 - DNA, 2520 bp, Heterodera glycines
aagcacgaagctcgaagtttttaggaaaaataatttttcactaacaaaattttagtggggtggtaaaaattatttgtaacaaaaattaggatcatatctaggctgtaagaggccgaaaatttcactagattcgagaccgagatcgaaaatcccgagacttttttaattttttaaaaaaattttcgtattcacttttgtataaatttaaatctaatcaactgatttttccacttgccttttttgaggcgcatttttaaagaacttttttttgaggggggggggggggtacggcggtgtctttaggcgccgtcgggaaaaataattgaaattttagcgcactttgttaacagatttaggcaaaaaaatgaaaattttagcgattttaagcctattttttaagaaaaattgggtgttttacgcgttgggggtgaaaagtgttaattttgacctatatattaaaaatatacacttacatcatattttcaaaatgttaatttttggaaattaaaaaaaacaattagtcatagaggaactgatcaaacgcaaaaacaggtaaggaaaccaagagcacaacccactaaaccacgcatgtgacatatttgaaagcaaagaattaataaaataatatcaaaagccaatcattaggggtgtatttttcccgaaacttctggtaaattacccgaagccgaagcgcgaagttcgaagcccaaaaaccgcaaagttttcgaagctcgaagtttcgcccgtctctgcgccggaccccccccccccccctttaccatatttttgaaccaaaatgccaaaaacaattttttggcgaaaaccggcagaaaattttgtaaaatacacccctaacaatcgcaacccttatactggccatgatccgggcaaattggaataggataaccggatttacattcccttaattttttcaaatttttttaatttggtataatatcataacaattttaaataacttaactttgatagatctttcacttatacgtaaaaagcattggaagttatgaagaaaaaggttgtacttggattattgaaaaaccttatttcgggagtcaaaaattggcccaggttcgggctccgagttttttcaaaattcattctctactaattattgtaattttttgcctcaaattaactccttaacaccattttaagaagcaatcaaattgagatggaactgtttaatgagccgttgtggaattatctgagagtttttggaattgatgccaatgtagccttgggtaaagcacattaatatatgtaaatttaaaaaacaaatagttaatttaatttatgcataatatcattttttagacgtgttcaaattttgcaaagaccttcatacagttgtccagaaaaaaattgaagaacataaaaaatctgtatttgataaaatgaatcttcaagttaaaaatgtgacaacagaaatgaaagaatttaaaaatttgaattccattcttaagttagtagaagataaggaaaactcaacggcattggaaaatttttcatcaaattataagggaaaaaatttatctcagaaaaaagaggtattaaaggaactgttggcaattttaatgaaaatctacacggactacagcaatgccagcaaaaaagaaataagcaaaaatgccattcggttgacacattctgggaatgtaactttacgatttggacaaattttatatgaaacgatagagaatttggaaaatttgccggaagaccgcgtgaagtacgatgaaaatgaacaattgctaagcattttgttaccatttgccaaccatttgcttaagcggctctatgaatttcttgaaaggtttgtaaattaagcgcttgggataatttgccacatttggccaaaagtctctgccgttggttaaaatttaaaaatggtttaattaattctgatataaatgggaaacatagaatttttaattactttttaagaaatttaaccgagaaaagcaaaatcagtgatgactttgattttgtgcaaacacttcaaacagttgccgaagagagcacggaattagaggcggagaaacggcaaatgccaatttcggctggagttaatgtgaacttgtttcaattgcttttctcattagcaattcgtttgtgcttactaattgacgaaaaagaaaaattggcaaacaaatatttgccaaaattcgtattcgcgttgaaaatgtgcacaaaagaaactaggtaaaaaataaaattgatttttaatttttatttcgatttttattttattaagcaattaagggttgggaaattttaaatgaaaaagggtgaaaaaatagattgtattaagaattttaattatattggtaaattaactttattaattaagctataacaatttcgaactctttgaacacaaaatgaaaattgatggtaaaaatgtgcacataaatttaagaaattggcatttgccttactttgtgtataagcaaaaagaagatgaatttaaaatggaaaaagaggaaggtaatttttgaa

SEQ ID NO: 15828 - DNA, 1107 bp, Heterodera glycines
agttgctaataactcgaaaagtagtttaacaaccgccgaaaaaaacatgtttttcgtgcatttcaggctcggggagctcaggaaaaaatagtgaaaaaactataaatccgatccctaatgatgacaatatattaattatagattatacaaaaaaaaaaatgaagaattcatttctaatatttttataactatattattttaaatttttaatatttgaatatcgtgttatattaacagtatatattactaaatggtcaacaaccaaccgataatacaaaaaaatataaatataattttatatggagataaagctttaaaatttattttaatatttttattccaataaataataggtttaatgcttgttaaatttataaaattgtactttcaatttttatcattttttttgcgaattttgcataaatagctgttcaacttataaagggattaattaattttaatcgatcaataattattctgtctcaatatttaatggctattatgtatatatactaatatttgactcgataatattggattcgatttgaatttattctattcaatttgaattttttctccataattacattttgtaacgtgaatcttttattattttaatttatttatattattgtatgtaaattaattttagatattttattggttcattaatcaattttattctaattcaattttcatttacattcagatttgaattgtcataagttttttctaataaattcttattaatcttaatttattattcaatccataatttcctttttataatattcatatgattagagctttaggtgcagttttaaaatagtttaattgaagtagaaaaagaattcaattaggtttattaaatgataaaaacattcttttcattcaattcttattgcgaaattagaagacataaatattaaaattgcgaaaaatatgcgggtcaagaacaatataaacgtaagaaaagcaaaaggctgaattttatcaaatatttcggggttttttgccaaatatattttacatattttggtttatttcagtgataatcaatataaattcattaagttttccacaatttattaataaacaaccgctgcg

SEQ ID NO: 15829 - DNA, 2772 bp, Heterodera glycines
  misc_feature (974)..(974): n is a, c, g, or t
  misc_feature (989)..(989): n is a, c, g, or t
  misc_feature (2359)..(2359): n is a, c, g, or t
taataaacaaataaaatttagtgtcatttcaaataaaataaactacaataacgcgcctaaagaaatagcaaaattgaagttcatcttaaaattatcaaaatttttaactaaataaaaaactaaatatttaataaatgagctaaaaattaaataaatatagtataacataaatgaatattatgtttcaaatgatggactaaaaatttaaataaatgcaaaaatttaattttaaaattatcacttggattgataattttaaatatttaaaaataaaataataaacttaaaaatgaattgggtaaaacaatttttctaccaacagacaaaatgtgacataagaaaataaattttaatttaaaacataaattgtaaatgcaagtaataataaaaattttaaaaaataaatatttaaataaaatttttttttatattttaaagttcatcaataatgctcaattctgttcattttaattttctgaatagaaatttcatatttaaatcttgattttaagcttgaatttttaattattaaaatatttgatttttccttttttgtatcgtgatttagtttttaggttattaaatattggtttcttttataaaccttcttcatatccttttcataaattttcaggtttaattttaaaaaatcaatttggtaatttgaatcttacgttggaattttccgttaacaaagtttttgacagcaaattttctttttgaatattattaaataaatattaaatattttattgttatatttaatttctaatataatttataaagctgccaaattaactaacaagaaagtaaaatttttgaaattataatttttttaaatataaaacagttgggtagccaacgaacatataaatattgcaagaacataattatatttatagatggaagttgtcacacatattacatatattagtgaaaattaattttttgaattagcctcaattttaatattntgtgattttttacanataaatgccaagttaaattaattttatcatcttctcttcttgtttgtttcttaagatatttttatgaaacaacataatctataaaattctcatcaaataattccgcaagaaaagcttttaaagagtattagaattattattattcaaaaaatgtttacattgtttgtgtgcacaattagattatttaactctttttaatatctaaatatttgattcgccagcacaaatatttaatattgaaagttctaaaaaactaaattacataatgaagactccgcgcatttgtgttgagcttcagcagccactgcagcacggagacgcacgtttctataggatgaattacttacaatagaggacgagattaatccggcgaaatgatcattaaggacaaataaatataaacaaattaagaaatagaaaaaagaaattttaagaaatcaaattttatttctaaacattttatgataaaaaataaattaaaattgttttatatataaatattaaatatatcattaaatatacagtgagttttagaaaatttgcaaatatctgtataagaattttgaagtaaatgatttgaaaatgtatacaaaagcaaaagttcattttgaaaatttataaattatggctttgtttctaaaaatttaaagggttctttgatttgtctatgggttgtcttaggtgttcgtaaacaaataaaaatctggttattttagttttcgtagttaaaaaattaaaaaggtgcaaatgtggcagttacctcaaaggtaaattactgtatagtgaacacaaaaaaattaacatttataactaatcctgtacaaattatctgtaatgcgcctaatttgagattattatcataataaagatataaaggtaataatatattttagcgaaattatatatatgtataaatgaatatattctttaaattaaattaaagtaattagaacaatgcaataggtatcagggttgcggcgggacgagaaaaatatcaggtcgggattcgggtcggcggccaaaaaattatcgggtcgggattcgggatggattcgggttttgggatttgggtcaattacattttttcatatgaaaaatcaataaaaattttctgcgtcgcgcctttttctttcaaagtaaattctcgagtaaggggtctggcggtgccgataggcgccgccttgaaaaaatttgaaaatttgagtgaaatttgataacagattttcaccaaaaattgctaaatttttgcgattttaagccaagcgacgaatttttactttaaaaaatgcctttttacgtcgcttttttctaaaaaattttggggaacctgggccggcggtgccgataggcgccgccggggaaaaatttgntaattataatacgatttgttaatagattttgtcaaaaaaataaccaaatcattgcaagcgacaaatattgaaagggagaaggtatagccactagactacataaacgaaaaaatgctttaaaagaaataaattatttagggtcgggattcggatttcggaacgagaaaaatgtcgtgtttcgggattcgggtggcaaccatgataggtattggatttattcttaaaacagaggtgcgtccttatcttataaatagaattatctatccgacatactaatagtgctattgatttaaaaactttaatcagacaattattaaaaattagtataatctaaaaatataaaaaatagtaaaataaaatctctaaagcatcaccaaaatatgcgcaaaccattcagattcaagcgccaatct

SEQ ID NO: 15830 - DNA, 1466 bp, Heterodera glycines
catagtccaactgggatttcctcccagcaagcgtttttcgatctgagcaaaagcaaaaaatttcgtaacactgagactgcaaacaggggccatttcagcgccgctggcgctcacctggccaccggaccggaaagcccgtatttttcctgaatccgcctcaaaaagttggtcgggacatcgaatttgcaaagcccgcccggcgctcgttaggctcaaaatagcaaaaaagtgcgaaactcgacttctttctataatatataaactagcgggtgtgtgcttacatgtttcttgggtgcttaaagcgcttcgcgctttgggagcttcgctacctaggccttgtgttagggtctttgcgtcagccgacatgcacttggtttcactcacgtgatgagctgacacattgcatttatcagtgcaatggaaaccggaagtgccctaactcgcacgtcatccctcctccctcccttagtccaggtggcagcactttttgtatgtgtatccgtttaaagtgcagatgagaacggggcgacatcagtaaagtgccacacacgctggactataactcgtttgccttattgtaatttgagcatgtttttggccacatcctccctccctttagtccaggtggcagcacttttctgaatgcgtgcatcccttttaaagtgcagatgggaacggggcgacatctataaagtgccgcacactctggactataattctttgctttattgcagtttgagcatttttgttgccacaatattcagcactttgactctgtcttggtcgtcggtcatcctatgaatcgttaaacacccattataatcctttttttttgtctgtaattataagaaaatagtttatttaccaaagacaaaaaagtataaatcaagcaattcacataaaacaatttataaatcagtacgaggttttttcactaagtcttgttcaacagtactattctttcttttcaatgcaattagttccttttgatttacttcaaatgtgacaatggcaaccattctgttgacagttgcacgaacaatctgttcatcagttatcggtttcataacatttgtttcgtttggaatagctttgtgagttagtatattggacatttcatctctgatgacttgtgctaccatccgatgcactacaacatgcacaatctgttcatcagtaaactaaaattttaaaatttaatcatttaaaaaataataggttattaataaaaccaaagcttagaaatgttacaaaaagagctcacctttttctcctgtcctcggcactcaaactgaactaaagaagatggaatgctttgctgaagatctgctttcataacagtaagtgatgatgaagcaattcggggttccgaggatttcacatgtgttctgtaattaaaaagacctatttgatcaagcagtatcatggtatggctacccgtcggatagatttgttccaatttgaaa

SEQ ID NO: 15831 - DNA, 2108 bp, Heterodera glycines
acagctctttcaattttgaagagcttctccctaaagagtgtggtttccccctccaaaaaaaattcaccatttttttgattgcttttccttttctgtgccctcccctcccatcttattttaattgggacctccaacagcgacgaattcctttgctgctaaagaattgccattttccgtcccgtgcccttctttgccccccccccttttactgcctcttccggatcagataatgttgtcgtaccgctagaattctgtatcatcttggtcaaatgttgtcattattggcgtgtttggcgttttgctaatatttgttggcggcgattttcgccgcgacgggccatgttgactacgaatgcttgctttaaaacaaacaaaaagaaattcattttatttggttgagtaaacaaaataaaaaagaaagttttttaagggggtttccttttttggggtttcctattttttttttttgaatttttaagggttttcctgttttttttttgaatgatggcagtttgtaaattggcaatcgtacaacaataagaaaaacccatttttaatggatttaaacttgaaattgtatttattttcttaaattttaaaaattcttatgaaaaattcggcgttagttaaaaagcgttacattttgaaatttttttcacttttttttgaaattttttttttttttacacataatgatgaatattaagcattaacagcacaattatggcgaataaaagtatattcacgatttttaagtatctttttgaaatttttttcacttttttttcaattattaaataacgtgaaatgcgtatcatatattaaaaaaacagattctgcatcaaaaaaaaaaacaaaaaaaatttttgaccaaaaaaaactttcaaaatgtaacgctttttaactagcgccaaaaattctccattttggttgtcatcgaaaaaagctttttcgggctgttaccacctgttttttaacctatttccgaacaattatgtttcataaataaatatatatttttaatttctaaaataataaaattatttatttttggagagggattgcaataaaatgaataaaaaaatcttcttaaaagaaaaaaaactttttccattaaaacaaaaaaaaatttcattaaattaaacgctggcgccttctcaccattatttgccgacgctgtctcctcatccgagtcggtttcggcacaatgcctgaagtggtgttgctcgtcgtcctcgccatccgattgtggatgttgttgttgtccagctttgccatcgctgctgtcatccacttgtttgtcctagaaacccattggaaatttagtttatgtccttgcgaaattttaatttttgggcccaaccacagggtcaatggcagttcgtacaatggcatttggtacaaaaaaaaaattataatttcaattaaaatttttcagttgagggaacttcttctgattttttttgagaaaaaatgtaattctaatttaattaaaaaaattttttttactaacgaattgccatgaaacaatcctcttacaaaaaaaaagtcaaaggtcaaaatattcaaacaaaactgactttatagtctttcattaacaactaaaaaattttatttccaattttctcaaatttttttaaaattttctttgaaagttgtaagaaattaatagaaaaaattaaaaaaagaagaatttgttttttaaagtatatcccacctcagtgcttggctcggcattgccacttttgccgtcccccttcttcttcttcttgttattcttactcaaactcttcaaatagctggcatggcattcatacacagccgatttgtaacattgtcgtgcatttgttgaagttgaactgtttgaaaaattgttagtgtttaaaaacaaaaaaaaaattttaatggtgcaaatcctcctgaatttattgaggggatattgagcggagcaggccccccccccacaccgaaatttttttaaattttcaagtcataagaatttttttgaaaaatttacaaaatttgaaattttatcttaaaattttttttggggggctggagaacgacggggcgaggggaatgtcagactctgatcagtgaccccgggc

SEQ ID NO: 15832 - DNA, 1535 bp, Heterodera glycines
ccaagcggtgaaccaagacaaaacaaatttttgactttgaatccaatctgttgctccgggctgatcaggatttgttccatgaagcctggtatttccaaaattctgtgtgtaaaatttaaaaatttttttttattttttatcgaattttttgattgtattttttttcaccgtttcctgctattgtggaaatcctcaaacaatttgcgctgattgcccgacacactgctgttcatgttctcctcaattgcatttgacacaatttggtcgtacagcaaaaagggtgaccaacgcgtgatgatgtcataggcaatgacggagccaagtgaatggccaacaatggagacggggcctgacaggtttgtaaagcatacaattttgctgtgaccggttaaaaccattgtttatggaaatgcattcattcatgcagtttcccccccccccccaaaaaaaaactataaaatttttttaaaagaaaattttaagaaaaaatttatagcgattttttacaaaattttaggatgaattaaaaaaattgagtttgagaaatccctttctaaaatagaataaaaagcatgattgtactgaaaggatgcgacatatgtcagggaaacatcgcgcatttgggctcgtaaattaaaaaaacgaaaattagaaaaaacccgaatttttggaattttaatttcggggggaacgaacgacctgctccggtaaaggcatccaacaaagaggaaaaaacgcaaaaaaaaaattgtttttttaaatccatccataccatcaaagtttgggttgttggctttgaatgttgtgtaaattgaattcaaacatcgaattacaccgttcacaatctctgtccggtacaacggtgattggtaatacatctataaagatatcaaaataaataaataaaataaaatttaaataaatggaaatacgaccgaccaggtccatcaaagtagaattgagcgtggacctggcaaattccatctgaattttttaaatttttttttggtgtcaaaaatgtcaaaaaaccgacttttggaagtgttgccacatcagtgacaccttaatttttgaaagtaattattacaaatttacaaaataatttttgaaagtaattattacaaatttacaaaatacattgcataatttaattccgattttacataaaaaatcgaattaaaaatatatactttaaaaatgcttaatatcgaaaaaatggggataaagggaaaatgtagaagcataatgtattttccaccttcatccaatgtcaaagccgagcgccattccaccggcaaaacggcgggccgtctcttctcatttggataatttttgtccattaattgcagcatagcctcacgaatttgggccgaatttttggctatcaaattttggtagcccttctggccaatgcctgaaaattgtggaagctttttttataaacatttacatatattcaaaagattttcagtatttttgaactttttgcctctgacttttttttttttgtaaacatacgaaaattttctaaactt

SEQ ID NO: 15833 - DNA, 1463 bp, Heterodera glycines
cgtgtagttcatgatgaacctaataaataattaaagaacaatacatagctaaacaatttgtgagattgtcaatttaccagtcaaggactggagtaagttcgttgggaagagccatgtccagagcaataattccaggggtgaagactacattcagcgcagtgatcgcccctgtctcaaagtgcatcgacacgctgtccgggttgaagtcttgccacacagttcggaactggtggcggtgcgtcaatttcacggcgtacacgcctgattatgtaaatatacaaaaaatatttgaggaaaaataataaaatatcacttgctgtcgctgtttggttgggagttgcgcaaggactggcgtggccacattctgcagtaagcgaatttcaccgtcagcactcggcttgtgaaaagtgtatgaatggccgttgtgctgaagcttggcacggttcctttttgttagaattgtgtccattttcttagctgtaacattagaaattaagtcgattttattctaattcatgataagcatccaaccgctggaaatcttttctatttttgaaatttttaccaaaatttgtgaaactttttttggtatggaaatgaaccaaatacgtgggtaaggaaacggtggtaaggaaacggttggtaaggaaacggctggtaaggaaacggttggtaaggaaacggtggtaaggaaccggtggtaaggaaacggtggtaaggaaatgagtcgatcccagacatatatatatatatacagtatactttaacaatgaaatcctgtttttaactgcttcactgaagctggggcactacataaaatgccgttacataacaaatatgattttgatgaatttacgttaacattcactaaataagtttggtgttaatctccattaattcagaataaatattgttaaaatgaaaataagtgaagaaaccataagaaaacgactccaatcaattaatcaaacacaagaagcagttcaaacatgctcaaaatgggttttacataatcgtgaaatgattgacagaattgccacctgttggatggatatctacaaaaagggtattcatttattcattcctgtcccttaaaacaatgtatgtaatttcagctcctgagaaattacgcatcgcactcatttatttgttgaatgatgttgtgcaaaaagcagcaagcaaaaaggataataatgtaactttggctttgcatccacactggataaacgcaactgcgatgtccaagtagagttgtttttttttatttcttattgtttgtgagcttaattaagtgtaaatgtgaagaaggcgatctcgcggtgcgtggaagttttggaacaaaggaatgtttaccctgctcatatcatagaagaaatgaaagcggcattgggtaactattctaaagacatcgttgagggccacttctttcctttcagttagtagaatagccactgagaaggacg

SEQ ID NO: 15834 - DNA, 1917 bp, Heterodera glycines
  misc_feature (1876)..(1876): n is a, c, g, or t
  misc_feature (1880)..(1881): n is a, c, g, or t
tttttaaggttctcaccgaaaaagctcgtgaaatactggccagaagttcttttaactttaaagaatcagtccaatctcgagtgaaaggtctttataagttaacgagcagagaataaatacctttttcagatagagaggaaggagtgaaagcacttgcggacatggatacatcccgacaaaaaatggcctcgtttttggagagcgttgaaaggcatcggcaaaaagggatgaaactcatggaattgatgcaatatgccaaacagaccttcaatttgcagttgagggatgtgaccgtagtgaacgatgtatacatatttaagcgacacatctatagcacataaacgaatgttcaggcttatgaaaagtttgccgaaggaatgcgtgaaacaaaacagcaactcgaaaagatggaaaagtcaggagcgttgaccagtctggacgcaccttcttcgcccccacgagatgcaccatctccaactgctggtgatgacccattcgtacacggagtcgaatgcgatgaggcagtgggagcagaagacatggagatggatgaggagtacggacccggaccgagcagctgttttcttaaatcttccaaggattatgtcgcgtctattcccgccgtacctgaaatggacccacgtttgcaagtaattaaaatttggatatttttaggtattatatggtacacctcaaaaagtcgccgggccggtacatagcgtcgcagcaaaaaataaataatttttaaaaattacctaattttaaggtgttttcaatcaaaattattgttttttttttcggtttttgtttgagttattttattttatcaaatttcaatttctacacatgagatacaagataaaaaaaatttctaggtgtagaattatcaaaatttacctttttaatatatatattttctttatagcgtttggtgaatcaaactatttctgcttgtcaattgtccgacaacagtaatataccaatgccaagcgccagtttaagccgaacaacgctggacccccgtcaattggaccctcgtcaggctcgcttttttcctcctcctcaacaacctccgccacaattaacgcaacatttaaactttccacctccaatcattccaccgcctggtctttctccaccgccagcaacacaaaacgctacacaagatactgccgaaacactgcttaccattgataaatctcaacctccacctcaatttttttcgatgcctccgccacaaattccaaatggaaatggaaatgtcacagttctccatgaaaacgcttcaaattcgcatgggaggggctccactctctcgccaccaattgcgctttttaatccatcaaatcctccgccatcacttatggtatcgcaaaatcttattattttctttagttattttaatttcctaaacttattttcatttagcatatttcacctccttcttctcatatgaatttttcccttacgcatcaatctcttgttgttcaacctcctctgccacttaatcagtttcggacaacaacattgtatcatggaggccaaaaaaggaggaattcctcgggatcaggtacagtattccatgctacaattagtgagatttcataaaattttaattgctttctattagaagcagctggtaatttcaaacaaagacgtgcagcttggtctttttcggctgctgacggtaacgagagaatgcgaggtactaattggcggagtgttggcgaaggtggggaaggaggacgacatcaccgacattgaaaagctgtttttggcatttccttgacggagtttcaatttacaatgattctcatttttggccaaaacagaagcagaaaaaaacgatttttataatacaatttctgggttattngtannggctattctcaaacgattagtaaagtaaccctcact

SEQ ID NO: 15835 - DNA, 2158 bp, Heterodera glycines
aaaaaaaaattattttagctaattaaacgggacgaagatgaattaaaaatatctcacgaccagggacgattatacgggggaggggctgatcccgggagaaacgagctgctcccgaccgaccaggcaaaccgtgtaattgcgtccataaaacccataaattaatttccaactttttgtgccattatatgccaaaggtaatggccaagttttgattgtaaatttttccacgtttgcgagtttatttccctccggttcgcaatacctttttcgcaccattgccctttccgaccgattcaatgcgaacggatggacaatgtttcgcgacgaatgcctccagttgattgggtgtgtccaacgcgttttcgcgagtgactggtccagagaaatccaacaacaactcaaagagatcgtcgcgcttaattcgcaaccaaataatggccacggaaatgcaaaataacaaacctccatattacgattgataaatatcgtgtcgttgatcagtttgaccatcgaagtaaaatccccgaaaaccttggaaaatattaaacatttggcaaaatcaattcgaattttgtgcccatattctctatctggtgagaaaagaaccgttcaagagaaagattaattttgtgcggccaaatttatgtcaagaaaaagaacaaattcagtttttctctctaattttttcagcctccccccctgaaagttagaccgcggaatatttcaagggagactcgaatgcattaaattcggtaaacaattttccgttttgcgtattatcctggattttcactaaattctaaaaatataaacgctttctgaggtatggttaacaattctctataaaaggcaaaattccttcagcggtatctttctgcaccattcgctaaccatggacgttttgtcgggttggatggacgtgttggaactgtcagattcgagtttgatgatttttttgtcaccagttggtttgctcttctcaagacgcacaagtctttgccgattcgcttcgcccaatgtcagttgccggtgccggcactgcaatcggccatttgagtccagcacctgttgtgacgggtaaagtgagtacgggcaccagccgaaagttccaaaatgccaaagatttttttttttttgcatattcatagtctttctgacaatgagctcacaaacgaatggtccggtagtgtcggcaggcggacaaaaaaattttgcaaaatgatttaaaaaaaggaaaatgacccttgcctggcaaaaatatttactttccgtttcaatgcttcgtccaaaaacagcctttgcgtggtgttcgggtcaaccacagtcagcgacaggttgtcaaaaaagccaatttcgacggcctttgccagtgaaatcggttcgcgcattccgtgcaaaagcaccgtcccgtttttcgtgttcaaaatcctttcaacaatcgcctttccgacgttgtaaccatgtaatggcacttcgatggtgccattgttttcgttgtaagcgcccatcaccgcctaaacgaaaaaaatggtataaaaactaacataacctatgcaaatttttaaatttagaccatttcaaaagtttcacttttggcctcttttaaaaaagcacccgacaaactggtaatgccatttttaatcctggccaggtttatgcaattattcctttcttaattcgggccctggctttggcaattcaagggcatcttttgttcttattattttctttacaaactttgtgtccatttcctcgctttttttgttcgtttggcgccttgccagtcgtttctcccttattttaataaaaaatgatcaaattaaaaggaaaaaaacgcatgtttacaaaaaattcacccgacaaaatgtaattcgatatttaaaacaaatatgtaaattgatgtttgggcaaagtacgacaccggagataccctaacaaaaaaccattgtactcgtaataaaaaacattttgttggaaaactacaatttaatacttgactgtgtaaattggcatttagcattccaactcataaagcagaaaaaaatactaaaaaccaaaataataatgtttgagaagaaaacccatgaatttatttatcggttcttccgaaaacaaaccatttttttctcaatcgtctccagtttcaccgagtgattgt

SEQ ID NO: 15836 - DNA, 1882 bp, Heterodera glycines
  misc_feature (1856)..(1856): n is a, c, g, or t
tgcttccttctcggcttaagcgacactaccgctattttcgtgattcttcacaatcgccgacacaatttgaacggggaacagtcactgaacacgctgctgaaatggtccacgagctgagggaagtcagcgaattccgcgcgatggacggcgacgatgcgccggagggatctttccgcgagacatcagaaattgccgcgattgtctttccgacgtgccggctgcaaattgagtgggcaaacaaaagcacaaaaacagtggaggaatttgaattggtatggccaaaaaagggatgaatcactcattagctttgaatgtagaggaataatttagagtgattaatttctcccctttcttaggatggcagcgatggctttctgcttcggcacttggctttcaactcggaatactccgtccggcttctcaccctcaactcgtcttccgccgatcattcttcccctccccattggctgtctctccacggcacttttctctccatgcattgttcccaagtgtacggctcgggcagtttggaatgcggtgagtatgataccatttatgcggataaagtgagtaatgccgcagatcctgagccagtgcgcgagctcacagttgtaccttcggtggaaaatgggacggcactgatcagttgggagatgcctgaggaattgggaaatattttgctgtacgaagtgaccgttgaggcggtgccggaagtgaatccggacgaacaatgccaagtgaagccgagcgcgcgcattgtgtcagctgtgagtagcgagtttgactagatcagtctcataatgtcagcttaagcagtccaactccgtgctgttttctctcccgcaaaatgccatttgcgagttccttgtccaagtcgtggtaaaatccttctccaagctttagcttggcatatctcatttgtctttgtctcaaaaggtgtacgatttgctcggccgtgacgcgtcctcccagcaacggttcagcttcatccccctcggtgtcagcctttggtcccagccttctccgatgcaattcctcgtccatttggatggctccgtgttggcccttctctccgtcgtcattttcgtcccggtggccgccatggtgacactgatctgcacattctcacgacaaaacactcgaagaaaagccattcgacagaaattgccggggggaattgaatttgggaggaaatcggctaaaggattggaagtgaaaaagcggacgaagaagcagaaacggaaggggcgcgaggccggcaaatcggaggaggcggaggacgaggaacaacgacggaacgccaagccgaaacagtgcaattcgccacagtcgacattgacgacggagtcatccataattgggggaacgtcagccacaatggcaccccaggggatggaaaatagccaaaacattgggaggcaaatggaaaagcacggcgaaaggacaaccggcggaatggccatttggacggacacaattcgaagcaaaacagagccaaacggtgccattgtttgatcagatttttgccaatatttggtgctgttattattattttgtgccgatcggttgccaattaagtgttttttatgttcaaaaatgtaaaactatcgacacaattcgcacttttcgctcatttgttgctcaaccgtccctttgtgaccattaattccccccccccccttttgctgctgatctccccctcaaaatttacaatttattgtacaaatcccaccttttaaatgtaaaattaaacagatgtatttatttatttatttcgcatttttgagaaataaaataatattttttatttcatttcaaagagatcataaaaaccctaattcatagtataaaaattnttattataaattttcatgtttttgcc

SEQ ID NO: 15837 - DNA, 1231 bp, Heterodera glycines
catctgaacagtcattaaggaatcacagcataagcttacatccgtcgtgcaccgttactcgcctggtaattgtcgtcggttgagccaaggcaaacgttgcaattggggagggcgaagctcggatcactgtccatttacaatattatatcaacaattaacgatctgattgctaatcaaacgtgaaaaagttgtgcatcaatcatgtgccgttgttttcggttcgatttggcattggtcggcttttgcccctcctcgccttccccccccccccccggcccgtccctctcctcggcccccatcattatcacttctccccaacctttgcccgtgttttgctttcgctttcccttctcataaattggatttgcttttccttcgttctgcaaaagcaaaaaacattttttttgttgtgaattagggacaaatgaaagtatttgtttactgagaaaaacattcggagaaattcgatttttcattttacgattttttgagcattttttgagtgaaaaaggaggaaaatggcctataaagaacaaaaggtaaacgaggaaaagaatttggcatagaattgaaagaattgaatattattattcattattcagtctccgcaacaacaaaaaatgatccattgacttccgacgaaataagccctaaagaaaagaatgttggtgaagaaagaacggtccaactaattcactgtcctttcattactcagtcgtttattgggcggcagaattaatgatgcgtgccgaaaacggttcgtctacccgaaaaatcgaagtttggcatttggtggcccaaaaagtttgcattttctcgccttttaagacgaaagtcgcttagcaaatggtgagtgaaaacggcagcagaaggatgaacggccatcccaaactcaaaatgccatccccgccttaattaaaagcagccaagcgaataaatttgtcattttgacaggcattaaaacagaaataaaagggaaattcatatgcatcccccccccattcattgatgaacgctttgagactttttggctgcgaatcgtaaggcaccgcaaaaggaattattgaggggaaccaataaaacgcgaattgagaatgggcggcgtgggatgggcacgagttgagggaggggcgacaaattggcaaagtgggacaattcacgcacattggggaggggggaggaagacaagtgacgagagggagtccgacagaagaggggggcgggtatcaat

SEQ ID NO: 15838 - DNA, 1450 bp, Heterodera glycines
  misc_feature (1404)..(1404): n is a, c, g, or t
aaccaagacccagtcacggtaaagagaccattgatcccaaataatttattcttattgatattaatatatttacgggctaccttcaataatatatttttataataaataaaattatgatatatgcttgtctaagattgatttagtaatgaaaattagactatataataccatttccttcagttttaatacgcacagcaatgttcattataataaattatttgtaatcgattttagttataatttttgttcttcataactcgatcttacagtatttaataataaagacacatctagttatagtttttaactatatattgaaagtagaatggttatcaaatattatggaaataatcttattcgatctacgtgggtctaaatagtaatgtgtgttttgcttctcttgcacgagagaattccattgatgaccagatccgtagttttaatcagtagtcattattccgtaaactctcaaaaaatagagtgatcagctgtaggatcagccgcatccaattcccgtgaagaagccaagctcatcatttatcacaaagcccaaaccgaaaagcgtcaatttctttgagtgcaaaaaactgactgagtgagtgattaatgacagtgcgatcatctcatttttaagagtgtttgatgatcaaactaatactaaatctatcatttaaatatagcatcaatttatttcaaaatggactaaaaacggggcgatcagcggtaaaatgtgatcaggcaccaaattcttgagataaatctaagttctttattacatccaagctgccaaatgagtggctctaaaagagcatggggtagtgatcagaaattagtggactgatcagaaacttagtaaaaacactgatcaaactttacggattccatccaatttgagcataaatagcatcatcaatcattgaataaaaagaggccaagccccttttttccattcatttggggccaaaagtgatcggagcattccaatcaccacccaagcagcaagcagcacacatttcgatgaccaaacctccgtaaaggccattcattcattcattcatttatttgtgtccaaattgcacattagccgcccggccaatcaaaaagggcaaaaaaacaaagttacaactggccattcagaaaaagccacctttttaaatttaaattataataatgctttaggttagtgccgaaaatttttaagtttaagatttccatttttataaattaatggagcatttccatcattaaaaccttatagattggatcggatggatatgcggactcttatgttatatttggctagacccagatttatgtgtattgtaactgatccatcaaaccaaacctagttttatcctggatattcagtccgggtacattttccaaatcaagcagaattctcanaattccattatccaaattaattatctttgaaagtgaacatggaatc

SEQ ID NO: 15839 - DNA, 2237 bp, Heterodera glycines
tttttgcatttttagaaatatttcggccattttttggaaattttcacaagaaaaatgcgaaaaaaagcgaaaaatgcacccctaaagattgactttttgggaataattaaaaaatacacccttaaaaatcgaaatttttttagctttttgtaagaacttttggaaaaattttatttagaaagtaattttgttttagcatataataaaaatttaatttgtaattcaatattttttttaaggagttaaaagccatcttgagtaattttcaaggcatatttttgtgcatatttgggcattttgcgggttatagggcatatttagggatttttagtgcatattttatgcgaatatttgccattttttagtgatacaacttcgatccctactaataacttaaaaattcaatttattttatgattcaatataaattaatttttaaaaaaatgctattattacttttataataaaacaaatttattaattatgtttttcaatttattattttcacattataaaatcttgcttttaaaaataaatggtcaatcaggtataaagccgatcgcttaataattgtaattttccggttgcaaattgatgacttggccacagcaaatcggatcattgccgtacattgtcgaaattggtcccaaatgaagttccaatgggcctgttgttatgcgatggacgaactgcttgaagacgacagaatcttcgacaagaacagacgaagagcattcaggcattggattattcaaattttataaatccaaaaagtcttaaatttaaattctctacttagtcattatttttattttaggctaattattttttcagaaattaaataatttttaatacagaatacaaaatcttagtttttaagaagttttcccttttcttgatcatataaatgatcaatcagaatgctcgttcacctgttattttttctcatagtaataattagtaatgtttcgggcactaattgattgattgattgattaattattggtccatcgatcaattgcttccgtgatctccgctgataaaatgcttcttggcactgctttagggccaagcttgacgctcatccggtgtaccatttttggcttcgtgtgttggaggaccgtcgggagtgggaacggctgtaccgtcccgaccgactgatcgtcgaccagcaactgatgctggtgttccgatttgcgatcacgcacggctttctcgaacttgtccaccgattatggtaggaaaatttaaaattgcaatgttttaaaaaaataaaataaaacacgaatttcaggggcgatttgacagagggacaaatcgaaacaatcggtgattttttggcatttttaaactttgagaatgcttatgattttgaggtgtggaggattcggagaatttctttgaattaggagtacaaatattaaatattttttcaattaaaaacgctcatttgatttttacttttttttttaaattaatccctaattttcctaaattctttgcagaaaatctgtctcattttaattttctaaattgatcaaatttttgtcaggcttcttgtcctggaaaacgatttgcttcaatgtgcaacacaccgaaatggtccgtttcctgtgccgagtgttgtgccgaattaacatcaatggtgacggcattttccattttttgcaaataatttttttttaaatttgcattaaaaattataccaaacagtttgttaaatcacacacaaaataacatagcatgcaaaaatggcattaaatcttgcccggtgtaaaaatgccctaaaattcaactaaacccattctcgaaaacacaaaaaaaaaaaaattaaaattttggtttgtttaatgctgagatgacataatttatattggcaatttctcgtgttattaatcctggcatactcattaaaatggcgcttcggggaaaccttaccttctttaattaaagttaattgtttaattttgtagggatggttcgcctcagttgggacaatttctaccacaaagtgcaacaaacacttgaagtgaattcaaataaatatccaattttaatacatttgaatttttattttattcagtcggacgaaatgccaagggaagagcaaatgaaacgtttccacaaattggagagtctgctcatcaattggtgtcctgagctaagaaaagcggttctgtcacgcgaaaatttcaggcaaatccgagaaaaaagcctattaattaattagttacttg

SEQ ID NO: 15840 - DNA, 1679 bp, Heterodera glycines
tattaattagttaaaatcgtttattccgtactgaaatgacccgcctcttctgatcaccactcattagcacttttgtcacttcgcccacattcgcacttttgtcactttgactcatcacgagttagcccatcaatggctctccttagttcactttccttttcttttaatttcagagtttcttttctcatccaacagtcgcgttctatcgctctatgaaaccatttgtgtggaaaggacaaaaaatgactaaagagggcggaaaggaacagacaaaaggaggagggaaatgaacgaattgggaggaacccaagacaaacgcattggaagaggaacagtggaaagtgacttttgcaataatttggtagtgcaaaactatgactgttggtttagggtatttgcccgttcaaactttgccgcattttctcagactcaaaagaacgaagggaacacacgaaagaaagcaatttgaacagactcttcttcattcattcactcattcattgtgtgtcgcttttcggtcattccccagaaaaagccaacggatcattcccttttgtgttctttttcggatctctttcaatgcttcttcttttcagctgttcctcctcagttccttcgccactctcccctctttttcctcctcctccccctcacaatttccaattgctcttttcgtccgtttggtctcttttctgtcggcgctaaatgcgtaatcggacggcagaagaatccgtgcacaaaacatcgctttccaagtggaaacccatcgcatcaattgcacttcctgtaaattgtcatctcaatttttttcgctatttttttgccaaattgccacctttaggcattgtgccacattttcaacttcaattgccatattctccgccacaattcgttccgcttcctttttgtaccattccatttcgtaatcagccgtcccttttatgaaaaagtgacagtgaatccaaaaatggcacttctcaaaaacatcgctaaaaatagcaaattatgaaaaagaggagaaaagacaaaccaaccgaacagaaccaaaatcggacataaaagaacgaaaatgaggaagtaattgtgcggaaagaccaggcaaattcatcacaacatggaaattcaagggaaaaactcgttgggaagggccttcaatttcatcgctttcctttcgcaaattttggcagaattcgaccactttttccgggatgacttttcggatgaattctccgccgtccattacgtaagtttcgatgcgctcttcctttatctgtcggtgtgcttaattctttcgcttttctcaatttgatggccaaccccattcagtcgaatgctttcccgcataaattcgatgctcgccgggttcaaatcgttggcaaatgccttttttatttttatttttttaactgcaggcaaaatgaaagggccaacgccggcgaaagcgtcgaaaacgacggaattttggtcgaatttggcgaaggtttccgagtggactctgctgagtcgactgttccaaaagacctaaaagataaaaggatgaaatgagcgaatggaaggcgaaaggcgagtgtgcctttgagtaatccaatcggtaacgcagtccgtgctccaccacctccgtcataaactccgcttccccggcgaccaattcggcgtccatcactcggaattcgtgcgta

SEQ ID NO: 15841 - DNA, 634 bp, Heterodera glycines
tttctaaaatttgttttccttaatttggatattctgaatggtgtagaatgcatagatagctttagaatgagccattaaatgtaaggaaagccaaaattttagaaaacaaaaaatttcaaaaaaaaatcaagtacgcgatgtaaaatctttggctaaatcaatgattttgcaaaatccaagctcggattcatgatcatcagcgcattttttccccaagtaaaagtgattttgtaagaaaatttttatttatttttttctgtcgggacaccaattccgaaggattaccgattttttgaaggacctacaccgtcaaacccaatctttttaaacattggtaaatttttgattaaagcatcccgaattctttttggcaacaaaatgtgcccaactcacgtgaacttactcctgtccaatgtaagcattccatgggcagaaattggcgggaacataatcttgtcataatgtgaccgtgacatcgtacaaagttggcgaagggtcacagacaccaaaaccatttaaaaaggaaataaatgtgacaaaatataggaaaggctacaaatgtatgtgtgagatgattaacaaacgaaaaaagcaaaataaaaatgaaaaagtgatatgaaaaattaacgcagaa

SEQ ID NO: 15842 - DNA, 3389 bp, Heterodera glycines
actttttcatttcattttatttcacaccccaaccccatctgtgctgctgtttccattactatttttgttggcacaatcgcctctgttaatgatacaatttgccagggcctgacctgaggaccataaaaatctcaaaaatttcggctccggaatccgttatatgtttacgcgaacatttagggttgatcagccaaaaaaaaattctaggaatccagaatttcggttaccctaaaaataatccggggctggtcttagtcctggtacagttattatacaatatgacttgaatgactttgagacttttttacatcggaatttacgcccattcattcttttttggcattatgttccatcgaccaaacacaaatatttcattttttatttatcctaatttaaaaaacatcgaattttccatttaaaacatttttgttttttttctgttcccatcagcaagaatctctttctgattttgctcctattcacaaaaacaaacccttttttttgttgttgtattatccaagactttgttctcctaccgctggggcagtaggccatttcccccagaaaatctgaaaaaattgaaaaaacaaaccctaaaacgctgttttttttgttgaaatttttacatcacttcggaagagttccccccccccccccctccaaaaaaatggaaaattaaaaatttaaatgatttgttggcggcctacaaaacgaaacagaacaaagttttagattacaaaaaactaatttgtatttctctgtttctgtctgttgtaccatattatgattgattgattcacattgccaaattggtgaacaacaaacactatcaaaatgttcgaattttgcattaattattatgatcattaattatcacaacccccccccccccatcctaattaattattattttttgttgcctaattttcacgtcactctctcttttcttcccctcaagattgtctcctctcattacgtcgctcttcgtcttcatcatccgtcgtcgtttgcccacaacatttcgcaatttgctcttctcctcctccatccaccacggcaccatttcccccctcttccgtgcccaccgaagagacttggtggcttttttcccgctcctcccaatcatcatttgctaatcccgaaagcgatgatgagcgattgatttgattaatcattaatttatgttttggcacatttttgttgccctttttttgtttgtttccccccgcccattccccgaaatcagcgacaaattttgtgcccttttcataataatcccgatgtttttttatttacataaaatgtatgtttattagacaacaaaaaacagactctctctccatctctctcccgtgtttctctgtgcgcatattgtgatcattgattaataattgttccaccaccacccaattcatgcgaataaaaatggttttttttgatgaaatctttattttaatatgcaaaaatttaaaaaatgttgtttaaaaaaagattggtaaaatttgaagaatttttggtcataattttttgaaacgaacattttgaaataggtaatttgtacactgttaatttaaaataaagacaccctgttttttgggagtttgaccacttcccatgaaccgatcgagctgaatttttaactgtacgtagcaattctgaaaatattaagattctgaaagtgagaaaccgaaatgatgacgtaaaaaagttttacgattcaaaaatgaggaaaaatggcttgaattgagtcattttttggatagtcggtatttacaaggcacccctcagcgaatacttgctatagagcaatcattcaaaggccattttgtagagaattttgtgctctttctgttcgtcatattcatcttccatggaaaatttttcccaaccccctagaatttttttttcgaatttactcagattttcgtattttttcacccgcaaaaattttgtgtttaatgccttttttatggcataaaatgaataaaaaatgcttaaaggatgtctgtacgttatcttagtgctgattgctgttagtttgattcagttgggcaaatgttagaggcgatttaagccttttggcccttaatttctcctgaaaacttagaaaattcaacataactctgcctaaaagacatatttctgttcgcaaaataaacagaaatgtgaaaaaagatttattctttcttatttagtttgttttatctgtttatttttggtagttgttgagattttgttcgtttttatcaagtgtctctattttaaattaacaccccatttttgaaaaaaaatcgtaaaacttttttccgtcatcatttcggtttctcactttcagaatcttaatattttcagaattgctacgtacagttaaaaattcagctcgatcggttcatgggggtcaaactcccaaaaaacagggtgtctttattttcaattaacacagtgtattgttccttctgcagcacccacatttctgttaattgcttttttatccacagatttcatgcaagtattctaagtcgagaaatgctaactgtttattaggcctttttttcacttggtcatacttacattcttggtaccaatttaaatattgaaattttataattataaaaaaaagttttttaaaaatttctcaagccaaaaatagttgttaaaaagtttcataaaccaaaatagttgaaaatagttgctaaaaattgctctaaatcgaaattaatcgaagaaaatgtgttctttgcgtctatccgaacaaatgatatcagcaaaaaaaaataggtgaaaacctaccaatcgggtcggggtcacttcggcgcagaccatttcggcgccgcaaattttgaaatgctataactagggctgccaaaaatatgcatgaaaagtggccaaaatatgcgcataaatatgcaaataaagtcgtgaaatatgcacaaaaatcgcaaaatatgcaccaaatatgcataaaaaaacttaaaaattaggcgtgcaaattaataaaaaaaaattttttattcctcataaattttatcggttgtttttgcaatttcaaatcaaaatttttcaatttttcgcatggaattcactgttgacccactcgcgcatccattcaaaatttgatttaattttaagcataatcaaatttttttctaagatttattcaaatcgaaaaatatttagttaaaaatggcaaaatatgcataaaaatctgagaatatgcacaaaaaatggcaaaatatgcagaaaaatccaaaatatgcataaaaacccgaaatatgcaaataaaagtcccgatttttatacgcaaacacaaaaaaagtgtttttcctactatttaaagcacggagaagccaggaaaaaaacatgcatttgcatatttttggcagccctag

SEQ ID NO: 15843 - DNA, 2102 bp, Heterodera glycines
tgtaagtaaaatattttccccaaagggctaatttttcgttttttgtgaaatcaattaccaaatgatttttttatcagagcattataaatttcgatttatcatttatataactaaaatattttaatgattaaaataatattaatttatttattgattctgcacgcgaattaacaccattttttcaataaaccacattttctttatccattttctatcaagatcacatgaactttactatttccttaatttgtatcgcgtaaatcttataaaagatttaaataatattaattttttaagattctacaccgcgtctgaaaccttcaaatctgtaagtaaaatattttccacaaagtgctaatttttccgtttctgttgaatccattatcaaatgatttttttatcagagcattaataaatttcgatttatcatttatataaataaaatatttttaatgattaaaataatattaatttatttatagattctgaacgcgaattaacaccatttttttcaataaaccacattttctttatccattttctatcaagataacatgaactttactatttccttaatttgtatcgcgtaaatcttataaaagatttaaataatattaattttttaagattctacaccgcgtctgaaaccttcaaatctgtaagtaaaatattttccacaaagtgctaatttttccgtttctgttgaatccattatcaaatgctttttttatcagagcattaatacattagtagtatatgacccctaaaggttgcgggtgtttcccgcacgagcccgtgggcgcagccctttgaagtagccgccgtggacatttaccgccaagaaccaaatcctaagggatggatgcgcattcctttgattccaaaacctattggaccactttgatgtagccgcctgaccaaatccgatttcccaaattgttgcgggtgctttttttttcaccgccgcgcagcgccgcgggaaggtcatcaatcatccacctgtcaccaaagtgacaggtggaggaaattcaatttaacttttgcaaattttaatcttttgtttcaaaaccttttagcgttttattttctcaatcctgaaattttttttttatgatgattttttgatcctgaaattaaaatttttttttttgaaaattagccaaaattgtgaggtttttttatttccactcactccctgccgatgcgccgcgatgctcactccctgccgatgcgccgcgatgccgagtcgcgcaaaaaaaaaaaaaaaatcgataacggaatttggaagaagtgcaaattaattgatattggcagcaaataattttgattatgaattggacaataaaattactatttaaatccaatttaaaagtaaaatcaaagaatgaataaataaattaaaaaactttttcaaaagtaggtcacctgtcaactaaaaattgattgatgggttttttatttttcttcccttatttctcaatctgcacgtgactttttgttcaaattatttcgcaatatctcccctaaattaggtcaactgtcaataaaatgtgattgattggtttcttatttaaatgtctccattatttttagttttctgttccaactatttcgcaatatggcccgtaattttgcaaacctgtcaaaaaaaaaaatgattgatgactttcgaaataaggaatatccaaacgatttttgctcggtttttgaataaaatgagacagctgtctaccgaaatgattgatgaccccctaaattaaggcaaccccagacagtcatgtgactagacccctccccctttttgcccaatccgtacacccggcccaaatcgaaaatcattcaactaaatagttggatttcattaaactctcttcgcgctctaattttaattccgctctatttttaattgaattaattaaatcttctattaaattcccgtctttttcttttcaaatctctcttcactctttaatttactgtatcaatttcgcggttttttgttttaaaatgtcttttacacgcgcgacctccttccaacccgccgtgccaatggccaaaaaatgaaggccgatcaatcgggtaagtgatttttaataaattaa

SEQ ID NO: 15844 - DNA, 1261 bp, Heterodera glycines
aaaaaaaaaaaaatttttaaaacatttttttccccccccttttttccccggggggttatttttttaaagtttttttttccccaaaaaattttccaaaccccccttttcccccccgggaagttttttttttttgaatttttgacccgttttgggaaaataaaaaaaaaaaaaaataaaaattttaaatccttttttccccctccctttttcccgggggtttttttttaaaatttttttttcccaaaaaaactttttcaaaccccttttttccccccgggaatgttttttttatgaattttgaaccggtttgagtagatttgactagaaaaaattgaaaattttgaaatcatgttttcccctcccttttcccaggggtatttttttgtaaaatttttttttccccaataaacttttcaaaccccatttttcgccccgtgaatgttatttttattgaattttgaaccgttttgagtagattagactataaaaaattgaaaattttgaaatcatgtttccccctcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccaaataaacttttcaaaccccatttttcgcaccgtgaatgttatttttattgaattctgaaccggtttgagtagattagactagaaaaaattgaaaattttgaaatcatgtttcccactcccttctccccaggggtattaattttgtaaaggctttttttccccaaaaaacctttcataccccatttttcgcccccgggaatgttatttttttttgaatttt

SEQ ID NO: 15845 - DNA, 2649 bp, Heterodera glycines
  misc_feature (2627)..(2627): n is a, c, g, or t
tttagaccgaatacattttcattagagtacaaattaatgaacgaaagttgaaaaacaaaaaaatgaaaattgataatcctacgagaagcaaccaatgtttaaacgtacaaaaacaaaaatttttggtcttttaaaattttgggctttttaagtaatacgttttgccattgtatttttggagctttttaggtcaaaaattcgaacccctatcatggtcagttttagaattatcagaaatacaaatagtgaggctttctttggaaaaatttacctaaaaaaactataaaatctcaatattaagcctccgatgtgaattaagaaatgccaaaagttggaagtaaaaaagtagaaatgttggcattagggatgcactttttaggcaaaagcctatttttttcctgagctccccgtggcctgaaacgcacgaaaaacatgatttttgggctgttgttaagctacttttcgagttataagtgcctattttctaggcttttatttttagagcctaaaagcctaaaaaaattttgaaagagcctatttttgcctattttggcgttttgtccaaaatttgttaataaaaaatgcaataaaaacgaaaaatatacccctaagaatcgacctagaatttttttcaaaaacacacccctaagaaatgaaaaatttttaattattcatctccaaaattttttatttattttcttgacaagaatttttggtgttaaaattgaatttgtgatttaaaaattatttacctcaatactgatttggcctaattttttacttttttgaatacattttgtaattttacacccctaaaaatgaggttttttagtgcctattttccattttttagtgcctattttaggggttttttaaagcctaaagcctacctattttggcagttttcagagcctaaaaagtgcatccaggaccaagaaattgatctaaaggtcaaattgaaaaatcattcgaaaaatttatcatatgcaaaaagaaaggtcagaattaaaaaaaaaaactccgaaaaaagtaaatattgtggattaatgactgtgaaaaaacttaattccatgagatggaacttttttacattgagcaaactgtcagtttcaagcttcagctttttaaatcatgaaagcagaaaataatagctgtccttgaaagaaaggacagattcgaaccctgccatgcttatatattaatatggattttcataaagccaaaaattcttaaacaaaaaatatatataactaaaaagcataaaaaatggacctgatacaaattataattaattgtgaacatgaaattgacacgcacgaacaaaaaagcaattaattgactcctaattattgtcacttcaaagggaatacaaaaatttatgcacattattcgagaatattttaggacttaaatgaagtggaaaaaaattggaagcggaattctaacaaatgcgcatggaggcccaagaaaacaaaagtcttagtcaatatgttttgtatcgaccgaccaattcgggagaaggcgacaaataaatttcgttaaaattctcaaatttcttccctcttgactcaaaaattcccgtaaagattttaaaattcagacgaaaattcacaaattggtcatttttagtcaaaatgaattaagaaaacggggtcatgatttcaaaaattttccgacggaccgctctctagctcttcaaaaaattttttcttaaaaagctcggcgaaaagattaaacaaagcccttgaacttgaacacctttttttttgcacttcattctaattttttcatacttttttaaaattcattacaatggaataaaaaaataagctaattttaaatttgtggattttaggggtcgaatttgatctcgggcaggcaggcggggagagccccctcccccccccgccctcttctcttccacttctagttaagtgcctgcacgcgaggtgttgtaagtgagtgcgcgaaaaatttgtatgggatgttttatcgtggacatgaatgctaattaaaaaaggggtacgctgtgtgggaacaattagcgtaagaaatttggccctgagggcaacctccggcggcacggggcacacacacaacccagcccagaaaatttttgtacctttcggcaaaacaccattattaccttttttattcgaggaatatgtgtatgtttgttgacacagtaaagcgctaaagcaagggacacgcttgatgccagccgctgattataaataattaattttaaagtgtggcgctggggtcgcccccggcaaaaagggatgacagacggcggcacgtctttgtgcagctgaagcggctgctgccaacgacgaggcttcgaccccaaaaagccgttggtcccgctacccgtccgagtgtttccggcactcgcgtaagcagtgaaccatttcacgtgatactatgtgctcaattattcattcattactacaatttcatctgctgctaagaaaagagtggcgccagtcgagctttaaaagtggcggccgagtaatgcgggtaatcagcgcgtcaattgtcccccgcccccctttatggccattgggatggtcgccttgacaacttttgtgccgcgtgccgcgttgctgctgttgctgacagcccgncgggcatttcgggtaatttttt

SEQ ID NO: 15846 - DNA, 1441 bp, Heterodera glycines
taagagcgatcagatcaccgtcaaattgaagaaaaatgatactgtgcaagttttgaaggggaagataatggaaaagttggataagaaaattgaaaatgtgattggacatgaattaggaatcaatcaaccgaagccgacattgaaatatcagcagaaatcacctgcagataataatgcttttgttgttgagcttgaggacagtaaaacattgaaagattatggcattggacaaaacgcaaccgttcatttgtcgtttgacaaatttgaaattttcgtcaaatttcaagaggaaaaccaaaatgaaaaaaggcgattaactgttggggtgaaaaaacggacacagttgaagcattgaagcggataatccaaacgctcactcagattgagccccaaaagcaaacactgagaagggacaattgcggtgctgtgcttaaggacacagaaacaatggccaattgtaacagtaaacacatcgtttatttggccattgatgagtttcaaatccaagtgaaattggagtactgtaacaatgaacatacagtatgggtgcacagtatggacacagttagcacagtgaaattgaagatttgtaatcaaatgatctcatatatttctgcatataagcatattagggccaacgaacaaacattgaaatacgacggcactgatggtgtgcttgatgacaatgcaacaatggcattttatggcatcggagcaggcgcaaccgttcaattgtcattggatgaaatatttgaattttttgtgaaatatgaaaaagcggaggaacagaaagaggagaaaaaagtggaaacattcagtttagaggtgaaaaaaacgaacactgtcgccagtttgaaggaaatgatcaaaaatgagaaaaaatttgtgccaaaaagacaaacactgcgacgcttttccccatatcatatgctgcttatggacactgaaatattggcaccaacaattcaacatgaaccaacaatttacttggccattgatgaatttcaaatttttgtggaatatgccagcgaaaggtacaacaccatttgggtgaagggcacggaaacttggcaattttaaagaacaagatcgcaaatgggcttaaaccatctaagtacattgatcccgacagccaagcgctgcaatacggcacattggctctgattaatgaccgtaaattattgaatgattatggcattggaaaaggtggtgcaacagtgtccttgtccattgatacattttcaattgatgtggcacatgaagaccaacaaggaagacatgaccataccatttgggtgtggaagagtgacacggtgaaaatgttgaagcaaaagattgagattaagctgggattttcgcccaacaaacaatcactgagatatgatcataaacaaaatccatatcctgctgaactttatgacgacagcaaaacaatgaagga

SEQ ID NO: 15847 - DNA, 2462 bp, Heterodera glycines
  misc_feature (947)..(947): n is a, c, g, or t
  misc_feature (952)..(953): n is a, c, g, or t
  misc_feature (2244)..(2244): n is a, c, g, or t
  misc_feature (2285)..(2285): n is a, c, g, or t
  misc_feature (2329)..(2329): n is a, c, g, or t
  misc_feature (2380)..(2380): n is a, c, g, or t
  misc_feature (2396)..(2396): n is a, c, g, or t
gagacagtgcttaaagacgactgaagggaggagaccaattaaaaaacaaagatggcactgagacagtgcttaaagacgacttgaagaaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatgtcactgagacagtgcttaaagacgacttgaaggaggagaccaattcatgggttggcactccgtttaaattgaaattaaaaaacaaagatggcactgagacagtgcttaaagacgacttgaaggaggagaccaattcatgggttggcactccgtttaaattgaaattaaaaaacaaagatggcactgagacagtgcttaaagacgcctctcaaactttggcattttatggcattggcgaaaatgataacaacatttacattggacaagctgaatccgattagttgttgttgcaccatcgatagagaagaaggctaaatccacaaagatccggctgccgttataggacattttgaaaatccgtcatttttacgcccttttcgaaccaaaaattttggcatagcattttttttaaagacaacanaaaannccaaagaacatttgatgtcattcggtaaaacaaaatgctcagaattaggtgacaaaaatctccactaacttttcaaaaaagtagtgaccaaaaatgttcaaaaatagttaggtacatttttttacaaattttttttttaccatggctgaattgacgaactgtcttacatatcatccaaaaaagatggaatgatcgatccgaaacatttgtcgtttccccattttctttcggatctcttcagctgtcactgatgaaattgtttttgtcatttgaattttatggatggtagtgcgttttataaatccgtcagttttggttactgtaacagtaccatttgacgatccagtgaggtcagagcacatgcacaaatattgaaaagtttgattaaaactgagttcagcgtcagggtaaaaaaatgaaaaaagatttttcaattttttgagaatttttagggttttcagtttttttttaatatttttcagagaaagttttttttacaccttccatcgataaaatttataaaaaaatgaatgcatttatacatattttggggatcacaattaaaccaaattatgaaaatacaataaattgacttcgggtattgttcagtaaaaatttttgtgtttcgtattttattttagtttctttttttcgcatttcacattttattttaagtccccatttacattcgccttaacaacataactcgaaaaagaacatataaaaaatctaaattttaatcacccaactttcgaaaaaattaatttttaatttttttagacaattcatttctgaaatattggtccgcaaatgttcggctaactgatcttggattgtgttatattccattaggatatttggcactgttttcttaatttggttaacaactaaaaaaaaattagggtccaaaagttcaatgtttgatatgtattttcaaataaaatggaattttatataaataaattaattggaaaaatggaattttatataaataaattaattggaatttttatctgacaagggaatatatctaattgtgagtgtccaaatcactttaaaaccacttttttcgagtagagcatagtccatttgctattgtaaaatttcggcttttttggtcttggtgacaaaagtgatcagaaaaagtgatcaaaagaaaaaactagcaaaaattcgttaatttaattcgttgtttcaccatttgtcataggttcggatccgctcgacagatgttgaattatttggatttggatttttcttcaaagtataatattgtatctaacttttttanaatttattcattttatggtacttgtagtggatcacgactanaaagagacaaaaaatggcgaaaaaggcactataataggcaccanaaaattgaaaaaagggcatgaaaggcactaaaatcacgaaaaaggcatganaaaagcatttaaattntttaacgcacattttttttcagacgtttaaaagtcacattttttaatcagcataatttcttggaaa

SEQ ID NO: 15848 - DNA, 3179 bp, Heterodera glycines
ctactcgggccattcgcgttcatgtggggctgccggccaagtcgggcgtgtccggcgtgaccattgttgtggtgccaaatctgatgggcattgcgctgtggtcgcccccgttggaccgtatgggcaattcgtgccgcggggtccatttctgcaaaaagttgattgaccgcttcaatttccacaactacgattcgttggcacataacgaatcccaggtgttttttgatttattggtctatatgaatgttaagaaattttcgaaaaattgatatgtaagtgtgctagtgcgtttcttaaaaactgcaaaccccaagttctataactcaaaaaaatttttaaaaatacagtaaaaaaattttttggcaaaatttagagaagactttaaaaaagttaagaatttttatttttttaaattctaatttctagatttttctttagaaaattctaattttctctaagaaaatttttaagtcaaaatttctttcatgaagcttcattaaaaattttacacttttcagtcggggtggtccaccccattttccgtgcaacccgagtaaattgatttaaaaattttcgtcattttttcatataaatttaattgaaaattcttccgcgcaccttgacggcactgctggaataatgccacaataaaatttttcttcaattcttgaaattacttgattttttttattttacagaaatttgacccacgccggcgtgtcggtgagcgcgaaaaaactgcggtggtttcgttgctgtttgcttcaaaggctggcgatttgaacaccatcagaaggtcataaactaattatattgagttagttgatttcgaacaacaaaaactcaaaaataaaatttatagctttttttattttaaatttaaaatcgaattaaattattaattttcaacatttaaatttaaagttcaattgaattgtcagaatgtatttgcaaggctgtgacttggagatggccgactatgacaagcgaactgcgctgcatttggctgcttctgaaggccattttgatgtggcacttttccttttggagaccggcaaagttcaaccagacccaagagatcggtgagtcataatcaaatttaaaaatagtaatggcacaaaacataattatttgttgaagtaaatttaaaaataataaagctcagaaatttgtatttttatgaatctttaaaaattaaaaaaataaatgataataaaattttaaattgtttagtagcttttcaattcaaataaaactttgaatacctgaaattacaaattctaatatcttatttcaaaaatatatgaaatctatgttttccgtgccgaaacctgggcttggattccgtatttgatatgagcctgtttcttggacaaaaatcctggaaaatttaagccggacaaaattaaatttaaaaaaaaagaaaacttttgactcaaacagttggaatcggactcctcttgacgatgcccgttcggaacatcacacatcggtggcactgatgctggagcgacgaatgcaagacattacacagacaaacaatttgccggccaacaaaccattgcagagccgaacagtttcattgcatgggttacaggtgggataaagccgagagtgggcggggtggggatatccggtcaaaacggggaaagcgggaaataacgaaaaaatttaaaatcgctgatcacaacatgagtcaaaacctacaacccagggacgatcccaggattacggattggttggcatgccatccctcgccccccgtgcctggaactacgaattttcttctttttttttgttgttgttgcttttcatacaactttttgcggcgagttttcgaaaaaatttttatggcttttcctctgtttttaacaaatttttacccaaaagtatttagtatttccgttctactaatcggaaacggtttttccaggctgtcagcaaaagtaggccaccagttgtctttgggttgggatcgccgccagcaatcagcagtggccaaatgtccgtctcatcgccaatggtgccaacaatgccgacgcatcatgtccaatctggtagtggcgctgtaatgaattaaaattgacaagtcattcccaactcatcaacatccaaatccaattctgaaataactatatacataaatccaattataatgatcagactttcaaaaaatttccaaaatgaaccctaaatacaaaaagaatgaattttttaattataatttctttgtaaaattgaaataaaaaataaagaatacatcccgaaaaccgactttttcatttttattaattcactatttaaaaaaaaatttcaaaaattctgacaaaaattaatttttgaaaattacggattacgcattacgggaagttacggcttttttggacaccctccccccataattactgattacggatttccataactgaaaaaatcgccgtaattacggattactgatttccgtaattgaaaatctagttgcgtgcagccctgatagctatcatttggcgaagccacaaaagctccagcctaggtccgactgttcaggcacccgctacttattgaattacataaaaaaatttcccaatagaacaaattatattcttccacgtctttctgatcgcttttgtgcttcctggctttgtgatgccacgctttttgtgggcggtgatgcgcaacagacggcacaatttgcttgtctggtggatttgttggataacgctgcacaatgcgcatgcgatgatgggattgctcacatacattctcaacttgaccgtaattttcgagattttcagtcgtgccaactaccaaaaacattacatgaaccgcaatttcaaaaacaattaccttttataataaaaaaggctccggcaatttggacatcagaaaattagacactattggatataataaaaatttttttgctaaatatagcctaagcttaagcctatgcctaagcccaagcaagcctaagcctgagccaaagcttaggcttagtctaagccattgtacgggttgcttttgtacgattgtcatgacatcgttttataagcgtaatttggtgtccagttttccgccggtgtccaaattttctttggtgtccaatattccggtgtccaatttaccgccggtccggggggcatgctaggtcccgctctccaaaatttaaaaatagtcaa

SEQ ID NO: 15849 - DNA, 1513 bp, Heterodera glycines
attgcattcgtcggcatccagtgaatgccttctgctgagggagaagcttggcggtgtgccaccgccggtgcgccaaagtccgttgtgccattgcaacttcagtgccaatgccaaacagcaacatttacaacgcgcggactcggctacaatgttctcttgtttgtcatcggctgttaagcaatctacatgcagcgtggtaacatgaaaaaaatagtgtttataatcaagggcgtagcacaaacccttggcttcgggggggggggcggggcgggggctgaaaattagattttaagggttatttttctttttttagaaatctcgaattaggaagtgttttccgatgaatttgtagtcgtttttcgccaaaaaattactagttatttgctattttggtctccatttttcaaaaatatggtaaattggaggtccggtggtgcctttatgcgtcgcctgaattttttttttgaaaattttaatgaaattgttaagaaattgcttaaaatttgttaaaaaaattctcaggctgcgtctatcggcacccaccgtattcaaaaattcattgaaattttccaaaaatttgacccaaaatgctaaaagtggccattttttggcaaaaaaaaacaaacgatgtttgcattcccatttctgatttttttttttttgcttatgggcctgatttgtctgggcatttgccatcaaagcctgtccctagtaaaaactaagtcacaaattctgccaaaataaaaaaattcaaaaaacagcaacaaaatgatcatggttgcggcggcggatcattgcgcaaattgtcctgctccacgcctattgttggtggacatcattatgggcaaggtcatcatcgaagccgaaaaattggcaaattttgatttcaaatttttataaaatatttataaagtctttactttttgtttgaatatcgtactcgtgccaactcttaccgtataccaaaaattacttctaacttttagctggattaatataatttttaaaattaagtaaataatttattctttatctattaactttcaatcaaatataaaatgaaaatattattttgaaatttcgcggtgtccacaattcttcccatataccacaacaggtcagcagcaccagcataattatggtattcaaaacggcaacagtaacaataacaacaacaggacggagcagtataacaacggcaacattgacaagcatcatcacaacaacaataacagttgcaacaacaatcaattaactgggcaagggcatgatcaaagtcatgccgaaacgcaggaaggtaatttatggcacagataaagtaatggtcagcacgggaattttctgaaattttgcagaaaaattcctttgaatttatgcaactaaaataattttataaaatgtttataaatcaccataaaaaatccaaaaatttaatttaccgtaacgcaggggcgtatctagaaaaatttttcggggggggggggggacccgacctgaagaggacttttttttt

SEQ ID NO: 15850 - DNA, 3031 bp, Heterodera glycines
tggccttaaccttcactttttctatttctttgttttttaataataaaataaattatttaaattattttcctttttattttgtttttgccttttgcccattgaaacggagtgaataatgcaaaagaagtcaaaaaactttggccaaattcaatttttttttttgctttcctttggcccaccatcaataatttcctcctcccccgccgccgtcgcccattcattgcgtcgcggtcattcggcggaatttggcgggagagattgaaaaatgcggcgaattgaaaaggcaaattttatataattttacaatttgaagattaggtttgatgcagtttgtttaaattacgattaggatgaacaagcaaatctgccccttttctcatcctttcgtttcgatttttcgtttcatttgtcctcaatttgcccccccccccctttttttacgccccatttatccgtcggggaaaattacggaaagtatgacagtcttcgcagaacaaacaacaaatacaaaaattctgagaaatagatggacaaaaggaagcacacacagttagcaatttgtcctttgccttttcgcctttgaaaatgccaaagaatggcgctgccaattggccaaaagttggcaaccgacaaaaatggcacgtgtcatcagcgacaaaagcacctggcgacggacgacggaaccgtggaaagctttgacgcaacaaaacggaaccccaaaagcacgagttcgtctcgcaatttaatagccattagcataaatagattggaagacaaaatttgatcctaaaagcattgcctagtaagccgagattcgcgaaaaatgggcgaaaaaggaaaatattacgaatctgataaagcattctgggttttcgaatctattgaaataaaagcaaaatgaaagtcatggccagcattccgacaaattatgccacaaaaataaaatttgaaattttcttcttccattttttacaaagaatttcaaaaattttctattggtttcctcacaattaagaaaagttacggttataagcagatgagttttatcagcagctgatcaaataccaaaaccaaattagtcaactccatgaaaaatcataaatgtttaattatgaaaacaataaaaaattatatgtttttaattcgcaatgtttttgatcatagcccccaaacgaaaattaaatcggcaagagataatttctcaattttttattcttttttattttgtacaagtagcaaaagcgaagaaatgaatgaatgaatgaatgactttacaatttgtcatccgttcttcgtccgttcattcgttgggcgcgaggacataaaaggcgaatgatttgtcatttgtaattaattagcaaaaattacctaataaattaaataataattgccaatcatttttctggtgtttttattttttatttaaactttgaaaaaaggttttctttttcgcaaattgatgaaatgataataaaacgagtttatttttgtgctcatttatttcctttttattttattgcaaaattaaaatattattctttgggcatataaataaataaagaagttggaaagaaattatcattttgcatttgtatcactttatttggagaagaatatggttaatttattgaggctttttttacgtgtaataaaatttaaaaaattaaaaaacgcatatatttaacaaatttaccattcattgcttatcaccgtaatttcgaaatgaattgaccttttgaatttattaattaataattaatgttataaggcaccactaattttaaatctattcttaaaatggtgaatttttttgttatttttgtgccgtttttgttgttgattgtgtcaaatcagttgaaagccgaagaaacggaagaaaatcgacataaaacggaggaaacatggaattatgaggagcccgaagaatggggaggaaagtgccaaaagggcgacagacaatcgccaattgacattcacaaacaatgggtaattaattaattaattgaataagagatagcatgggtggcaaattattacttattaattaaataatatgatttatttttataattagtcgtgttaattaattatttaattttatgccttccttttcagttcattgattataaaattccggcaatttcatttgcaaattacgaaaaaaatggaactgtgacaatgaaaaacaacggtcatacgggtaaagaaagagctgaaattacggactgggacactatagtctgagccaagtttagaacatcataacttttttatttgctgaccaaatccaataagcttggtatcattcgattgatcttaacaagctctattggttttccaaaaaatacaaagatataccgacatataaaaaagttataagcaaaaatatgcaaaaaatctgaatttttggtagtattcatgtttcaacttttttagaagctgttcaatcgcttagaaatagcttatcaaaagcttctaaacatgtaaagctttcgaatgaagctaaatttataaaatttggccagctgagaaaaaattttgatgctttaaacttagctcagactataccggcctatagtgtcccccacccctgaaattaacataattagtataataaaaacataaacaacttaaatttacagtggtcgtaagcggatttgacacttgggaaaagcagccgaacatcgccgacggaggctttgggagcaaatacatgttgagccaattccattttcattggtctcaaaacgagaacggaagtgaacatacggtggacggagaacattatgacgcggaggtactgtagagagagagagagagagagagagagagaagaaatagagagagaaagaaagaggagaaatagagagagagagagaaagagaagaaatagagagagagagagaaagagaagaaatagagagagagagagagaaagagaagaaatagagagagagagagagagagaaagagaagaaatatagagagagagagaaagagaaagagaagaaatagagagagagagagagag

SEQ ID NO: 15851 - DNA, 1388 bp, Heterodera glycines
cctcccctcctctcccctctcctcctttccctttgcccccttttccctccctctctcccttttcccctccctctctcccttttcccctccctctctcccttttcccctccctctctcccttttcccctccctctctcccttttcccctccctctctcccttttcccctccctctctcccttttcccctccctctctcccttttcccctccctctctcccttttcctctccctttctcgaccctttcccctcccctcctcttcttcaggtggtcatttacgccccggcaatttctttgaccggtgtcacttcggtgcgactttggcccttcgttcttctcgtcggcgtcggttccacaatttatacggctgccgggggaattcgggcggttatttggacggacactttgcaggccggattcatctacggagggttagccgttatcattgtgcgcggcacggcacaagctggcggattgacaaatgttttggcgattaatcagcggacggggcgactttggtccgcatttcgtgtgcacccgtcactgctgcaggtgctcttaaacattctcatcgcattccctgtcggtcctttgatgcccttttgatcagtacaacaacctgtgggtggcaatgtttggtggcattttgcaatggacgtgcatttacgggctcaatcagatggccatgcaaaggtgcggtcggcaattgccacttgcgcttcttcgacttctttctcgcacctgcaggtactgctccatgccgtcccttcgccatgcccgcgtcgtcctctctctgaccatgccggccaacttgctgatccaattgatgatcggctacatcggcctgctaatggccgcttactttgaccagtgcaatccgcttgcgctgggcgaagttgaaacggtggaccaagtgaccattctgatggcttcgcgcattttcggtctcccaaaatgctgcaaattccacctcccccctctccaccatttcagaaggagtgcccgggttgccaggactgtttttggccaccattttcaggtgcccgccattcattcccatttactttctctcaaattgtgccattcagcgcgactttgtccaccgcaagttccggcatcaattcccttacagctgttttatgggaagactttctcaaagtgccgttaaaagatctgtcggatgcccacaaaagttgcgcaatgaaaggcatttcggtccctttgtccttttggctttgctcactttttgcttggctttgaaggtctttttcggggctttggccacagtgatggcttttgcttgctccaatctcggtggcattttcaacgtcgttctcacaatcctcggtcctttttgataatttgcgttcaacgtgccatttgtccgc

SEQ ID NO: 15852 - DNA, 840 bp, Heterodera glycines
gcatggggggaaattgggtgggaatgagcagaggtaattggaagttgtggtggcaaattttgtaaatggggcgcataaactgtaataattttgttggtttaatcataagcatgccaaatgccaactcgtgccattgtttcccgttcagtgccctttttatgtccactttcggtgcccaatttcacttcggcacttccaacagttccgtcttttccaaactgtctcccttctgctattccagcttgggtatggtttctctccttttctgcttttctatttccccctcttccctaaggcgttttgcttgtcattttcatcggattgccaattagctgtgtctttaggcaacggcaaagtcaagcacagaaaaagtccgacttagtttcaatatttatacttcaaattttgttctttttcaggctgacttttgcctgcacttattttggcttggaaaaaccaatcgaaagaaagcaaagttttggcgaagagattggccaaatggaattacaaaagcaggagcaaagtttaagcttaatgttagcggaggaagcgcagcacggacagagagcaacagaagaaggggaacagataatgagcagaaggaaaagcaacaaattggagacgtacagagcgacggaagagaaacacaaagtgacagacaaacaaattggtgatgctcgagactaacctcggcccaatcgcgagaaagtctcgagttttttgtgcctcgctgaaatgatttgcctgatatatattaatgatgaaagtcacagtacaaacactttcgaatctttttgatcagcataaaaagtcataagaatttttttcgatcaacagtga

SEQ ID NO: 15853 - DNA, 933 bp, Heterodera glycines
gcacttaccaaagaaataaaattaggctaatttttaacctccttatgcttatattttttttgccaattcagaaaattgcaaatgaaaaataagaatataaaatttgatttatgctcttaatatttacaacaaatcaattaatgaaaaaggcatgtgccatcgaatggaaaatcagcggggaaaatgaaatgacattttggcatttgcttaaacagcaggggaatgaatgatgaaataaatatggtcgatgcgattgcgaggagtgatttaaatattccaaattccccccaaatgtcggcccctttcatcgtcgttttctgctaatgttggcactcattcgccaattcaattcattcgttcgttttccttctcttcgctttggccctttctttcgttgcgcggagaaatgcctaaaaattgggggggggggaattttatgacttttcaaatccaacttcacttcttctcaaatgcatccattcattcatcgatttgcgcgtcctttctttcatccatttcttattaattcaattattattttttcaaatgaaattcaatcccaaaaaacggcaaatgtaaaaaagaaaaagaaaaagccatcctttgctccctttaaaaaattaacaaacaaaaaattataaaatatttctgaatttttatttgaatgtcgtcattatattaaatgcattctttcaatgacgacattttatttttaaaaaatcataaagaaaaggcacaaaatttttggcaattaatgccaacattttgctggcgggtgcaaaagtcgcaattggcattcaccgcgtgccttagtcgcattggccaacaccaaagtcactggtgaaagcgaattgcaacggcaccccaattttggagaagaagggcaattgttcatttgagaggaattcgacgaatggtcacaaaaatgggaaa

SEQ ID NO: 15854 - DNA, 2129 bp, Heterodera glycines
tttcaatccctttaattttttgagcactttgaaattttcatccaccaaaaaaaacagtttctattaaatattcaagataatgggcaaaaatatggccggaatttctgaaaatttatactcatagaatataagaccaaagacagtcctcgtatttgtacattgcttatggtttttttaaaataattttatctcatataatattacaatttctaaccagttctgtgttgttaggcaccttttggcatgcatctaacatatctattcttatcatagatctgattcatcatagtcaagtagatcaaatggccctttaaattgttatcactcaatataatatggagaaaatagactcattcagccaaaactgtggcatacggtctgcataatacaatttttgtacagtatgtactcaaatggtcaatgattaaccctttagactcagtcttaagaaaataaatcattttatttagagaaattttcagattgatcttctatttatagaaaagctttactattatcattgtcgcagaaaacttcacttattacagaaaatcaatactccttttggttttcagtacacatacatcatataattcgatttttgtaagtatactatcaatacatcaatctacattgttttgcacattttctttcagaggtgggggggggggcatttgtcgagaagggcagaaaaggaaggggaacattttcaacagagggcaacgcccgccgaattagagcgagcattttgagggtcagacgaaacggagggaagggaagatccgtcggaaagtgccggatgggccctaatggaaatttagtgccgaggaagaagaagcagcatcagaaaagtaaagcccgccgacagccgaccgagcggagaggcattagcgagcggcggagcggagcattgaaaagccgcaacggacggacgacggtagggaagaacaaactcaatttttgtggagtcggcggagccgagttgcttcacaggccgtgccggcgcctttgaagagaattttccgcataatcgatacattttggtgggcttgtggaaggaaaacatttgggaagagtgggaatggggggaggaggaatggcggtggcatttatagagaggaagtggcgcggagcaacgaatggctagtgggagcatttaggaatggggcgggaatggagggagggcacgggtggcatggcatggaagggccggccggtcgtggactgcttgcttcatccccacagctgcggcccacttcgctgcagaccaagacaagaagaggggaagaatggaattgaacagaatgagccaagggcgggagcagaggacggagtcgagagcgcagctgccaccccgcgacgattgggacggacggttgctacgccgacgaatggcacagaaaattgccgaagaaagggtagggcaaatgagagaagaaagaggccgggagggaggaaggcatgaccaaaaaaggaaaaagagaagggacagagaaggaagagggagaagagggaacgcatggaacggagaggcagagacatcgcgaatatgaaaacgtgagagttaagtgggaagaagtgggaggagtagcagagggagagagggttggcccaaggccccgtctaggaaggcactcaatgccgaggaatggcacaaacaagcacccctccccttcccctccttctccaacccccgcctcttctgttttctttccgccttcccccccccgtccgtcctcatttgtgtgtcgggaaagagtcggccaacactggatttaaggtggagcataacaggagccgatgcccccgctatagcagctccctcaaccacaaatggactactgactgagttagttgggagggaaaagagtctgaggagcggggcgggaggagaaagaggcgggggaagggaaaagaagggggaaggagaggagagggagcccctgaggcggaaagggcctttgcccgtccagcaatttcctcccccccccccccccacaatgtccgtccctcgccatgcatttgttttcttctcccgtgcatcccacccacccgtccatcgatggaaagaagtgtttgaattgtatgaatagggaactctaccacagcatcaaaggaatggggaagga

SEQ ID NO: 15855 - DNA, 2492 bp, Heterodera glycines
  misc_feature (2478)..(2478): n is a, c, g, or t
acataacaataaattgttttttctttacgaatttaatttcaatatgttaattttccttttctacatatttctcatgtcattaagtacaacaaatttgttgtcagctttggtgttatgtattaatcattattcaaattaaaatttgactctttttaaatccacaaacatcaaccaattcccaaattgctgttgaccatttcttctcatccatttctgagccaattgaaaataaataaaaatattattttttgatactcaacaaatattcagtgattagagagaggatcaaaagaactgacgaaagattctctcctcaaaaacttttcaagtgcatttttcaattttaaatacaaaaaataaaataatgcacaaatcaatggctaaattatttaaattcaaattaataaatggccaattaattcctctaacaaatcaatttttattttattgcctcaataacaattaaaatattaatttgttttttaatttatttttgggaaattattttacagacaaacatattattattctatgattgttttccttcttatgttccccaattgggtgcatttttcctctgttttggcgctttacatattattatttttcgtccgtccgtcccctccatttatattttatgtatgcattaattattttcctcatcccccgtgtcacgcgacaaaaaatttttgggaggggtcaacaacaaaacacgttttgttattttggcgcactttgggggataaataactccaaaaggtatgtctaataggtgaataataattgttggattgttagagaggggaggagagactgagacagacggacagacggcagagaaacacagaaacatagaaagtgttgaacaagacattcacagtggcaattgaatagtgtgtgaaaaggaaaaggcaacagacggtcagagcaaagctatgatagagagagagactaggcgaaactgagatggacagaaaagagggggcacagagagtgtgccgaactgaaaagcggcagaagaagcaaaggcatggggagcagcggctggtggcataattggacggacggcgaaatgaattttgttccccgttcgccccgttttcccctcgggggcagtcgcccccggcgcggcgacagacggacggacggagggagagggagggacgtgtttttcgagcgccgagacaaaaagtgtgtgtaaacaagttcccctccctccccccccccccctgtgcttccatcggctgattgatgaattttcgtttttgttaccgccaaattccttttttttcatctttttacgcagggtattgtttttctgccccatctacaagcggataccgtacctgtcttttttataaatgaataccgtattctttgaatatcgtattttcccttctacatacaaataccgaaacaaagctcactgtcatatgcaattatcgtattctccctattaatgcgagtacagtaatgtccttctgtgtgctgcggataccgtcctccttccccctttctgtcaatgttgcgcccataaccgtgttctctccccatactgcgtttctttaggtgcaaataccgtacccttccctccctctcgccgccggtcccacctgctgccgataattcggtaattaacttcgtttcgcttctcccccccactttgcctttgctgcttctgctcattgtcagtgtttgcacacttttggcgcgtgcgttttgcgccttaagcaattgtcagtcaaagccaaacaatgaatgagtgaggggcacggcaaaagcttcgctctgtgccgtccattccattcatttgtttgtttgtatttgttgtgcattccctcaggctaaatattgtaattattgctaatggcaacatcataatcatcatcaaaatcatcattatggcatttgcattaactgttttgctgggcttcttcaaccaaaaaaaaactcagaaaaaaagaatttgctcatttttaaaaccttttaaaaattaaatctttgaaagatattattattattatttttttgcttattttataagcatttgggcaaaactttcgtcgacaactgacggacaaagacaaatgacacattcaattttctgaaaaaaaacatttccttcttttctattgcttttgagcagcacattcactcacaacaagaacagaagaaaaccccacaatgaaattaatttttaaaaatattattaaaatgaaatgaaaaacacttcatttgtttgctttgcttggcattcaccccgattcatcctttttcactattcttttttgcggtttttgatcaattttgggctccgttactttttgaaataatttggataactttgctcaaaaataacaagtcttaaacttatctggaatttgcttacaattttcaaaatcatcgttcggtttaaaaaaggctaatttattgtcactttggtcacagctttttttgatgattttttaaatgccaaanggttgtaaatttaa

SEQ ID NO: 15856 - DNA, 2529 bp, Heterodera glycines
cggtcgattgtttcggttttttaattatttcggtcgaacggtttcggttaaaaaaccgaaaccgaaaaaaaccgaaaaactcaaaaatttctcggtcggtttttttggttaaaaaccgaaatcgaaaatcgaaaaataccgaaaaaaccgaaaaaaaccgaccggtccgatctctactaaaaatgttttaattttcaatttttccaatttttctaaggcattcatctggtgccatacccggcacaatttgctgtcccattgtttcccgatgctgtgaagaagcaatgcttgaaggaattgaaacagcgatatgaaaatgtggaaaaataaaaaataaaatttatttttattttttaaattaaaatttttcagaaagaaattaaaagtccgccggaaaattttgaagaatgggttctgcaccattttggaccccaaattttggatgtgttcttcaatccgtactccaaaaaagtgtggacagtgaaaccgtcgaaaatgtaaaaaaaaaatggggcaaaataattttaaagaattttttttttattttaggtctccaatttgggttggcactcgggtggcaaaattgccacaagaaaagctggaggaactgtgctcaatggatgccaatgtgttgaaaaatgccgattttggatggggcccaaatgcacaatttaatgtaaataaaataaaataaaatttagaatttaaatttaaattttgtaaaattaagttcccaaaatacggtggcaccggcgccgtgtggaaaaatatgacggagaaattgccatcggaatggttcaaatataattcaaaggtgggctgttttaataaatttatgtatatactatgaaaattttcgtaaaattagtgacaaaattcagaaaattttcattttttgcgcatcgcaaaacgaaaattttcttggaaatctattaaaaattttcattatgaatagcaaaaaaaaaaaaacatcacccggattggtagagagttaatattttcgaaaataggatggttttttctattttttatccagaaaatcacggggttggacaaaaattttagtaaaaaaacgggatttgaatcggggctgaacgtaattacggattatggaaattacggcgtttttggatccctgtgatgacggattatggattaccgtaattgaaaatccagttacgcccagccccaggtaaactcggcactttacatttggccaacattttgtggccaacttcttccggaacttccaaaaactcggattttgtgattggctttctcggcgccattttccctaattttgcttttttccaattaaattttaatttttaaatttaaatttttttaggtccttcgcgttgaccatcgccaaaagtgtgtgcattacgtccaactgaatgccaatggtcagccgacgggcccaacaaagtcactgaaatacgacgcactgatcaactccagtcccatcgacgcgttcgtggcggacaacaaaatttgcgagatgccgttgttggagcacaacaaagtggggggtgggggggggagtaattagttggactgctcgagattctcgatcaccgttttaaattcatatatttctatgggggggggataattaatggtaattaccaggactgctcgagattctcggtcgcggttcgacgaaaaaattcataaaaacgctaaaaagccataaaaaattcgcacgcaactttttgcatccttctatttcagtcccaatggtatagaaatttcagtaccgctctctaagattgattatttttcggaatttcttcgctgaaatttaaattttgccttagaaagggcttggattcaattagttcggagtaattaatgtgtctaaaattttttaggtttttgttattggcgtcggattgaaactgccaatgactgagttttgcgaggtaccctaaaaaattaattgaaattttgaaaaattcaaatgtctttaagaaatacacttggctctactttcctgaccctgacgtgccgttctatcgtgtcacatttttttcacggtaaaatttgccgttttcagacaaaatcagaaccccgccgggaactctctaaaattttgaaaaatccgaaaattttttgaaaatccatgggtttttccacatttaggtatggtgaagtaactccggacaacaccaaattttggtccgttttgtgcgaatgcgcacggcccagcgatgacacggtaattatcaatcaattaattaatgaaacagtaaaatcaatcaattaattaattaatgacacggaattaatttaattgatgacacggtaattaattaagtgattaattaattaatcgactgattttttaagcaaattttttaattaaattgtgcggatttttaagatgaccgaggccgaaattcgccaatgggccatcgagggtctgatcaccaaatcgatcattaaaggtgagcaaatcatcaatgaatattccatctgttccccaaagggctatccgattccgacggttgaggtggaaaatttaaa

SEQ ID NO: 15857 - DNA, 1959 bp, Heterodera glycines
ttttgtaatttttttttcttatattagttgaatttctgttgacatcaataagtgtgcttagagttgcttttgcacttctcttttatatgcaaccacgcgaaaacgaccctcacgcgaaaacggccacgcgaaaacggccacgcgaaaacgtcctggcccgcccaaacgcgtgagtcccagttgacccatagtgagcattaagcataaaacaaaatgccaactatgtacataaattttaaaattttagtggagaataatttgctttgccaatttttttggattccttcaaatttggaaaagggttcggaattgattgaaagtattatccgcgaaaaattgttacatttcaagaaaaaaattatgaaaatttcgctcaatttggaaaattttaatgcattttttgagtataattggaagcatataaacattaaaaaaaagtgctaaacagttaaatctaaaaaattaatgctcaaaatcctttatttttctcaaaaaaatattttaatcgacgatcaattcaccgaagatactttaattaaaacagtgcaagagcattgattggaaacgcgataacaaacgaatactcaattcacaaccatcttaatgtttgtccacgtgaaagataaaagatacaaaggaaaaatggttccaccataaaaggctatctatttaagtctacgtggccatacattttctcataatttaaatatttaaaagctttttaatttctaaataaacttattcttgaatatactcgagaaaggatagaattcttgtttcctcattatatataatttctttaatgccagtttgcatgatttgacacctaatatgcatttttttttaatatagtcgcgctacaaaattacatttttagattggttttttttaattgaatcaacaaaatgtctaccgaccgatatgatattgtgttgtacggtgcttcaggctttaccggccaacatgttcttgaatcattcgtaaagaatggtcatttggaccaatttaatttcgccgtcgcgggaagaagtgagaaaaaactcaaacaaacactcgaagacatcgaattcatcactggtctggtgcaaaataaaaaatcatagacatacataaaaggaatttaacaaaataattcagggaaagttttgaccaaaattccaattatcatcgccgattcgtccgatgctcagcagctcgcagaaatggccaaacaagccaaagttattgtcaatgttgttggaccataccggttgtatggtgaagcggtggtaaaagctgcggttgaaaatggtgcaagtcatgtcgacatttccggcgaaccagccgtttgttttccaccatacaaaaaataataattgcttctcatactcatatttcactctcacttcagtggattgaagcgatgcaaatgaaatattcggagaaggcaaaagagcagggcgttttcattgtcagtgcctgcgggtgggactctgtaccgtgcgacttgggaatgaattatttgaagcagtacttcaaaggcactctttcgcatgccgaaacatttgctcatattcaaatcggggaagcggtaagcccaaaatgaaaaaaacaaatatgcatttttagtcattttcagggctattccttcaacgccggcacttaccaaacattgattttgggcctttggcaggccaaaaatgatggtcttggaaagatacgacggtcgattatgcccgagaaaatggagaaaactaagtggagacctccaaaaaggtacaggcacttactaatcccaacaatttaaatgctttttctagaggaatgttttggtggaacgattcattggacgcttattgccttcctttcatgggtgcggacaaaagcattgtgcaacgatcgcaatatttcgataacattgccgacaaaacataccctgtccgtaaagcctttcggtttttcattctttagtgcgttttt

SEQ ID NO: 15858 - DNA, 2284 bp, Heterodera glycines
aaaaaagctaaaaatgggaaatagttatgcgtctgaccactggttatggatgagaatgctcaaaaaaagggaaagagaggaagagaaaatagtattaaaacgaaaataaataaataaaatatcagcgaaataaatcattaagcacaaaaaatttaaaaagtttggggaagcctaaaataaaggacaatctttaaaaaaaggacattttaacttttaaagatccggcccctccaaaaaaggacaaatctttaaaaaaagaacacttggcagccctgcatttattgcattttgatttttccaattatttctgttttacagatgtgctacaaatcattcccgttttggttgccgaattggaagaaatgcttgaaaatggcaattggaattacacaaatttaagccatttaaaaatggtggaatggaaaatgctggaatttgcacttcacaaaaggggggaaagccaaaaatggaaagaaattcaaaagctgtggaataaatggagacgaaaatttatcagaaaatttaaaaatgcaaacaaaatgccaaatttcaaaaaagtaatggaagagttgaaggacaaaatggaacaattgagagcggaaaaggaagcggaatgatgaaaaaaaaggaggaatatgttctttgtatattggcatttgttggttagaatttcgttctaatttatctaactgttgaaaaagattaataattgaaaaacaaaaatcaaaaaaatacttttgcactactcaaaattatcagatttgtgataagaaaattaccaaaaattttttggttttacaattcgtatctgacaaatgagtgtcaattttattggttcgagttttatataaataatcaatttaaattatcttatggctaacaattaatttaaaaatatatattcgatgtttgagtctatgcgccgtacaaaccgtacaaaggcgcgccgccgggaaaattttttgcctagatttgataaattttgcccccaaaaacacttttttaaaaagaatattaaatttattattattatattcaacaaataaagggaaaacataaagtagataataggctgaaaaagggcaaatatttcaaatcggattgaaaatttctcagattgggcccatccaaataaggacaacgcaacggcaattcacttctgctgaccacttgggactggcgttgtgtccaccaaactaacgagaaaaaaaaacgaaagtgattggatagataagtaagtagtgattagtagggatgatattcttagctgctaaaaactgctaaaatagttagtttttaggttcttaaaaaccccccaaaataggtgctaaaaattggaaaaatatgtgccaaaaagttccgaatttagggggggggggtgtaaaaccaaatttatattcaaaaagcaaaaatattatgtcaaattattgagaagcacaatttttaaaatcaactcttcaataaaataaataaatagattttggagttgaatttttgagaaattttttaggttaggttctaaaaaataaaacccgtagcttaacaacaaccgaaaaaaaatgtttttcgtgcttttcaggtcactgggaattctggaaaaataggaaaaaccaaaaaagcgtatccctagcgattagtaccaaccatgcactgatgtagtgatcaaatgtatcatcttcatcactttctgacaaattaatatggctccactgatcatcaaatcgccaaacaatcgcttccttttcccacttggcccatttgtgctcatctcgcgaaattggacaacgaatcagcaaaaagctacgcttatcactagggagcggattagtaatcaaaaatgttttttaaagatatttttctcaaaatttaaaaagagagaacattatgtatgaacaaatgattaagtcttctcaaactcttttaaaaccagagttcggaatttttttttcttcaaaataagacaaaatgactgaaaaaatttacgttaaaaatcacgaaaggatggctgaattatattaaaaaaaacaatttagaagaaaaaattacaaatgaaatctaaaattttgaaatttaaattttattttttgggtttttggcctaatgcggtcccaccgaacccaaatgattgataatgtaagattaataacatactcatcataaatctgtttcagtgtcaatcgctccccagttgaattgttgaacaattcaaaggtcggaataccaacccgaacactccaaaaagaaaagcgaaagcgaatgtaaacgatgaaattggcacgagaaa

SEQ ID NO: 15859 - DNA, 661 bp, Heterodera glycines
caaaaaagaaaatatctgaaaaagaatgaaacaaaattatgccgaaattggtaagaaagtcggagttagccatagaacaatgaaaaatgggaagaaacaatttgaattagcagtaaatagacggagaaagaaaaaatggagaaaattaaaatttattggcaaataaaaagagaaaatccaaaaatgagtgacaaagaaattgcgaaaactgtgaacacttctcatcagaatatttttaattggaagaaacaatttggagaagaaatggttcagagaacaactgaagaagaagcgtgaagtgccttgtgcttttcaatttgaaaatatttttttggatatctttttcaatttagtttcagtatttactgaattagtaacccccgtggttctaattcagtaaaaacggtatttgggctgggattttttatgccataaaaatgaccttttttggcattttatattttctttaccattattttaattgaatttaattaataaaaaatattttaatatattttttttttcatttttaattgcataaaaacccataaattaaccaaaatttggtcattttttgacaaattctgttatcaaatctcgctcaaaatttcaaaatttttccggcggcgcctatcgtcaccgccggaccccgggtcccgga

SEQ ID NO: 15860 - DNA, 1622 bp, Heterodera glycines
  misc_feature (1604)..(1604): n is a, c, g, or t
ttaaatcatatttattttttgatgaatttttgagatttttataggagtgcaatttgcttatttgactgacaaaataactgagtattatataaattgtttttcgagactgaattttattatcaatccattatttctgagaaagttttttttttctatttttactttatttttaaaataaataaaattttgtgtccaattttcaggcccaattttggtgtgataattaatgtcgaatatcgactcgacaaaatctcgagtttctttttggtattggactcaattctcgggaaactttcggtctcgagcagcactaataataataatgtccactgtgtaatgaacaattaaatgagagtgactgacctccgcttatcatttgttgctattcatctctcaattaactaattaattaccttaattacccttacacaattgccaaggtcacttctctttcttgctaggtgagcaaaagttttggagcaattactacaaaacattaaacagttgttgctctatctgcagaatatatttttaaatggcttgaaaaatatgtataatataaaaatttaataaaaataaataaaaggattttaaattcattttccaaattattcattcacaataaataaaataaaaaagttattatttatccataaaaatcataaaatagtttatttttaagttttttttaaattatatatttttgccttataaattaatggaaagaaatattttttgaatttaaataaaatttccttttttccgttttaatttaatgctttaagtcacttgttcaaaaaatgcccaagttatttttactaattatatttttaaatgcccaaattcctcccccccccctttccttttccaaattttcgccctttccttttccaaatttcgttgcgctttctcttttccatcagggattcctcttcttctctgttttttcacaagcctcccatccattcgtcttgcgcactgactctgaccagcccccccccaaataacaacaatttctcatcgattctttccgtccatcgttatcgccgcaactgggtcttttagttggcgtcgcaactgcctccaccagtcgccccccccctaagtaacagcaatttttcattgattcttttccgcccatcgccgttatttccgcaactttggatggcgttgaatttgaaaaaaattattcattcgttttatgcgattaaagattttaccaaatttaatatttaattcttttaatttttttacttatattcaaataaaatttaaatcccgaatcccataataaaaattaggaatattttctgtcatgtggtcctttttcaaaattatttaatttttttcattcagtatttacaaatgattgaaataattattctttatgtaatattttattcaatcatcatgcggctttgccaccgaatcactgcaaagaaaactactttcatccaaatcttcgtcaagactcttgggggaatgacgctgactatttttgcccattcctttgacaccatcgagaatgtgaaggcgaagatccaggacaaggaagacatcccaccggaccaacagcgtatcatcttctctggtaattcttccgntttgttaaacttttctta

SEQ ID NO: 15861 - DNA, 3015 bp, Heterodera glycines
tcgtaattaatgcatattcagaggctttttacaatccacgttaattggcattctgtccctcccaccttttctgtctctgttcctccgattcctctgcgtccctgtccgactcgtttagttttctctggttcttgtccacgccgtcactttcgtcgtcgccgtccgacccctcgtcatccgacaaatagccatgggcgacgaagaagccgtcattctcctcatcgtccatcacatcgtcgtctctctaaattgtgccggggaaggagttggactgttctccggccccccccatccgtccatttcggcacctcaatctcttcgtccgatttgcattcgtccgcatcttccggctcctcctcccattcttcgtccgagttctcctcatagttcagcgtctgccaaaataaaatgcagaaacatttcacaaattgtgggccaccttttctcggccaaacggtcgacggccggtgatttgggcactccgacgccgccaagtgccccaatagggcggccgataattgtcgtgaaaatgataatactttggcttttgcgcatcagtgtttgtcgcggtgtgtttttggcgcttcgttttgcaacgcgccaaaaagtcagaggccttaaaaaagggggaaaagtaaacaaattgaaagacacaattcgaaattgtatgcgtaatgaccatattttcagtcttccacctcatttgcagcgctgcggagaaaattgtggtattccgtctcatttaggggctaaaatttctcagaataaattatgtaaaattcaaaaaaaaatgtgtttttccaccgacccttcgcattagcaccggcgcaattcgcatgccctccttcagttgaaagggtcgaaagcgcgtgttcaaaatgctgggcggcacagtgggcggtggcgccggtttgtccactcggtggaaaaacgtactgatgacggattgacgaggacgcttcacactgtcggcattctcctaaaaacaagcacatgcaatagttttggtaaccatttatggtcatttttcgttgcaaaactttttccgaaggttcctccggcaactccaatgccaattgcttcgtcgattctttccgttttggcgttcttgtcggagtttgagttggcgttgtttttggtgttttcggtgtctttggggtacccttcaccatttgatgtaatttttaagcaaaaattattaatattgatagaaaaatgggctgaaaataaagtgtttaatcggattataaattaagaaggtgagttaaagcctgggaagagaagcgcaaacaaaggcaaggcttaaaaatagacgcaggcatcaatttttggcgccaaaatcatttaggcataagctgaaagtgggtcaaataaatgagtggcttaaaagtccaattttatgccaaggctttgaattttgaattctcggcattagtttttggcgccaaattggagttaatattcgttcgcgcgaaccgtgccataaatccccaatttggtgcagatcgcgatcggctttatcaaatttgaatttcggcatttgatttaaacgcaaagccaaaatacgcggtattttgggtattttgattttaaattttttgttaaaaaacattctaaaattgcaatcgtcgtacatagatttttggcttttcagcaattttgcactacaatgggtagcgagggcaaaattttgactggagaaacaaaggaattcggatgaaatgaattatttgcggcaagtgggtgagattttgagtcgcggaacggtgcgcactgacagaaccggcacaggaacaatttccatttttggcatgcaaacgcgctatagcctccggggaggtcaatcgaaaaaaatgaaattgtttaaaaaatggcggggttaagggaccattccattgctcaccaccaaaaaagtgttctggaagggcattgttgaggaggtacaacaacacacacttaagaaattaataaagttttcattttttagctgctttggtttattcgcgcagaaacgaatgccaaaacgctttcttcgagaggagtcaaaatttggggtaccaaattatttttaaatctatttttgtattacctacatttattgctcaattaaacataaattttgacagatgccaatgggtctcgtgcctttctcgactccgcgggtttcactgatcgcgaggagggcgacttgggccccgtttatggcttccaagtggttattattttgagagaaattgcttatttttgccttaagtggcttcactttggcgccgagaatcgcggcgcggacgccgattacacggccaaagggactgaccaattggcggaactgatccaaggcattcgtacggacccgaacagtcgacggcacattttatgcgcatggaatgttcttttttattattgatatatttgtggaaatttgtaaatttcaataaagcatttttgaaaaattgattaatttggggaccaaatatgagggccctgctgacgtagaccgcgacagaacttatgttccaccataagtaattgtttgaacttgataaaaatcagaaaatcagagggacatggaaaattttttggttctagtcggttttgacccggcaatcaaaacatcagcgtgaagaacagacttcggcattgaagctcactttggtttttgtgaccagcttgttctgccgactagcgcggttaattacaccggacagccttaactgacgatcgtgtaatcgatatgaatacaaaacgaagaaacaatatacaacgcatgtttttccctttggaggttttaggacaatcaacgtgaatccgctgaatactgaaaagcagggacatcctgaatcgcattaacaatactaatttagaaaattatagaccaaaataagactcactattcccgagctaacgccctttttcggatgcggaaggaccaccccagatatcttatgatcgcggctatctatgtaatgcaagaattattgaaacaggccccgtggtgtgctcactgcggttgat

SEQ ID NO: 15862 - DNA, 1139 bp, Heterodera glycines
taatgaattatgttcctacatatctccccttattacatagtaattatttcacgaagaaactctcataattcaggatttctaatatcaaataatactcgtttaaaaatctcctgaataaagaaaaatacgcactttaaaatcgactgaaaatagaataattcgtctctaataatcgatattttgatttcaaccacttccgaagacaagggtctggctactgccttgacagagacttcaaaattcaggaacaatttgtatatcaagggcttcttagatttttcagatggtttccttataatttaagttatatctgaataatcaggtctctcgggatgattgtagttataacaatacctttggatgtcataaatctatatttgtctcataaaactcgattggactcataaaactcgattgcactcataaagtgcattagagccgaaatcggtacgtagaagcgcttccaattctgaagtcattatgaagcgatgcgtttcctttatgagagagaacacaagacattggcacgtgcgcaggaacgcgaggatgagcgcaattttttgcgtcaatggttgctcggtgagttaaattttttgttcattagacctaactataccaacagcaatattcgttcattaattgccattaaaatagcatttattatttccctttgtttcaaggaggcccacaagggcaacagggacatggaggcgttcaacaacaaggacaaggtcttcaaacgttaataaggccgtttgagtttgattacctgaacgtttaccaaaaatgcttatattgcatatgattataaaaatttttcgccgaaaatgcagttttgggtgtgctttagtcaacccccagaaaaaatggcacaaatgatgtatcaatcgattacacaaaaaaataggtctccacttgaggaaatgccaaaaaaaccggtttttgaaccggtttaaaactcgaaaaattgagtgaaaaggagggctccatttaaaatggtcaaattcggacaaatttagtatcattcgaaagctcttgatgagctaagtctaaaaaataaggtataaattcgaacttatgccttctaagcactgggacaactgagtcccagtggaatagacaccagtaccaaagaataa

SEQ ID NO: 15863 - DNA, 529 bp, Heterodera glycines
agtatgttaccgtaaatgactgtttcgcttaacagctgatccattctattgctttgatggcttacataaatttttaatcatgattgagttatgcccttacccaacggttaaagggtagagtcaattgtgcaatgtattatatataccatctttattcattgatagtgtacaatttaaattaacatgttttctgtgcctagtgagtacaatttttaaaaagcagaatttatactaatatgtatgttcgttaacaattaatattctttctcttttctcccaaccattcaccctcagcagtttgcgtgctgcactccccatttaggattttattgttaagcgacacactcattctcggtaacaccgtcctttttgtttaccgtttggctgttagatggttagtttccccgctgtctaacagcgaattccccatgctccgctgtcgaacagcgaatcccccacttactgtctaacaaccaatcagtaaacaaaaaggaagtatgttaccgtaaatgactgtttcgcttaacag

SEQ ID NO: 15864 - DNA, 1953 bp, Heterodera glycines
atatagccatcggtatgtcgtttacgagtagggccactcccggtcgctcatgttgctgaaatggcacgggtacacatgtaccgatggaaatatcaatacccagccagctcagacttactccaagaataatttggcgctcagcgggaggttggtcgatttcgtcagcccaaatccaccagcgttgagcgtcagggatattgttgtctgtagttggggcataagtagtttcggcataggtattattgttgctgttactgaagttgctcatttggattattttatttaaaattatgtagcgaaaaaaacgaacggaggaaaatggtgcaagaatggcagaatgagatcatttgtccaaactccggcaccgccctttcattcagtgagggatgtcacaaagaacatttgttgccatagggcgcggttgtggggacatacaatgcgacgatcaaaacgaatgtgtcaatcaatcatcagattaggggcacaggaccacaaagactaagggctttgtccatagttaggcccgagaatacacatacgcggtaattagtcaaaggattaaactttatatttggccaccaaaaatttggacacagatgtaattaatcaattttaatccgtttagaggccgtacataacttacaaataaaaaaattaaacattttaaatatcaatgcatgtcgtccatgtcaattctttccaagcactttcgttttccttgcatgtagttgtttcttggaccacctctacagtatgtaggaccgtaattatcgtaccaaaagttattttgactgtcattttcgtcattatcgttgtttttattgtttctgtttttattgctgttgttggtgttgttgtagttgttattacgtggctgatatgccataaattgcacagaattcatatcgctgagtcgcatgttgagcattgtacaatgtttgcaccggtgaaagttcaagtccacacctccatcgttacactctgctatgtcgtccttacggttgtatatctcttgtgcacacattttacatagtttaaatgtcaacatgtatttttgtcttttcaatttccataactgttttgtggggcgcgcgtagcagtgatcatggtcgatcacatcagtttgatgttgttgatcttggtgttgttgttgttgttgttggtgttggtgttgttttggcattttgtcctcatgctgaaactgattattcatacaaactccttcactttttttaatgaaattgtccatttttcaaaaaattagttttaatgaatgattaaagtgtatacttaagcatacaatctgcacttaaataggctactatgtgcgattttttgaagcgaattttttagcacaaaatttgaatacaaattttgagggtgtgtagtgagtgagtgattcgaacattcattctttcaaaaagcacgcattcacttttcgtgtaactaactcctgctcagatgagtttgctcgatcaattcaagaatttgtttaactgttctgcttatgacgttagtaacagactgcttagtgatgctgagcgaacaaaggctttagtgttgtgtaatcacaaacttctcactaccatgtacaaggaccgtaatggactgaatcacacgttcacgtgtactggtctgtccgcagagggagcagaatcccttctcgcgtatggaaaactgagagaaccgttcaatatttctgtcgctgcccattattacgcacgtcatcgaataatactgagtcaccccaaagcaccatgtgctattgagcgaacaactttgtctcatcgcggcggtcagcgaaccaccgtattaaagttctatcccttggaactcgtccgattctcctcctattgtgcaattccatcacggtctcctcatatgaacacctacgttgattatgctgattactatgctgacgatgatgatgatgaattatctgctactacgctt

SEQ ID NO: 15865 - DNA, 735 bp, Heterodera glycines
aaatgaataaaaagtaaaaaataaattgaaaattatagaaaaataaataaataaatgagaactcgaagctcaagtgccaatcctcatctcggtcgacttcatgttcatccgttaggcatatcaaaacattttccatgaattttgaatcgcttgctgagttttgccgttggatattttgtcgtcctcattttcttagccattttggcactgttcgcaccggtaattgccatattttttgataaaaattatgtcttaattaaattggcgcatgcgtaaacaaacggtcacatagttttcggcttggaaaaaaaaattatgttaagtaataattaatataaaaaacagggttcgcatgtatctttatttctaagatttgtctttatttggaggggcagatcttaaaaagtgaaaatgtccatatttctaagattttttattttcaatcttcccctaatttttttaagaaaatatttgaattaattcaattttgaaaaaatgcatttttaaaccgttgtagtggagcgggaccggaattttaaaattcaaaaattaaaaaaattcaaattgtaatttatttcaagtgaaaataatacaaaattaaatttttattttataaattccaaaaattaaagctagattaaattaatgaaaattttcaaatcgagttttgaattatttcaaacaattaatcattttgactaaatgatcgaatattcctttttttcagcgcgcttt

SEQ ID NO: 15866 - DNA, 1754 bp, Heterodera glycines
  misc_feature (17)..(17): n is a, c, g, or t
cacaatatttaaatttntggagactcttcaatttcatggtaaacactcgatgattttttgagctctttatcaacaaaggattgctcaacagtgccaatgatttcattacggcaactgagcaaatttgcttaaatatttaaaaaaaattaatatacgaacatttaaaaatgtatttaaaattatttatcattcattttatcttataattaccgctccaaaatcacgcaaatatgagctgaaggataagcttcattttaaggtcggttcttggattatctaagtaagacaaatgaaaatttttttatttttaattattattttttatttatttattttaaccaaacaaattggttaatccaaaattaatcaatgcatattttgtgttaatgaatgtgaagcggattcatcactgatgaaagaaaaaaagttcattgactcccaaaccagtgaatttatgcatacataattaaaataaactgtagaataaaaactaaaagattttagaaattctcggaaattttaatagaaaattactctgaaggattgaattttcattcttgaattttgtcaatgcttttcatttagtaaattccactctcttaaaatggtaatttaaaatggtttaaagccttaaacccggggacacatcagaatctttcaaattaaaaaagttatggcacgctgcgccgaaaaagccaacaaaaatcgatttttgagatttttttgggcatatgaaaaggcgatttgcttggtccaataatacctcggatcgattttgagctcgcttttcctagtgctgggtcgtttcgtaaaaactgccaaatttacaacatcctaaaaaatgatattgagtcattcgatagcaagctcttgagttgctctattatcatgaaaaatctcagaaaatttatcggggttttccgaaagttatgtctattttttaacttttttggtcagaaccttctggaaacacaataaaattttctgaaattttttagactaatagagcaagccaagggttatcgcatgatataaatttttttaatttggttgtgtttaagagaagttatgacggattttgcccgaaaaatccgtaaattagtagttttacgaaacgacctagcaccgcttttccttaccattcatgcccacgaaaagttttcttctgcggattaatgatgaaatctgtaacgcctcctaacttctttgatctttttgataaaaaaaaatataacaatttatttgcaattgaaattttaccaaaattaagattttgattaagttatacgtgctttgctaaccaaaaagcgttaataaacaaattttttgcctattttagtgcctattcgaaggtctttgtgcctatttaatgcctagttagctattatgtctaaaaattgcatccctagttattatataaaatagctaaagtgactatgataaaatggatattacgataatttttcagtcaaaattgaatttcaattaaaattttagtataattttaaaatattttattgttttttgttttattcattaagagtattaaatattaaatggaaggtcagtattttctgaacagaaaataaagaaaaaaccgagaaaaactaattaatgttttaaaacaataaaaaaaaaaattaaaatagagaaatgtttctattataataaacacatccaaacccgggcattaattataacaaatgatttggatagaaatatatgcactaaaaaatcccttaaatatgccctaa

SEQ ID NO: 15867 - DNA, 2204 bp, Heterodera glycines
tttttttccaaaaaatttccagaattttcagtgtagttggcgtcccgatcgctatgaaggagtgatctgatcaaaattgctgttaaagacttttttgatcagcatcaacagttagcatggcagggattttttcagaatttttggcccacaagatattgattttattaaagaactaaaaagtgagtctaaacatatgactaccaaaaatgggggtgaagttgacttttgttttgtaattattagcgatgagaagaaattaggctgtaaacatacgaccatgactgtataaagcaattacaaatttatgttaaattttaaattgacctcgtggtggtgaacctgcaccgtttgtaacattggcaaaaatgatcacaattattaacgaaattattaaaatttgcatttttatcattttaatttgtttttttgagagttaattataattatgaaaaatatttcttattcgacaaaataaatagcgatttttttttttgcatttccgttgtttattattgcatcattaaaattattttacgttgccattgcaaaaatcaataaacaattcatgatttaaaaataaggaatattattttttgcaaattttttttatatgtaaacaaatgatgaatattttaaaatctttgggattgataattctttggatatttccatttttttatgagctcctagggacttgaaaagtaaaaaaaaaacttagcttaaaattatgtctatcaaattgagaaattagcgaaaattatcgaatttgtttaacgaaattggattgtttttaacttggtttgaagctgctaggatggatttcggtactcattaagtttgtatcccccttttgggtcaaattttttcaaaatttttttttcttttttattgtcgcaattgctttttagattgatggaaaagcttaaaaatttcactcttgccgatttattcaaagtattggctctaccagacaaagaattcgaagaatggctcaaagaacttaagcttctacacaccacccgtttttgcgactgtggcaatgaaatgagctacaaatggaagcaagatcgacaacaaccgctttggatatgctattcgaaaaagaatcacgacggcaaacagccaactattggcttttacactggcactttttttgaaggagcccatttgtcgcctaaacaagttttaaatacccttaatttacacgatcaattgatattaaggttttggaattttcctactattgggcacgaaaattttcaaatgatgaaatcagttttcaaatgcaattgggacgtgatacagtgaccgattggaaaaacttcatgagagatgtgacatcagaattttacagcagaaatccaatcaaaatcggttttttgtttgcttgcaaatgttttattaaatgataagtttaggcgcagcaggtgcgacggtggaaattgatgagactgtttctgattttttgtggcgtaagcaatttggaggaccggatattttttataatttgtggacccaaatcgcggaattgtacccaataagcacgtaaatctccttttatttgttatttaaagcaattccgacaataaaaaagaaaaaaaaattttgaaaaaatttgacccaaaagggggacccaaaccgaaagagtaccccaactcgttctgatatattgggtggggagcagggatgggccgaggtttcgcttttcgcatttcgcctttcgcattattcgcattttttggcgtttcgcatttcgctttttggcgcgaaatgggacttttatacccacaagaattggattaaattcccataaaatttttcaaaattttacatataaattggctaattttcagtgaaaaactgtttataaatgatcaaaatttccaatttttttccccagcggcgtctatcggcaccgccgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcccggcggcgcctgccggcgccgcctgccccctcttcccaaaaagtttttttggaaaaagcgcgcctcaaaaaagcgttttattgatttttaaagttgga

SEQ ID NO: 15868 - DNA, 2268 bp, Heterodera glycines
tgtatgaggcaatcgaaaaaaagctcgtaaaagaatatatgtaaaacaataggtagatactgtgtgaaatttttttgtttatctacatttaccatactgtaagtaaaggattcgttttttaaggactagctaggcattgtcttttgtcttattggtattgtagttttcagtacaaaaattcttatgcaatttctttctgtgcattaaataataaatttaaaaaatatcaatttaagtttcgtatacaatacatataagctaaacaaagaaaaagctttcaatggaccaaaacaacgaccaacgccgtgctgttaacgaatatcggcttaatgaggacaatgaactgcgtttagaagtgggcaaagaagaagtcattctcgaattgctggagggttctgccgaaatattcggctcccagatatccatgcacaaacgctactctctccccccaggcgagtcactgaaacaatcgcattcacatatctttgctttttgcagggtttcgcgccgccgttttcacatataaaggtgcccttattgaagtggtcggtcgaacagatagtgcttacattgcacaacaaacacctatggttgggtttggttgaacgtcttggaggaatgcctccggggactcgaattttcattaaatttttgcatttccacagattatctatttgaatactcatgccgctctcgagagtatgcgaaaaagtgccgagacacaattggtggccgaccgaacatcttccgcccgtggtccacgtcttttggttgccggaccaactgatgttggaaaatcgactctttgtcgaatattatgcaattacgccgtccgggagggaaggacacctctttatgtggaccttgacattggacaggtaaaactacggaaaaaattcagattttgggaatttaataagcatttacatttgcgagactattatccttttagggcagtgtttccattcccgggaccatcggatgcctttacattgaaaagcccgcagacattgtggacggattcgatcgaaaagccgcctatgttcacaacgtattcaatttacttgtatttccatttcgattttaatttaagttcggtcacatttctccgtccgcgaacattcgactttatgaccttttggtgaaggaattggcacttgcagttcgcaaaaagagcaaatcatcttcaatctgtgatgtttccggattcattgtgaacacttgcggatgggtcaaaggggacgggtcggtgcttaatttttaatgggtacaccccaaaatctcgccgagacaaaatctggccgcagaaatttcaaaaaatttttttcgaacataaatttttcaaataaaaaattcttataaaattttttataagaaaatgtcaaaaaaaaaaattatttgttaagattttttgaaaatttttgagaaaacataatttatcataatttcataaagaattgcttaaaaattttctaaggatttttccttggaaaatttcttaagtttgaaaaaattgaaatttctgcggcgagattttgtcccgtcctcattttaattgccttcaattggtcttttgggacaggtcataaaatcccaactttattcttatgaatttcatttaattgcttaataaattttatggaaagtcccatggctttctttttcagttacgcttgcattgtgaatgcggcggaggcctttgagcccgacgttgttattgtcttggatcatgaacgtctttacaacgaattgcagcaggatttgccaagttttgtcaaggcaatgatcgattattatactattttttagtcttattttttacctggttattttttctgacagattctgcatcttcctaagtcaggcggcgttgaaagtcgatcacaagaaattcgaatttcgggtcgacggagtgccatccatagagtggggcggattgtttttttgatattttattttgttttagtatttctatggtacgaaatcatctcctttttacccacattcatttgaactgtcatacgacaaaccgacggacgaacaggaattattaattgccaaaattggagctgaacagctgccggcttcgtgtgtgccagtcggaatggtgctggcggatcaccgaactcaggtaaatgggggcagttctcccgctgtagtccactttgggtgtccagtcttcagtttatttggccacaaatttcttgttaattcttatattgttggtatcaattaaaagtttggtcttggggttttataaataaaaga

SEQ ID NO: 15869 - DNA, 843 bp, Heterodera glycines
  misc_feature (31)..(31): n is a, c, g, or t
  misc_feature (35)..(36): n is a, c, g, or t
tcacaagaaaaatgcaaaacgaaaaatacancccnncctaaagatcgtacttttttggaaatttaaaaaaatacgccccctcaaaagagatttttttcgaaatttcggaattttttttaggtattttgtccacttccgaaaattttcactgaaaataatgttattacaaaaattttaagatgtatttgattttcaattgtgaagctagaatttataaaaattggcatttttttaatgttaaattcattttttcgcagtttttagcgtatttttaaagtctgttttagcaaatattgaatataaatacatttttcggaattttttagggtttaaaagaaatattttgtctctttttagtccatatttggccatttttgagctttttagtccatatttcgggcttttttagtccatattttatgttcatatttggcgtttttaaaattttctaattgaggcatcctttttttctttacgaaaaaattgaatttacttagaaaaaaagaagcaaaaattagtaaatttttgcaaaaaattaattttacacgaattgctaatgaaaaattttttgtgcaatttttggtaagtttctcaaaattttcaattttagggcgtattttccaaaaatttatcatctttggggtgtattttttgaactttttgtgaaaatgccgaaatatggatatcaaatatggaaatatggacaaaaatctgaaatatggaaaatatggaagtaaaaaggcatcctagaagcatcaaaccaagctaaaaacactatttacatggtttttaggccgaaatgagtgtgcaaaaaatatggaaatccatacaaatcctgtccct

SEQ ID NO: 15870 - DNA, 1045 bp, Heterodera glycines
  misc_feature (34)..(34): n is a, c, g, or t
tattcaaaattagatctaacatagcaattttttntggggaaaattacttaatataaatgtaaaaattttcacgctggcccatataaatccttattctcttaaaaaattgagtaaaaatcgtaaaactttgtcatttttggtgtaaatctgttaacaatcacacaaattttttaaaattctccccggcggcgcctatcggcaccgccggacccccccccccccccattgtaccctaatttttttttgaaaaaatgagccgtaaaaagggtttgaaaagcaaaaaaggtcgatctaaaggcttgatataattctaagctaaaatataaaattataaaaattttttcgaatttttaattaaaatttcaaaaatttgaaaaagtcccggtcccggcgggatcccagcacaaaaattgggacccggaccgggagtcccgtttaaaccgggagtcccggtcccggtcccgtcccggttcatttcccaagtcccggtcccggtcatatcaaaattccggtctctaatttgcacccacaaataaaagttcaaatttcagaaaaatgatattaaacaagcgggacttttaatctcacaaatggccaacacaaagattttggggttgccgaatgaacaagcatttgacagaagccgttgcatcaaaacgctatttaaatgtgctaatcgagaggcaattaaagcatttgcttccggacttagttggcaaatgattttggaaattttatggggtggaacgaattgccaggcatttcatttcttgtcggagtgagtaaatttggggccaggccgttttcgtacgaacacatgtttttggactataacttttttctttgccaaccaaatccaacattgttggtatcattcgaaagctctttagatgctctattagcctgcaaaatttcaaaaaatttcgtcaagttcaaaaaaagttcgagccaaaaagttggaaaatttggttttttgaattcttctggccataacttttttgaaccttaacgaaatttttcgaaattttgcagactaatagaggat

SEQ ID NO: 15871 - DNA, 984 bp, Heterodera glycines
tatacgaaaacgaaacgcataaaaatattttgaaaaccgaaaacgaaacacgaaacgaaaaaattttgacggacgaaaacgaaacacgaaaaccaaaaaataaccatttcgtacgaaacgaaacgaaaaaaccgaaaattttttgaacttatttcaatcataattaagaaacataaaactttaaaattgtatcctctaactgaaggaatgaagatcctagtaggtggaaaagctaatgtggctctaggacaggggtgtgaccaaacaatttttaaaataaagaacatcaatgacaaaaaataaggtttagggtcaaaaaatacaatcttgcaaaattggttcgaatcagttaatatataattttttcgataaaaaatgtattaaaatgttatgtttttcacatcctattatggattttaacaatttttggggaagaaattagcaactgctgaaaaaaaagattttcaaacgtttttttgcagtgtagtttttttttacaagttgatgaatgggaagtggatccggcggcgccgataggcgacgccgggaaaatttttgaaaatttgagtgctatttcatagcagattttcaattaaaatcggtaaaaacatgattaaaaaatcggtaaaataaagtgcggtcatgcgggatcgaacattaatgcacagcacaaaacaaacctgctgttttcaccactaaactaaaatacttaaataataaaacttattatttctttccaaaaaagtcattcttaagggtgtaaatattttcgtctttttcgtaaaatattgctctgacgaaaacgaaacgaaaatccaaaattttaaaaaccgaaaacgaaacgaaaaacaaaattttgaaaaccgaaaccgaaaacgaaacgaaaaaactttagcggacgaaaacgaaaacgaaactcaaaaagtaccgaaaatttaggacgaaacaaaaacgacacgaaatttcgtccagccctgaccggga

SEQ ID NO: 15872 - DNA, 1513 bp, Heterodera glycines
gaaaaattttttgaaatttgagtgctatttcatagcagattttcaattaaaatcggtaaaaacatgattaaaaaatcggtaaaataaagtgcggtcatgcgggatcgaacattaatgcacagaacaaaacaaacctgctgttttcaccactaaactaaaatacttaaataataaaacttattatttctttccaaaaaagtcattcttaagggtgtaaatattttagtcttttttgtaaaatattgctctgacgaaaccgaaaacgaaacgaaaaaactttagtggacgaaaacgaaacacgaaaacgaaactcaaaaagtaccgaaaatttaggacgaaacgaaaacgacacgaaatttcgtccagccctgattccaacccacaacattttcaattgatttcgaagccgccgtttccaatgccatacaaaatgttttcaatgggaattgcgccataaacttttgtttttttcattttgtgcgtaacatgaagaagaaactgggagaccaaaatctgactcaggttgtctcaatttttcaattcaatattctcaactttattgattttaagcgttttaatacggatccaatttttgccgagtcagcaaaaatgctgacattgattgcttttgttcaaattggcgatcccacagaagcagtcaatgcattggatgttgcgttccgaaatttaccagaaatacaaccgatgctcgaatggtttgttttttgcagtcattaacatgcaaatatttactgcgttcaggttgatgaacaattacacgggtcgtccacgcgcagatgggtcgcgaacggaaccacgtttcaaagccgaagcttggaatgtctacgagagaatgctgagcaatgacgacagaacgaacaattttgcagcccacaaaagaatccagtgtcatttcaattgtcaccctactctttggaacttcattgacgttcttcgaaaagcccaaacagtgattaaatttattgcttatttatccgtaacattccatttaagactacggatgccgattactcaaaatttgtcaaaggaattgagccgcctccaaaaaagaaaaaataccgtgataccgattcccgaattctagcaaaggttcagaactattacattgacattcccaacaacaatgctcacaattatgttaaccgtcatccccgtatcattgagtatttgaaaggcatttctcgcaattaccagatgaatccttgatcaattttttttaatattggtattatttatggaaatttgttagtttcaaatttcaataataaattattttgtggaaatttgttaattgcaataaaacattttttggaaaatagaaaaatttttacttggggcccaaacgtgtggagcccaaacgtgagggcccaatcgtgagggcccaactgacgtagaccgctacaaaatgaaccagaagcaagtaattaaaacacaacgaaataatgataagttggtgcatgatggtgcactctatgtgttccacaaattcagt

SEQ ID NO: 15873 - DNA, 1500 bp, Heterodera glycines
tcaataaaaatatcactcacggtgcgaaaaatggggttttacaagtttattggggaaaaaaaccctttacaaaataatacccctgggagaagggagtgggaaacatgatttcagaattttcaattttttatagtctaatctaatcaaaccggttcagaattcaataaaaataacattcacggtgttaaaaatggggtctgaaaagtttattttgaaaaaaagactttacaaaataatacccctgggagaagggagtgtgaaacatgatttcaaaattttcaattttttccccaagttgcaaatccccaaaagtcgcaccacgtatgctttttcagcatttgtcactgatttaaaaaacctagttaaaaattagggcaagaagaatcatcgcattgaaagaataaatcagttagagtttttattttgcagtttgtacataacagtcataaaaacgaatgaaaaagcaaaatttttggcctatggtgaacctaaagaaatgagaaaacagcaccacgtgctaaagaggtgacaaaaacgggctgatctttgatcagagagaaagcagaaggaaggcaatcagcaaaaaatggtcactaaatagcataaaacagagagagattgcctgtggggacaattagcagctgaaaatgaaacaccggtggattataaaagaaaatcgccaacagaaaaataaaaataaaatgatggggcaagaaatgggagccggaaaatccgacactggaaaatccgacaccggaaaatccgacactggaaaatccgacacaagcagaaaatccgacaccggtggaaaatccgacacaagcagtaaatccgacattggaaaaaccgaccccaactttaaattttaaaaataatttttgattgtttgagttagtaaatatttaaaatacatataataaaagttaaatacttaagttatttaaaataaatatttttattgctataaaatagatttaaagtagacatataataatcatattatttcaatgttctttttgatcatctcaaaaaaaattgtaacaatccggcaaatggaatcagatgaaagggcatgaagcataagaaagtgaacgtggtgcaagacatgaatctcacagagatttatgcgactcgcaacaatcgacatcaatatcccatcgaatggcagaatcaattaatttttttaaatccaaatcgaaaacttgataaacttagccagatattaactcaaacaatcaaaaatattttttaaatttaaagttggggtcggtttttccaatgtcggatttactgcttgtgtcggattttccaccggtgtcggattttctgcttgtgtcggattttccagtgtcggattttccggtgtcggattttccagtgtcggattttcctagagcccgcacaaagtgcctatatctccaataaaatcatcggcgtcgtgcggtggggggggggggcggaagacggacgatgggcggcgtacgttcgcggaccaaaaat

SEQ ID NO: 15874 - DNA, 1986 bp, Heterodera glycines
  misc_feature (1408)..(1408): n is a, c, g, or t
tgctcctgccgacgcatcacaatggcaccagccagtaagtgccagtagtacatattgttgctcgaaacaaaaaattcccaggactagagagtgattctgattgagaaaattcgagacttttctcgagtcgaggctcaagactgacactttcgagcagtactagtaaaaaaaatagtagtggtagtgtgtgttggtttgtttcgtaaaatccgccattttaacttctttttttcgacgaaatatgctatatatataactttgtttaaaattagtcaaattttgtattcttggttctttgatagcccaggtttttctctattagcatgcaaaattttaaaaaattttataaattcgaaaaacttgtatgaaaataagtatattgaatttgatatttaatttaaaattttgtaaggctaatagagaaaaatcagagctatagaatggtacctgtcaaattttgtaacttttaagcaaaattcttatttttggcgtattctcaggattatggcacgcccaagccaaatgctccatatccgccatatggccaccattgagatgctgtgccaaaatgaaatgggcaatggatgaattttaccgtgataaaaaatgagtgtggggaaattagagtccgtaatttttaaaaatcggggatgggattgggaatcaggccgggatgtgatttaaaatccaatttttggtccgggaaaatccacacgtcctatcccatccgggccctattactcataattggttagaatttctcaattggtgattttgatgtgatccgcgatttcaaccaattaatatgataaataaactaaatttatcatctacgccaattttttcattagaattctaagcgaaaacacaaaaaagatctgctaattaacaggattattacaaagatttttaccaacctagtccttatggggcggagtcgttatttaaaaaaccatcaatatgatttgatgaaaaattatttataacttagctcaaaagcaaccaaatttttaattcttgataccattcgatagccctaagtgttctctctctaccagtccacaaaatttcaaaaaattttgtttagtttaaaaaatcgaatgatatgaagaattgaaaattggttgcttttgagcaacttataaatagtttttcagcaaatcatattgatggtttttcattttttgaaaacttgaaaaaacatcggtcacttgaaataataaaaaaatttgcgattttaagccaatttttttaagagaataagaatttgggccggcaggaaaattttgcagattttatacccattttaaatacatttcgccataaaaagacgaaaaaaagaaattatctaggaaaatccagattttttatgcctggacctagatttcctggacaaaaatccaagganagtcaaggtccaggaaaaatctaggttgccaaaaaatggcctggacctgggcctctggagccaggaaaaatccaggcctgggtccagatccaggccaatctctgcttattttcttaattttaaaacataaattttatgaaaatttatgtggaatttgccctgtaaaaacacacaaatgccaaaatattatattgttgcctttgtgcaattctttcaatggctttgcaatttctcggatttgtttgtccaatttttgtgccccatttttgtcattaaaatccgtcggattgccataaatgcgctcgtgcagtgtttcttcgccaagttccattattgtgacgcccaacatgatctgtttttgttgcggttgtgattgatcagtttgatcagaagcatcgtcttgcattttgaccggtgccttttcaatggcaattgttccgctgaaagccataaaaatgggcatcattaaaagcattcattagacacataaatacccacaaatcacacagcaacgaaatggaaaaatataaataacaaaactttattgtaaaatttaataatcgctaagagaaatatta

SEQ ID NO: 15875 - DNA, 1889 bp, Heterodera glycines
  misc_feature (1825)..(1825): n is a, c, g, or t
  misc_feature (1866)..(1866): n is a, c, g, or t
catccgcaatctgttgaccgaagtggaaattcgcgtcggcggcactcccgatccgatcaatccgacatttccatgcgcaaaaaaaattgacgacaaagtgaaccagtgcccatgcgcaaaggcggaaggaacttggcaagtccaccccgaaataacttagtccaagccatcattgtaccagttttggttgggcagcaaatccagtctaggctttagcagatgcgaattctcagcttttttggggccttcttatgttggcagcatttaaaaaggaatcaaaaatcaaaaatttttgtaattttttaataaaatttgtccatgtctcaaacaaaaaatttttaggagtaatttaacgtaatcaaaataaattaaaatgttgatactatttattttacaaaaaatatatgtagaaaaattgaaataaaattaattgaaaattgaactgctttttggaaattttgaacgggtccatccatatttttaatatttacgccctatgccgggtgagcaaaagattttttgacgcttttgcagcttgttctgcgatttttgtcgccaaatgcgcagccaacaggccaaagtgtccgcttctgaggccgcaaaagtgtcgcgcgggtcgggcgccgcctcggccgaatcgctggaggagcagtgcaaatgtgaggtgatgcagcccggactgtacgacatcgagacggagatgtgcacgccggaattggacgacgccaagcagttcatccccactgagttgcagaacaacgtcatggacaaaacaccggtggggagaaaccatcaacaaaatgaattaacttaaataaaattgaaaaattaaaaattttataaaaaataattgcaaaaaagcatgctagctagattaggttagttccaaaacacagggttcgttttagggcgagaacatttattttgtgtattcgaatccaccccagaaccagaacgaggcccaaattttttggcaaaaaaatgttacaaatttctgtatttttttttttgctctcccgcgctgaaattttttaaaaataacactgttttccgtgtctattattccggcgtgtaagtattttgctgaaaaaatggatatatcgaattccatacagatttccatgttcatcacggtctatcttatggacttgcaaacacatgccaacgagtcctacttgtccgcctttgggcgtgccattcttcaacggcggatggcacaaagcacggtggcatgttttctgatggggcttgatgtaacgttggccactgcacagcaacaacaacaatcccaagctcaacaacaacaaatgccggtggcaatggaaaaatgaatttaaaaatgaattattatttttctatacgatcgaatatccgcgcctaattagtgcaaaatttttgtgcattgctaagacaattaaaaaaatgtgtgtgacaattaacttatttgattaaatatgtttccatggtaattacatgtattgcccaaatttgtaaattatgattattaattagccaaaactatttggataatttttattattaaaattaaaacgataaaattcaattaaaatgcaatatgtcctcatcgtaaacggctaaaaatataaaaaatgacattttaattaaaaaaaagaaatattaccccatgaagatgaaccagtaccagacgttgaacagaataaaacagaccgggaaaataatcattgaatatttatcaattttttttgccgttgcatcaggacatttccagcaaatcatattttcggaacatttgtgccttaatgaaatatatttattttaaattatataaataattagatattgnggatttgtataatttcttgaaacaaaaatttaaattaattntatgcttccgcctaaaaaccggc

SEQ ID NO: 15876 - DNA, 1327 bp, Heterodera glycines
  misc_feature (1201)..(1201): n is a, c, g, or t
aatgatgcttgcctgtgcatgaagtcatgactaacaatgtcagggttcgattgatggaaggggcgagcagtgatgatcacgaggtctgacagggcgctgcaataaaggagcactgaaattttctcatttttccagggcgactcagcttcacggcttattgcatcccccattaattttttcaggatttttttaaacattttttcgggatcttcgttttctgggcatttaaaataaaaagttgtcacgagctcttttatcccaaattttttattttcgtttgtgtgactctccacttcttcgaaacattttcccaaattagcactgtttttgaaataatttttggtatttttcgagcggcggatatcttttgaaatttcttggaaaatttctttgaccaaatttgattaatttaaaatattaaatgaaataaacattaatagaaaattatcaaaacaaaaattattaataatatccaaagggcaaaacattaaagtgatcgtcaataattccttttttctgcaccggcgtacgcttccacctttatcttcaaaaacatccgcacatatcctttgaacagttgactgtcaaactgctcaaaatgataggcccgatagaagcctgtgacccgatatcccagctctaaagccttccgtaactcaattgatgtgaacgttcccaaaaatgctctctgcgctggacggtgttacatttctttacatcttttgtcatcacaaactcattcttggccctttttgcacaagcccaacaattggggaagaggagcatgtcatcgatgtgcatggggaggagggggtaaatgggacctcaggcattaaaaattcgattttgaggccccataacttttttttataatattgctaaaatattcattcattaatttttcacatggaaacatttcaaaattctggtgaaaaatgttttcggacaaaattgcagcagatttactggagcaacataatatagacacggatgtgaccaaccaataaatgataaggttttttttttaaatgataaatatttttagttttgatggactatattaaaaaaactttagaaaaattgtttaaacaattgaaatgaataatttaatttaactaaattaaaaatacaagcaacaataagcaaacatttattcaaaaaaggtgtaatgtgagcacatatttatttccttattttttanacaaaactttttatacattggtgaaaatcaaatgaaaaaataaaataaaatccattcaaaacaaaatcataataataaaaaaaagcaaagttagtgacatcaaatacgtttgctaagtacatttaa

SEQ ID NO: 15877 - DNA, 1292 bp, Heterodera glycines
caacccaccagcatttcaatcgccgggaaccaccccaccagcattccaatcgccgggaaccaactctccggcattccaatctctgggactcaaatctccggcatccaaacattgggactcaaatctgcggcattccaatcactgggactcaacccacagcatttcaatcgccaggactcaatccaccagcattccaatcactgggactcaacccacctgcattcaatcactgcgactcaatccaccatcgttccaatcgtcggggctcaacccaccaacatttcaatcactgggactcaacccacagcatttcaatcgccaggactcaatccaccatcgttccaatcgccgggactcaacccaccagcattccaatcagtgggactcaacccaccagcattccaatcactgggactcaacccaccagcattccaatcgccgggaaccaacccaccagcattccaatcgccgggaaccaacccaccagcattccaatcgctgggactcaacccacagcatttcaattgccaggactcaatccaccagcattccaatcactgggactcaacccacagcatttcaatcgccaggactcaatccaccatcgttccaatcgccgggactcaacccaccagcattccaattactgggactcaacccaccagcaattcaatctctgggactcaattctcaagctttccaatcactgggactcaaatctccggcattccaatctctgggactcaaatctccggcattccaaacattgggactcaaatctgcggcattccaatcactgggactcaacccacagcatttcaatcgccaggactcaatccaccagcattccaatcactgggactcaacccaccagcattccaatcactgggactcaacccaccagcattccaatcgccgggaaccaacccaccagcattccaatcgccgggaaccaacccaccagcattccaatcactgggactcaacccaccagcattccaatcgccggaatcaaccctccagcattccaatcactgggactcaacccaccatcgttccaatcgccgggactcaacccaccagcattccaatcactgggactcaacccacctgcattcaatcactgcgactcaatccaccatcgttccaatcgtcgggactcaacccaccaacatttcaatcactgggactcaacccacagcatttcaatcgccaggactcaatccaccatcgttccaatcgccggaactcaacccaccagcattccaatcagtgggactcaacccaccagc

SEQ ID NO: 15878 - DNA, 1120 bp, Heterodera glycines
ttaaagcaaatgccaagtctagcaaagacagcgcagttcgaaaaccattggcacagagaatgaatgccctgaggcgtaaattacccattcattagcattcatccgtttgtgaagtaacacgaaagacgggttgtgcccgcgaaagctttcttagcgaaggtccgccctcagctttttctgattgtgatgttcggcagtgattgttgatctcatccatccaacaatcctcgccttcccttgccctctgtctgctaattacccaatggcaccaattaaacacaaattaattaatatgtatttgaacaaattcatttgttaaaataaatttttattggattttattttatttatatttgtgtaaatattttataaaatattttaatatttaatttaccaaattattctaattttagttacctaggtatgtagagtagttattttaaagtaaacaattactgcatttatttgggttattttttgagattatttcgttctttaccaattttttgccgtgtttctcactccttttctttttttctttttctctttcttttattctttccactcccactttctcatctttctctctatttgtctgcactatgggtacgccccactgtgcagagaaaagcctagtactatctcgtcgtttctctttttctttgtaatttctctcactttggcgtactatctcttcattttaattatgtaaaaatcaacatttacttctctccatataactttttttctatgcatacaagttgcaccaaattttgcataccgatagagaaaaaaattctgcatcggttaataggtcaagttaatattaaaataggtcgaattagaaagttatggagtgattaaaatttttgcatttcttttcctctcgtgttggcgtactattttcacatctctaacacacaaaaaacatcaaattcgtaaatgctaacaattttggttataaggatacaaaatcactttggacatttagaattaatagagaaattaatagttttagcatttttggtgaaaaaagcagtttaggactttgagtataacgtgataaaaatttgaaaatatcacaacttttttctgagatgtcaaatgcttagcattcgct

SEQ ID NO: 15879 - DNA, 1578 bp, Heterodera glycines
cgccaaagcagtgcttccaccccaaaataaacgaatttttctgttgcttttgactttctcccgctattttgtgcttgtccctattccctcgatttataacaaattttcatccaaaaaattgacattttggaaaatttcgcgtaaatatattatttttttcatggaggagtagtcttggggtatgtacaccgcgaacccctccccctccctgagatagtccctgatgtccaatttaggattgtttattgttcaccaatatccacctgcggtggcgatggcacatcacaattagttgacggtggcgcgcgacacattagttgttgttgaggttgtatatgtcctcctcggattgggaattggagcagcaataaatatctatttgcttccgtgtaattttggttaaattttattattgtcagtaggcgaaatgtcccattttgggtttgtaggcgaaatgcccgattttggctttgtaggcgaaatgtaggcgtgcccattttagcaatttgtatgaaatacgcttatctaaaagggcgagggaaactcgaaggatccgaaaataggccaaaagactcattcaaaaaaacaatagtgactttgtatgttttttgtccgcaagtgtcgtaatattaagattcatgtcaaagcatatgccttcgtggatctttcctcgagttgctcaacaacagcagcagtcgccgtttccacagcctccgaccactgccgttggttcttttcaacaacatttccaatcgcctggcagcagaggagcaccgttaccgccacacattccgccccaacctttcttttctgcagggcctccgaatggcactgtatgactgacaattgtttgatagttttagtgatggatggtagctattctctctatcgaagactcccttttttcatggcttaatttcttcacgtttttttaactatttctttcccttttcagatgaattctacgccagcaatgaacaactttggcactgacggtgctcagctgcacccgtcctttatgtacgatggacaagtgccgaccaacggcggtgctggtcacatgcttatgaacggagcgggcggccctggcgggacaattgacttcaatgaagacttttctggggggatcaatggcacaatgcctgcccaatacattctatccgacgaattgatgggaaagattcataattcgactaaacgaaaggtgtgtttgttataataaaatatgtttaaatagccgttttagacgctgttggaactgcagattggatttgagcaaattgcgtacgacgtgtccaacatttttgagacttgggctatggtgatcaaagagcgtttggttggcagtgacccgttgtcgtcttccgacttggagatcggcgccgccattctcattgaaatggtttcaagaaactgctattaactgtttctcagtgaacttggatttaggcggtcgttcttgacgaaagtcagtacaattactctcgtcttggtcaatacctctgccgaaccatcgaaagttttgccaccggcatattgttaccgcagatctccgtgtttataaacgaaaccaatgca

SEQ ID NO: 15880 - DNA, 1882 bp, Heterodera glycines
tggaaacgaactccaagaagcgctttcttctgctgccttttttgatgattttatgccatttgttttggcatttgaatttggcacaaaattttgtgcacaaaacgacggcaccaaattgtgcagagagaaagtccattttgatatttaaaattcacaattttattttatttgaatttagtgcctttcccaaacattggtcgccccaaaaacaaaggcaccgtttgttggcacaaccaaattccatcgcacaaagccacgcgcagtgccaaaaaccacttttggcattgtgccaacaactgaacaaacctttggctttgtgccatttgtgcggcatgtggaccattttggcatgaattgtacgaacattttcttcccgacggaagtggacaaattcttgttgaatatcaccgcgacgccatacgaaattgcatgcaatgactatgaaaaacgtgccaaaattgacgagccaataccgtcatattattggtcagatggacgctttgtgaatgcttgcatggcggtgccgagtgaaaaatgcgaaaagtcattttttggaatttattttttgaaaattttaaatttgaaggcacgtcgaactttacgcgtgctatgaaagcattggcaataagccaagtgtcaatgccatcggcgaattgtgccaaaaacatttggacaatgccacaaatgctgctgggtttgctgttcaaatttgtgcacatcgacaccaaatggaggggataaatgagctcattgttgaatcgttcatcaacttttcgttcactaatgagccgtttgttaattaaataataattttttttattaattttattaattaattaaggttccaaaaaacgcgtaatttgccaatttcaatggacaaaataatggacataaaaaagaaaacgccatattttctcatcgaatttggccaaaacgagcaaaaaagtgcaatccgagaaaagggcgacggagaaaattttggcggcaaatggaacaatgaggcaaaaaatgcattaatttgaatcaattttaattgcattgattaatttagaatgatggcatcggctccattctcaaagacattgcgccacaaatggtcaaagacactttggcaaaaatgattcattttgtgccaccatcgaatgatgataaaatgctcccatttttccaaattgaaaggcccaaattttcaaaattcatcaacaacgatacggatttgttaccctaccaagatgatccgaacaaattcagtcagtaaaaaataaatttaatttttaaaattaattttggcactttttaagacaatcctgacccctgtgatgaatacggcgcagattgcgtgccgatcaaaaatttgttgttgaaaattgaggcattggcaaactgtaccggtaacgaaaacaatgcggtaaagacagaaaaaaatattaaaaaaatatatatactaaaataattttagattttcgaaatgccaaaatgggccccacttcctccagcgatgccatggaaaaagcgatccgaaacaatgctatgcgatggggatttgttttgtgacaaacgaaggctgcacgaacagtacaacagattgagggagagtgagtcacttggaaattaaataaattaattaattaaaaataaataaaactaaaaaatctaaattaaaattcagtttgtggacttcagcctgaaaaagtggaaagtcagcgtaaaaaacgacaatacaatccaaacgagaaatggaccgaatccccgatcaaaatcacattcaacaaaaaagctcgtaataatcttaccacattatacaggatttgaacaaattttttaagtgcctgataaatacggcctctgggacaatgccattagagttggagcaaaattaatt

SEQ ID NO: 15881 - DNA, 1942 bp, Heterodera glycines
tttaatttgtatctgattaaggattttaacatgtccgtcgttgctggccatgaattgatgcacgcgcttggctttacgcatgagcaaagccgaagtgatgcccgaaattacatcatcttacgactagacgatgacgtaattaacacaaataatttaaatataattttccatgtgctaattttaaagcaatcggaaattgacccatacacaaaaaactttggcttcgcttacgatttcgggtcggtgatgcattatcaatctgggggcgatcatgaacagtaagaaaaagttggatttaataacgtaaaattggaattaaaggggcttatacaatctgatcactttgccacgcttttaccaacaaacgattggccaaagcgaacgaatctctttcaaagacgcggcgataattaaccgaatttattgcaaaggcaaatcaattaaatataattaagtgattttccatttgttcagactcatgcaaaggccatgaggacaagtgccaaaacgggggctatttgaatccgaatgattgtacaaaatgccattgtccggacggctacggtggcgaatactgtaaagaactcgaagagagtgagcaattaattaattcaattaaaaataaattataaataaatatatttggagatttgaattgcgaggatttgagtggaattccgagagaattgatggccaattattcagcagtgttattgaaggcggaggcaaaatgtggcggcaattggccgtgccgatgccgttggcgaattaaggcaataaataatatttttgaatttttaggttttttaattaatgcaaattttaattgctttcagcctgaagcggggaaaaaggtacgaattcagttcaaaagtttgagcaatttgtttgaatgcacacacaactgctcatcggcgtatgtcgaggtcaaataccgagacgacaaaagggcccaaggcaaaaagacaaataattaattactgattacttagcaaaatgatggctcattaaggtgccaaactttgctgtccccgtgcactcactgatctgaacgccaatgaatacaaaaattggatcgatgcggaaaagccggacatggacatagtcatttctgcgctcctttcaacaaaatggaccataccatctaccgtattcgaactgacgtatgaatcaggcaaggaaattgtaaaatatattttatatattttcatttttaaaaaattaatttattttaaattgcctttgttttcaatgttttacaaaccattacaaaatgcaaattgttcaaaaatgttaaggcaacgtcaaactcataaattcaagcaaatgccgttacgccttcaatttgtatgccgaaaaaaggaaccccggcagcggcaatttgagctgttatgacggggtcaaacaccaatattatcaatgcccatgtaaagttggtaatgaaaaatgccgcactgaagaaaaatgggcacacgaagaatttctttgcccaataataaaggtaattaattaatcaattaatgtcaaaaggcaccgccacaaaaaaatatttgagttaaatttttaggcactaaaaatttgaatttgaaaaacaaaaaaaaaggccgaaataagtgcaaattttagaaataaggacaaattagaagataaatgataaaaactccatctacatataattttacttataaattcaaggtcaatggaattcaaatccaaggaaaaaggcaaacggtgtttactgacccaaataatgaaaaatacaattggactaaaattgatgttgattgttatgtgagttgtgtcttctaatttcgaaaagcctatttaattgacttaattcacagaaagccgaagggggtaccgtaaacttttggggctacagtaagccggagactaacgaaatcattcgggtggacgaaatccactgcttgatggatgatgc

SEQ ID NO: 15882 - DNA, 3781 bp, Heterodera glycines
agtcatggggttcaccacacagcacaggtcgcggccacattctttggtcgccttcgaattctgtgtgttgttgttgatgggccgtttctcctccctttcttccttctcctcctcctccttttcttccttctcctcctcctccttttcttccttctccaactcctccttttcttcctcttcctcctgctcctcctcttccttctccctcttcctcttctacactttctttggtcccttcaaatgcatctactgcttctccttcttctgctttttccactgcccttgtgccaacggttggcgtggcattcttcgccaacaatcgttccgttctatcggacgaaacggtgacacctgccgatgctggtgattgtgggaaatggaagaagaaagggttcgaaaatgaagagcacatctgtggacgcaaaaaagaacagcaaaaggagctaattaaaaaaaagcaaatttaagacaaaagagcaaatgaggaaaaagaaaaagaaattggcatttgagagagagaaaaggcaaaaaagagaggtcaaacgaaacgaaagagacgaaacaaaatgaaacaacggcaagccaaaggcaggcattttctgtttgggtgcctttctttgccaatggattaacttccaagcgagagaaagaaacagaagagaactgaagacatacggagggaagagagtaaagagacacacaaagcgaagggaagagagtggcagacggcacgataataaaaacggtgccaatgaaagacagcaaaaaggcacaaagccggccaatggtgtggacgggaaaagcagcagaggaccaaatggacagaataaaggacacatatctattatttttcaaaaaaaagcaaaaggtttttaaaaacatccgagagaggggaaataggggtgggaagtctaaaaagaaaaaatgggagagggagaggggagagggagggtggtggagagactaaaaagagaggggggaggaggagacgaaaaaagagaaaagaaaaatggggtagggaagaggagagaggggaagaagaagaaaagggaaaagtcgaaaagaaaaatgagggagggaagaaggaagggaatggagaggggcgagggggaataacagaccaaaaaatgcacttaaaacgaatgaatgggaaacatgaccaatgaccaaatgaatgcgttacacatctgctgatcaaatccatctgctgatgggaatggtaaagaattgcttttcctaattaaattttttttttattttgagctcaaaatcagtttccggtggcttttcgaaggtgctgatctgatcagtgaatcaaaaacctgaaccctccgggcctttgactctttcttttccctctttccttttgaccattaatgggctgacacattagcacattcactaattggacctgagcgagccctaatctgtgaccatatcgctcggttaccccacgaagctttttaccccagaaaaatgtattttctggataaacttttcgacttttgtcgaattcggacccgggattcggaattgggctaatccggttcagaagcgtgaccagcaccttcgaaaacttactggaaacttattttgagccgaaaataagttaggtaattagggacatcaattctttaccattggccatctaaataaattgggtgggacgcaaagggaaagtcacggaaaataaagtgaagtaaaatggagtggtactactgaccaaaacgacagatgagaagcagagaacggaggaataattggccgaaatggcaaatggacggggaggtaatggatactgtggtcaccgtaatccggtgatttgtgcaaatcacaaaacccaacaaatgttaaactatcgacctgtaatatgcgaatccaaaaagaaaacactgacaagaattattggtcaagacaaagaagggatatttatttattcacacttttattagttcccgttaattgtgtatgatcgtttgcttaaataaagcacgtttcacaagtgagtaatcacaaatctaaaaacgcggcatgacaatccgtccgattgcatttcggcaacttctcaagtacctccctccgctcaatttcggattaacgctttgcaactcgcagaacagcaccgcacctgcagttctgtctcagcaacaaattctctccttgcagttgggcgttgctggcttttagcgtttctatcagttcggctttccgacagttctaaaaaataaagcttataagcattttatgtaaatttgggtaatcatgtactttattggttcctaaaaaaattaaagggttttatgcggttctgagtttttaaaattgttaaaaacgcctttcctgtggttttcgaggtgctaatcatgaatctaacttcaattttggtcaatgccgaaccccagacccgaattcgaacaaaaggagaaaattaatttttcaccaaattttacatttattgtcccaaatctattcaaatggacggaatacaatagaaaataaagatcactgccatttagtgcatttgaacctgttttggacaatacatgagaattttagtgaaaaattaattttcgacttttgttcgaattcggggttcgaaattggggtcgcttatgccgatatccgttgtgggaaaaacatgcttaagaaatttttcgaaatgcgaaaataggtataaattttaaaattatttttagattcttgctaaattcaagaattgggcggagaaaatgcggcactaaaacgtctaaataggtaaaagcgtagaatccgttctatgttaatgatataaaaaacccagtaagcttatataaatgaggaaattcgtccttacatcatcttgtaagagcttcagctcgctttccttggcttcttgaatgcgttttgctttgtctcgactgcgtcggactgcatcattgttctgaaacaagttcattatatcaaataaatatattcgctcataataatttctttttttaatttaaaatcagtttcgaaaaaaggtccggcgatgtcggaggggttgtctggaaattttatttcaccgacacttattgttagattaagaaattttaccataaaaagattcgattatattttgaagatcctcggacttaaataatttttagttctgagggtttatcgcgcatctgctgcaaccctaatcaatgtgttttccagtaaatagaggtcaaaaacatggattttcatatgtcaaacataccttttgcctctttatccgatacaaagggttctgcttctccgaatccggctttatcctatatctccgaggcctaagagaactgacagaaggttgagtgccttctttgtgatacttaaaatggatcgatccgctggcaacactcgactcgcgagacgacttcggcgcgtctaagcccaattgcaggttgatctgttcctgaaaataattattaacataaacaataaataagatattttctccaaaatagcagtgatgtttcggccaattattttttttataaaataaaaccgcccaccctccctttttcatgtatgatgatgatcactcacttgctcagagatgggttcctgcttcattaacggcatcgatgatttcgaagtgcttggcacgtgaggaattgcatccaaattctgtgaatagatttggtgtgtagcgggcggcattgggaagggaactccttcatggaaagcagtgggaacgtcaaaatcggaacggccgtcagagggcacatttgcgaaatcgtttacgccaaaaatctgaaatttatttcattctgac

SEQ ID NO: 15883 - DNA, 1982 bp, Heterodera glycines
  misc_feature (1930)..(1930): n is a, c, g, or t
  misc_feature (1947)..(1947): n is a, c, g, or t
  misc_feature (1971)..(1971): n is a, c, g, or t
aatatacttttttacaaatgaaatgggttttcctgttaataaaacactcgcagaaaaaaaaagttttatagcatctttagcaacctggtcatataaattaattttttgataattaaataatttgaattaaattgaaagtatttttgaataaaaattaaacacaaaattcccggaaaccgtttatgcaagaacaacaaccacaacaaaaaaccaaatcccatgacaatgaaaatgtaaataaatttaaatagaaatgaaagcgtttcctcagatttttcctgtctcatcaatcatcaatcgcatttgttcaaattgttttctcaaaattgttccgttttcccatcaaaaaatgctctcaatggcctccccctgtctttttgtaaacttcttcaatggattcggctgatccattttcatgaatttggtccattgaatgatagacaacaggaaagtctccccctgtctttttgtacacttcttcaatgaattcggttgatccattttcataaactttttcacctgaataatagacaggaggaagcggaggtttatttgaatccattggctttttgcccttattttttgcagagaaagaagaagaaccaaattggtttgattggttgctaattggttgttggctgccaaaattgttgcttttccttttgttaccaccaatgctaaggaagtcttggcccagggttgaggtgttttggccacgactttgagttggattcgatgaactgtccaactgatggaattggtcacttgcccaatttggctggttgggttgatagcttccaaatgggttgctattaaatgggttggacaaagaattgtttgcattgtgattattggcaaagttcgttgttgaaccactgttgctattaaatgcattggacgctttactttttcctttactgtcgcccaaactcagccaattttttccaaaagatttattgttcttgtcacccattccgtcacagaaactggcacacaatgccaaagtgaacaatgccaagagcagaagcataatggtggaaatttgtttcaaaaagatagatgggcaaaatgaattgtaaaattgatggatttttttctttttgtgatgggaattgaattttattttttgacgaaatgtgtgccattcgttgatggcacggctatttatagaggcaaagtcttttttcttaccacgtaaagataaagctattatgacgtaagcctactgaaaatattaaaaaagtttctttgtttcattttatgtaaaaggaaattttaggcccggaattgagcaattgattctttttttattgaatttatggaaaagaaagattttaaggcccattaaaagcgaaataataaaaaatagtaaagtaattataataaagatatatatttttttgttttataaaaccaggactcatacatggaatcggaattccgaggcccaaaaattttttataaataaatcatgtaaactgaatcaaaaaaaaaaaaaaatttaattttggtcatttaaatgattattaaatattaaatattttataattttttcgaatagggaaaatttgtaaatctaaaatttttataaaaaaaaaaaatgaaattttggcaatcaatttttgagaagaattttcaattcttagggggtgtatttctgaaattttttcaggcatttcttagggggtgtattttcccgattttatcgcatttttactggaattttttcggaaaaacgccaaaaaaggcacgaaaaaatgccaaaaaaggcatctaaggcacgaaatcccgaaaagggcaaaaaaaagacataataaaactcaacctaaaagcttcaaaccaagtgaaaagtgtgttatttatgcttaatatattgaaattagtgcgcaaaaaaaggcttatgcctcaaaatccgaatttactttacagncctgtggacagacactngtgccaatttgaacattaaactgnccaatgaccaa

SEQ ID NO: 15884 - DNA, 1122 bp, Heterodera glycines
gttgtccgccaacgacattttttgagcttttcgctatatattttttttaagcgtaaataaatttactaaaaataatgactctttttgtgacattatgggacatttttctgcgaatctaccaaattttcaaccaaatttctattaaaaaaattttcaaaaatttcatcgacttccaagaaattaagcctaaaaaattcaaaaagcattatttttgaacataaattcacccaaatttctattccgaagagcaaaaagcataatggaaaaaaatattctgtccttcgaagcaatatattagaaaattttctaatcatgttaagctttcgaatgataccaacagcattggatttggattacaatgaaaaaagttatagaaagttatagtggaaaaacatgctggcgcccaaccgtgcgcgcccaaacgtgagcgcccaactgatgtagaccgtcattaaagcgtgtttccgtgggatttcggagtcgcggacgacaggctaatttatgaaaatgcaaaattttcgagaccctttgtaacctaatcatcacaactgcaccattttctcgaccaaaacactcgcttccaccggtaagtttgaacccgattttggacgttctgttggctttaagaaattggaaaacagttacatattgtagaagtggtgcaatgtgtacaaaagcattgagcagaagtacaacaccgccactctcgcccgccaagtgcgcggcgtcaatgctcactcactcattaatgagtatatttagtgagtgactgttgagagtttgtttgatcattttgagtgtgttgggtgcgatcattagcaacataagcagaagaagcaaaagagtgatgctaatgctaatgatcgatcacacactacacaaatagagcacaaacagtgcgaaagtgcacaaacacagtttgtggtggtgaggctttcttgggtgagagagaacggacggaaaagctgaccctcgtccttcaccaccaccaaatgcatccccaaaaatgcaaaagaaaaattccattttgcaacaatttttgttttaagtatgaaccggaatttctgtggaatttaaagctgttcgttaacgtagccaacagatattagggtatcattttgt

SEQ ID NO: 15885 - DNA, 2046 bp, Heterodera glycines
aaattcaatgacgggaattgtcaatgtagctgaagaaatataaaaaatgctttaatatacaaaaaagtttaaaattactcaatccgaaggttcttaaagcgaattttgatgggcagcggacggtccggcaatggaaatccctcaaaatcttgatccaccaaaagttttgacattccttcatccttgctaatttcgattggtctccaaattgtcaattcgcttttgccatcgaaatgtttgtccaccaaaacatcgaaacggtcggaaatcagtgccattttgaggccaagttgggcatggtcaaaagatgggaaaatgtccatccacacgtcgttacaaatccaactgaaacatgaaaaaaagaattgggaatttaaaattttaattttttttaaaattgcttaccgtctgttcatttttgttgcaatttgcacaagtttgtcgtaagttgtgattgttaactaaaaactttatttgtgttccaagaagtaagcagaaataaaatttttaacatttgattgcttttttcatgttttaaacaaaaaattggcaaaggcatggatttgcagaaatttattgtgccaaccgcttggcggatgatctgctgctcctcatccgctgtgctgaccaatttgcgcatcaaaactttatcgagacccccatttttgtccccaaaatcgcagtcgttgtacacaaaatggcacagccggtccaaatagggattacatgatgcctaattaattttaaaattatgcctaattaattgcaaaaaaaattaattagtattaattaatggttgaacccattagacgtacgtttaactgtccaacatgttcagtggttgcttcatggtccgccatttgttcagcagtcactgatcggaaatcgcattcggcacattggtgaggtcgataattcctttaaattaattttttaaaaatgggttactgtattttcaggtacagtataattagtcattttaattattgctcttacaaatgttctgcaatatgtgccatgaacgtgctgcgggactccgactggccacacatcagacatttcaatactttggtggtgctgctgccaccattagcagaaatcattttgaaaatttatatcgaaaaaatgtttaaaaatattccattaaaaaaggttatttacttttttttatatagcattattagggctgccaaaaatatgcacgaaaagtggccaaaatatgcgcataaatatgcaaataaagtcgtgaaatatgcacaaaaatcgcaaaatatgcaccaaatatgcacaaaaaaacttgaaaattaggggtgcaaattcaaaaaaaaggtcggacacgtcgtcttccccagcgtcggcggcacctcaaaaagtggaactgttgaacatcgacgagtacagcaggaaggagcagacgatgtgcaattgtttttatttgtctctaaagctaaagggcctgtggtcagaaaaattttcaaggggagggcgacccgaatttttttgcctggcaaaactttttttttcaaaaataggcctcgctgtggcaaaaaatgcatttcagaagaaagataaatgtttgatttgaatgggagcgaagaaatgagaaaggaggaatcgattgtatggaagcgaaatttaggtcggtaaattatgtgccgtccccaaccaaagacatattggagaaaagggactgagagagagacagagagagagagagacaaagggactgagagagagacagagagagagagagagagagagagagagagagacaaagggactgagagagagagagagagagagagactgagagagagacagagagagagagagacaaagggactgagagagagacagagagagagagagacagagagagagagacaaagggactgagagagagacaaagggactgagagagagacagagagagagacaaagggactgagagagagagagagagagacaaagggactgagagagagacggagagagagagagacagagagagagagagagacagcgggagtgagagagagagagaga

SEQ ID NO: 15886 - DNA, 971 bp, Heterodera glycines
  misc_feature (862)..(862): n is a, c, g, or t
tttctctcggttcgaaggtcctcaacctgtcatttgctttcattgtacaaaaccgccaaatcggtgtatcaaaatgaatgccctttttttgtcctttgcgtttggcttattcatccttcgtctcccccccccccgccctcccgtcgtttttctcattttgcttcctcaacaatcgcaaattttctcgattttttgttgcatttgttcatcgtcccgccaattatagtacttctcttcgatgaaaaagaatctcttcaaatgcaaaaataatatttgttttttaatttagacaattaaaaatcgtttaaaaaaagctaaatttgaccaatttttattgaaaacaaattcgaataatcaaattttacatttgatttggcacaatttaataagttcgatgagtcattcctcaattggcttaatctctttcctacagtattcgccttcccatcaccacagtcattaccgtaaccatgcgttgttttcgctgtgttctgtgttttgggatttgttttgtcagtgtgcgcgtactccgagcccaaaagtgtccatactggcctaacaaattctggagcactttgcacaacaatgttcggttaaattgccgattaatcttttgttcacaaaatgtgccgcccttcgttttgtgccgcttccccgcggcgagttgggatttccgatggcattgtactcgcgcggttgtgccgatggctgtaatgcccttcagaaatctcatctcgccaaggggcgccgaagcgaaccctccaaatgccaaacactcattttactctgaattgaaaagcggcgattatgattatggcattaatcattgaatgattggagaatgtttttttggtctttcagnccatctccgctaatcagcagatcaaccgactgaatattcgccgactgatcagaaaatctttttgcccttttctgctggccatcatttggaactttcgcgcacttattta

SEQ ID NO: 15887 - DNA, 3353 bp, Heterodera glycines
gatttccggcacaaacagtgcccaacgaatcaaaaacgtcttcgtatcctaagtagaagggttacgatctcgtctcgccattttattctcggatttccttcgaaaaattcccttttttctccaatttttcgatggtgccaattccgctcatcgctttgctgctttttgtgccattcattcaacaaattcggctcgtttctgctcaatccctgcgaaacattcacttgggcttccccgaggcgtgggacggggacaaattccccgaaatttactgtccttcaaaaaacatcccaaaatggttgggtgagcattttttgctttgttatcagttcatttatacaatagaatttaatttgttcacgagaatgaagtttttttgaatttataatctcaattaatattttcccaatttaaatcaaaaatatttaaatttttattttataaaattcacaattcattatttctcagacggttactttctgtgccaactttcggcagcgtacggcgaccccaacgcgcctccggggcagaaactgatgcatatgatcgacgccattggcgtactatattaattaattaattttttattaaatcatttttaattttaataaaggcaatcggatcgttccatctcagcgggggagaggtgaaaaatgattggcaaaaaccagcagagagagagagagtattcactgcttctctgcttccaattgcaggtggtgttctcggcccgctattacccctccaggccctaccgtatctgggaattctacgaccgtaacatgaccaaagcatcgggtcagtggtggtcatttacgcatgggatttcattacggtatacccacccgtccttttacagtaccatgggccggctggtcccactacaatctgagcgcaatggcacggtgggaacaagtgccagctaacccggacgcaggtcggtcaaagcgcaaaaacaaaaaacgaaactttaccaaaatgccaattttcaaatttgcttccacccacacagtgccattcattccattgtctgtccctttcccatggctttagcccgcttccacccgaacctcgacttttggcgggttggccacagaattatcgcgggcaccgaagcgccctattgggtgggctacgaattcgatgttcgttttttggcatttttttaatcaagtcccattcctcaatgaataagaggcattttcacaggttccaaaattgtccaattttcgcttggcctcttttgtggaggacaacgacattttcggcacttcggcacggccttcgctgattccaatttcgatggcaatgcacgaaagggcggacacgacacggaatgccaagaatggcgacgaaattttatggggcactttcagcgcaatgaattttgatgaggagcgattttttcaggcaaaatcattttaatgtttatatatttaatttggaaggatgggaaattaattaattatttaattagaaatcactaattaaggggctgttcaccatcgactcgaacggtgtccgaaaggtggtgggaatgtacgattacggcacttgggacgcaaaagcatgctcaaaagaggacgaatacatcggtgagacaaattggcaatcattgaataattaattaggcatattttctatggaagttaatcaaaatttaaatatgaatcacccaattaattaagacatttctcaatgcatacatttcgggaattcagaccaaaaaatgcccttaagagaaaacgttttaaaagaaatcaattatataatagctctcgtgtaaaattctcccctatttcataagtgtccatttattccgtcaattgtctctccgtcattcaattagcgtcaattagcataatgcgttccttttgccgcaggtgacaaaagtcatctgcccggttacatgcactcgatcagttccacggaacattacgtcattctgccgatcacttcgctggtgataaacccgtgcaagttcaaagagccgccgcgcaccgcgggcgccgacccgcaaattcagcagggcggcctttggggcatggacttttacgacgtggtgccgatgaggtgcgaacttgtgtcaggaaagcacaacaaaaccaaagcctcggaattctgttggcattattctctgtcaggtttttggtattcgacaaacgcaccaattcgtggtttacccaaaagccgttggaagtgttcccgtcaatgttcgtcacccatcagctgaacgccttcgaagactcggaggggaacatcgtggcggacatggtcagtcaattagcgatcattagaagagggagggaaggaaaaaagggccgaataaattgggtaattaagtaaatattaatgactaaagggagggccgaaatcccattaattcaccgtaagtgtgattttggccacaaacgtacagacaaatctttaagtttcatctctgacttttggcattttgccaaggcttaattggggggggggtgattgcttctcgggttttcatttttggctttccaaagattgtctacgacagccacgacccttacgtcaaatatttctacgccgactttcttcgttcccaactctacccgaacactgctcgcattttgcgctttacgttggacttgcgcacttttcgcgtcatgtacagctatttgataccgcaggcaaattaaatcaaattaaattaattggctaattaaatttgataatttcaatccattaaggagaccatttccgccgacttcccccaaattaaccgcgcgttcgactcgcggccttaccaatgggcgtattttgtggagaatccgttcgccgggggcaacaaaattgtcaaaataaatgtcaacgaaccctcggggacaaagtgccgaattaatgaccttttttaaaaagcatttaaacccttccaaaactcagaaatttgcacttcaccccggacgaattgcaattggtgctgcacgagccgtactttgagcagaggccgggcgccacgcgagaagacgacggcattttgttggtcagagggttggagttggaggagaacaaaggcaggcgaaggaggaaaagcatttgaaaagcttattaattaaaattaaaaacagacccggggggtaatttgggatgaaatgaataaaaatgtcatttaaatttcgacaatgaattaaatcataaaaaataaataaatttgaattaatgaacagttttatccttggaattttttcaggcattctgctggtgatcgacgccacctcaatggaagagattggtcgcgcttttgtgccaatttccgtccccttcggcttccacaatcgctttttctctcgccaacagttgggccttaccgtaggcca

SEQ ID NO: 15888 - DNA, 1084 bp, Heterodera glycines
gattgaatttccccaattgtgacaataaatgggaaaacggccgggtcctctaacaaaaaaacagtatttcgtcatttgtagtaattatgtggttgaataattatttttaaatatttaatgattatcaaatatcagtcacaatcacttgtatgactatgtctaattctgtttaggctatcgtggcttgaaaaaataaaatttgacccgatttttgacaggcgcaaatgtcgggactttaagggaagggttattcgaatagttaatacgctttatctcaccgtttatttttctaaggtcaacactttggtcacgcccgatcatacaaagaaagcgtatgttcgcttagccgccgattatgatgctttggacgtggccaacaagattggtattatttgagtatattctgcgctttgtttttttgttttttgcgcataaattgttgctgtttttctgtattgaattgaaggtccatatggaaaaacttccatttttggggtcggaattccgaaatttttgataaaaacggagttttgagtttttttttccaaaaaattagcaatttttacaatttgtgttaaaaaattgcattgaatttcaattggttcggttgcacccaatggatggatgcgacatgggtctccctttatgcccacgtgtgcccctatttggcgattccttcggcgccgtttccgtccctcgccctgcccagcccctctccaccattcactcaaaagggtccaacttgagcacgcgggtcgcggcatggagatcagttgcgctttttcaaagggtcgaacttcgacgggcggaccccgcttatccgtccgaattgctttgtcgcaccagggacaattgttgcgacaattcgacatcgatgactgggacgtcctctcctttgtttagtcattcagcacgagtgacgattctcggcaaaaaaacaacgcccaaaatatgattcatttaaaaaccgttttttcatccctttgtttgttaccgatgctttcatttttaaatgcttaaaaaaattttttgttttcaaaaatcatgaaaaaatgtttccaagggttttctgggttgctgatca

SEQ ID NO: 15889 - DNA, 1960 bp, Heterodera glycines
tgttgttgggacgcgtaaaatgtgatgggacgcgtccttcaagtgggacgcgtaaagtgtcatgggacgcgtaaaaccctctagaacccatttaagtatatttaaaccgattttgaaccaatggaaaattcaaaattttggattttcgaacttttgttcgaattcgggtccggaattggccgaaatgtatgccgtattcgtaatcaccgacccagaaaaccattggaaatatgttttgatttttgaaaacaaaaaatatttttttccaaaaagggggggggtaccatctaaagtattaccctagatgctatcaaaatttgacatagcctgaagaggaagtaaagcatacatccagacagtctcgaattgtacagatgaacagaatgagaacccaaaggctatttttgtgtgtccgcggagtttcaaaagcaaatttaattactggataaagcacattttgtccttactaaattgggtagtactgccaatggtaggaacatggtttaaatgattttttattgaagcactaatgattcatggaccaaaaatatgaaattcgaaatttgagtgacttttgttcaaattcgggtccgggattcggaattggtcgaaatgggtgccggattcgtgatcaacgaccccgaaaaccctttaaacatgttttaatgaatcttgaaacaaaaaaatttctaatgggggaggggttaaactttactgttatccatattttctgtgatttttaagtttaattttttcaagagaggttctaccaacatgcaatattgtctgtaatgcttttctttttcgaaacgagcaggtttattgggaaaaggccgttgcgcatgaattcgattttttaggcccaagtgaaggtaaaataaatcaaatttaacggaaaagtccaaaacacaacaacaaatttgattctttctccaaactttctcagcgtatcaacggtccgttcattcttctggcacttcaatctctcccgccctgatcatgtccacaatgtcgtgagggtgttgtccatcgacggtacagccaaccgattgagcggtgcctataaaaattcgttaaatttgttgcaatggattaggaaacaaacccaaaatttccttgacggtgccttgcaattttcgtgcgattgaacgggggcgcatctgacgagcgatgttgatcacttgttcaatggtcaggttgccgctgtgcttcactaaaagcgttttataatagtgaccagtccatacctactggtattccttggtctattcctgatattattcagcaataagatttcgacgctactttaaaattggcaagttttgaattttactaaaaaccaatgggggggggggaccttttgttcccaaaagttgacacttttaaaattgcgccacatttctaacgagttatgttacgtttgtttcatttgctctctgtgaatctaataaactaaccattcgtgttttggtaccaatagtttgttgattttgaatcgtttaataaaagttgattttactaattgttcataccgttcttgactttcttgcggtcccttggcggttcacgcagttctttgatgatcagagaagcggccgatggaaccacgtctattttggcgacacgattctaaattgtaaaaaaaatattttggtaatactaccgattgtacaccctccgcccactttttgaaaaaaagttttatttttttacaaaaatttgttttataggttttcagcgaaggaaatatgattttcacatttatctctgatttttcattatcattaaaaaagaaaccgcagccaagcggagactcaaaccaaaacccctgtcttatatgacccttggagattaataattaaaaacttttcttcgaaatacattcaatagcttattcaaggcgatttttaagctcttaaatatcggtgtatgagtttttgcgcccgactaatttccctta

SEQ ID NO: 15890 - DNA, 2774 bp, Heterodera glycines
  misc_feature (2632)..(2632): n is a, c, g, or t
  misc_feature (2656)..(2656): n is a, c, g, or t
  misc_feature (2671)..(2671): n is a, c, g, or t
  misc_feature (2702)..(2702): n is a, c, g, or t
  misc_feature (2710)..(2710): n is a, c, g, or t
  misc_feature (2713)..(2713): n is a, c, g, or t
cccctcccctttctctccgtccgcgctcaaatccacgcacacaaacaaacccatcccaacagattgtaaatgcttttcccactaacaaattcccattcgcgcgttctttgattccccatttgcgtaattataataatcgccaaaacgttttttgtattgagatttaaggcttagcttacaaatcacataacttgatcctttttactttcacttccattacattaaattgtccaataaatcaaatacattttaataaaacaaaataaagcaaagatacagcgagaattggtggatttacatttccgagcagtgaaaaacattgggaagcgcaatacatcgcaaattgatttgtgtgtgaatcaatgaggatttgcttacgcaattttatccctccgttacttatccgttggattaaagaaaaatgttactaaacagagacgagaattagaatcattgcattggtagtgagaaatcagcagccgatgatagaaaagggaggttaacaaacaattcaacaaaagagtgaaacacagaagatatgacagacgaaaatggaaatagaaatgtgcacaatcagcggagggggggggggacggaggtaaaatgagcattttattatgcgacgattttctgtcgttttgccctcgtcccacccgaattgcttaaaaaaactaattcaggaaaacaaataacagagcatatgttacaaatgttggcgctacttgcaaaaagcggacttttgcattttattaaaaaccaaaggggcaagggaccattccggtttgcaaaattttgtagtaataaatcgtgtaatttgttacacgggttttcgaaatcgctaatcacatatctggcataaattttaatcaattcctaatccttaacccttaaaaaaattcaattaaaaggaccccctcccttggtttttaataaattcaaaagtccgcgcgcccaaatgtttatttacaaaaattagaatcagtcagtcaaatgaccatctctcttcgcctcgtcttccatttgctcaataaatcaattgttgctacccgtacgtgtcgtcgatcgcgtgcttcgacgtggaagagtattcgactcaaatccggacaaaccgtttatctcgtcgttttttcgggaacgcgaccgactgcgccgtgaaacggagtccgagcgacgcggtttggaactgatggggtccttaaggaggcgagaaaaataggtggaaaagggcataaagtggtgaaaacaaaaacctcaatgacgacaagctcctcatcattgaccttttttacctgaaaattaactatttccgcaaatggacaaataaataatggagtttaaaaatgtgtgtgagatctgtcatgtaaactgcaaaaagtaacgatttctgtgccaccattttaccccctccccattttacgggcctttccgtcgacggttttgtccatgcctatggcttactaaccgtcgcctcattcgactcagccattgcgttctccacgatgttaccgtattcgtcatatgagccggtccatgtccgaacctgcgcctcgtcgtcgttgtctccgaggtgttcctcttcgatacttgttgttgctgcctgtttttgatagaccaccgttgttgtggtcgtcgtcctttttctctccccaccgccgccctttcccgcgttatttatatcgcccgtgctgtacgaacgttgcaaatcggtgagttggacatggctaaatgcggcgccacggagagccgcggtcgcgacaatgtcacgcgcacaagacaaaccacgagagccaagactgaccacctaaaaagcactaggacaaggaaaacggaaaggaaatccaatgcaaaattaacaaatttaaggtactttcctattttgaggccacacccaaaaatttaaaaaaattaataaaagggaacgaaaaataaacaaggcgagcgtaacactagtgatgaagcataaatgaaacaattgcagataaatttcgttaaattgatcagctcctctgtgtttgcagcgctccctttgttgatttttttttaaatttttggtgtggcctcataacaggaaagtaccatttacctaatttccaaatttcatttaaaaaagattgacctgtctgtaggactcattcttggcttgttcgaggaaattgtcaatttcttcctcgtgtttcataaacatcggatggacccaattgcggtataagattgaagcgccccttgtcctgaaaaatgcaatttattaattttatatatataaagataaacttaaataagtaccatggactgagcaaccaaaaaacaaaaataattttcaattcgtagtaaaatggaaacctgaatatatgtaatccaattaaataaattcaattaacagttaataaaaaaaaccaaaatgcgaggaaaatgtcggccaccgcctcacccgcacaaaaaatgccaaacacaatccaatacatcatccattttacctggaagaattatgaaaataaagtaaccaattgttaaaagttacatattccttaacgtctttgttcctgacggctttataacttcgatagaccgggtaaagagtgcctgcggtgagaatcacaattcgggaaagaagggtcgagatgaacatggaaangtcaattagcaagaatttatgatngaaatgatttgcaanatatgtattcaaaatgagcaaaataagcttnaaggcaantanattattatcagcagaaagaagaaaatgagaagaactacaaattaataaatcaatcatggca

SEQ ID NO: 15891 - DNA, 954 bp, Heterodera glycines
ggtaattgctgtttactggaaatgacgcggcagcaattaaaggtgattggcgggaaaaacaaaacgaaaagcgattggagactgactcactttggaattggatacataatagcctaaccgacaccacccactcattcattcagtctcaactttcttttatgctgtggtggtggtacgaatagactccgcctttgcttcccccgcccatcgaagaaatccctccgtccaccccagcagcagctgcaggaagacacaaatcatatgagattaactgctgatggagatgagagtaataaaatggatattcggattgcattgtaattagtattgtttaaacagctaacagatttcaagtgcaaaagtgccagtttaaggtccgaccggtggtactgaaggggccgccgccccgctttagaattttaaatttaattaacaaaaaattgatgaccgaccttcaacatttgatcttttccctgtgtgtgtactgcttcagctatggggtacggacaatccgtcagtggacaatacgtcagaggtctatccgtcagtggacaattcgtcagcaaatttttttaaaacaataatcaaaaattttacaaaataattattaaatttaataaatataatttttttataaattcttaacatttctagttactttatacttcaattatcatttaattctttaaaaatgattatttcataattgttaattttcacataattttaaataaatctgggtattttaaaaataaatttgcacaacatgtggattgttgagtttgtaaaatgagttaccgaatgcacaaaagcctttattccaagggacgaacgcgtgttgtgatcgatcacttccccgccctttccctccgtctgttcgtccgtccgtttgcttgctttttgtctcccagccatcccttccttcgctccttcctcatttgcttttccgtctct

SEQ ID NO: 15892 - DNA, 2018 bp, Heterodera glycines
  misc_feature (1882)..(1882): n is a, c, g, or t
  misc_feature (1960)..(1960): n is a, c, g, or t
  misc_feature (1993)..(1993): n is a, c, g, or t
  misc_feature (2001)..(2001): n is a, c, g, or t
  misc_feature (2007)..(2007): n is a, c, g, or t
ggtttccaacccatcgaattgacgctgcaggaagaaaaccaacaaatgaaatatcaacaaaaacctcatcgattgcatcggcccatccgtctctctctgttgaccttcgccccttcacccacaaaaattaccaaaatcaaaaactaaacttgtccacttttgtaagttttttaaatttcaaccatcgactggcattactaagtgccccgtaaaccaccaccacacctgaaggattcccgcatcacgagcttccttgaagctcataattgaaccatccgcagcatttctcactccttttacatcgaagatggtgtgtcgaacacggctggtcaaaaggccccgttcgtgcgccatgaacaaattaattttctctcctctgtgtatgccaacttcacccagagtcaacacaatttctcctttcggcgtcaatcggcctcgcttcagcgcctctccgatggaaatcagctcatctcctggtcccagctttgatgtgcacacgacatccgtgcgtcgtattcattatcgatactataaacatggatcagagtgccagttatagcaacatttatgattctcacaatgtttccgtgtttttaaacaaagtttgaaccaaaaacgtgaaaatcgaaaatttgagttttccgctttttgtccggaattcggaattggtcgaaatgaatgccggattcgtgatcagcgaccccgaaaacccacagaaacgtgttttcatgacttttgaaaacaaaaaatttttctttaaaagggagggacaaactttactattaccgaaatgagcttaaatttaaagttttaattgataccaagaaagtaggcattgataagtgagagaaaagcagtagaaactggggatggtaagccttagacgataagaccgattttttatttccgcgttttttttttgttgtgttacaaatacatatgtatatacatatgcaaatagctattagtaacggaaccccgacatttgcgtctttgtccaaaagcggattcaaaataaccaaacatcactaaaattaagaaattgtagtattctagtttattaggagcttaattatgttgtttgaataattaattattttttcaaaatttttttgtgatcaaatgatcggatacaatcacattctaccgcttatttaaagctgttaaggctatcagggattgaaaaaacttaattttgaacccgattttggacaaaggcgcaaatgtcggaccacaaaagtcggggcgcaaatgtcgggacatgattaataactgatgagttttgtccttcatatttttgcactgttatttgtttagatatgcgatgacaatgatcagtcgcttcgcttggctaattttgattggttacattttgtaaagtcccaaaatgactgtgactctcagaaagaagaactacaaatcaatggaagtgaaatcgattcgtattcagaagaagacgacgatttcattgatgtttctgattgcgaagttggcaatacgaaagaaatggcggaagtgacgagaaattcgtcaaaacaacaacacattgaggatcgtatcggaagtggtgaagagacgacggaggacgaattggaagacgaagcgcattttgaaacacggaaaatgagaaatattgggctaaaaagcaaagaggaggacacttacgccgactgttatgtacactttattcaatttaacaatgagacttattaggcttaattcttcaatttaggatttattacggttaatgccagggacggtcccaggatgtcggcttggagcggggggtacctcccccgggcgacgaccttttttttcacaccactttttttgcagcggtttttccaaaaaaaattttgtggaacaggaaaccccgggcggntgccgataggccgcccgccgggaaaattagcaatttataatccgatttgttaacgaattttgtccaaaaatgacaaanttttgcgatttttagccttcttttagcagattntcatcaanaaattngtttatttttt

SEQ ID NO: 15893 - DNA, 817 bp, Heterodera glycines
catgacatgccttctttacccctgatatatttaaaaacggtgcagaatttttatttattgatttcacttaggtgttattaacgcttctcggaattccgtttatgaaagcgcccgcggaggcggaagctcaatgcgtggaattggaacggcttggccttgtcgacggaattgtcaccgatgatagcgatgtttggctttttggaggacggaaggtttatcggcacatgttcagtcggaaaaggcatttacaaaaatactgtgctgaggaaatcggcaagaaattgggttagttgtcactcttcaatccgatgactttgtctgaattggaaggattgagaagggccgagtttgtccaattgggaatgctggcgggcggcgattactctcgcggcttggaaaggatcggagttgtcgccgctcttgagttaatttccgaattccgtagccaaaatgctttgattgaggacgaattcgaaagggtttgaagcaaccgacgagtgaattctgcattcctcgcatttaggcattgagctccttaaaatgcatacgaaattggcttttgtcagacagaaatggacgcggattagccgaatcgaccggaaggctgagactgagaagagcgatagaatcgaagaacagcagagagacaattggtgggacaataagccagtgggagtgcataagctaactaatagacttgtaatgcaaaataaccacaaaatccccccccccccccaccattacgccaacccccgaaaatattgaaaaagcgttggcacgtgtgctaacgttttccaaaaccctcagagagtaagca

SEQ ID NO: 15894 - DNA, 3100 bp, Heterodera glycines
atccattttttgattacaaattttcgttgtttacttttaaggcccgatcccgattgatcactaaagttttgttttaatattccgctggtcctcgggtcgtttctcagtcgttgctctaacacttttgtaccaaccggtgatggagcattctcgggtgaccgtctcaatattcgctctaatgcttgattaacattactttttaaatatgccgttccattagctctaagtatgtgtcctttagcaccgataccaaatttctcagggtcatcatttataatcgacataattttttgttgtttcttgactacaaaagacttttgcttttgacgaaatttagttgttcctacacgcattggtcttatcagtggtctcgtctttggtgttgatgttgttgactcagcatcactctcttcagcagtagtgtaagggtcttcaagtgttggaatagagcctgtttcatccaatccttcgtcattaacaatttgagtaggaattttgctatctctttcacgctgttttggtttaaacaccattaatgagccatctgaaagctcaacctttaccggtttttcttcaacttccttcctaagtttcaagaaacgcctcaattcctggttgtaaagtaaattttttgaagtagcgtccaattttcgctgcttcaaaagtgatgacaatttatttttagcattttcaacattaatctcgccagactcaggttttaataaatttttgtacaagtctgaaggaacgagaataaatttattctccatattttagcgcggcaataagtactggtaataataaaggagtcaaattaacgaaaaaaccaccaccgttttgttgaaaaactttctttgcacccgtctcagttctaacttttgctaattttcttacaaaatttgcgtatggtaaaagtctatatttttgtctcttcgtgagcggaaagtacccctttaatatattataactaatttcaattaataatccaatttgctcactagtcgcttctttaaatatttgttgtctctttttaaaagactttgtttttaccaatttctttaaaaaatccaagttttgaataacatttttaggtaaattaatcattttgaatatacaatgctttttcttcatcttctttaaatatttttgtccgtattctcagtaaagggctcgatgctgggtgtaaatccaagaataaatatccatacggtgatgcggttgcatctttataggcacttaggaagaaggaaagcctcttagggaacaactgtacacccaaattacgtatttgtagcgcggcattcggcgccgacattataacaatatattgtgaattaattcgtgctaccttcacctttttttcaaataaattttgggttatgaaaatcacacccatattcaaatggtgggcttttttaatgaataattcggataggcttttctcatcaattattgttaaaaggtcatctagaattaataagagaggcttctttagagagctcagcaattcatctgtgggtgaccctctgtgcacatgtacacccattttttgtagtacaggaatactatcattaaattgaccataacaatagagcaccgattttgggtgtgggctaattaactcatctctttctctcaaaaattttagaaaaaatgttgttttaccgctactggaatggtccactaattaccatgccaaaaggcaattttaatttcaaatcgttcaagtgaaaaaatttttcatcaatcatctttattaattataaatataatgttaaattttaatcttaaatacaattagtgggggttctttgtgtgtttgttatagatatcagtctgcatcatattgtactttacgcaacccggacacatcacttgggtaaagtgaaactcatcttctcccatcaacttgaactggtccttgtgcttatagttgattcgacgacaccctgggcagagaaagttgatcactgcaaactttggccgggccaatttccaaaaggatcgttggtggtcaagtaagttatatacggtgtgggttgatttccgttcactcttttccaactcattctgttttagtggtttctcactgctttttatttctgcgtcttgttgaattacttgctccactacagattggagagtcttctttgaagaagtagaagacattctaatttctaaattgagttacaaaaccctgactatttctctccttaaatacctttttgtttggttaatttatattagtaatgacacattttttcaattttatttctgaataaatattcaaatgaaaaaacaagtgtaaaatagaaaataaagagaaatggtagaaatgaaagactcttttgatagatttgaaggcatatcagaattcatatagttcccttaaaagtgaaaaaacacacccagggaacggcttcacccttcggtccccaatccaaacactcacgcaccaggctgtgcattacaataatgaacagctcgtccaccttcatctcagatggatggcctggagtgttggagaggatcaaccaggggtcattccgtcccacatgagtgatataaacagagaaaaagaaaagaagggaacaataagaaaactaatatttagagaaaaattatacaatcatttgcgataaccaaattcgaggacttggaaggcgttattaataatgccttttgtgaatatgggttgataatgttttgtgagggaatgagtatacactttgccttggataaggttgggacgaataaaatggggataagttacaattatagggtcaggggggtcttcggagccatagcgtaagatttgatccttaacagtatcgtaatgaattttttgaacagtttgtgcatcaagggtgaccctcttattttcaaatcgtgttctatttcaccggtgtccttgcgttgcagcttcatcccataattcttgcagccagcactaatgaactccaagatattgtggtaggggttttcgtctgttagttctccaaggtgtccctttcctgttggtagtgggtcgttttcctcggggtgcacgtagatgacgctgtcggtgtcgtaataaaggatttcgcagtcgggggtgtcg

SEQ ID NO: 15895 - DNA, 2811 bp, Heterodera glycines
ccgctgttcggcttgccgttcagcgtcaaagccaacttttttctgagcactctgactgatcacatagggttttgttagagatgaagtcgatcgtgtgcccttgctgtgccgattataaaattaggtagacacaaaaagcgttggttataaacttttaaattaacgcatgatttgatttgacgtaatctattaatttgaatatttatttgaaaattttaattttcacaattacaattagagaccggacgggcccgggacgcccggtaaaacgggctttttttgaccgggcagcccgggcccggccaattgtcgaagcccgagcccggcattttcaaaattccggtctctaattacaattcacgaattcacctaaattttaaattaaacgaatagttttctctattcttttctcagatcgaaatgagctctcacaagaaaatgaatgggaaatttattgggaagaaaaagcgtaaaattgaaaagaagtggaaaaaggaagaaggaaccaataccaatgacagcaaagggaagaagccatcgtcaacagcaaaacattcgccattggtcggccatgaaagtgatcagaaatggtctgattttgacatacggattcagagtgatcatgcaaaacggggctcaaattccaaaaaacggagaaattttgaaaattttcttcccatcgccacttaatggctttatttagaaaccaagatttttgcattaaaatccctcattttctaaggtacgagagccaatttgatgaggtcagagcagagggcagtgccacgccttccgatgaattggtccaacgagcgcagaatcggggggaggaattgctgagccgtgacatcgcccgttttgcccaatgttcgaattttatgcaaaattccgatcatttttctaggcaaaatgtttcaaaaaattggtgccaagttgtcaaattccgttttgccccttctgtggtgatgacaaaacgggccataaacttgggaaattgtaatttgatttggtcggcgcttaaatatgggaataaacgcgcatttccatggccaattcccaccagatgcgccgccacattttgccaaaatttcccaaaaatctgtgaagcgcatttaaatttcttccccatttttagcctatcggagtcaaaaccgtgccgatgccgactggctggagatggtggccaaccgtggcacttttcccgaccgtttgtccgccctccaattgcgcatccgtcgctcggctgtccacgcgttgccccaattgcggcaatttgtccaactcgcccagcggaaaggggccaaaattcgccaagcgcacacattgaccagtacgggggggggggacaaattgacattttgaatttctgagcaagggcctgtaggactaattttcggactaaattgtgcaaatttgggcggggattttgacagttccatgggctttttggggtcgctgatcacagttgtgacattcattttggacatttccgaactcgaacaaaactagaaaattaaatttttttccatttcggaaaaatttgaaaatttttgttggctttttttcgaattttgggtttggaattcgaaattgtccgaaatgaatgtcatagtcagtcagcgaatccgaaaactccaaatatggtctaggcaccccttagtgtacaaaatttttttgccgaaagcgaggggtccatcggtactagtattaccaaggtttcaaaaaaatccacataattttatttttagaaatttggacccaacttttttccatcgctctaaaaatgccatcccccatttttagaggcgttgaaggacatttttctgcacgaacttttgcctccgaaacggaaactgctcacaatggcacaggtttttgagcaaaaaataaatttaaaaaatgtaaaaattgcataaatttcagaggccattggagcaatgggtcaatccgacggcaaataacaaatcggaggcggacaaacgacttttgatgtggcactttgaagcggagctgaagcagttgtaccaccaatttgttcagggacttcaggtgagcaacttccggcctagtctttaaaaatggaaattttggcacagcgaaatttttggtcgctttaaaccgttcaaatttacttccccccccccccccgagaattttttttgctaacttagaatttttcgagaaaaaaatcttagaaagttttttcatgagaaaattctaagaaaaaaatttttcgagaaatttttataatgaattactaagatttttcaaaaaaatttccaaaaaatcgctgagaatttctcgaaaaattttttattagaattttctcatgaaaaaactttgtaagatttctttttttaatttctcggcggggggggggaaagagctggggggggggcctcgtggacggtttctactacatactgatattgactgtacgacgagccaatatatcaatagaggaggttatagcatgtagtttaagtaagaaaatgtttcttccttatagcgtaagagaaacgatatttatcggagtagattatgaatattctaatggttgctttgacgttgatttgttatcagaaatagtaatagatttatgaattattgacttgcaagtcttattttaattcgaaatagaaagaacgaaacaacataggtatttatccatccttatgtggacggaaatggacgcttggggcgccttgtgatgaactggattctcctttagcggtgggcttccaaagatgaccctaccatagcgtgccagagatgagtacaacgcccaaattgcgctgacaaatggagcca

SEQ ID NO: 15896 - DNA, 1237 bp, Heterodera glycines
atatataccaatgacttgtaaaaatgctcaaatttttgcttttagtgtaatttgcgttcctctgacagaattctctttgacattttgaagaaaattggcgacggacgaaaggtttctttcacttgcgacagttcgcgtgtcgcagaaaacagtcgagtgatagtcagactcaatttggaatcgaacggtaattaagcaaaaaaagacactatttcaataaccccaattaagaaataagcattcttcaaaaggaccaaagcaaaatcgaaggtgaaattccggtttggaaattcatcggctctttggttggcacttattgtgcggatgatcaatcggttaatgagttgacggaccaatggcttgcgctggcctcgtctgtccgaattgatgaactttcaagacagatgagcgttcatttgggggcacacgatttcctcaggtggaaaagggatgggccaatagtgtcacagcaaaacgtgcaaaagatacacacagcaatccagaattttgggactcagaaaattccaaggtcccaccccccccccaccgaaatgaaaatttttaaagaatttccagcaaataatggaataatttttcgaattctttccaccaaacgaaaatttattttccttaaaacggccaaaatagggtcatttttacccagcagcggcaaaaaaagaagaagaaaaggctccccaggttgccccccccccccccccgaaatgttttcaagatacgcccctattgccccgtgcattgttttttaatttaagctctcaacacgccatttgcttgcccgatttggtgttacgttgttgtttttttgataccaaaacgacggctgatttgctgaattggtccagcataaaggcatccaacaatgtgcagctgtgggcgaaacgagtcgatgatgcatgtgcgaacatttgagaaatttgttgttttggtggtaatgctgcagaattgcggtctttgtgttacataaaccccagattttttgcattcttatctttgcttctttttgtgtgttcatttagtgttgtttaacttattttttgtgttaaatttttcattcgttttttacaattcaacacgtttaaagcgttccgttaacttaataccctatttttgttattattttagtaatttaatattaactttttgaaattctttgctcaagggaacaaacaatgactgaaaaacggaacatcaaaaaaatttgctgaatttcaaatgc

SEQ ID NO: 15897 - DNA, 2078 bp, Heterodera glycines
aatttttgttttttagtgtaatttgcgttcatctgacagaattctctttgacattttgaagaaaattggcgacggacgaaaggtttctttcacttgcgacagttcgagtgtcgcagaaaacactcgagtgatagtcagactcaatttggaatcgaacggtaattaagcaaaaaaagacactatttcaataaccccaattaagaaataagcattcttcaaaaggaccaaagcaaaatcgaaggtgaaatttcggtttggaaattcatcggctctttggttggcacttattgtgcggatgatcaatcggttaatgagttgacggaccaatggcttgcgctggcctcgtctgtccgaattgatgaactttcaagacagatgagcgttcatttgggggcacacgatttcctcaggtggaaaagggatgggtcaatagtgtcacagcaaaacgtgcaaaagatacacacagcaatccagaattttgggactcagaaaattccaaggtcccaccccccccccccccgaaatgaaaatttttaaagaatttccagcaaccaccaaacgaaaatttattttccttaaaacggccaaaatagggtcatttttacccagcagcggcaaaaaaaggaagaagaaaaggtctccaggttggccccccccccgaaatgttttcaagatacgcccctattgccccgtgcattattttttaatttaagctctcaacacgccatttgcttgcccgatttggtgttacgttgttgtttttttgataccaaaacgacggctgatttgctgaattggtccagcataaaggcatccaacaatgtgcagctgtgggcgaaacgagtcgatgatgcatgtgcgaacatttgagaaatttgttgttttggtggtaatgctggagaagtgcggacgttgtgatacttaaaccccagattgtttgcattcttatctttgcttctttttgagttgataattagctgatggttaacttattgttgtcgattaaattatcattcgatttttacaattcagcacgattaaagcgttccgttactttaatacctatttttgttattattttagtaatttaactattactttttgatattctttgctcaatggaacagacgatgactgaaaacggagcatcaaaacaaattgctgatttgcaaatgcacgaagttgagcaagggtcaagcagttcgacggaaaaccaagaggcgtacaaagagtgcgttttttttttgatattactgacggtgcttatgaatagatcatgaaccagacccataaccaggggcggcgatggggttgcagttgcccccacccgaaatgcaaaaactttttccttagctttttgaaattttaaccccaaaattaacctttttgggcgaaaggcggctacaaattccttcttttttttcctttttggcgctggaactttaaaaatttaaaaaacgctggaaaaaaaatttttgcctcgaagagcaaaaaaaaaaaaccctcggttgcccctcacgaaattttttctggttacgggcgcctgtcatgaacaatatgttgttttttcttatgtacctttgctatagtttcaatttacacatttaaatgtgcatattaataatttctaaacagaaacatggatgttttggacaaattgttggccgaaggacacaaattgatgttggctcagtcattttacgacgcgtcagttgtgctttgtaaggctgccgaattatcgtgaggctttttgcacgtcaatttattattttgtttcgaaatattttagctcaaaatttttcggcgattttgctcctcagtcattcttgcctcatttcaattacggcaaagcactcattgaggtgagcctatggagcagggatggtctcagggggaagtacgtacactctccacccccacccccaggcccgtatccagaaaaaatttcggggagggcacccgatgagcttttctttcttttttgctattcgagcggccaaaaatttttttttgattcaaaatctctagcaccagagccaaaaagcaggaattaatagagaatttgcgccgaaaaatca

SEQ ID NO: 15898 - DNA, 2040 bp, Heterodera glycines
  misc_feature (783)..(783): n is a, c, g, or t
caacacacacacaaaaaagaaagaaaaactaactaatttctaaaattcaacaagatgccaaaatatgaagtgtaaaattggcgcgacaatcatgttttatggaaaagagtatttattgttggcaccccctccaagatctacccacccaaaattaatttttccgaaagtttttcttatctattgtatttatttagcgacttccctggtgttgaaccctttggtcatatcatcaaattgctttttgaatttaaattaagctgctgtgacgaatttgtatgacaaaaaatttttgataattttttccccaaaattttgcgcaagtctccgtccccgaatataccataaagaattacaactatctctttggaaagacctaaccatgctattaaaatcaattaaggtcaatacccggttgttttacaaaaaaaatcttttaatttacaaagaaatcagtttaaataagattaatacgtgtccgttcctttcagttaaaggctaaaatcaaaaaaacgcacaatgcggctttggccaaagtgacgcgggcgcagcagcgacgagcgatggactatcagcgcgagcaaagggcggcgaaggacaaaggcagcggcaacaaattgcgactgctctcattggacggaggcggcatcagaggattggtactcattcaggtgaggcacagacggaagggcaatacgcgtaatgatgggtactgaattacttcggtgtatacatgtgcaaggggtgtctcagcctaagggccatacataggaaataaaacaggcngggggggggtggtgtcgggaccgattttttcatccgaattctaaattttctctgttgtcaactttttcgattaaatttcgcggcgcgcattttctaaaaattttgggaaccagggaggggtgtggttcggcagtgccgacaggcgccgctgatgaaaattgagtgcaatttgttaacaattcgccaaaatggtcgatttttggaattttgagccaggcaacgaccatttatttcgggataggggtggccggcggtgcctattactgctattcttaacagttttctaccaaaaaaccattttgttttttaaattaatgtattttgaagtattactgctggacaaataaaatacaggattaccattctcattgtgtagttttttttattttttgcttttttcaggtaaccaactctgatggagccgcagtggaattagcaagaagaatttgccatgacaaaaaagttccatttttccggatcacgcctcaactgagagacgaaataaaaatcgacaccacagacaatgtgcaacttataaaaatgatgtggaaggcaaaggtgggagaatgaattttataaattgagttggaatttataaaattataataattcaaataatttttctgcaatttttcaattgatgagaaaaacacaaaaaatacattttaaaaataatttgcaactataacagttaataatcaattttttaaatatactagcggggtcagcgccttcggcgcatcccccgctaggtagtacgattgtagtgtaagattatgtttgataaaatcgactggctcggccgcttcgcggcctcgcatcctttttttgctttttctccaatcgtcggactcaactcaccagcatttcaatcaccgggactcaattctccaggagttcaatcactgggactcaattctcttgcatttcaatcactgggactcaattctcttgcattccaatcactgggacctaacctcacctggtccttcggcattccaatcactgggactcaattctcctgcatttcaatcactgggactcaaccctccagcatttcaatcactgggactcaattctcttgcatttcaatcactgggactcaattctcttgcatttcaatcaccgggactcaaccctccagcatttcaatcactgggactcaattctcttgcatttcaatcactgggactcaattctcttgcatttcaatcaccaggactcaaccctccagcatttcaatcaccgggactcaat

SEQ ID NO: 15899 - DNA, 3003 bp, Heterodera glycines
ctgagtctgagcaagtggaacttctttaaatttaaaaacttactgcaatttcttacccttccgtccaatttgctcggaagacgcgaatcggtgatgcaaaggtcgaaacatcgattgttcattttcaaaatctaaaagaaataataaaatggtaaacaaccgacgaaatcgacctgttcctgtaatccctgcttctgaatttctgcttggagttgctggacaaaatggttgagctgatggtcaccgccggtcatttccatgatgcgattaccaaataaatatgaactataaacgaaactgaaaaataaaatataaatcggaagcaattcacaaaaataaaacagaaatacgaaaacaaaaggaacgaaggattcattggagcaaaaacaatgtttattttttacgactttcaattgaaaaacaattcctgcgaaaattgaaaaacaattcctgcgaaattagacgagaaaagaatcgaatccaacataacgaagtgcgcgagtgcctaaattgagaaaataaaaatataaaaaataaaagagataaatgcacaccgatctccaagatgaagccacaagcgatgaacgtgaaaaagtcgtcacgggccttcctagaagcggaggcctggacctgttgttgaatgttgtggtccataggcataaacatttttagacttcgaatttaggtatttgctcagaagaaatgactaaaaagaaaagttatgttttcaatgtttctaagtaaaaaaaaaatgaaaattaagctgttttaacaaattctttaaaaaataaaattatttgccaacttttaaatttaaaaaaaaataaattatattgccaaactttttcttttgcaatttcaaaactaaattcccttgtttctgtgtaggtgtgttctttctagttttatgcgtttattttcgtaaacaccataccatacaaaaattaatttggatcactaattatcgatcaattagtgtatttatttttcgtcatttcctttccatgtcaatttcttaatgggaaaccaacaaagtcagcacaacaattctggccatgcgcaccatggcaaaaaacaacttgatccacggatagtgagtgccttcaattcgttgagcaacggaaaagataccatcggattggaacaaattaaggcaaatttaaaaaaagcgaattgccaaatgaaatgatcaaaaatttagccatcaatcggcgctaaattggccctgtccatttggccttcacttcaagacacccagcaaaggattacgttggaacagttcgttgaacgtgccgagacaattctgaattttacgccggacatagccgtcagaatgctaatgccagcacaaaaattggtcggtttctccagtggaaaatgcaattgactgaatttggtcccgcttttaatccactttatcttttgacttttccttctcaggtgaccgcttgccttgaggcggacggaatcgaagttcaaactgaggaggaaaaggcctttttgaattcgctggtggaacatatggtgatgaatcatagagagcacttctctttttttgaacggcacttttggtaggaatcgaatgcaaaaacggccgatgctttggttgattggaagaacacgaattgtgctcggatgtgccatccgttggtcgaacgggtgcaatcgcttctcactgccattccgtttaaagtgaattttttggttgccaaatggcaatttgtaaagcgattgacccaaaagcaaggcccaaaaatccattcggccattttgaacgacgtgcaaatgttcatccttcgccacgctcctcccaccactgtgttcttcccagacccatcgcgtcattcgtccgacgaggattggctgctgctgtactcaagcgcaagggatgggatgagcacgacgaggtgggacacatgggaaattcagagtgtattcaaaaccttgggattatgtcgacaaattctaggaattttagaacttttgaagaaaatttaataaactgaaaaataattatatgtttgggatttcttctttaattacggattcgacagatattttcttcttattcaagtcgattttccgccagaaaatttttttatgatagctaaataattggaaaagccacagtttaaacaaaaagttttgatgtataatttcaccgatatgctccaaatgtttctttatcattttgttgttttttaattcttgtagatttgaagcaaaagtgtttgactataagggcccttccgtgctgatccttcgccaaacttcaaacgatatttacgcaattgcgacagatgaagaatggaggtacaccaaacccaacggaaaaagggcgatcgatcggaaattggggggatttgcgaaacgatttgaatcggggagccattgtcccacttttttgcgtgccaaaacaatcaatggatggactttcccatcccattccattttttaaaggcacacctcaaaagcatttggtggtccctattccgtgctgttccaattttcgccccaattcgtccgtctccaattccctccgcccgccatttcttgcaatttcaaggcccgctcttcgccgcttggcctttcctatggcaaccgtttgctgatcgaagaggcgatggccaacgtcgggggaatggaagtgtggggctgtgcaggcgcagagacactgagggaacagagcaaaacgaagcaaaggcacgcacagcaggcggaacgaaatgcgaaagtgcgttttggggggaagggaagcgcagaaattgggacggtcgaaagaaatgcgattttaatgcatttaaaaatattttttaattaaaatttaatacccaattgccacttttccttttgcttgttttcccttcattcactttttgcttttcccattttaaggtgccattgccgggcaaatgggaggaggaaaaggcaattttggagatggccgggcacagattttccagcgaacgacgcgactgacaatgaacgatacatttggaacgg

SEQ ID NO: 15900 - DNA, 1365 bp, Heterodera glycines
taattgttatttaatttacagaaatattaatttataaccttttataaaataatataatagtatttaaagttgtttatatgttatacaattttcagtgccgagaatggcaacaaaaaaaacattttgacatattatcactagggctccaatttataggtgctaaaaactgccaaaatatgaaaactggaattataaatatcaaacaaatttaagaaagtcaattaaccaactctaaaaaagcaaaaattaattcacattaattataaaaggcatctatgtaaagctttagacaaaaattgtgtttgaattcatcgcgactgtcatgagatttaaataaaagcacaaaatttaataaaaataatttatgcaattacaattaattagaaaaataaatgataagaaaattctataattggtcagtaaaaatgaacttactgaatatatttaataggattttacaaataaatgcataatctttaactgatttattaacaaaaatattaatctttattttcattcaataaatccgagaaagcattaattttggaatttctaaaatttatttttacaaaaagtttcataaaaaatgcatttaacacaaacatgaaaaatcattattttaaagccaatatttgatgcattaaaaaaaaggaaaaataataaatttcaaaataaatcagtttgtttaaacgaatattgaaaactagaaattataaagtctaaaattcaaaaagatcgactaataaagtaggaaatttttttttaaacaataaaataattattgaaagaaaatgagcaaaatttaaaaaataatcaacaaatatataataaaaaaaattttctaaacacattttaaaatcaagatatcttttacattcagctaaattttatttatgtttgtcagctaaaaattttgactaggagttacttgacgtctacaatcatgccaatgttccagaggaccttatcagggatattgcgaatcgaaaaataaaatgcgaaatacgaaacacgaaaaatacgaaactcaaataaaatacgaaacacgaaacgccttaaaaacacgaaaagacgaaacacgaaatttttttactgaaaaaatttctatttttttttttgaattattttcaagatttgatcaaaaaattttctaaatcatttatcatcacatttttttatcataaattcataaacttttaaattatgattttttaaattttaattctcctaaattccttaatttaggtgtgatctgttacaaattttcaattttttttgccgcattaattcccaaaaattttttgcggagtagagggccggcggtgccgataggcgccgccgaggaaatttttttcaaatttgagt

SEQ ID NO: 15901 - DNA, 2060 bp, Heterodera glycines
ttttttcaaaaatttgagtgaaattgctaacagattttgttcaaaaaattttaaatttttgcatatttgagcagggcttagatcgaaagtttttcaaattaagaacattaaggaaaaaataagattttagggtccaaaataagaacaaaatggcttcaaatcagttatttttacaatttattcaatcaatataaattattatattttttgtctccaattatcgattttaataattaaaaattttttgcaattaaacccaagagacaaccttttgcattaaaaagcgcttttttttgcggcgcgatttttatggaaaattttgggagacatgggggggggggcgcggctgcgcctaaggcgccgccgggaaaattttgtaatttttaatgcaatttgttaacagatttttgtccaaaaattaccatattttgccataaatcttatttttttgatgaatagtgacattatgccataaaatttcaaaattatgagtatataatgaaataagaacaaattttggtcgatacccaaaaatcagaacatttcttataaataagaacaaatcgaagccctgtatttgagccaattttttatgaataagttttttgggctggcgttgccaattggcgccgccagggaaaatattgaaaattagagtgcaaattttaataaattatgtccaaaaataatcattttatggattttagattgaaaatttaaatattcgaaaagcacctccgggaaatttcggaaattgttacattttcaactatttataacggaaaaaaaaaatttttttttaactttttgtctatcttttaaaagaaaagaaatatttaaatagttttatttttggtggttgggaaatttttgtaattaaatttgaaaacagtcttaataaattatttaaaatataataaaaaaataattataacatgtgcggatcgaaccaagagtaagaccagcgaaaaacccgaagtttaaccacttgactatctgtttttcactatttataatttaaaaaagatagatatatttttctcaaataaatcaaacttttcacccaattattaaaaaatattttctttcaacccactaccccattcttaccagtgcttaatgtttttgtgtttcgtgccaaaatacgaaacacgaaacacgaacacgaaacagcccaaaaacacgaaaatacgaaacacgaaacgatcaacatccctgatacatgagatgtgtaaaaatagttaaattagtaaaacaattatttaattcaaaaacacaaatttataatgaaatgccaaatataatattttcaaaagaaaataaattaatcactattataatgattaaataattttatttcattttgtaaataatagtaaattttggtaagtaaaaagtactaataaacattattttggttatttatttttagttattattcaaataataaacttttcctaattattcgaaattgttgtgtatttgctacaacaataaaaatgtttggtcttcgaccaaaaccaatgttgtcaaataaataaataaataatttattaaacaaataaatatggaggacagcagggaataaataaataaaataatgaaatggtggaatgactgggagaatgcccggagtgggggaaagggagacatatttatggactggtcaaggggcggggatagagacaatgcgagagggaaagaaagggaaaatataatcaataatttgtgtgttcccttatccaacacctcccttctttggaaaagtccctcctgcgcgagatgtcatggccggatgatgtcgtacttcggcttcgacgggtccatgtccaatcgctgaggtgccctattggcgcgtgctgatgttcgcggcgcattttgacttcggccaattggagatttggctttttcaatctccttaatgggggtccgattcgtttggtccacagccaaatcatttccattttcttggccaagttgtgtctccatttccactgggaaacggcggcgaatttggttgacaaggcggtggactgcgcaacggagcgtcggaacgtcga

SEQ ID NO: 15902 - DNA, 2425 bp, Heterodera glycines
gtaaagaaagtttgggaaactgcttggattcaaaaccgcttcaaatttgggaaacacgtccaattcacacttttgatcaaattccaacaatttatgagaagaccaatttaaataaaagcacaattacaattaaaaatttcagaggagaggcgattccaaaattataaatagagaccgcattttgaagcatatgccttttttttttgcgcactagtttcgatatattaagcataaaaaacgctgtttccacttggtttgaggcttctacgttgacttttattatgccttttttgcctttttcaggattttcgtgccttaaatgccttttttggcatttttttcgaaaaattccattaaaaatgcaataaaatcgggaaaatacacccctaagaattgaaaattttttaattagttaatgtgcaaaaacagttagcacaattgtcatagtatttggcttatcctttcatgtccgtccgtttttctctttctttcctttaaaatttggtttcctctcgggcggcaatgtgctgaaggtgaaacttatgctattactataaaaaaaaatttttgtatttaaatcaatttgttgtttaatatttttaaatctctaaatattttgtggtaatttctcatggaaaatggcaaaaaccgctttaaattggccttgtgatttttcggattaattgtatttctaccgtacctccttgatgatgggctcattttgaacgcgagcgatcagtgatttaatttgagggtacgcctcgaggcagtctttttctccaaaatcaatgcattttgcgaaaaattcagcggcataaatatcggcccaagtgatctaagagaaatgtgcggttgattcagcactgattgtgatctgctgattttttagtcccactttgtctttgccaagcaaaatgccgtcgcctttctccaccaaatatttctcgactaaactcgcgcatccgtccaactgcgggcgtatcttttctcggaaaaaagccgcctaaaatagcgactaaaaaggacgacgaccaaaaaaaattatatggaattgaccgatggtacactgattgaatcttaactgattcaaatccgctgttccctgcccttccaatgttttcttgctaattaattaccttatctccgcacggcactaagtccaaacggaccattggccattctttgaaggcaccgctgttctgagtgtctgaaatttgatcgacgatcatattgagaagagcacgttccagcggatcattgaacgatagtccttttttgttcaaatacataaaacaacaatcaaaaaggaattactgtaaataccgtaagtttctccaaggtaacgggaaatggccagggattgggagaacttaacgccgttaacctccaaaacgggaagttggccaaggggcatttctgagaggagaaatgaatcaaaaaaggaaaagcaaactgccgaaaccttctttatatttgggccagtcttcaatgtttatgctcacttcctcaaatggcactttggcgaattttaaaatttggcgaatgtattcgcctcggcctcgaaccccagcaaaataatacaatttcggttgttgagaagacatttttcagtttattgcttatactattgatgttagtttataatttctggtttaaaattcttattttttacatttttaaaaattaattcaatttttcggcttttttttcattggaaggccaaaaaagcgaaaaatgaggattagtggggatgttatccccagaacattacgaaagaatattaaaaatgattaaaagtaaaggaaataaatgataggacaaagggaccgattgttgggtgcccaataattcgagtgtttacatgttgcatatcaatccacccagcttatttgagtgagcgtgcaaagaagaggaagagagatgagaagggatttgggggaggttccggagaaggggagaaggcgagaggaaggaggggcgtgagggaagggggtgaaagggtgagagggagagggggagagagagagggacgaagagggaaagggggtgaaagggtgagagggggagggggagagagagagggacggagacggaaagggggaagagatgggtgattgatgagatgatgagtggagagaactaaggacaaagaatgaagacggaagaccaaacaaaaacagtcaatgtcattatgtagtaaggcttaaatttacttaatcatttttatgcagcattattttgatgaaaatgcatgaaaaacgtcattttagcagaaaatattctcatatccaaaaatattttgggctttaaaaatgaaatttacgaaatattttaactttttatcaatatttgataaatatttttgcatttaatcttttcttaaatattttagcatttttttcttaaatacttattttatatttcg

SEQ ID NO: 15903 - DNA, 2953 bp, Heterodera glycines
tttatttgttatttaaagcaattctgacaataaaaaagaaaaaaaaaatttgaaaaaatttgacccaaaaggcggacccaaaccgaaagagtaccaaggagttaacccttttttatcagcttacgtaaatgttgtccggccaccacccgaatttttatttcttttacggttagttgaccacattttttcctttaacaaagcataattaatgttggtccgataaaaatcaaccaagatctgttccaattagctcgtatgacctttaagatttggcataatatgtcctttgtaactattcccaagaaaatgaattacggaccgcgggatcccacacaaaaacaaaatttgcgaatcccgctgtgggattatttgtttgtttcacatttttggactctgtttcaaggaaagcataaatttcaccaaaaaaccgaccctttttcttactttcaaaatattcgacatttgaagcgcacgcattttttagctttaagtaagtagggctcggatttttaagcgcgaaaaagtccaaaataagtgcttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttagaaatgaagtacatttagaaattttcaggatttaagggtcgattctcacaaatcaggggcgtatttttccgaaattttttgggtcgattcttaggagtgtattttttgaaaatttttaggtcaattctcaggggtgtatttttccgaaatttttttggccgattcttaggggtgtatttatcatttttattgcatctttgttaataaatttcccaaaaatcgcgaaataagaacgaaaataagcataaaacgctaaaataagtacaaaaacttattttatgggcgaacctctaaaataagcatttttaagcacgaaacgccaaaataagcatttctaagttcgaataagtgcgttaaaacacaaaattttcgaacaaaaaatgtgtttttcgtgcatttctcgtcgagttaaagccgcagaaaaaataagcaaaaacttagaaatccgttccctaattcgaatatacaaaatttatgtaaatttatttgcttcttttttaagtgagaatttcttggtaccaattgatctgctcaccaaatacaattactgccgccccaaaaaataaattggatattgttcaaaatggcatccgaattttcgcggtttctcctgtttcagtctcagcttttctttcgtccgtttgttcaccaattcaaatggttcaattggcattgtgtccacaagaaaaaacagttgaattgtgtaactgacagaagtggtggcatgcgagcacagtgtagtcaatccgccgcttaatgatcaggcaatacgaaggcttgttatcgcacatggtcccaatgaaaaccaaaatgatcaaggacattctcccatcatttatagggttaaataaatcagattttaaacaattttttttgcggcgcattttttcagaaaacttggggaacttgggtgggcccggcggtgccgataggcgccgctggggaaaattttgaaaattttagtgtaatttgttaacagatttagtaattaaaatagtaaattaaatgaaaaaaacggtaaaataaagtgtgggcatatgggattgaacccatattaaaaaaacaacaaaaatctgaagtgtgcactgggctttaccagtggcgatgctttggacaatttgcgtcgccgcacttcaccgacaattctcactgatcttgatcaattgcattcgatcgatttcgctcttatgtgctccggcatgattgacaatcaaattctgtccaaatggttgcacacgccgagcaaagatggacaaccaaagcgattgcgtttccgtgcttatgtggggcccacgaaatctcgaatggctcaacaatttccgagaggtgatcactgatcagccatattttcattaaacgacgactaattgatttaattgtccttgattttgacgagcagacaacggaaaatccacaaaattgccaccaatcgatacattgccatcgattagtaaagacattttctgttctggtccattatcgtttgcttttggtacttcgtccttgccaattctgatcatcctccaaattaccaaattggatttgtatgtgcctttatatatgaccgaaacttgggatgtttttgcccgtcacatttggccaatttttgtgacaagcattcgccatttgagctttgccgatggcgatgatttggataatttgcgtcgtttggtttcccctacaattctcactgattgcgaccaattcaaaatcaaatttctggccaggcattgtccaaatggttgcacactccgacaactgatggtcaaccgaagagattgtttgcagtgattatttggatccaccaaaaattgattggatcaacaacttcaaagagtgtctcgccatttttctcaattgtttttgtttttcccaattttgtttagacatttctccgtgccacctcttcggccagttacactgttcgaattatttttcgtgtgaaaacaatgccaattgcgccatttgaattgatgaacgaagtgacaaatgagaagctgacactgattaagggtggagcttttcgttggctgttgaaacggtgcccaattgttggggaggcggcggcggtggtttagaaacagcagaagaaccgtttgaacggagtctacttctgtctttatgatgccattttctcgactaatggtttatataattgaaacaaaagaattaacaaaaacatttctgagagaaaataagcacaacaaattgagatcgatcatttctcaaatacaattaattattctttcccgtaccacttaatcag

SEQ ID NO: 15904 - DNA, 1583 bp, Heterodera glycines
  misc_feature (31)..(31): n is a, c, g, or t
caggcaaaataaaccaatttgctcatgatgnaatccccttattattgtatttattgtctctcactttttcaatttttgaaacaaaaacaaaaaaagggacacagacaaaatgacaaaattgaaaataaaaaattgacaaaatgtcaattgctttaatcatttttgttcttctcattggcttggttgattgattggaatttttgctgatcagtggaaaaatggtgggaattgaaaaggtgatcaaaccggtttatgagcccacagctcaacaatattgcagcagaagaaaagcactaaatatttcaccaaaacgccaatttatctattggtcaaataaatgggaaatttcaatgtttgaactcgaagaaaaataattttaaacatccattttttttaattttttgccggtaattagctaattatcgtgattaaacgaataattaatcatttggcaataccgtgcgataacagaaattatagagcattcatgaaaactagaaattagaaaaatttaattaaaatttaattagatttttacaaaaattaaattcaataagatgtcaagcggacttcacagcaattttttgaatcgctgtaagcaaacgattggcgttttgttttatcttggccttatgcttctgcagccgctcattctgctcgcagttgtcgtttcgttcgcctcgtccccaatattttggtcaaccaaaaaaataaaaaataaataaaagaaaaatattttaaatatttgtttgcttttcttcaggttttgcgcttctctttacctcatttggtatatttcggactttgaaacgccgcgcagtggcgcccgcttcagcgaaagcatttacaattggtcaatttggaccgatttggccaactttttcccaatcgaagtgattaaaacagcggaaatcccgcccgaccgaaattatatttttaggtaacttttgtgccaagaaaaaattataaaaaaattttagtgcccatccccacggcattctcggcacatcgagcgcaattttgttcagcacaaatggactcaactttagaggactttttcccggcatcaaaatgcatcccgtgactttgggaatgaatttttggatccctttccgacgcgaatttattttggcaatgcgtaagtccaatggttttttttaattctgtaattacttcatttagggattatctcaagcgatcgggagtccattaaatacgttctctctcttcccaaggaagggaatgccgtcggaatggcaccgggcggtgccgccgaggcattggaagcccatccgggaagtcaccggctgattttggccaacagaaaagtgaattctcgataatgaattaaaatttattttcgtaatttaagggattcatcaaattggccatccaaaatgggtaataaacaaaacctaaagaagggtaatcaaaaattgccaattagcgcgtcaattgtgcccgtttatcactttggtgagaccgatttgtacaaccaagtgaacaattcggacggaagtctgatcagaaaaattcaggtcataataattaaaaaatgaattaaataatttttggccttttag

SEQ ID NO: 15905 - DNA, 967 bp, Heterodera glycines
actcataaaggtcgattggactcataaagtgcattagagccaaatttacaagcatttcattcattattcatttgctttggggacagaaaaaacatttggccattacttttttgtatatcattataattttttttatcaaaattataatttttttaatttcgcatatttttaatttcagatatatggtcacgttgcatttgcatttttttagggaatgttttcttgctggctttatccgtgtacatttgcttgactttcgcccaaaatatatgtataatcatagggccataaatacaaagctaaattttttgtttatatgtaattataataaaaaaaattaatatttaaaactgaattttctttcattaattggtgtcttatttgtttgaatacattaaacctttttaaaaaaatatttatgaaatttttttttatacaaaattcgatttattatttcatttatgaaaatgtcttcatcattggtcctaattttgcttgtccatttttgtctcgctaccaatgaatcggaggataaaaacaatggcatgttttatttcaatgaagagggaatatcatttatatcgccattattaccatcattagcttcatcctcttcctcattagcttcatcctcatcatcttctaatttcaatcaaatgacattttatcaagcaattcaacaattgccatttgaagaaaacgaagaacttttgctgttgtgttcattttctgaagtgaacgaagacaaagtaccaaataaatttaaagattatttaaaaatgcatttaatatttaatttgggcacattttctaatttagtactattacaaaaccaacgatagttttgcagaaacatcgaatggtaaaacagcacaaaagcaaccacctccttcggcaaaaaataagggaagtaatttattgactccaaataccaaatatggaagattacggtaattttgttatgttt

SEQ ID NO: 15906 - DNA, 1455 bp, Heterodera glycines
atgggtaaatactgtattttatgaaaggttctttatcggaatggcaagtggtcgtaaatatatgaccatgactgtattttctgtgggttttgtgatctttttaatagttcaaatcgaataaactttcaaaaattctaaagttctatcgggttggggtcagttccatactgccatttccataccgccatttccataccgccgtttccataccggccgtttccataccggccatttccataccgccatttccatgccgccgtttccataccaaggtatttaggccatttccataccaaaagtttaagacattgaaattaaaaatccaagaaaaaataacattttatctgtttcaaatcacggtctcatttcataatttcgagaaattccgatcaaaaaagcaataataaaatgatgattaaaaggctgatgaactgggaaaatgttagtgtctacgttgttaagtggtaaataattttgaaccatcgtgagaattcggcggtctgcttcgcgatatttctttgccttttgcggtggttcttgtctagttgaacacttcgcgaagtcatcatcggataacttttgatcctttcgcagaaggtcaatggaatgccaaatcgatggatgtgaacaggcaaatgcgcattgcaggcgtctgttcgcggcttctgaatggttattcgtccggtcatcgccttgcagtgttcgagtgtaaacactccaaatgtttgggtcaaatcgcgggcgtgttcggcttccatcatcctaagacgatccgtgtaattcatgatgaacctaataaataattaaagaacaataaatagtaaacaatttgtgagattgtcaatttaccagtcaagtacgggagtaagttcgtcgggaagagccatgtccagagcaatgattccaggggtcaaatctccaattgggagaaacgcgagcgacgtgacacatcgtgccatttctgcgaatgtcgggtcattttgatagcgctaaaattttcgaaaattcgattttttttgtcatgaattcaacctgtttcagcccaaattcagaattttttttgtgaaaactttggacgaggtggaacagacatccgcgcacttcagtgaatgggaagactacattcagcgcagtgattgccgctgtctcgaagtccatcgaagtctggccacacagcaacgagcatacgaaacatacgctcgtatgtagtgtgcgttttgttggacagcatgcagtagcacactgggatgacccagcgattccgacttaataagttcaaaattgttaactgttaatttcataccgcgccaaaattgcgtacacttgttggaaaggcatcggtgtgatgctgaaggcgccatcggcgaagcactctttcatttcatgcgcccacagaccattcgattcacgtccacatatcagaattcaaaattgcacatataaataattaaaaag

SEQ ID NO: 15907 - DNA, 1968 bp, Heterodera glycines
tttttctggcaattgcgttgacggctgaaccaaatcgcgaggacgtcttgattggcctcgcacttgattttaaaacactaattccttttaataaacttgacttagtttcgggaaaaatttgtgcgtaattctgatagtgtgtccaacaaaccaactttatctggtgtttgtggttgaatgctctcagtgtaacgcttttattcgtccgtcccagtttacttacaatgagttgcactctgctctgctctgacatcggcttaccctcctgttcaacgattgaatttggaattaaactgccaagtgaattgtattttgaaaataaaagcctatgctgactgcgccaatttgttgtgtcgtttatcaacaagaataaatataatcaataaacaaatgaataaagtcagaggtgaagagagagacaaagtgtgtgtggggtgaaatgcaaatgataaatgagaatgaatgaagcccgaagcgaggaaggagggaatagagcagtatgggatgatggtgacgtacgtgtcaataacataatgccaagaaaatacgaaatggcaataatacaacaataataaaagaataaaataattttcaatgatgtgttttcatatttattttttttattttagttatttcaacaatattttgatctttaataagtgggaagacccaagacaagttgcgacaaaatgtgatggataccattgctttcttatgactgatcagaatgaagtaaacgttttggcagttcggtacttggacaatcagtacgaacgggcaaaacgtgctaacaactggtacaatgagaaagttgtcgaaattgcaaacgtcatagagtaaattattcaattataaattaaaaataattttttaaaccgctagcagtttgaacaaaagaaatagaagttttagttagcttaaagagaaaaaattgttttagttagcttaaagagctttaaattaaaacctttttgaaacattaggaaaattaaatcatatataaataattagggccgccatttataaaattctgcgccttgacacgcacaaataagcatggaaaatgggtttttagcttagtttgggatttctacgatgactttatatgaatttcggaaaaattcttaacaaaactgaaataaaaaacgaaaaatacacccctaagctttgatttgaaaaatattcttattcgaaaaaactaaaatataataatttcatttacgattgaaatataaaaaaattaaccttcttgattctttatgggttttgctgtaaaatatttaataattttatttacaactgaagtataaacttttgttaattttttatgagttttactactaaaaataggcaattaaaaatttatttgcctatttttacctatttaatgcctattctgcgattttttgtcactaaaaatggcagccctaaaaaaataaattggtgaagaaataaatttgaacccaattttgagaataatctcatatttccggtgcggaactgtctgcatcttcatacataaaatgaactcgtggctgttttaactgatactggcaaatttttaattttgataaatttgagcaaaatccaaccaatctaaaaattcttgatggttccttttgtaccggatgaggctcctgatataatcgttagggtaaataaaaaattaattaattgaccttaaatagtttggccttttaagctcagaataaaaatttattgccgtaaaagtgtttaacttcttgatgaaattctttcaaaaaatctttgacaaaaaatcgttgcctctattaatttcgagcttagaaacctgattaaaaggcatttttctttatctcttaaagtgatgtcttatcccgcaggcgcatatcggcatcgcaaaatattccttaatttttttaagattcaaaaatgtttttgaatttaataatattctattttccaaaaaaaaatgtttacgaatcagtt

SEQ ID NO: 15908 - DNA, 1285 bp, Heterodera glycines
  misc_feature (81)..(81): n is a, c, g, or t
  misc_feature (1253)..(1253): n is a, c, g, or t
gaggcataaagcgaggcaaaaaatagcaaaaatggcaaattcagagctgtgaacgaatttttccaaaatttcgtcatttcnaataacaataagattttggaaaattttatacaacttgtttacagattttgtgcaaaataagcatttacaaaaaaacagtaaaaaaaaaaaatcaaaaaaccggttctagaggtgcattttttcaccgaaaggagttttttgtgactgaagaaatttattattttttgatagtattcattagggctccaatttaggtgctaaaaactgccaaaacagttaggttttaggttcaaaaaacccccaaaacaagaaaatatttaaaaaattctgcaaatgaatttttgagaaattttgatttcttaagggtgaattttttaaaaaattttcgggtcgattcttaggagtgtattttttggaaaaaaaaatttaggtcgatttagggggtgtgtttttcctttttattgcatttttgttaacaaattttgggcaaagcgtcagaataggtgaaaataaggtttttcaaaaaattttaggttttttaggtgctaaaaataaaaaccttgaaaattggttctaaaaacttgaaaagtagcttaacagcccaaaaaaaaacaacatgtttttgtgcattttagaccatagggagctcaggaaaaaatagttaaaaacctaaaaattggagccctagtatttattcattttaggaaaattttcaaatattgatcattaactttgattttatatatttatttcaagattataaaatatgaaaaaataggagcgaatcgacaaaacagagacaccattattttctagacgaaaccccaaattagggaatagcctttaaataccacaaattaccaagaataagtatatttttaatttctaaagaagtcgtaatacgggtaaccctttaaataaaaatagaaaaaattatttttataaaaaaaaatcttacgtaccaaaattattgaaaagcccaaaaatccgtaacccgtaatacatacgggtccaaaaacgccgtaatttctataatatgtaattgcgtgcagtcctgttatgcactacctcccgcgcccacaacaaagcgacccgcccattccgcgatgtgttaaaaagcttattagacaaaacaaaaaatctaaatcaaatattatctcagctctttataaaaaggctttaaagcctttctcaaatagtgtaaaataaaaatatttttaaattttatttanatttggaatgaattgcacttttttcgcctttt

SEQ ID NO: 15909 - DNA, 2579 bp, Heterodera glycines
cgttgtcggcttcagtcccacgaggagttggacagtgctcactccaaggcattgggtgagcatgggaaggaaatcttttgatttcaaattgtggtttaagaggcctccgaattctttttttaatcctagaaattttcaatttttcccctttctttttgcttttcgtcagccaaatttttttctcaccgcaaaattttgcgtcaatttttgtccttaattttcatggcatttcataatactatacaatacaatcagcaagaaaaaaaaacgatgggttcaaagactaatcgccccaaatccatcggcggttgttccattctttcgcggacaaaacgagcgttgcaattgcggcaaaacctgtttaagtgtcaaatgttgtgtgtttttttgcacacgccgacattttattcgttttattttgggagaaattttctttgcctcggcagccctttctttgttctcttttcttgcgcaacactttgaagggagtgaaagtgaacaatgatgaaaatgaatgggaagcaatggaaaattttaaaaaatcgccaaatttggttgcccaaattgttcattttttgcacacattttcccatctattcccccaaggcatttctggacgtctccaagtgttctacaagggccaatttatgctgacggacgcgccggagggcgctcgggacgaaacgccgggggcgacgccgcaacaacaacaatgaggactgaatggtgatgatgatgatgatggttgacctttgatcgatggtcgctttcatgttttttcttcatgggggaagcacggcatttgttttggggtcattgccgccctaattgtaattagacacatgcatttgtaattaattactctggagggtaattaatgaaaatattcttctctgatcagtgaatgaatgagtgatcactgctgctggcccaacaaaaatacaataattaaagaactgaattcaaatgggagaattccatttttggcactgttcaaattttgaagggtaattagacctaattatgtgcaattactcaggataaccaataatcatgttaaacattgccgcgcttcccttactatgcgctatataaatactaaattggccctttgtaattatttgttacatcaaccactgtgcctttttcgaactttcattgccattatattcctccaaatcgtgctgttcgtttagtacaaacttgataatataccaatcgattcttctcgaggagttaaacacgcaaaaataggtctccagctgggaaacgccataaaccggtctttgaaccggttaaaaactaaaatggaaccaggggataaagtctacccaaagcaatctgtgcggcgctatgtaatttcgacactgagtattttcgacactaagaaatttcgacactgaactatttcaaaaactttcactgttttcctgaattttcgacactggactatttcgacattgagtaaatttgacactattgcgaatttttaaaattaatatgaaattttgaaagtgttagtatttagttatggtaaattttcatatttcattttctaattcgtaatttttaaaagggtaggtggtacagtgtgttaacttaaaacaaagacaccctatttttacacggcgattcaattttgggctccaagtacaaataagtttattatttatttagtaatcagaacgccaaaactttgcaaaacttaaaaattttatgggattttcccttgtaaaaacggaagagccgatcttgagttaaaaagcattttgacaaaaaataaagcatcatcctataggttgggttaaaatatgtgtttaagcaaaatttcaagaaaaaataccaacaggaaaaaattttttccaagggcaaagttttttctttttctctcattttgacgcactatttccatgcctctaacatataaaataacacatggttcatttttttgtcaataaacaatttttttaaacttttgactaattaagaaatattcttcagaattttcccttcaaaatgagcataaaatggttttatttggtctattattgaaaaagttataagctaaaaaaatttcataaaatcaagggtaaaataaaatgtttaccttttattgtttgtatttgttcttttggcgttctgtttttattattttttttctgaaaatattaagattctaaaagtgagaaggcgaaatgacgagggaaaaaaaaacttacgaatttttttccgaatcgcgaaataggggtgaaaataggggcgaaaaagtttcaatgtagaggtaaaatttattaaaattgctgttttttctatgtaaataagttaaaattaaggcaaacaattttattcactgattttcgaaatttcgggatttaagggtcgattcttaggggtgtatttttccgaaattttttgtgtcgattcttaggggtgtatttttcgttcttaatgcattcttgttaataaatttcccaaaaatcgcgaaataagggccaaaataagggcaaaacgccaaataggggtaaaaacttattttaggggcgaacacccaaaatagggctagggtcggatagaggcgt

SEQ ID NO: 15910 - DNA, 2639 bp, Heterodera glycines
gaggagctcagcgacataccggcaagatttggtactttgagggggggggctcgcgaaaaaaataatttggcatgcctaaagtgaaaagattcatccctttttatacacagatagtcagtgctggacaacggaaaaattctaaaatccaaccaaagtgattagggtcggaaaaaccgattccggcatctattttcgcccaattcgaaccccgaacccggaattcgaacaaaaaagtcaaaatccgttttttaaaaaattcacattttacacacaaaatcgcttcacaatgccacgacgacgactcgtatgaccaaaaaatgccacgacgacgactcgtatgactaaaaaatgccacgacgacgactcgtatgactaaaaaatgccacgacgacgactcgtatgaccaaaaaatgccacgacgacgactgtatgactaaaaaatgccacgacgacgactcgtatgaccaaaaaatgccacgacgacgactgtatgactaaaaaatgccacgacgaccactcgtatgactaaaaaatgccacgacgatgactcgtatgactaaaaaatgccacgacgacgaccaatcgtatgaccaaaaaatgccacgacgacgaccaatcgtatgaccaaaaaatgccacgacgatgactcgtatgactaaaaaatgccacaacgatgactcgtatgactaaaaaatgccacgacgacgactcgtatgactaaaaaatgccacgacgacgactcgtatgaccaaaaaatgccacgacgacgactgtatgactaaaaaatgccacgacgacgactcgtatgaccaaaaaatgccacgacgacgactcgtatgaccaaaaaatgccacgacgacgactgtatgactaaaaaatgccacgacgaccaatcgtatgaccaaaaaatgccacgacgatgactcgtatgatatataaaccaacaaattatatacaatattgaaatggcacagtgccaacatatcatttcggtcatcataatcgccatcaatcaaccaattaattcattcatttcctgctgttgatcagtgatcactcggcccgggagaagcggcgtcgaaaagactgaaaaaaatggtgaatcccaaaaaaatttgtaacataacatttttggtacatttgaaagcgcactaagtcgaagcaattgttaattagcaaaaaaaaaaaaaaaattagatttcaaattattaaattattcacccttcgtcaaatgcgccgtctgtgatcaaaaagtgaactggattcggtgaatcattccatatttcatccttcgcatttttccaatttctccaatcccacgcaattggacaacgtttgagcaaaaaagcatttgctgattgtagaagaaacaattgctccccagtcgcttcgttgatccgatcaacaaatggcacaacagagtcaatcggagaagacagccgaaagtgaatgcggaaagtaaccggagaagaagcattggaaaatgcctaaaaatgtgacaaaaatcacaaaaaaacacacacaattaaatagggataattaccgttttcaactgttccaaggtggaagaccattgatccggtgaattaacagagcatctgagccacttcggcataccatccggactgggcgtgaacagccatttggccaccgcttggccatccgtcgccatggcactgtcatcgggcggaaaagcggggagaatggcatcattgaaagagacagcgcgaagtgatagacaattgctgagcagtgccggagccaattgacgcaaatgccgaaaagcgatggtgttcaaaattatggcacgaattgagtcgcggagcattggccaaatgttcaacaaaacaaactccgaaatgcgaacattttcagtgataatgatcaaatcgatggtacaaatggcgaaaatacggcgaaaacggcggaaaaattcgatgacattttgatcgatgtaactgaaaatgttataattataaatcaaatccaaaaatcaatttttacaggatttgaatgcgtttgaatccgatgagtttgttgggcaacggatttcgagggattggcaatggatttccagcagaattaacaatttgcattttcttcgtgccattttcttcaatgtcccattggattataaatggtttgttcagcatccatttgcgtgttttgaaatgttcgtccactcggaggtcaaaacgacggctgatcagtgcaatttcgaggcccagctgagaaggcgaaagaaagtcgaacacttcaagccaacaatcggcagagataaagctgaaaaattgaagaatttttcgaaatttttaaatttttgttttacatttctttttttgtagagaggagtcgttttttgacatgatcagaaaagaaccaaagaatgctgccacagccggccaacagaacagtcacggcacaccaactgaaaaatgaattgggcaaatgaatgaataatgaaagggtcaaagatcaaagagtaatagtaaagtttatcccccccccctttttttgaaaaaattttttgttttaaaaagtcatgtaaacatgtttccatgggttttcggggtcgctgatcacggatccggtatccatttcgaccaattccgaaacccgggcccgaactcgaacaaaaa

SEQ ID NO: 15911 - DNA, 3440 bp, Heterodera glycines
  misc_feature (1927)..(1927): n is a, c, g, or t
gcgcttcgcgcctgttttttaattttttgggggacagtcgtgcgctatgcgtaatttattaattttaaaataaaaaaggaaatttaaattaattaatagaatcgaaaaaactaaaaaataaattaaaaaataataaacacggcctgggtccgaacatgcgccccacccctcagaatctccaatcacacagtgattctgaggtcttaaccatgtctaaagtaaaatctgattacatattcgtgatcagcagcccaaataacgtctaaagacatatttttggaagatttttggtgaaagaaattttcctctcaaaaatcatggtcacacccctgtggtcagaaattacaaaatcacttttatttctataacttttttcacaaaagtgataaaaagctaaataaaatttataagatagagcaaaaaattgcggattttttgagtatattatttttataaaatactttttcagaagggagttaggaatttttttctgaaaaatcgaaaatttccagaaattctggaataacttttattatttgcaagatagaaatcccaaataaatctcataaaattctcctaattttttgctatttttcaaactttattccactaaaattgagcaaaattgaagtgatttatgaatttttaaattttggcgtgaatttcggaagccaaaaaattgacgatttttcgaaaattttttatcaccatccaaaaaacccaaaacacaatataaagtgcatattcgtgttcagcacctcaaattaccccacgaaagtattttttggcaattttaaaagcaaaaaaattttttatgaaatgcaaaaccatagggtcccccctatggttttgaatttcaaaatcggtttttattttataactttttttaaactcgtgataaaaacatgggataaagcacattggatagagcttaaaattctctacaaaaaagctcttgcatgatttttcgctaaaatcaacccccggcgagttatgggcccgggactgaaatgtcccgctcaggccaaaaaatttttctatttccggtaaaaatggaaatttttctgaaaataccaccaatcgatgcagcacgaaaaactatgttttggaggtggtctcagttttcccaggaaaaatcggcaaaaaataataaaattcaaaaaccaaaaaaccgacttttaggcctagctcgaaaatttctgaaaatttcagaaatttaaaaaattgacaagatagagctcgccgagctgtacaaaaagttcagcggcgccaacacgctcagcgcaatgcccagcgagttattcccgaaaaacacaaaaaccggaaaattggaaaaaaatttttacaattttttgcaggccagggctttggtgctaggggctaggtcaagaagaaaaaaatttcccaaacattccaacttagtcgcctcccagcagaagttttttgctccaggttcccagaaaaaagttatggccccaaaactgcatgcatttttcctcaaaaagccgtttcagcgccgctggcgttcaactgtccgtcggatcgaaaaacctatagttttcccagatgcgcctcaaaaagttggttaagcaatgtcacacttaaaacccacccccggcgcccgttcccgagattttggttttagcaacgaaacacgatttgattttatagtatataaactagcgggtgcgtgaaccgtcggatctgggaatgggataaagcgcttcgcgctttgggagcttcgctacctaggctgtaaagcgattcaaatttatcgaattggttgggagaggtttttttgaatttttaaaaaattattaggggtttttagtccacatcgaggctcaagacgggcgcttcgcgcccgtttttttagttattaggccgcttcgcggcctcagtcgggcgcttcgcgcccgtttttcanaattttgttggccttggacgggcgcttcgcgcccgtttctaaattttgttgaacttggacgggcgcttcgcgcccgtatttaaatgttgttgagctcataagaggtacaaaaattgttggaagatgtgttggaagaggtacaaaagtgataaaagaggtacaaaagtgatgagaagaggtacaaaagtgattagaagaggtacaaaagtgattagaagaggtacaatggtgattagaagaggtacaaaagtgattataagaggtacaacagtgattagaagaggtacaatggtgattagaagaggtacaaaagtgattataagaggtacaacagtgattagaagaggtgcaactgtgattagaagtggtacaacagtgattagaagaggtaaacagtgatcagaagaggtagaacagtgatgagaagaggtacaactgtgattagaagtggtacaacattgttaggagaggtacaatattgtttaaaattaaataaataaggaaacgtttttattaaaagttaaaaatcgagtgcattttaatttaaaaattttttaataataaaatactcttttattaattaaaaacaaccttggaaattattaattgaatatttatttaatttgaaattaaatgaatttttttttacaaattcaaaaataaataatgaaattctttaatttaaaaaaaataaatttaaataatttaaaagaaatcttcaaaaattaattaaaaacattgtaaaataagccaaaaatacaaagaaaaataatgttacaccgtccggattcgaacctgctgcccccccccccctcagaacatgtcccagaatccccaatcacacagggattctgagggcttaacgatgtcaaacgtaaaatctgatcacgtattcgtgatcagcggcctaaataacccctaaagacatgtttttggaagatttttgtcgaaaaaattttttcactcaaaaatcctggtcacccccctttggtcccgaatcccaaaatcacttttatttttataaaaattcttaaaaaagtgataaaaatgccaaataaaatttaaataatagagcaaaaaactgcggatttttgtagtattttatttttccagaatatcttttcagaaccgagttatgaatttttttctgaaaattcgaatttttccagaaattctggaataacttttttccttttttagatagaaattccaaataaagtccataaaattctcctgatttttctctatttttaaggctttattcctgtaaaattgatcaacccttcgatttgttatgaattttcaaatattaagccaaaatcccgagggccaaaaaattgccaaaaaataaagaatttttaaaatattccaaaaaatctgaaacttaaaataaacatcatatttgtgctcaggaccctaatttaccccagaaaaatatttttcaccctctttttcaacccaaaaaaaatttttgaaaatttctagggggcctagctcgaaaatttttgaaatt

SEQ ID NO: 15912 - DNA, 1485 bp, Heterodera glycines
atgagccggagccgaagaagtcacggctggaagaaggaggagaacagcaggagcaagaaacggagcagcgaccagcttcgaccggcgcagaaaaagactccatcccaatggagcagtcatgactctgatcgtattacactaaccattcacattgaccaactgtctgtcaatgggtggcgggtgtaatttacgttccattccctcgctaattatttaatggtctcttttcgttgtgtttgtccgtttttccacttttttttattttttgtataagtaaaatgttttcattaatattattttttatgtcgattatcaattttcatacctttgtcaatttttgttaattctaaaaccttcaaaaagatttaaacagcaaaaatgacgacaacaaaagaagggagcatcaaacgcgagcagttttatgtgcgctattatgttggccacaaaggaaaggtgagaattgtgacgagtgttaattcgaagttggtcttttgggtcggagtcattttgagtttttggtaatatggtgcggatttgttcaccgggaaagcaaaataattttatttttagttcggtcatgaatttctcgagttcgaatttcgcccggacggcaagttgcgctacgcgaacaattccaattacaaaaacgacactttgatccgaaaggaatgctatgtgggcaagtcggttatggacgaattgaagcgtatcattgaagattctgagattatgaatgtgagttgttggcaaacatggtcataagaggattatgtgtcgaatggttgcaggaggatgatgccaattggcccgaacctgaccgagttggacgtcaggaactcgaaatattgagcgggaatgaccacgtgtcattcactaccagcaaaatcggttgtctcgtcgaagtgaacgacagcaaagatccggtgggactgcgctcgttttactatttggtccaggacttgaagtgtttggtgttctcactcatcggactgcacttcaaaatacgaccaattgcgcaatgatggactaattggtgacgttcttttaaacgacgaattccttttttgataagcgactttttggcataccaaaatggaaaacaaaaaaagaagacttttggtggtttcataacaagaaattttgcccattgtatgccaatttattttggacttttgatctttatttaacacgttatctcttcaattggtttgttgtttcaccaatttttaaaaatactggaaaaaacattatcatattcagtccaaattgcagggaaagatttggctttttagtgttttcctccaaaacagatcagcaaaaagttatatactataaagacgattgccgatgagacaaaaatccattaatattaaactattaataattttactagtagggtgagtaaattcaaaaggtcccgtgaaggacaattaaagcggcaaaaatcttggcgtaaaatttatatggcaattcattcatacaaaa

SEQ ID NO: 15913 - DNA, 1362 bp, Heterodera glycines
attcatttgcaaattcatttttttgttcgcccgttttctaaacatcaatcacgggaaatgccactgttcgtgtttcgcttatttttatgtaatggcggttcactggaatttgacgaaagactgcgcgatgttcgtcgaatgagcatttggatgtaagctgaagaatgaatagagggggcatgccaaaatggcaatcaaatgtaaaaaagattccccggggatatcctcggaaatgaaatgccggaacgatttgtttggtgatttaagccttacttctcatgcgatttgtgaatgcgatgaacacaaaggcattgacagaggcggaaaggaccgagaggattttgctgacgtgcgattggatgtaatcggcgcgggtgggacaatcgtcctgaacagaaaatggcaatgcgttgtaataaagccggcaaatcaaagtcatgtttgaaagaacccataaagtcggaaaatgcaattggatgtgttgaaatggtgcccacctgggcaagcagttgccatttccgagccaaaatgtacaattccatggaatggagcacgagataaagcaaaatgatcagaacgatggaaagagttgcccgatattctgaagaaaaggcaaatgacaatttgcaaagtaatgtcatttggccactataatcggcaaaaagcggcatattcttccgtcccaactcacaaacattgccttgtttttgccgtacgccgtcgattcgccttcgcaatggatggcttaaagtgaattgcctttcggtttaaaatatgtagcttttcccacgtatccttcctggttttttctaccatttctccccaattttcccaacatttctccgtttactcgccttgaactgctcgaccttcgccttttcacaattgcgccttgcgagtcgcatgagacactgaactgagcataggcgaattgtcgactcttcacaatttcacacagtgtgagcagcgaaaagacgcacatcagaacaaagggcagaaaatgcgaaacgatgggatcgatgacggaataaagccaaatgcgatagggagaaagcatctgacaagccaaagattaagcgatgagcatttgcaatggcatggccaataagggccaaaggaaagctcagccggcacagatttgacggtgcaaactcccccccccctgccttagcccatgatacggtatggcaccgtatgactacggttttccacaccggtcgcccctttaacttctgtggtttcgagtcgtttctgaatgcgaaacacgggctgccatttgatctgaagttcgaccatgaaggacggtaagcgatagaaggttatggcaataaacagaatggccatcagagagcgggctctact

SEQ ID NO: 15914 - DNA, 1828 bp, Heterodera glycines
cagttcggctgtctttccccgcctcccccttccttttcgcccttatctttttggcctttttgctcagctcggtgccttcctccgccttctgcttgtctttctccgcttctttcccccctttctcctccttctctttccctttttcacctccaaaactcttttcccgttgcaccaacaaaatgccattagtgaacaaaagtttggccaattcgacgttcgcttcttgcgattccaagcccaactcgcccacttccaaccaattcgggtaagagtcgaccaaagtcacgaatccgtcctcaaactgaaaggaacgggcaattaattattggaagccgacgactgtcagtcagtctcttcacctcaatgggaaaatcaattgttttttcgggatattcttcacaacttcgagaatttgccattctgtgaacaatgaatgccttttcagcgttttcaaaaagaagtctaaaagtaaatggaatcgattttcgggattgatttcagaggagtctcttaccgttgggtgtgctttcgcaccaatctgacctccgttttcttcccaatgtccaacgacgagtcaatagcaccgccaaaacaaatttttgtttcttcctcaggggtcaaaagcggaggtaaagcgaaacggaagaattcgcgggccatcaaatcgatgtaagagggaacgaaggcagcgaaattctcaccaaatttacgagagaaaacttcagcgacgggaataattctgagagaacaaaggaggaatattgaaatagcaaaacaaattgctaagaagtcccacttctcctcgagcgtttcttcgcccgggtaatcgtttccgctattcccggccatgtcgaacaaaagcggaggcaaattcttacgaagatgttttgagcccgaaaccattgtcttaacgaattcggcggaagccttctcaagaaagtcggtgaaagaatggccacgacaaatggacacttaaaaatgggaaaataaacaaaggaaaagaaggaaaaggcaccgaaaacacagagcgaatggacgtcaccggcactcgccttaataaagggacttttgttttgctaatatttaggtttcaccttgaaaatccaccccttcgggatgtacagagtgtcgccttgttccagccatccttcaaaagttggctcgcgtccatcaaaatctgattcactcattgtgccactcgaatccaacggcgaagtatccttatcacttgcgggggaataaactttaaaatatttccgtccttcgatttgaagcaaaaaggcatctaaaaagcattggttgtgaatataattaattaatcgtttattttcgaccgttgtcctcccaatgtggcgcaattgcggaagtgttcggaggagtcaaataactgaacgaaatgtccatttggtgagcagacaaaagaactgaccattttgcaccgacaaacgaacagaacaactcctgcagaacatcgcacagataccaaatgttgtcgttgtagcactgtggtcggtcgaattgtgccgcccgtccccgcccaaaatgtccccaaacggcggcggcagtcgctcgttcgccgtcggcacaattatggtccgttggcacatcattttcatatagagacaagttcacatccgtgccaatgtccaagtcaaactaagaaaaatgcaaatacaattggtattttaaaaagccatccaattccactttttgcagcattttgaacaaattgacagtcccaaagaaaccctcgaagtaatccttggccttccgatttaccatcaaaacacgtttattgaagaaatcgctaaatgaactgcttaaaaat

SEQ ID NO: 15915 - DNA, 1649 bp, Heterodera glycines
aatctctccacattccccctttctcttccttccttcgagcacttccctttctctctattcttcgatcccctcttcctctctgatcagcttcctcgttcatcctccgatcacttcccccttccttctctttctctgtatccttcggtcatccatcccctacccttctttctcttcctctttgatcaggcttcctcgttttttcctccaatcccttccctttcttccttcggtcagtctcctctttctctcccacattcctcctttctctttccttcctccgatcacttccattctctttccttagttccgttcgtccgccgttccatttcgtctgcccctctttctgctgaccgtccccaaagttcgctctctgccgatgatgttaattcgcgccatggctccgttgtgtcgtcacgcgtccttcccaatcggatcggctccccctgcgaggattccctcccttattgtgccgtatgggtggcctccaacgaacgaatttgtgtcgattcaaaagcgacgatggaaagagaatgccggaagagttgtctattttgttaattttttttatttgccattatatttttatatgaattattcaaattcaaacatttcttctcgcagtttaattgctcccttttctttctgtcttttcccttttccttttgtgttaattggccattcattattcaattgtaacgaaaacgggtgaaattcagatttttaccttcaaattgtccaattttacagaaaataaattaagtgtcacagtgagactaattgtaagcaataagggacgaaggaccaattggcatgggtttgaccaattaattggtcatgtgagtgtgtcgtcctccaacattttggcccctccgactgtcagtgtgttgtccgggtccatctccacgatggtctgatgggctcgcaattctctccgcccctccgtgccgcccgacacgacggacagtgccgaaccgacgcgctgctgtaaagacggcaccaaagagccggtggaggaacaccgctcgacggacaccgccgaatgactctgttcaatgaccttaattaatcaaatgcccttggagaatggaatcgcttaaaaatgcccacatttataaccgtgattcgcgtctgtctgtcaaagcaatagaattcctcctcggtgatcctttgcaagtccgtgtcgcatgaattgtccccgtcgaaaatgcgtttcatagtaaaattttgcccaaaattcttcaattccccgcgcaatttgtccatttctttattctcaaatctgttttgaatgatgcgtccaataattattaaaatgcttgttggaattgtactttttcagccgttgcctttgcttttcctccccccaaatgatggcaattctaagcgcaatttccctggccgagtcgggcgaattcgaagcgaccgattgggaagaagaaatcgaacattttgtgcccataaaacgggcttcgatcatctgaaatgccgattaaaaaagacattaattattgcttcattttcacttttattggtggttctggtaatccctcccaggacaacagcaaatcgtgcatattcacagcaatttcatgacgggccaattcgatgccattggggtagtaaaaaagaagactgacaaaggcggacct

SEQ ID NO: 15916 - DNA, 632 bp, Heterodera glycines
tagtaaaaaagaagactgacaaaggcggacctacgtaaaatgcggaagggtttccttttcaaaatttttacaaaaattgactcaccgtttgccaacgtttttcagccaaaaacgaaatttcgaaatggaccgtacaatcagttgaaattgaccgttcgtggagaagcacaagttcgcgcttcggtcctccatcgtcggctccaccacggcacgtccgccgtaaccatggaccaaaaactgacgaaggattaggtcagttccaaatatactcacaaatcagtttaaaatacagtcatttcaatcaggaatttatatactgaacaattcatttactagtatatctctataaccataaaatcatcattgaaaatcggatttttaatatttgttaagccccttttaagaatttctcaattgcgctgtataatattaaaacaaatcgaaaaatgtgtcctaattgcaaatgcctgacaatgtgccatttcccttacgtaatattcgcgcgtttcatcgcgcgatttgcactcaatgcgcaggaagttcttataataggcgcaatcggacggagtgaatccgatgaccactttggccgcttgttcactgcccaaaatttgcgtgtgttctctgctctg

SEQ ID NO: 15917 - DNA, 828 bp, Heterodera glycines
aggtcatcaaattttggcccaaaagggggggggcgatgggcgggtgaatttcaacagcgataaacttaacatttttttggcatttttgtattgcgtctgtaaaataaaaataatatgaaggcaaaattcttgtgcgttttcatgtttataatgaaaagtttcaatttttgcatccgaatttgagtgcatttccttaccattttcaggtgttcgtcgaggggtccttcaaacagccgggaattgggctgccgtttggctatttgaaggtaaaaatacccatggaactgtgattaataattgcctagttaattcaaatccctaatccgaaggtttcggttttttaaattactatagcttacaattaggtattaggcgtttaatgaatagagatgccagatttatggttttatgatcagagtgatcccaaaaactctccgagaacaaattttgatgaccggacctcatcataaaacaattattgcaaaccaaaagagtggatttaataatgattttcaaaaagcgcaaattttcaagtaatgtcaacttttttaaaaatttattcccggctgtgttatgtctcggctgtgttttgtcctattccgccatttcttaccgtcctcccattttttaaaaattcaattcccccgttttcaaggtgtcctcctcctccaccgtcaatctgttggtgatgccttacaattaccccgaccttctcacgctgttggcccaggccaaagaagggcccgaaatgatcgccagcgtccccttccaacaacgctttgacaaatatttgaacaccgtcccgccctattattacacggtgagtaa

SEQ ID NO: 15918 - DNA, 3384 bp, Heterodera glycines
agcgatgaagaaaccgatggacgcaggcacagattttgagcaccaaatgcggcggcgattttcggtcagtagcggataaactcccaaagcccccccccctccttcacaaagattgaactccttccgacccccttcagtccgatttgtaatatccatcgtccgtccgtccgtctctccattccgctgaccttgggggggagagatgctttaccaacagaacacaaatcgatgctggtcaaacacttaaaaagcattcaaacttaaaaagcatattctgttaaatatttgttggtgaccttttctctctcccatctctttaattattaatttttgttaaattttgttttatttaaatttttcaaataatcatttttatactttttgttatcgtttccaaacagaaaaaaagaagaatgaaacccacgaagagaatgccatcaggcaaaaatcgaatgtttggctgcttaaggaaatgccattggcactgactctcccccccccctttcccccgtcgcttctctccgctcggagtgtctttttgaaacccttcgccttttgttgttttttctccagtattttaaaattctctcccgggcattcttttctacatttttttttgttttgttgttttgccattccatcgatttgactcatttaattgtgacgaacgaaactcacgaaaatgaaaagcgggtgaaaacggggggggggggaaagtattttttatcgatagttgcttttatttcaccaacgaagcacttagggggcggggggggggcagtcacacggcaatttggccccgggggaacccccgccaaacggtccaacgccctctcccacttttccaagtgttccctcccctttccccattcccccggtgctcccccattttttccattcattcgcctccccccttttccacgtcagcttatcacacactttcgtagaaaaaaattcgaattttgactccaattctcttggcaccgatggctgccaccggcgggtcctttgtttgtcgtcggtatttgcttaatgacgacggtaagtgatttgaaatggagtcattttggaaggtgaaaagttcaaataagttggaaaattttaatcataattaggattaagagttggcaaattttgtaatgaactctaatgacccggttcttcttcagaagtgtccgacactttcgacatgttggacatggacaaagacggacgactgagtcgcgcggaaatcgccgcactgctgcgcactgcgaatgtggaaccaacgcgcaaggagtggacttccttttccagggagatggacaaggacagtaagtgccattgactgtttaagcaagttccattcatatgggagaatcctgtacagtatgataggcatttgacgttttgtgatgctcgagaccgagaattttcctcccgagactcaagaaaaaccgagacttttctcgagtcgtgactttcaagtgcttttccacttcccccttttttgctttttttatttccattcaagagtctggcaaaatcaacagagagtcttttggtaagtttttggcattttgtacgaaattctctcccccctccctttaccttgcgttacagtatcttatctgcgttgtcctcccatcaaccgaattactgtcaaagagttgcgcgaccatttttcgtcatacgatacaaatggaaacggtacaatcagcagaggtaaaaacagaagagaaaaataattaaaataataataaaacaaacaacaaaagtaaaaaacagacaaatgaatggaaaatgggcaaaaaaaaaatacaaaaacaatttgcaggagaattgaaaaatatgctggcgaatattgccaatttgcacgacgacgacacaattggccaaatgttcgaacattgcgacttggacaacgacggacggctcactttcgacgagtttttgcggatgattcggagagagtaaaaaatgaaaatttccaaatattttggaatttattctgttaattattgtatatgaatatatatttttgatttttgtcattataaaataattctttctttttttatttttatcttttccttcttttttctcttttttagttaatttttggcgctccgccgtttaaaaaaatgtaatgaccgatcagtcgactgatttcattgcccttaataaacaacaaaatgttttctgatcggtgtccttttttatcgttaccaaatcggtctccacggtcactgactttttgttgtcatttccattggactgagttgtgaaacgaatttcgaagaaatttgtgtcagaaactgaatatttggccatctcgacgatctttttttgaagacagtcattaattaatgaattattaattgataattaatttttaccccgtccaatgcaaattcggccaaaatatgatgcgttccgctggataaaactcgaagtccgaatttatttaccgccaacacacaattttccgcaagaatcgccgcccccggcgtcgaattggactcatttctcccttttgcgaatttcggatttaactttggtaattaaatgcgcttcattcgttcgtccgcttaccccaataaacgcgacgcacaaaataaaaggcggcgccgaacaaatgccatcgttcgatgagttcttttttttggcattatttccttcctttttttcatttcaaacccaaaaatcgttgccgcgctttcgccggggataaacacgcgaagttcgagcagctcagcctttggacacggccggaaatgcgcttaagccattggtcgtgtgaaagaattcgattggcactgttcaaaacattttttgggacgaaaagagacaaatcattcctaaaaatcactagaaataatttaaaacattttaaaattatttatgactttttcgcatcattttgatgagcacttaacacaagcaaagcaccaagaattgccatgtcctcctaaacaatgaaaatcaaaggaattttcgacaaatgcaccaaaagtgccgcagttgcggaaccatccgcacgaagagaaacggggagaccggcgaggtaattgggcaacagttggaagaacagtgcatcggtgcacaagtcactctcacggcgaatcggatgaagccaaaccttagataaagcgggaaaatgaaaagcgaaacggaaaaaaagtggaaatgcaatggaattgcaattgcaatagcatggcattatgtgaaaagcatggaatagaaactcaaggaatggatggcatagcattggtcgggatcgcgagggtggtcagagtcagtctcacttacactacgagtcagaatcagcacaaagtcatcgccgcgcgtctccaactccgtgcacacgtccatcacgtactcatcgttcagcagtgtgtgcat

SEQ ID NO: 15919 - DNA, 2006 bp, Heterodera glycines
caaattttgcgattttgggccattttcctaggatcttctagagttttgggggcacggcggtgccgataggcgccgtcggggaaaaatttggaaattttgaccatttttaaacaggtcttcattcgaattagccaatttataggttcaagtttgaaaaatttaagtgaatttatccctcatttttaggggtgtaatatccgagatacggccaaaaaaaaaatgagaaagcgaaagtccatccctggtgtttttgtctattatcagaaaaataaataaatttaaaagaaaacttcaacgggtatcgaactcataacaaaaagtacagctagttttgaagcactaaccactaatacacaaaatatcttatataataaagttattgtctgtatgtgtcactgtttgaattagtgtggcgtttggtgactggaatggagccgaagggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataacctttatattacccgttgcctaaccttaggcccatccgaataataaaaaactcaaattcgagacttggacatttcgtggcctggacattttgtgggtcagcgagccgaaggcccccgtacgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttatataaactgatcagaagcgcaccagattttgcaagggcatcaaaaagacaaggaaaagcaccgctatgatgctaacaccagtaactcttaatttaaaaatttttattaatttttaaaacttcactattttatttttttaatagatttttaaatgtttggatttttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttcagaaaatctcgcatgaattctcatttttaaattttttatagatttttaaatgtttggattttttttggcttaccaaaacttcatcgaacctggttctttctcgccccaaattttttttacagcttaactaggccctattaagcttatttccagaaaatctcgcatgaattctcatttttaaatttttaatagatttttaaatgtttggatttttttttggcttaccaaaacttcatcgaacctggttctttctattctctttcaaatcgccccaaattttttttacagcttaacaaggccctattaagcttatttccagaaaatctcgcatgaattctcatttttaaattttttatagatttttaaatgtttggattttttttggcttaccaaaacttcatcgaacctgggtctttctattctctttcaaatcgccccaaattttttttt

SEQ ID NO: 15920 - DNA, 918 bp, Heterodera glycines
  misc_feature (29)..(29): n is a, c, g, or t
  misc_feature (850)..(850): n is a, c, g, or t
  misc_feature (854)..(854): n is a, c, g, or t
agtgattgaaatgcaggagaattgagtcncagtgattgaaatgcaggagaattgagtcccagtgattgaaatgctgttgggttgagtcacagtgattgaaatgctggagaattgagtcccagtgattagaatgctgttgggttgagtcccagtgattgaaatgctggtgggttgagtgccagtgattgaaatgcagagaattgagtcccagtgattagaatgctggtgggttgagtgccagtgattgaaatgctggtgagttgagtcccagtgattagaatgctgttgggttgagtcccagtgattgaaatgcaggagaattgagtcccagtgattagaatgctggtgggttgagtgccagtgattgaaatgctggtgagttgagtcccagtgattagaatgctgttgggttgagtcccagtgattgaaatgctggagaattgagtcccagtgattagaatgctgttgggttgagtcccagtgattgaaatgctggagaattgagtcccagtgattgaaatgctggtgggttgagtgccagtgattgaaatgcagagaattgagtcccagtgattagaatgctggtgggttgagtgccagtgattgaaatgctggagaattgagtcccagtgattagaatgctgttgggttgagtcccagtgattgaaatgctggtgggttgagtgccagtgattgaaatgcagagaattgagtcccagtgattagaatgctggtgggttgagtgccagtgattgaaatgcagagaattgagtcccagtgattagaatgctgttgggttgagtcccagtgattagaatgctgttgggttgaggaagcagtgattgaaatncagngagaattgagtcccggtctagtaagtgctggtgggttgagtgcctagtgatagaaatgctggtg

SEQ ID NO: 15921 - DNA, 3140 bp, Heterodera glycines
  misc_feature (155)..(155): n is a, c, g, or t
  misc_feature (2049)..(2049): n is a, c, g, or t
  misc_feature (2058)..(2058): n is a, c, g, or t
  misc_feature (2081)..(2081): n is a, c, g, or t
  misc_feature (2108)..(2108): n is a, c, g, or t
  misc_feature (2122)..(2122): n is a, c, g, or t
  misc_feature (2141)..(2141): n is a, c, g, or t
  misc_feature (2151)..(2152): n is a, c, g, or t
  misc_feature (2156)..(2156): n is a, c, g, or t
  misc_feature (2183)..(2183): n is a, c, g, or t
  misc_feature (2191)..(2191): n is a, c, g, or t
  misc_feature (2202)..(2202): n is a, c, g, or t
  misc_feature (2218)..(2218): n is a, c, g, or t
  misc_feature (2223)..(2224): n is a, c, g, or t
  misc_feature (3023)..(3023): n is a, c, g, or t
aaacaattgaatataaagcaaaatatttttttaattaaatttttattgttttaatacctacaagcgtttaataaaaaaaaattgttgcctatttagtgcctattcgagatttttgtgcctattaatgcctattttgcgattttttctgcctattntaggtgcctatttcgcgattttttgtgcctaaaaaagaagccctactgatcatctattaaatagaatttataaattatttaattttttaatttttattttgctttttaaatcacttttttacaattttgaagaattaacactacgcctacgatcagcaatcgaagatcaaattttctcaaacgttaaataaacccaaaagttttttttgacaattaaaattcggaaaaagcacccataaagtactaccgaattaagtgaaattctgtcagtttccaacagtgtcttctccaaattgtttcttccattttaaaatgctttctcgactaattttcaacattttcgcaatttctttttcactcatttttggtttttctttttttatttgtcaataaattttcaattttaaattttcaatttttccattttttctttctccgttattcttttacagcgaattccaaattgtttcttccatttgttaattgtccctttatttcgacaaatgatttttgttgtagttttttctcttctgttttaattagactaattagggcaattataattgaaattaaacagaataataacaaaaataatttcatttttccgggattatattctcaaatataaatttattaatatttatttaaatgacaaaattattcattttagcccattaagagccgtttattcacatgaaaaatcacaactctcttctgatttccggtaaaaaattgatttgaaaaaaggaaaaaaagatgatattttcgaccatttaattaacaaaatttttttaattaaataatttatttattttttctattttattgattaaaaaagaaaagaattaatattttttttggaaaatatgtaaaaatgataattcgaaagtgagtgattaaaaaattgcaaatgatgaaaatgtgtggttaagcattctccccatccccttatggaaatttagttttaaaaaagtcaatttaatttttaattaaaaaatcatcaaaattttccacttgcacctgagtttaaatacatgttcgaaacatattttaaacaaaacaattatttattctgcccttgctggaaaatttggcgaattgtgccaatttttctacaaatttgcaccgtaatttggcaagaatttaatagaaaaaaaaattttaagcaaattttaaaaaattaatgcaacaaaataatttaaataaaatttgtcaatcaatgaaatttttgggaaatttgctagcaatgttttcataaaaattcaattgtcttctaaaattgcaaattttcttctccaaatttggctttccatatgcaaatattctttgccgaagtgtttatcatttttgcaattttctgatcacttatttttggattttcttttttaatttgccaataaattttgattttttccattttttctttctccgttatgctcttgctgcgaattccaaattgtttcttccatttctcaattattccttggctaactccaattttcttacaaatttcggcataattttgtttccattcttttgtcgaatattttcttcctttttgcttaaattcgtttttcatttcaatgaaatttcaaatatttcgtcaaatgttttctgttgtaatttttcatttgctgattcaatttgatcaattttggtgatcaaaaataaaataaaacacaaaaagaataatatgaataaattcattttgaattttaaattatattttttcaaatgttttctataaaaaattattcctttattaatatatagaaaaaataaagagtggaaaatgaaaagctaagcattaatgaaattcaattcttgtggaaatgatttttaataatttttttcttattgcaaataaataaattattaaaattatctttaattnattttatanttaaaaatttttatcaatttttntttcaattttactccattctttttttnaatatttttccaanaaaatccacctcatctacnaaaaaccaannttantaaaaaaaataaaataaattacacctnattccatnaaaaactaaancactaaatcattattntcaanntccaaatctaatttatattaaatagtgatgtataaaattttgatcagtaatttacagtttttccattttcgataattctcttattaaaatttaagcaaaatcgccactccgttgattttaaacaaacaattttattaaaatatataaaatatttatttctatgatgataggaatactggaatttaatttaattttaaatgtaattgccaattaataaatccataactagcacaaacattattatctcgattttaaaactcaataaattttatttgaaatttaaataatattagaaaatctttgtgttttccaatcctatcaaggttggtttcaattatttgaagtttaacaattttcatgcatttcagcaactttacatttttgtatgaccataaaaatatggatatatttaattcccaaccaattttaattttctttaaatacatagaacgcttaaagatttctctattattttgcaaattattttttattattaattttaaaaaagttatacacaaaattattgagccaaaattttcgggttttttttagttataacttttttctttgctagtttttctaaaatccattaaatagcagaggatacgttgaactatccccaaatacaaagtttctttaattttactaagttataattgctaaattatgatttattattctgcaaataaattttaaataataattaaatttaaaaattaaccatctttttgatattaagcgaccagaaattctaatataattaaaagacactaataaggcaagatcatactaatcctanaagcaggatcaataaatagtgaatttttatattttgttgaaaatttaatcgcaaatcatttcgtaaaaagtgatcagccagagcaaccgaatgatgatttttgatgaagaaatcaat

SEQ ID NO: 15922 - DNA, 2307 bp, Heterodera glycines
ggccgaacacaaacgtggtctcggaattccagccaatattgccatgcgaacatcccagattgaaaatgcgcgcaacgcacgtcggaatatggcatcaccggatgtgggactcatgcgtgttccactacatcacgcatgattcggcactggtgacttggcattgtggcgaatgcaacagacgttcttttcaaacttttgagtttgcaatgggcgacaagacagatcggtgagttaggttaaaaattttataatctttataaataaaattgactaataaagcgagttaaatttatttatttagttggggacgttatttgctgcaccaatcaaaggaacggcgccatgtcgtcaacatcgacgaagccgacgttcatcgggaattcatgctgatgcgcgggacgggacactacaaccttttttactacaactgcaagcactgggccgaagaatttgtgataaatagtgagtttaattgaaaacattttaaaaaattggaagttttttcttaaatggggcagtcgtcaatgcttagggcaatttctcgaattgaaacaaaaatgaaaagcacattttgttatcggaataattaaagaaaattaaaatttaattctatttaaattccccctccctttttctctcacttcttccttttccttctgttactcccctctctttatagacccgggactgaagtgtctaaattacaacgggactcaaatgaccaatgtattttcatgaattattattagtagggattctttttttatgtaagaaaaatcgcgaaatatgtaaataaaataagtataaaaaatgctaaaatatgtatgaaatatgtacaaaaactcccaaatatgtacgaaaatatgtaaataaaattttttttaacggttacttttttggaaaaattcttcgtaaagggtgaaataggcataaaatgcaataaaaatgacccaaataggcctagaatcacattttaatactttaaaattaatttttggtatctgtttttgcaaaaaaaaaattgattttttagaggtatatttctcagtagaaaaatcccaaaatatgtaaataaaagtcccacttttgttcacaaaaaagaaagtgtttttcttactaattgggctatggagaatccaggaaaaaatatgtatttacataaaaaaagaatccctaattattagggctatttttacacgcatagaattattttgaatttatagcgtgtccctaaatttgcggctcgacaaatgcggccccagccaaaaatcgacatttttggcccgatttttgcggttctacattttttaactgttggaaatcggaaattagcggcccacaccagaatcggatttttgcggccaacggaaaagggatgataatttggcattctgttagtcgcaaaatcagattttggcttgggccacaaatgatgggtttttggggccgcaaatgtcggggcctccgatttgctgtgcataatcaattttcatttaaaaatcgattataattatttaatttttagttacggggttctggtgatgatacaaactgagctttggggcccaatttcaaactcgatttggccagtcgctgaggaaggacatttgatcatgttatgttttctttgattttctctttcattattaaatttactttttattttatttcatatttaaccgatttcatcattttattgcatttttttttatattctcgacttgaatataaattttacttttttattttattttttaaaaattaaaaaaacttgttttttaattttttatttcggcgggtgagggggtaattaacttttcctacggtctgatgtaaagggtttccgagtttttcaattttatgccgttttatgcactgtttcatttttcttatgctgtgcccgtccgatcattgatctgctgatccctttcccatctgctaatgcactcgccccaattgttttctcaattttccaaaaatgcccaaatatgaacataaaatctgcatataacttgtatcattattgatcagacagcgccgatgtaataaatataggaaagataaatagcatttctcggacaaagggcagcagattttgaaacggagtgggaattaagtcaaatgaattgccatttcgtgcatttgaaccgttttggcccatacgtgtgaatattgcagaaaaataatattaatttgttcgcattcaccttctggtttggaattgatcgaaactgacgcctgcttcgcaatacagtggtctgatgcaatttgaatttatgaacagtggcatactgtagggtttgggcg

SEQ ID NO: 15923 - DNA, 2452 bp, Heterodera glycines
aaaaagagaaaaattaaattgttattaattaaagcaagttaaacaattaagacatcgaaagtcttgaactgtggcgtgtatcgtgtgcgggccgaaactgtagccgccgttgctttggattcgaagagtgggagaatcccgttttttgtgccgactccatcccgttttgtaccagcggagtggcatggccgatttggatgatcgcttcgtccgttgggctcaattttgtccttattgtccttgtccttgtccatttggctgtggtccgtgtccgccgagacttgctatttgcctcatttggggtctgtgatcaatgtcagcgccgtgttagtgttttgtccagtcgtattgtctcctcaatgtaatttcgggttaatcgttggcacggccttaacacatcacttgttaagatattttatttgttaatttaataaacaaatttattcaaatatttattattcaaagtttttcattaattattactatcaattttggttattggttaagtattttagtaatgataaataggaggcaaaaaaaaatggtgggagtgattaataaaagaagtttattttttggtactaattaaaatgaaaagaaaaatatataggaaaatcaaacaaaaaaaatgtaatttttaatgcgaaaaaatagaaattggggggggggaagtaaaaaattgcaaaattaaatcagaaatgtgatgggagaataaatggtataattgcaatgggaaattgaataatttttaattaaatttaattaattagtaatgaagggggagataaaaagaaaagcgccgctttgggaagtttaatttaattccccacaaggtccaccataaaatgggtgcgcgcgtgaatccgttgggccctgggccaatgccaggggcattggcccaaagcgcggattccccaattgaaagctccgattaattcaacaatcggtttatttagcgatgagtatatgtgtaaaagcaaaatccaagtgaagtctttcgcatggctgtgacgctggtacaattggacaaatgggttcagagctcatttggttccaaattattttccgtttttggcacgcgtcgcaggtcctcacaaatttttggatgtccttttccatgacatcccagtacagatttcgtctgattttgtcttttgttcgtttctcgcctaggtgtcctccttggaatgggtcggagtgatattccttcatcactctttgtctcagactgcttggcacataaattttccattctcctctgtccattgcacacaaaagatcttccgaagtttccattttccagagaattcatttggttcctctgaattttgatccttcttcaaagtttcccgtctcttttgtgtgtccgtctcttgtttttgagcctcgcgcatttcactttgtgaaatttttggttcaattttcagccaattaatttgtgtgtcgttgtcgtccaagtatcgtgaaagatggtcacaaaattggttccgctttccagggcgatgaatgatttcaacatcgaatgccatgatagccaattggtatcgactgagtcgcccttccaagtccttccgccggaataatgatgtcaaagccaaattgtccgtgatcactgtcgattttccagctccttccaaatatggtcgaaaattcttgagggaagcacaaattgctaaggcttctaattcgaccaccgaatagcgcttttcatgttttgttagcactcggctgaagtaacaaatcggatggacttcgccttcacggttttcttgtagaagacatccggcaattgcttttatgctggcatctgtttccacaacgaatggttgtccgaattttggtggagctaaaactggagccgtcatcagcttcgtcttcaattcctccaaggctttctcatgtggtggtccccattctgtcgtgctttcattttttgtcaactcgtagatgggttgatgtatttcggcaaatccgtagacaaattttcgaaaatatgacagcattccaatcaaggatcggagttcagtgatattcttgggcttcctcagtttgtgaattggctccaaatcctttggatcgattcgaacgccattggccgaaattaaatgtcccaaatagcgaatttctcccaacgcaaatctgcatttctccgctcagtctgaatccaacttcagtcatagttcttaggaaagtattgatgtcccgaagatgttcatcttctgtcattgatccgattatacagtcatccaaatacacgagaaatgttgctgaacacatttgtcggacttcttccatggctcgttggcctctgttagacaggtcgtgcgccatcggttaagtcgatgcggtgtatcgtttttcctttgaagagtccgacttctccgggtttcacgaaagcgctttcattctgtcggatgatgtttctcagcttctcaattccgtcttgactgag

SEQ ID NO: 15924 - DNA, 3917 bp, Heterodera glycines
cctttccttaacgggtcagaatcggagacttggcttttctttctaacggacccgaatttttaaaatccaataccctgtgcctgatccagtaggtacgggtccaaaatacactggaaagaatgggggggggagcctgggtcaaattgcttaaaatattttgggaaagaaaaaattaaaaaattatcttaatatttattttcaaatggaattatagagatttatctcttcagtttattgcagggttcccatcgtccatgctctgtttccaaggacgggtatattgatttccaaggacacaacaggaaaatttcataaaatccatgggcattaaaaatttttattatatgcaattaaaatgattaaattttatccaaatggcttgcatttttcaccggaatggatttttttcaacatttttttcttccaattccgaacacccgaacacaaactcgaacaaaactgtaacgtattttcaaaaaacctctttattatcctaaattcattcaaattcacgattaatcgccgctgccattcggtattttatttcatggaaaggagtgaaggaagtatcggtccataaactctagttttttttcccacaaaccccactctaattcccgaaaaaataacagatttatttccaaaaaccacatttttcctgaattaagcaagaaaatctttgatttcttaaaatgcagccgcacgacgaagccgcaagccgcgaacgacaacgcgcagcggcaatgcgaagatggccgtcctcgttatttttggcggacagcaactttttccacaaatttacaattgaggtgagtgatggaaagtgtgaagaagaagaaagatgacaaataggagagtgaggggaggagaggaaaggagagagtgacggaaaatgggggagcaagaagaaatgagagagattgaaactgagagtatcgcccaactctaatttaagcgtcttttgtctgcaaaggccaggttttgagttttggcccttaaaattctcttccttttaatcacaaaaaatgtttccttaaaatttgattttcaatgtgcgtttttagcctaaaaattattatttttttgtgttatacgttttcgaactttttgtgaggaagagatttgtcaaatgggagagggagttgaggagagatacggcaaaaggcggaggggaaagtgatggaaagagtgagtagagagagtggcaaatgggagaaggaggtgagaagaggaaaggagagagactgcaaaaagggggagggaaacgtgatggaaagtgtgaagaagagagaagtggcaaatggaagagggattgaagagaggaaaggagaacgacggcaaaggggggagggaaaagtgataggaagaggaagaaaaagcgtgtcatggcacttcttacaaaggcagttcgtacaataaagttcctacaaatttcttttcagttttcaattaaaactgtattttttcaaaaaaacatgaaatttttacatattgatttcaaattttttaaaaaaataacattttttattgaaaaagaaattcattctgattttaatttaaaaaatctgtctttattgaaaaatatttaaaaaaatttgtaagaaatgctattgtatgaactgccatgaccctgtcaaattggggggggggtgaaagaggggagtaaaatgatggcaaatgtgagggaaagggaagagtggcaaatgggagagggaggtgaagagaggaagggagaaagacggcaaaaaggggagggaaaatgatggaaagagtgaggaagagtgaagtggcaaatgggagaaggaggaaatggcaaatgggaaaaggaggtgaggagaggaaaggagaaagtcgacaaaagggggaggagaacgtcgtaggaagaggaagaagatgtgtgtcatggcacttcgtacaaaggcacttcgtgcatagagttcctacaaatttcttttcagttttcaattaaaactgtattttttcaaaaaaaacatgaaatttttccatattgatttcaaattttgaaaaaaaataacatttttttattaaaaaagaaattcagtctgattttaatttaaaaaatctgtctttattgaaaaatatttaaaaaaatttgtaagaaatgctattgtacgaactgccatgaccccgtcaaattggggggggggggagtgaaagaggggaggaaaatgatggcaaatgtgagggaaaggatttatcggtgtctttttacgctgtcggattttttaaaggggctcaagatgttcaaccataaatttatgtggagtcaaaacgaagaagaggcgggcaagatccgcgagcatggtcagatgttcgtcgggggctttgaagtgacgccgggaacaagaatcggcggctttgagatggtgccgggcccattggttcgcggtcaactattggcttttattaatgatctgaatgatcgatttgggaatgctaagaaggattgtgtgaagctggcggtgtgggcgcaccgcgaattggtttgatttttgggagatgagatgagagggagaagaggggaggagagaattatgcaaattggttgggggggaagagtgaatgaaaatgggatgagggagatggtgtcatggcgctttgtacaatttctaaggtgcgcattcatccgttttttgacgccaatggccgcacggcccggctgtttatgaatttgattttgcgccgcgggatgcgacgcgggccggtcacgcttgatgaggggtggcgacaggagtattaccgctgcttgaggcaaagggacctcgcaagctttgaggcaaaaatttgatcaatctgcagggcggaaataattaagaatttttaaaaattttaatgggaaaattgttaaaattatatatcatcccaccccttgatttatttaatttatgttcaaccatttcatttcacatattttgtattgttatttgtttcaataaatgactttctgatcattatattttaatcacacattgagaggaattgaatgattatataatttgtgaaattatgttggcagtttttcttaatttttcatatattatatcaaataaataataatacgcacatatttcgctgcacaaatacttttccttttttttgtccgctgttttattggttgtaggacatttgcggcccgacaaatgcggtcggacatttgcacctcggacatttgcggccacagccaaaaacgacatttttggctcaactttttcgactccaacaaaataaaaacctcagaaaattattttccatccaatttaaccgaatttaatgctctgctctttctaataagccgaatcaagttttttagaaaaaaaaatttcctaacccacacccaactggaagcaatgatgaggaggaaaacaatatcagagaaacaagtccaaaaatgatggagaaagaagtatgaacattattaggaaatctcagatctctacagtagttggtagactgactagcaacttttgagctctagtggggttttgacaagcccaatttttgaaaaagaattactacattgaagacttagacttagaagatgccatgaaaattttaaaaagactaattcaacaacaaaaaattggtgataaatgggagtccaggcggtgccgatgcgccgtcgaagcgaattttcgaaaaatttatttttttttcttgaaaatttttaatttttcatttcgatagtggaattccctgtcaaccatcgactggtttcgttaattgctgtttgtttttaaaagacaatttcggcagccgatgaacacgccgcaattccgcactatcgtctggacgaggtgtcgggcaaaaagttgatcgggccaaactcggtgtacctgttggactcgggtggccagtacaggtgggagcaggggcagtcggatggtatacgccgcaga

SEQ ID NO: 15925 - DNA, 797 bp, Heterodera glycines
gcttttgtgctttgcaccatccgccactgatcattcgccaagcttccttgaatttgctcaactcgtttagcttgagtaagagcttccatcaggttttggggttcctccatgtacatgaccctctcttttatctccgggagcatattcgctctgaaaaagtcgcgcgcaatttccgatcggaattgctgaatccgttttgcattttcttccttcacttcattctcgcgatcacccaaagctaaggtggccaagtccatctccaatgtgttgtccgggtaggcttttgccaccaaacttcgaatttcttgcgcaaattcatccaatgtttcgcccgcgaattgtcttctctgcgccaatttttgtcgtgccatcagcccggaagagactttctttaatttgtccgcaagaccgtcgaccaaatccttccagtttgtcttgacattttggtctaagccatcataaatggccttggccgaaccacgcaaatacaagggcaaaatttgaacgcagcgggcggggttccagccatgtgcagttgccacaagattgaaggatttcaaataattgtaaaaatccgttgttccgtcgaaagtgccgggaagtggaagaccagtgcgcgggttggcatgttcctgcaactgccgctcaagtgtcgtgacccttctcttgagcgcatctatgtccatgtttcggagctgccgtttttgtcggattagccaatgacgacgctccctctcgctttgttcggcacagttcgcttcctctgagcccgaagaatcaccctgaattacggcgct

SEQ ID NO: 15926 - DNA, 2822 bp, Heterodera glycines
gaagacaaaataggattttagaaataataaggaaaaaattttaaaccctttgcccggatttttaaaattataaatattattaaataattttcaattatttatttattgagttaatctatgtacttgatttaatttaaattatttttatttaattataagggaatgggagtaggccaggcttggctcggctgaagtgtcaaatgaagcactgaatgaaatgaacactgcattcagttcgtccacacgaccactgatcgttccgcctcttttcgtgcttttgcctcttttcgctcctccctctcattagtcttcctaccaaaatctcatctcgttggcttttggcccttcttttcgcttcgttccgttccgttcatcatctctgctttttcccttcttttgtgctttatttttggtgtatttgtttgttacacaattgtttgttacaccatttggtgccgttgttccctgcttttgatccccaaaatgttttggcctttaattaattattcgaatccaatccctgtccagtctgggcccgctgggggaaggactggggaagcaggacaactgattaattgtgtgcatcgccggcgatgcgatttgcattgagatggggagaaatgttacagcaaaattgggaagggaacgggaaggcgatgggctgatgggtgtcaaaagagagaaagagagaaccaatgagcgattggaaagcggggtcttgggacttaggactacggtagccaacacagcagcgagaggtgaatgaatgatcaaagattggaaggtgttaggaattaactacagttggattacacggcacacacacacacacacacttcaggtttaatgcgttttgaaccggtggaatgcgggacgctgaactgctcggcgatgtgttttgcacccgagggatgggaggagccgaaaatttgcgcttccgtcgctcccgtctgtgacgtgccaaaaacacccaaaatcgactggtctttgctcaccgacgcggtttcggctctcatgttgctcgccaacattttcttcacagtttggctcatttgccgcgtccaacgcttgccgaaggaagcgcctccaaaggacccggcttattgtaatcagtgccatcgtctcctgcttccgcgggtccttcctcatcgccgcgtcagcgtttttgaggacgtctcactggtgtccgccgtttaaaagcacaatcagaaataaaatcacttcaaacacaaacacacgtgcatttgatttttgttaattaattttatttgaataaataagcacttaaattgtccagtaaaacgagagagtgaggggaaaatatattagagaaaagctaaaaaatttgggtgaagtcttacggtaggaaattatggaaatgaatggtcaaagaatttaaattttaaacaaaatggtgaatggggaagcaaattttaagtgaggaaattaaataattaggaaatttaccaaattaatgaattataatggggagataacggggcagggttttgaaaattttaaggaaaatgaaggaaatttatggaaagaaattttaaatttgaagggggagaaatatgtaaaaacaatggggaattttgtttacgcagaattaataaacgaacggggaaataatggcagcgcaaaatggggcaaaataaaattgttaatttttaccaatgctggagaaatattaatgctaatatggggaaaagcaaatgtgaaatttaagggatgcattggggaaaacgagggaaagaagtgttcgtaaccacccaggagcgccatgacaaagccctactctgccagactgttgggactcggggacacccaaaatggggcccctcgtcgcagctccgggcgggccaaaatggccctaaacaccaagcccccaaatccgctgttcgatgtcccctttatttgttgagtaaaaaccaagccaagcgaacaaaattggataattaatagaatgaatgaacgaacgggccaggggaattgagggtggcagaaaggggaggggcagttggtcaattgaggagacaaaaagtgatgagaggggctgacacaaaggaagggggaagaactccaagccaaaggggaaccccggtcaatgaccatcttttcatcacattccccaccgacgacattgccgcgccctcgcggcaaaaataacaaagcgatgtggaaaaggggaaaaatcagagagaagaaggaagaaaaatgacgttaaagagagagagaaaatggagaaaatgaaatgattttgagacaaagagatgcagccccaaccgacgaccgaccgctccatcgttgttgtggtcgggtagcagaaaaagttagatgtggaaagatgataattcgacatgcaaaagtgttggtcatttgcaaaatatcttctggtggtgttcatttcaaacccctcttctcttttcatttcccctcagttttgtagctattccatttttagtgaattatttcggcgtaaaattttcaaatgcgtttggccttgttcaccgtcgtttcggctcttcttttgatggctctgatttggccctctgttttggcttcagcagaaattggtcagttagtggatttccgatcggtggggcggggggagaaagagagagagagatgagagagtgagggcgagaggggagtgcgcaattggaatggaaaaatggcataaggtagagaagtaaaggacaaattggggaacaattgggacataaaaaaaaaaggaaacaaaataattgtttaatgagtatgatgttatttggaaaagcgaaaagggttttttctatttttttgagtaaaaggggttaaat

SEQ ID NO: 15927 - DNA, 3001 bp, Heterodera glycines
  misc_feature (2949)..(2949): n is a, c, g, or t
  misc_feature (2988)..(2988): n is a, c, g, or t
ccccctcccatcccctaattcgtttgaatcattcctctccgttcactgatcacccccttctgatcactcctttcgttctctctctctcttacggtgtgtcttgaatgttttttaaaaatttcgatccatctccgttccgttgatcaatcctctccctcccccccctctcgaactttcttccgccatcattcttccctcccattcattcattcttcgtccggccgttaaacacttcacttccccccccccccccttctctccttcccacatcgcccattgtttccgccttcttatcctctccttccatcattttctcccaaattattccccggggaatgcttttcgtccgccctattgagcggcaaagtgccaatgaatgccttttccatgccattggcaccccttccaaaattttactcctcccccccctccctcctcctctttttttgaattttctcgcccattcgaataactttttttttgtgcataatttttccgcttattgcgcacatttttcattactttttggcattatttactgcaacatattctatttttttattttttcgcatattttttctatgttttgaccaatgggacgaaagcgaagtgtttttgaacgggcggagagataagcgaacaaaatgccaagaatgggttggcattggccaatcgtcggcacagtttggccacttttgctgttgtcgattctctttctattgttgcccatttattctttcgatgttcccggcggtaagaaacactcaaagaaaattctgtttttaaatgaaataccgtatctcctacagtttttgccacttactctttgtacagtaacttttattcctttcccaaaaaagtaacaaatgcggacgaaaggggcgactgctgctcaaaactgctgaaaatttattcccatgggtttttttgagttggccgactgaaacgaaaataaaagtgacacttttgcacagaaatgggaaggaatttcgaataaaaatatttaattttttattttttgctgggaaattcactttttatggcatgcgtttttcttttccttattttcttctttgccccgtttcatttgttctcttttcgcttttgtgtgacttttcgccgtttggacggcaaaatttgcataaacaatgccaaaattggggggggggggatttgcaagggattaaagggatttgggctaaaaggaattaattaggggcgattaacgagggaaatggcgaggaataattcgacagggcaatttctaagagccaattagtgcaataattaattaattagtgaattaaattgggaataaaaatccaaaatattttggccacccacttttagatgaagagactgaagccaatctgctgattccgctcgagaatctggtcgacactgacccgagagtgtaccgcaccagcggattggacggattgccggccgtcggcataaaagtgccggagggggggggggggggtatggccaaaacaattcggtgtttaagcgtggcgttgaaattgtcgtgccctaccgcatttatttgccgcgcaaattttacaggcaaaatttggcaaaaaaaatgtattttttctcatttttctttaaggaatttcgccattctcgcttcgattcgaccagccgaccatttgggaggtctttccgtccgcttttcctctttggcactcgccactttctgtttaggctatttgttcgctgtgctgaacgcattcgacacggtggtcgaattgggtgttcaactgcagccggcgggtgggtcaaaaatgggacaaaatgccagaaaagagggaaaatgtggcaaaatgccaatttgggaaaacaatgatattgggtagaaaacaaatgggctgattgctttttactttgaaggaattcaatgtcaaaaataagcgatctttgattgaggctgtgccaaaattcttttgatattttttcaataaatttcaaaaaatgacatcattaagcactcaaccggtccctccgggacacaaaatcctctccttctcccctaatgctgctgaattagccgttccatccccttacccttcgccacaaaacctatacatattgaaaaattccttttgtcggcaaatattttaatagcctacaaaaagtgattggtgtgtcttttgcttggaaaatgaatcataagaattattcccctactgcaatctaaaagattaatgcttttttgagtttcagacaaaaaaaaacttaaaacatcatcaaaaaaaattcctttgtcggcaactattttaaaaccagaaaaaagtgattaatgtgccttttcattgtatctaatttacctttttaccgatgtttgatgatacttattgtcaaggcaaaaattaacatattgaaaatttctttgtaggtaattattttaaaatccaggaaaagagataaatgagttttttcatacgctacaaacctaaattacattttctagcattattactttaaaaaatattgattaaataagattagggtttttttagttgaaatctgttaacaaaatcaacacaattttataatttactggtggtgactaccaaaagatctaattcaatctcatctaaaatatcgtgaataattgatgaaaatatatttgatgtaacccaaaaattggaaaaatgcatcctggttgtgctttttaggccatttttgtgcattttttcgcgcggattaaccaaatttttaaaaaattcggaagagtcgccggcggcgactccgggaataaaattggatttttaatgctatttgattacaagatttgcgcaaaaattactatttttttgtagattaaataattgttttttttgtgtgagtaaatgagtacagggtgacaaataagttttgtgccacctattttatgctgtaactttttttcaaacccaatcaaaaaatacaaaaaatatgaccaanattgcagaaaagaatagagaataataatgatcaggaganttagacgtcatcc

SEQ ID NO: 15928 - DNA, 1950 bp, Heterodera glycines
cctgcataattgtttaatgcttttcatttgacttacactttaaaaattattttgaagcttttttcaagataaatcattttttgacgggatttgctaaaaattacttcacaactttaatatttttacaaaattcaaaaccgatgataaatattctttttagaataatgaaactctccctacaatttttcatttattagttgtggcattggcaccttcgttttcttctgacatgctattttttgcgcaagtttttcgtaaaaatgtgattaagaagtgtcacatggcgtagccgtattagctattttaagattagtttttttaaatgacccaaaatttatttttttaaaaataataaaatatgttcagatgaattgtcgcaagtttcattttattcattgaactcttccatatttattcttttttgataatttttcttttgatattttaatattatggaatatttttcaaagttttatgaatcttatcttttaaaatttaattttaatcaaaaaatttttaaatataagtattctctaaatttctttaaatatttttcaatttttcatcttgaacacttgacatttgattgtgtacaaaattctctatctgttgcacattgtgaaggtatttcttttgagaaaatctctccccacatttttgggtcatcattttgctgaaataaaaatcaatgggaatattgggggataagcaaaatccaattcaaatttgtttcttttttgggtcaccgttttgccgtgaattattattttatgtgctcgccgccgtccatcataaatataagtgaaccatcccatctttcttcatttaactcttctggtgcattttttacaaaataatacaataattattattttatgaattcataagattttctttgcactttccatgtctcggtctttctctctcttttctcttctctctgctgatctctctttttctctctttctccgcaaaaagtgtttttattgttagggatcatatttttaggctgaaaatgccaaaataggtaggatttaggccgtaaaacccgaaaataagcactaaaagatgccgcgtagtttcacgaaaaccgcaaatatccagcaaaagagacggggaccctaatcagtacgatgtctatatttgttaaattaaaaaataatttgattaatttaatcaatcttaccatgatgcttggaaaagtctcaaatttattgctttgctttgcttgattgcattggcttttgggtttgtggttaacggccgaaacacaattatttacgaattattttttaatttaacaaatagagacaccgtactaattagggcccccgtttggtatatcatttgacccttttttcacggggcgttcactacagtttatccaaaattttaaatcctaaataaacttttaaaaattccttgaaaataaggcttgatttgaattatacagctagaaattttattgattggtttagatgtttgcaattactaaaacagcgaaaggcgccgacgtgtttacttataatggctacaaatattatcgatcaaagaagaacaagcaaaaaaatacaacgtattggcgttgtgttaaagtacgaaactgtgttggcagcgtcaaaacgacactcgatgggattttgacagaagggaagacacacaatcacggggtggaggcagtcggacagcaagtaattatttatcattttttaaatgaaaatcctaccaattgagcttaataatcgcaaaaaccaacctttttttgttgaaaatctgttaacaaattgcacccaaatttttaaaatttcccccggctgcgcctatcggcaccgccggaccccttctttcccaaaagttttttgaaaaagggctccgaaaaaagtgatgtgaaaatcaaatcagcagggggagtaatattcgatgatttagtccaaaaaaatgattaattgt

SEQ ID NO: 15929 - DNA, 939 bp, Heterodera glycines
tttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattacatattttcacttgatataaattaaaatctgaattttttttttaatttttaaaatttttttgaatttttaaaatttcccggttggtcccggttcccggtttttcttgcggtcccggtcccggtcccgaaaaaaatcgaggtcccggtcgcggtcccggcttctcaggtcccggcaagtcccggtcccggttttggcaaaaattcccggtcccgtggcactctagtgtaaaatgctctaaatttcagtgaaaattttgttaaatggtcaacatttctatttttcctccggcggcgtctatcggcaccggccccactttcttccccaaaaagtctcttggaaaaagcgggccgcgaaagaaacactattattaagtttttcactttgaataaaatttttcaaaatgctgattttttgtcggccaaatgctgattttgaaaattttcagttggcagccctggtttttccgctaataaaatattgttttaagtcgatttttcatatttttattgcgtttccttcacgctctattggttttagaaaaatcttatttttggggtccgaattttagtttttgagccattttgtcttattttgaaaaaaaacatggaaactctgttttagcaagtcccggtcccggttttagcaaaaattcccggtcccgtggcactctaattaaatgaatttactcagaagtccatgcgctgccccaactgctgcagtatttgaagcagcgcccgcaaggccgctgatcagtgatcagaaaag

SEQ ID NO: 15930 - DNA, 1874 bp, Heterodera glycines
  misc_feature (28)..(28): n is a, c, g, or t
ataaaaaatgtcttcttcaatgtatttntgtgaacaattcctcctaatttataaatttttttgaaaataatgcgaaaattacttatttatcagaattaaatgagaaattttttgcaattaatgaaaatattaaacaaaaaataataaccaatcaaaatttaaataaaaaagcattgaatgaagtttaataaagtagcagaaaaataaaaaaatatctcatttttttactaattatagtataaatctagctgtttttaaagatttgaatataatggatgttctaaaatttttaaattattattattttttaattatgaaaatgtttaattttcggtaacatctaaacaactgttataaaaaacgatttttattaacaataaatgttttataatttttttattaattaaaaaataaataaatatatgtattgtatagattatgctattgaggaggcaagtcaaaaacttttattctgttttcaacaaattaaatgtaaaaatttataaaattcattaaattttttatatttttaatttttctttgttttgataagttatatatttttttaaattaatttaatataatatgtatactttttatttttattatttcattctaaacgtttttgaaaataaatggttaatatttattaatctttcccccgcgtccaccggtttcttttttccgaggttggttttgtgtgtccgaccattctgctcatatttaaatttacttaaactaaatattaaaaaataaaatttatttttaataaataagaaaagttttcgtcacgtgcattatataagtaatttttgtgatttgcaaaaattgtgttttctaaaaattcgatttggaggcatttcatatttgcattaaatgatcttactttcttaaaattgagttaacaatttttatttatttccaaattattttatttatttattaggaatatgcatcaattatggaaaactaaaataaataatcatatttgtcgtttaatttagcttatattgtttgcatttgttttaattctttttccatttcatgttgaattttttcatttcaatttataaaatagaatatgttttatttatgatctaaaaagtactttttagataagatttttcttagtagaaaaaatgctaaataattgtttaatcaaaaatcattaaatttatatttcctaatattttagttttacgattttaaaatttcatttccataaaacattttctttgtagtttactattcgcttcgttcggaaaattattttaacttaggattttctattatttcttaaaataagttttgcagtttaatcatttaactattttttaataatttaatttttacagtgatttattattataaattaaaaaacattttttttgtctaatatttttattttaaattttctttgttttattttaaattttcatttctttgtttattttcatgagaatacaataaaacatgtagcatgtgtgatttatgaataaaacatttagcaaaaatttgtggtaaataattttatttatttataatttaatttaattaatattgaaaatttataaacatagaattgttttgatttgctgaattggtgctactatattcaaatttctttgttgttacagtataatttttatttaaaatgttcacatctattaatcctctcgttctttttcttctgttttttgtggctggcgacgtatgtttaatgaataatcttattttttaaacattaagcgagcattttataatagattaaaaaattttaagttaattcgtatataaaattaaaaaaaggttataaaaaaaccagaattttaatagttataccctggaactccacaaattataaataattaaaa

SEQ ID NO: 15931 - DNA, 3423 bp, Heterodera glycines
  misc_feature (3252)..(3252): n is a, c, g, or t
  misc_feature (3337)..(3337): n is a, c, g, or t
  misc_feature (3367)..(3367): n is a, c, g, or t
  misc_feature (3373)..(3373): n is a, c, g, or t
atatttcaataaaaaataatttaaaaaatttaaaacctttatataaagtttttcaagggctattaaaaccacctattagttttataattaaaattattgtaaaaaaagattttttatataaatgagctgatatttattttatttaaataaagtatcttaattacatgcaaaattttcatctatctgctttctctaaagaaaacgatttttatgttattggtactttttctatttttgggtaagacaccgcaaaatgaatttagctttgcgctttataattgttaattatttaaataaagtttatttgtaaaaatatttctaaatagcaaatagttaaaagcacttcataagatcaagtagcaaatttattttttattaatgaatttaaataattattggttttcttattataatattcaaaaaacaggactattaatgcatatgtaaaaaaaaattaaaaacaattgccttaaatagtcagaaaatatattgattataaagatcaacaccagaaagtcttggtacctgcggcgaaataaaaaaaaaattatatttgaaatatctaagaaattaaattaacttttattaaggaaatttgtaaaaaatcctgatttattcattaaacattaaaaggtgatttaataatttctaacaaataaaaaattctcattaaatacattttctcaatatatcaatacttttataaaatttttgaaaagaaagaaattttttaatattattttgcattttaaatagagatatgactaaataaatattcactaaaaaatcaaaaaaaaattcatttagagctacaattacaaacatctcaactttaaaccaataaataaattctttaaaaatttacatattaatttaaaataaaatctattaattaataccatataattaaatgattattagtcaattttcaaacttgatcttttataaacatgaataagtcaacttaatataaatattacattattattattaagctattttcaagccaggaccacattcatcccagcataaaccaagcccttaacaagattggtactcaaaaatgatacttaaaatttaagaaaaaaaaaatcaaataattattaaaataaatagaaaatatattaatgactaaaaataattatttaaaaaattataattaagaaaatcaatttaatcaaaatgctaatattaacaaaaaattattattattcataaaccgtaaaaccgaaaaggtcgcaagaaaatattcatagttaaataaatagcaatttatattaatttgcacaagtcttttcataattatcaactatgtattttaatttgccgttattcgagaacaacccaatacacgggctgatcaacatttatagaacaaatattgaaaacttattttttaataaaagaaaaaaaatttaatttatgtatcacaaattaatttgtgctagaaaatttaaataatatatgatataaaaattagaataaaaattaaacttactcttaaaattataaaaacagaataataaaattgcaaacgcagaattaaagtacaggctatagggaagctattcccgaaggattcggtctccccataaatctgagcgcatcggttcggggggactgccccgaaaacaaaaaaatcgattttttcaagtgtccgtttggggtactcaaacaattatggggagcaaaaatccaacgcagaaaaactaaataattagttataatatttttaaatttaaatatatcattacatcttatacttataagattaaaaacccttttgaaaaaaagaatattcttctaataatcgtgtataaaaattaaaaaaacaattccttattagtatgacctaaatatgccaacaatattaatttataaaatttagaacgcaaacagagtttgtccaaaaatgaccaaatttcgcttttttcatccggtcccactacgggattgtcaattttatttgctccaaacaattttcaaatcgttattttttaaattttcgaaaataaatattcctctgtttaacgttctgttttttatttcctatttaattaattctagtaattattttttattaattttgtttaaagaaaaattaacaataaaactaattataattaatcaaataactaatgttaaataaatttaataaagttacaaaaattaatggtacatttttaaatttcggagggaaacagaaaaaaaaaatttaaattgtactatttttttagtctctattaatttaagattctttttatgaaacatgctcatataaatttacattcgaattttttaggtttaaatgcatttaatgaacaagcatctaaataggacaatcggtagaatttgcagaaggtttaccatgtttatatttaatgaaaaaattgaaagaaatttcaatatggaaatttgactaaaaattatttatttttttttattattcataacttttttaatcttaggatacgaattttaccaagtggccatgagataaattaagcaaaaattgaaaattacaaaacaattcttaagaaaaacaaaataaaagcaactgtaaataaattaaacaaatgatcatacaaaaaccaagctaactaataaacaggtcgtggtaaaaaatgtagaagaaactagacgagggatacctcgtctagtttcaaagctattatttttgctactttagaaataaaattaaattaaaaaaaaataatttaaaaaagtaaataatcggttaaaagattggaactttcttcaaaaattttcaatttatgataataataaaaaatattaaattataaatataaaattaaaatataatctcaagaacgagaattaaagaaatgaaaatacattttacattatataagaacaaatgaattataataattaatgcaaaagatttaaaaccaattcagataattagaaaataataatgtgccatattttttttgtaattaaatcaaatttttaaatatattcagcaattggaatatataattaattttttttcattaatttattagcaagaaataattactaataatttgcaacaatatatttaaaatagaaataattggaacaaaaatttataattactaaatgcccttaaatttgatgtattatcaattatgtagaaataaaatttcagtcattaagaaaagattgcatatcgttgggataaacaaaataataacaaatttcaaactattctgaaaatgatttgaataatttgagaagaattattanaatttatttgacagaaagacagccagactataaattcaatcattttgtttaatttattataggattaattttattcaaaaacatntatgtttaaagcaaatgaaatttaaatatnaaccanaaaaatcaaatatcagctatgaaaaataaaaaaatgagttttggaattaa

SEQ ID NO: 15932 - DNA, 2197 bp, Heterodera glycines
cctcttttccaatggctcccttcgcccatgtgacttttacagccccggggggagtgtcgcgatttgcgaaataatttgtatttcctctctcccgttcccccgacagataaatttcctttattttacatttatccccccccccccctcccccctcttcgcttcattacaccgcttcgttcccgacggccgactggccataaaagactttgattttcctgcggttcttgttcatgcctttcccattcttttcccgtgcggacttatcccccttttcttcgccgttcgctcgccattgctttcacttagcattttttcgcctttgattcattgcttttcccttggacgtaattggtggaaataaagagattttgaaagtggtcttttgtttggattcgtttgtcttttggttttgtcttaatttggttcattctcattcttcacttttttctgcattaacgcatttttttctgctcagctggagccttgtcattattatttcttatccaattccgacattaaaattccgactgtccttatttttaagaaatgttttgatttgtggagtccatttatatcattttgactaataaaggggacttaaatttaattaatatccaaataaaagccccccccctctctatggtctttcatcggggacacttaaactggaaaagtgcacgatttttgaagcccttgggaaaaggccgccaattctgttgtcatttctacagtgtcggggccaaatgtaaccctatttaacagcctttcaacagtttaatttacataaaatgtttaattacattttgctaattgctttccgtatttccatttaggcaaaattattatttttaatggcaccgcccgtcaaaaaaaagaaaaagttttcctccgacaatcgccgcctcatttcttctaccggaattggtgaacatgaacaacaatcgatgggttcacttacgacatcgtttggaaaacggcaaagtctttttcgacatgcaaagaaaatgaacaaccgaattttgaggaaaatgtgagaataattgggctaaagttatgaatttcaatttaaagtctctcaaaatatttttcccgcatttagctggatttgcactgatatttggatggacactttcccgttctttgaccatgcccaactcggcctcaaattggcactgatttcgccacgtttcgatgttttagtagacaaacatttcaattgccaatctgaattgacaatttggagagaaataacaattgtcaaggacacaggatcagaattaaatctaactgtacggattggtggcaaatctgtgcaatttcctttgcccgaccgttcgctgcccaacaaaattcgctttgataatcttaatattgagtaattaaaagtttcatggcattattaactggtaaaggaattcatcccgttttcagttacattgaccattccgtcctcgtgtttctccgtgccaataagcaaatttgggacaaaggcaccaatttgagtttgtatgtgtgctggtcacacaaccagaacgacaacaacaacaatttcctgccaatttgggatgtttttgtttgtaaaatttggcccatttttgcgccaaacattcgccgcttgagcctttcaaattcttatcatttggacaattttcgtcgtcttatttcgccgacaattctcaccgatctgaacctgaattcaatgtgctctggtgatctgttccccgatgggatcggtgatgatggaccaaatgcaactgctggccaagcgctatccaaatggttgcacactccaagaaaagatgggcagccaaagcgattggtttgctatgattacccgtcaaaaaacattgaatgggtcaacaatttcaaagaggtcagtccccatgttatcttaaactattgtggttaattacctaattatcttttggtttccaattgtttaggcttttcttagtgccaccacttccgccagctacaaaattcaacttgaactgcaccaatcaaagcctgagccatttgaattggtgaacgaacggaccaacgaaaagctaacaatggaggaagtgccgcgcgaagtttacaattgggtgatgaagcgatgcccaaatggggggacggaggcagcagctcagtgggaggaagaaaagacgaataatttgaacattgtcaacttttggctttataatgccgaaaattg

SEQ ID NO: 15933 - DNA, 1472 bp, Heterodera glycines
  misc_feature (1470)..(1470): n is a, c, g, or t
ataacttttttatttgtcagttagctttagccaatctggcatcattgaaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgaagagctatcgaatgataacaaaaatttttaatttggttgatcaggaaaaaagttgttagcaacggcgccaaaaaggccggcgccgaagtgggcggttcccacttcacaaataaactaaaaaaggagtcttaaaaaatcccaaagaaattcaatattttcgacatcagtgttcattttgagaccggcagagtaccgtatatgctctaattatagcccagtctctattaatcccgcagtctccaattatcccccagtctacgaggtgttttgaaaaataatccctctatcataatccccagtctctaattatccccccttttctgaggaggttgaaaaataatcccccatgggcgataattagagcatatacggtaggccatattttttattcccgacttttgttcgctgtcactaaatacattttttttaaagttgaaccgttgctctttacttgtgggttcagccttcatttttcattcctatcttcatgagcaagaaatggacaaaaaatgtatcacaacttcataagaacaattggaatcaaataaagaaaaaaacaatgccaacgctaactgtgagggaaaaaatgaatgccggatggctttgtaaagtgtgcaattagtgtaattaacacgccggtgctaattaaagcctgacggcatatgtaaagtgatcagaattaattaattacatgatacgcacattcctacacatataaacagagacagacaattcacaactaattatattaattaggattgttttattaggaattaatcaacgtaaaaatatgaaatggggggggggggaggtggaaactatgaaaagtaaacaattcaataagcgataattagaatatatgtattgtattgtgtttttgtgattgttttctccgcgttttcgttggtcacatccatcgcatcgatcacacaacaaattcatcaaaatcacagtcgcttctccagaaaatcaatgttcatcttgaagaacacatagggctgagcaaagaaaggaacaaataatggtggcaattaacggccgagttaaggcattgatttgtttatgaaaacccaaatttcaaagggtcgaaaaattgaaaagctttttagtagagatcggaccggtcggttttttttcggttttcaaccgaaaccgttcgaccgaaataattaaaaaaccgaaacaatcgaccgacttttttgacaaatcagttggccatttttttaacaaattcattanaa

SEQ ID NO: 15934 - DNA, 1509 bp, Heterodera glycines
ccggtcaaaccgggaccttggtactatgttgtccgcttccaggtcccggtcccgtggcactctaataaattccaaaaaaaaaaatctctgaaaaatttttctagaaactttcgtattaaaaaaacctaagattttttctcaaaaattttgtttaatttttttaaattttgtccttttcccgaatactcgggagggggggggggaactgttccctccatttgtcgaagctctttttcatcgggcccatcccgcagtgagaatgggtcccactttttgaccatttgtagaagttagggggaatgattcgtatgatttttattccatttttcccaataaatttcgttttcccatgccatttttgctcacttgttttcccgacacgcgcctttgtactcgtccaacaccttctggaacagtgtcactgtgtacagcgcgtggtccgcgtcctccacaattttgcgcgccgaccccgggacgaccattgtggcgaaagtgtggtatttggtctcccagtccttcgtcaaaagtctgaatgggaaaacggagccaaactttggtggtttaaacgacaaaatatacgcggaattaaatgagaaatgactagagctcgaaaactcaaaattttgtttttctacgccgcaggccataacattttgtgactttatggatggtctcaatttcaacaaataaatccggcggttgcttgtctctttttttgttgccaaaatggtcaattttattttttaaaacaaagtaaaatgtgaaaaacaaactttggcacgacaacacacacagtttggaggtattcggagccgagcacaaagtcgtccgccttcaccaaatcggacagatcgcgagtgatcagagaaccgctgaaacattttcgctttttaatgaatattttatgttcgttttttcgtaaatttcctcgactttttctctgacggaattaaaaatttgagttttctcttttcattttttgctcgcgtatgaatgaaacgattcctttaatcggcagctttttaaacttacgccgtttttcggtcgatggacgcgagggcatttttgagcgcattgtaagcggtcgccttcattttgaggtcgttgtcgatttggctgacttgctgaacaaaacgaaatgtgtgccaaatggaaatggactttctcagagaaaaaattcacaggaaaattatgggaaatttttttgttttgtttttttttctcggaaaatgccatcgtttttaacaattctcatgtaattaaaacatttaaaaagattgatgctatgtaatatttaaacggcttgtaaaagtaagtccgtattttatggtggccatttattttagtttcgcaatttccaaaaaatgggaaaaacctttccgattaattcgctgagtgccttcagcgactgtttgatcggatagcgcgcggcctcccactgaaatttggtcacataagtgcgcatgtccactgcaaaaggggaagaaacagatttgaaattagacaaaa

SEQ ID NO: 15935 - DNA, 1590 bp, Heterodera glycines
tctgttatatacgttctaggtcgattcaaaaaagagccttcttcaaaagatcgaatttcggcgctagttgcaaagttggcctttttgaatttcattaaaatcaaaaggggggggggaggagggactctttgttttgcaattttttttgtgataaaaacaattattttatgggttttaaggtcgcttatcacaaaaatataattaattttttattcgaaattcaaaaaactaatgtttattgataaaaaattcatatataaatatataattgcatttacttgatgcaaatgcttttaaatccaattaaattgctgggcagtggcaactggtcgagcggaaaactgtcggatttaaaattaaatttaaaaatcaataattgttaataaccctcctaagctaacaccgccgccgtagatactaattcttttaaatgcccatttccgcgtttttaagtgcgttgccacaagacaatcgaatcggacagaaagcagtgccaacttcagcccgacttttgcggggttaagccatgggaaaatgtgcagccaaatgtcgttgcacacgtagctaaaagccaagtaatcacatgatttgtcctcactttttgataattggcccaatcaggtaaaatgttttcagagtaaaaattaaaattgataaattttcatcaaaaaatatacttttaaattaaattccattttaaatacatatacatatttatttaaccacacatttttcgtgaacatttgcgcgctttcattgaaagccgtgcgcttcgccttaggccaccacatgtaaaggaacccaatgccaaaagtgaatgccgtcgttgggttgccgttggtgacattttggccaactttttgaattatggcaagatgaaaagccaattttttacggatttaacttgaagaaacaggaggagaaaaatagtttacctatttgtctttgtgaacaacaaaccaaacagaaaagcgaatgcaatcgatggaaaaggacgcacaagtgacggactgacagagagagtaaggcactggtagagaatggacaagaaaaaggaatggaacatcgttttgttggtcagagagtgaaatactcaaaacagagagagtgggcaaaaaaggattgacagaattttgggtccggctgggccttgtggtggtacattactccgcgcaccgccctccccttgggccgtcgcccccacgaaaaacgagcgggggcgtgagggggggggggcgtttttaaaaatgattaaattaattcatttaaatttcaaagtcaggtttgaccgcgatggtgtttgcagtgaacgaaggttctgccgaaatagtgaagttgttggttgagtcgggcgccaacgtgaacttgatggattacgacaaaaaaacctctccccttatcatggggtgccaggaggatcgctttgcttgtggtaagtctgtcgtcagttaaatgagtttgggttaatgcccgttaatttcaccatattcctttttctaattaaaacaaagggaaaaccagccacttaaaggcaattttttttgtaaatttaagtcaaatttcgttttggagtaaaatttcattttaatt

SEQ ID NO: 15936 - DNA, 860 bp, Heterodera glycines
ccacaaggcccagccggacccaaaattctttaaaaaaacatttttgctgaaaattttagattttcgctagtggtacccttcccagacctagcctcacccaaaatttccaaaaaatttcgctaaatttccaaaaaaagtcaacatttttgatgaaaaactgctaaaatggctcaaaattgcaaatttttttttgcaaaaaccgcctcacaaaattcaatgccaatggcctttattgagctgaagcaagagaatcgctgattaaaccgcaccggatttgtctcgcctgtcaatttgtgctcctttttcaataaggaactgagcaatttgtaattggttagaactcgcagcatgcattagcggcgttttgcgtctaaaatccccggactgaaaatcttcgccgctgtccacacgtgttttaactgaaaggcatgcaaatgtatacataacctattccatgccagtgatgttagaggttttgggtttttgatgaaaattagaaaaaaattgagtaatcgacataatattgcttcggtggtccttgaaattttttagaaatttctatgtttaccaatttgttaggggtgcaatacgcaaccccttcgccgcccctccccactggtttagggtctgttttattaacttacccgcttcaaaatcgccttcttttaccaaagttattaaatcggtttccattttgtgaagaaataagttttttgccttaacaatcggtgcttttcaattaaaacataatttgaatgtgagaaattaaagtccgtttgccctattgttaatggcttttgccaatttttagcagctcggacaatgttcttataaagaagctttacacaattttgtttata

SEQ ID NO: 15937 - DNA, 1968 bp, Heterodera glycines
tgtccaaatactttttgagctgcatgatgaccatatctttgccaatccgtcgcataactttttgaaaagaattttaaattttttggataaaattgacattggcaaaacaattactaaaagcacaaaattatgctttgggtcactttttgtcatgcatttattgacgaaagcagatgaagcagactatttgccaaagcttgaatttgtcgaattatttaaggcacaaacggacgaattatgcacagacgaaaggtggggaagaaagtaataacataatttgttaacattatctattttaatgaagtctgcttggagcaaaaaataatttttataataattacttgtagaactcgcatttgaagtataaattcactaaataataaatttaaagcattgaaattgccagaataaatgcaaatgcttaaaccccggccaatatatattactgggttttggtattaaaaaataagttgaaaaattcattacttattagcctaaggagaaagaaaaaacaatattcatttaactaatgattggtcatttagaacagaagaagaaattaacaaaagcatcggggagaattcgctaaatattgtcagaatgacaaagctcaatttcaatcttgacaaaggcatgtgcaatatttgtaaaaaagcattaaattttttaaattcaatttaagtagtgatttattagagtccgattagactgtcgcattgggggcaaaaaaaaaaaggtgaaaatctgatataaaaatgaagattccccggatgttaattgatcatatttaatcagaattggattatcctgagagagaagggtccgtagttcgggtgcacccaaaatgtcgctggttggactacactttgttcattgttaatcaaattaagcattcttggtattgttcgtgagctttgtgttatttgccaaatctcaaattccttaagttaaaaaatgttatgaccgaaataaattcaacttgccatgtttttgtacataataataaaaaaaaattaaaattttgctggctaatagagtttttcaagtgctttcaaacaatattaagatgtttaatttggttgagaaagaaaaatttatggtccaaaaatttgcccgttgacttttcggctggcgacgttttgtcctactccaccgtagttcagctggtagaacactgatccgcaaaagccagagacgccggttcaaattaggcccgtcgcaagttttttcctcaaatgcttccccaagtccttcctacataattcaacctaaacaaatgccataataagcttggcacttttaaatggcgcctatcagttttaatacttaatttcgaaaacttttttttaaataattctccataagatttaccgcaaataattcttcctgctcttcttaatgaattggaagaaatgcttaaaaatgagaattggaattactttaatttaaatcatgttaaaatggttgaatggcatttgttggcattggcacttcgcaaagatggacaatgccaaaaatgggaggaaatcgaagacaaatgggaagaatggaagagcgaatttaacctttcatttggaaatacgaatgaaagtcagaaatttcaaaaattaatggaagaaattaaagaaaaaatggaaaatttgaaaaaaataatggaaaagcgtgaaaaggaatgattaaatgactataatttattttatcggatcatcgcaaatgaaaacaaagattaataaattacaaaatttgagccgatttttggcgaaatttggtaagcccaagtaaaaaaagaaagaacattttgttcattttgttcattatgtatttattagttgttgaacaattttttcaaccaatgtcactatattcactgcattaattcatggtcttaaaattggaaattatatgtatccatctatgtattcgaaagaagtgttaatttttgttaaggtttggacaaaaaacgccaaa

SEQ ID NO: 15938 - DNA, 1563 bp, Heterodera glycines
agcgcttcaacagttgctcgagtctccccacattttccattacattttcgattgtttctccgcctctgatcaagtctcttccgatcatcacaatgacgactttcacttttgatgataaaatagcgctgtcaacttcttttatcacttcggtgatggagccttcttcagtgccaataaattgtattttggccaaatttttagcaattgcttggccgaagagtctcccacgatcacgcttgtgatttgttttgaagtgaagagggatttgcttttcccgttttccacacaaaaaaaattccgccttgttcgtctgctcctcgagtcgtttcccgggtttttgttcaccctttttgtcgacagtccgctgaaagttgggggatttgtttcccgtttacagaaatgtcacttgggctcgtctaatcgtgggttttactttacccgtttacaaaatttggctgtccacagtcacttgatccggctcttctcttgctggaaatttgttttccctttttccgatttttccacacttgtcgacacctctttctttcttattcggcgtcgtttttccctttttccctcatctgttgtgctttcaacattaaaaaaagtaccgaatgatttttgtcccccctttaaaaaaattcaaaaatgttaatgtaaaaagtttgctgaggtttggggcgtcgctgatcacgaatccggcatctttctgccaatttcgaaccccgggcccaaaatcgaacaaaaagtcaaaacttcaaatttttgaaattcgcattttcgactaaaaatggtttgaatataacggaaatattctctatgctctgtttcataattactggattcgtgaatacgacttgaaaactagagcccggaattttgaaatggccgggaccgggacttggaaaatggaccgggacttggaaaatggaccgggacgggatcccggggccgggactcccgtttttctgggactcccggtcccggtcgtttgtccaaaataaccgggaccaggagtcccggcaaaatcccggcgggctcccggtcccgtccgacgcattcaatgggagggaaaaattgtaattggggcgtttcagtaactcatcaagaattagaagataaatatattatgtaccacaattttaaaatgcatatttttaaaattctcggtattaaggtttaaaagcacaattaaaattcaggaagtggactcattggcaaaacaaattctatgtagtttggcgttatgtttctgctcactgatcaactcttctgttttctttgtaaacaaatttgttttctttttgttgccttttcatttttgttttcatttctgtttttaatttacaaatattttcgtaaattttcccaatttttagtaaaacaaaaccaaaaatgcgaatttggccctcccctttcgttcttccgtcccttcccctcgcacttttcctgcccatttgcttccgtgtcgttctgttgttgcgcttcggcgccggacgcgacgacgccgcggtcggcgaattgcaacacaaccgactgcacccgtccgacaccaaagagatt

SEQ ID NO: 15939 - DNA, 1858 bp, Heterodera glycines
tgttccccggaaattttttagaaaaagcgcgccgcaaaaaagtgcatatgcggtgaaatgaggaaaattaccaacagaaacaaaaaactattcgttaaaatttcatttcggcgaaaaatacaagtcatttgaataaatattaaccatttttcattgcatataataaaaattttaaatgtccttggatttcatgaattttccccgttatgtccttgaaaatcggcatacccgtccttggaaacggatcattgacgatgagagccctgctttaaatgttttttgatcgattcaacacttttgaaaatttccaacgtttattcctattcatgccggtaccgttctattctacaaattgaaaataaataaaataaaattatatggatcaatttttaaggcgcttttaaacttcgaacaaaattattgggacgccaacgcttgtcacactgacctagaaatcattggtgacaaaaatttgacggttcattataaggaaagagcatctggtaattttattccaaaaataaaattaatgggctaaatttaaaaatgtattttttacttcgaaatttaagcgaattgaacaatacgtttaataaatatgcgataaaaacataaacaatattgccacttcatgacttaaaattcattttatttcaagtgttctaagtatatttgttacagctccagcaattcttcaagaatttaaaaatttaagactttattaataggttttgttcaaaaatggcccagttttgttggaggctttgcacaaatttttgaatttaagtgaattttaatagaatttttactcaaatgatcttccgctctataaaagatttcttcaaaaggttggcgtttcgtcttcgcaaaacatccatttttgctgggcattggttcatcggacattttttactttgaaatttcagtaaaaaatgggggatggtaaacgtatctcaaggatgtataattttaaatttccatgaatttcagtggcgtctgcttcggatttggcgtaaaaaagcagccaaaatcggacgaaagaatgtatgatggcgagggcttctacacatatgattccaacggcattttttggattaacggttcatacaaaggaatgtttgagagaaatgcttacggtgttaatgacattgtcgggtgtggcgttaatttggcaactcgaaaaatatttttcaccaaaaatggtcatagaatgggtaaatttaattttacaaagtttttggatttattttaattattttcaggcgctttcgatttcgattcattttctgatatttaccaattgtttccattcgtttctttgccttactggagcgaaagaatagaggcgaattttggcccattttaaattcaatttaaatgtgaaaaaattcactaaaatgttcttttgtaatttttatgatcattggacttcaaattgtaaggatttttcgaagcatttctctcaatttattttaaacttcaatattattctttttttcgctttgatttatccaaccaacaaaaagcgattaaaattatatcttcagtcatttgattcgtttgggattttggggctcagtcaaagggcccatggctttccccgattccctcccaaattcaatccggaataaagggtgccgttcagggatttagttccgaggcactaaaaattttcggaagtcggaattccggggccccaaaaatttcggaagttgaaagtcggaattccgaccccaaaaatgtcggaagtcggaactcggaatttttcaaaaaaaataaaatataataaatttttttaaaatatttaataggctaaatttttaaatttttaaccatgtaaaaggtaatttcaaactgt

SEQ ID NO: 15940 - DNA, 1305 bp, Heterodera glycines
atcctcaaaataacaacaaaaatataaattcaaaataaaattcatattttccccggcggcgccttagagagttcacagtaaaataatatttcttaattaattaataaagttgctttttacgaatgccaatgccgaagaagagaatcataaagtgaaaaatgataaagaaatgatggacaaattggtgcagcaaatggacaaagaaatagatgaggtgagcttgaaatgtgcttaaggaatttataaattaaatttaagctgtctttaaacatcggtgctggtcacaatgacaacaaaatcattggtgaaagaatttactgttaaataaattataaaaatatttaataattacctatattttaataagcatagaaatatttaataacattttttcaaagcatatatttcattttaaaggaaaaacaaaatgtcaacaagagtccgccattatgccaaggaaaggcaaaaaagtgaacaatgtcagtgatttgctacgtgggcgagaaatccaccgccaaacttccaccgtttgggtaaaactttgatgccattacgttttataaatatgccaatggtcagcaaatctaaaaacaaaaataaattcacatattatttaaagtattaatttttttgtccattttaaacttattattttttttcgaaaattaattaaactattaagagaatacttttttatctaataatagaaataaattaacattaacattcatatattaaaaaaagaatatgggatattttttattgatactttttcaaaagattttgagattttttaaataacatattctattgtacaacacttaaaaatacgaatatcaataatataaatttttgatgtttttaactagtgttattaattttattaatggactaccgtatcttaaggcgtttagtagagttcgacctggacctaggtgcaagcccggattttccctggttcaaggtccaggctattttcctggacatggatttttgttcacaaatttagcccctgttgaaattggataaatcattacatgctttttctcatgaataaaggcaaaatgtgcctctaatttgcttttttccctttaaatcagggctctcattcgtccttgaatggcaaggacgtccttgaaattgggcctttccgtttgaaaatttaaaagtatccttgaattcaagaagtccttgaaaatgagcatttggaaaagttttaaaaaattcaaagatatttgataaatttttgaatttataacatatttgaattaaattatggcattatgtcataaaatgtaaattttt

SEQ ID NO: 15941 - DNA, 1994 bp, Heterodera glycines
aaggcaagcaccccgagtacgagcgacgactccatgagcagatgggctcgtcggttggcagcggcggcggcggcggcaacaatagcacaaaacagcgccaaccaccgccaccactgcagcaacagaacagttttggcagcggacgcgagttggccgcgatgcgccacaaagcgacgatgggcggaggaggaggggcaggacggaaacaaacgtaaagcatatattggattgaaggggggggggtgagagcagggaaagtgccaatttgtgggatgtggattatgtcttcggttgagatgcataacacggaaaaaattaattggatcgaggcaaaagcagcgatttatttatgcttttgtagttatcttttttcattttttgtcatttagtgacaagaaacgtggtgccacgggcagtggttcgttggagaatttgcctgcaattgccagcaatcgaggccgaagtgggacgacgccaattccgatgacaaagagcagcaaaaacagcagcggcggcagcattcactcggccgctgaacaaagcagtgacatcgctttcggctcgtttgcttcgtccaactcgtccaagggaaaccagcggaagcaaaagtaaaaataagggggagagttggcacttacaattagcatcatggcatatttttattttcctcaaatgcgaattaatccgaaaaattgtccatgtttttaccgtagtattcctgtttgctcattttcattttactccgttttagtgatgtaacccatagagtcggaggcgattcgtcggacagtttgtccgcagttaccagcgaacggagcagaagtgtcgtgacaacgcctgttccgacagcgggcaaagggagcaacagtgccaactgcacaagtgacgacggtggtgaacacgatgacgaccttgggtttgatccatttgcaggtaaagaaaggggagtgtttttcaattaaaaaatcttaaaaatttccggcaaggaattcctctggttagggcttggacatcattcccgacatttatttaaccgtttttgttttgttcagagtcatcaaaggcgttggaagagatcattgaggaggagaagaactgtaccccaccggcaccgattggcacatgtaacagtcggttgcgcaacggaacaattaacacggacggcggccatcattcctcggcaactcagtgagtttggaaaatatttcatatgagagaagaaacggacatggaattttcaattttgcctcaaatcgggttccaattctgaccgaaatttaatttacatcccttcatttccagcttttttcccggttccaccaattttttcggccacgactcctccaaccatttgctttcggcagcagcgcgtaacggaccgccaccactgcccccgcccggaattcaccaccaatcgcctttctctgcacaaacccagcagcagcagcaacaggcgaacgccttcagcagcttttactcgccgggcggtggtggccccgccagcaatgtcccccctccgtcagcagcagcggcagcacattttcaccacaaccataacggacccggttcgatgatggcatccgcttttcaccaggcaacgctatcctcattccctacttcagcacagcagcagcagatgtacaacaactcaaacttcgctgccaacaacaccagcagtagcaacagtctccagcagcacaaccatcatacgcagcagcaccagcaacaacactcccaccatccctttggcggtggcattggcatgggacacaattcgttgggcgaccttcgcgaaacgttcaaggcaaccttcgccaccaatccgcagcatcaccatccctttggcggcggtggcattgggcacaattcgttgagtgacttgcgcgagagtttcaaggcgttgttgcccaatgtgaacgtgcggttcgtgtctgacgcggctgcgtcaagtatggtggtggattggccgaccagtactacttatccctgactgc

SEQ ID NO: 15942 - DNA, 1787 bp, Heterodera glycines
atcgctgcggctgccttcggagcaggaattgtaatgctgcgctttcttcattttttttcaaaatgcaattcaaacatttttgtcccttttcagtactgttggaagacgtacctcggcccgttgctcgaacaaccgaagagcgacgatgaggagaagcccaagccggaaggaggcgaagaagcgacgaccgccggcgacaaggaggagaagaaggctggcagcaagggcgacaagcacaagaagtctggcagcaagggcgacaagcacaagaaggacaagaagtctggcagcaagagcgacaaggacaacggccccgctgacgaaaacaaacagccgcaaacgagtgcttatgtaagtttatcgcgtcttaaattaccgcacataattaattttttatcaggcaactcccacctaagaacttcaccaatgacgcattcgactgaatagaagacaacagatgaaaacaaattcagtaaccacaacaacagccaaaagcaaaccaacggaggaaaaagaatgggaagcgatggaaacggattcgaaatgatatttaatgccacaaaatatttgtatgtgtattatacataggtatatccggtcaataaatacctatctaatttgaagacaggtctgttttacgctacgagtttcctttccaattgttttatgttggtattttggtaatcctgtattttattggtcccataaaaaaaagagattaaggttgtttttatgcaattcggagtagtacccgggggttttcgggggctctgatcacgaatgtgacattaattttaacctatttcgaatcccgaacccgaattcgaacatttttttataaaaaatttttaaaaaattgttgaaacgcatttcctatgggttttggggtcgctaatcacgaatctaacttcagttttatctatgccgaactccggacccgaaatcgaacaaaaggagaaaattaatttttcaccaagaatcacatttattgtcccaaacttattcaaatgaacggaatataatagaaaataaagattcaaggccatttagtgaatttgaatcgattttggacaatacatgtgaattttggtgaaaaattaatttccgacttgtgttcgagttcgggattcgaaataggtcaaaattgatatcatattcgtgatcagcgcccccgaaaacccccgagtattactccgaaatgcataaaaacagctttttaatctcttttttttatgggaccaataaaatacaggattaccgacaaaaatccaggaaaatccgggtccaggaaaaatccaggttgccgaaaaatgacctggacctggatccaggaaaaatccaggcctggatccaggtccaggccgatctctaataaaaaacgcatgattctagtcggttttatgcatcccatggcagattatgcgtcccatgaatgaccatacccagtttcttaggccataacttttttcttatttggtcaatacccatattcttggtaccaagcgaaagataaaaatctcgagattttataaatgcaaaactttcttttcaatgaatttggggtagaaaaaaagctgatcacgaatatgaactcagcttggttcttatcccttttgtgaccccccctgaaaatttttttaaataattttttctagggcatttatgcgctgaacacgaatatgacgttcatttttagctatcatgagttttgcgtgagttacgtggaattttacgtgaaaaaatttaaaaaatgtaaagttcaaacatcaggcgggcggcatgaaatc

SEQ ID NO: 15943 - DNA, 1880 bp, Heterodera glycines
  misc_feature (1809)..(1809): n is a, c, g, or t
  misc_feature (1817)..(1818): n is a, c, g, or t
tttgctttggttttggcttcggcttttaagcctactatcacacccgcggcgagaacgcaccaaagcatgggtgtcaaaggagccgaggggttctgtgatagttagagggacaatagggtcccgccctatcacacaccacacccccctcattaatgtggcgattaacttaccttaaaagctccttttcaatttcaattttccaaatattttattattaattgtttttcgtattttcatgtttaataaaattataaaatttccttccatacaatgttatcaatttttgcatttagattttcatgtgataattgaactttaatttgttgccatgaaccaacacgcgataaagctacatatgtctgaccatgagaaaaactttgtctcgtccaatcaactccaatttttttatatgttgcaccttgtccttttataaaagttgcagcaaaagctaagcgaaccggaaattgatgtctttttaatggaacaggaaattcgctttcagttattagagaaattctatgaatataagcttcagaaccatctttatcaccaccaagtattatacattttaatacattgttttttaattctttaacttgtaaaattgttccattacaaagtccgttttcaatgctaatattccttagaagcattatcttacagtttagcttcaattttaattcatgaacagggaatcccggggcattaaatgaattcattatttctggtgtaactggaaaattattagttgtttcaacttcatctatgcttaggtaagtcacgcattcaccaggaaatttttctaaagcagctgtgttatgttgatcaaccaaatcattgtatggtgaaagtatcaaacgattttttaattcattaaaattacgttctttaaaaacatcatcataaatttcatctattaaatttgaatcgttggctatgatacaattattaggtaattgaatagaatcgccaaaagttccattaccaatttcaagtatctgttcagcgaaaatttggtctttagcccgattatttattgttaatttcatctgctcaaatttactccaaaatattgacttttttattgtcaggtcaataatttcgcttcttactgcaaatttttttacaggtaacgtttgtctaaaatcacctgcaagaattattgttttgccaccaaataattgtttacagttagttaattcacgcaattttttctcgatagcatcaagtgcaaatcgtggtgtcatcggcgcttcgtctataacaaaaaaatcactttttattatttcttcggcagctttagtgccttgaacaactccagaaataatatgagcattaagattaagcggaaatttaaatcgattatgtattgttctaccattttttaataatgtagcagcaattcctgaaaatgccatgtttgtcatatgtagggctgggaatttgaaaaatttatgtacatattttgacatttttgccatttatttccatattttgagatttttgccattttatgtccatattttgcgatttttggtccatattttatggccatatttcgcgattttatatccatatttttaccagccctagtcatatgttttttataactacgtactaaatgatataatgcattcaatgtaaatgatttgcctgtgccacccgggccatcaatgtaaattaatttaggattaagtttgcctgatgctatttgttttattttcgtaaataattttttggtcagcgttcatagacttatacaaattttctgcgattttcttttcttcttcatagtttatattttcgttntcttctgnntaaagagttttctggggtaaatttttaaatctttcaaagatttcccctcctgttataaattt

SEQ ID NO: 15944 - DNA, 2913 bp, Heterodera glycines
aaccccccccccctcacctccgccggtccgtccccttcctcctccacccatttcctttccacttcttttcctgcaccttcgtcacatcgatcttcatttcttacttcaaaaatttcagaaatttttcgtcataatttttgcataaatcggacatggcttttggcatcagtcaaaccattctttcaatttcggtggccctttgtttatttccccgaattctcgtgccttcgtcggcagagcattctttgctttctcgtcctaacctcagcccttcctccctccatctctgtccacttccgtccaaacccaaacattcgtcaaattttggcactttttaataaataaatacctctaacgaaaagaattttttttcttgataaattttttatttttgagcctatttgaggatttttaactatttttgctatttaaattttttgcgcctaaaattccatcccttaaattatagatttttctttcactccatttattcttcagtattatctggtttattaatatacaaatattattcttaatgcccttctaccattgttccaaccctttcgatgatttggccgccgtagggtaaccaaaaagggcattgtctctctccgccaccatgtcgctgtcccccctctccgtaattggcgattctttcaacgataaaccgcctgaaaagcctcctcgccaattccattatcaatcggtggaggtaatgttctgtcattcaatcgtactgctgatttttaaatattgaataaaataataaataataataaaattaataatctttcccccgtccccttaaaaagggaaaattaaggccaaaaatacaccaccattcactggaaaaatacgcatgcatattatatcatacaaatgacaccgagctgagtagaagcactttctcgggacggggattagtttacctgttccattgactgatgactgtccccacccctccgcttttcacattttttaaactctctccatttctcattctatctctccccctttatttccctttcaatctctccctccccctcctttctctcaatctctccctccccctccattactcatctctctctttgattcccaaatcttcctttttctccatcctcctacatatctccctccctctttctctctcttccttctctctttttacatctctctccccctttctctatctctttctctctttatttctcgttctatttccctcattatttatctcgctttctctctttattactcctctctctatcattcccaatctccctttttctccatcctcccacctatctctctccctctctctctttctgtttctcttcatcttccttccccttgaatcgatcgctccttcgtccacctttgtttggatgacccacccacccttcattttcccccattaacattcttcgtatcccacaaatatcctctcccttctctccccttcttctcatttcaacaaatcattcgtttccacttttccctcttccctttctcctccgttttctttcgctattccctctccaaattggatgcattttgcacttttccttttcccctcccttacacttcctttttcaaaccttcttctagcagttggtggcccctgccatgcctttgcttccgtcctccgccgttggcacttcgcctgcgtctgcttcgtcatcggcagcctctccttccgctcgtcctttacgtgttgcgcaaccccctcccttggctaccgccttcccctcctgttcttccaccatccctcagccaccaaattccgtcgatgcttcttcgtcctttttgccaaattccatctccgtgccctccctgcccaaacccgccattcagtttcatcgttcagttgcgtccgtctcctcagagattggaagtcggaccggaacaacgaataaacaacagaatgccccggggggactgaatgggcggggggacagggggagaagcagatttgtgcagaagaggtaaagaggggtggaaggtaaagagaagagtgaacagagagagagagagagggacccgttcagctacgaagaactgctcgaactcgcccggaaccaacagcggcagatcgaggcaaatgaggacgagttggacgagaggagaaaggcggtggcacttttcggggtggccaaaaggaccgcagccagtcaaagcgaactgcaacaaaacgccagaatgtataacggaatattttttttcaaatttttattcaaattcttgtaaaataataaaaactcctggctttatctgtttaaaatgcaaaaagggggcgaaatccatcaaaaccagacacatattaacgattcttcatcagacttatggctaacctccgtgctcaaatctctcacgacgaaatggaaatggttcatttgggaaaacgccaaaaagaggcaaaaaaattgagggagcataacgaaaaacagagcagagaattggcacaattggaaaacgaatatggccatggtgagagaggaaaagcaaaggacaataagagaaatgataattggacattaagacgatgaacagctgaggagggccgtggccaaggtggacgcgttgaggagacaggtgaatcccttgtccgaaccaactccaaaaagggacactgtttcagctggaaatgctttatcagcatagggccatggccgctgatgcggcaacttttcaacagagacagataaatgctgaagaaaatgccgagaaaggcagcggacgtgtcgaaaagcggcctaaggcatcggttgtgccgtttaaagtgactgagtggcgggtgagaaggaaaagggatggaagaagggaattgtggtggattaagcaagggaacggtgaagagacttgcggataaacgaacgaagcggactttgaggggggcgacggacagtgccg

SEQ ID NO: 15945 - DNA, 2108 bp, Heterodera glycines
  misc_feature (54)..(54): n is a, c, g, or t
  misc_feature (107)..(107): n is a, c, g, or t
  misc_feature (138)..(138): n is a, c, g, or t
  misc_feature (140)..(140): n is a, c, g, or t
caattaaaacgtcaaaaatgatgaaaaaaaatgcaaattaatagcgcacactgnctatagtaaatgtcggacggctcagtccctgttaaaagtggacacttaagtcncactttttacacgaaaaatggcaagtgcgcncntaattaacatttttctcatcgctttaggtaggccactttaaatcaattccgaccgtttttgagcaattttgagttttggatctcagattaatattttcctacaatcttttttgtttcgaatttgcgacaatttttattaaccatggattcaagaattgaaacccatgtaaaattttttattaaaaatcattttaaaccaatgaagtcgaagcgtgtgaaggaaggcggacaaaccctccattagcaccaaaattgaaaaggtcagaacagcaaaagcgaaaaatatgaagtaaagcacaaagtatccggcgacaccgaggtgaaaggcaaaagcatttttgaggacctgaaaattaaacaatttttaatgcaaaaaaacaatttaaaaaataaactgtaaaattactgtattttatttaccatagtccaaagcacttcagagagttgcgcatgggcaagtgaaagggcccaaagacgaaggtatgaagctgtgtgggacacacagccgagcacatattcaatggtgtgaattgactggtggaccataatgtcgccgaaagactaaaaaaaataatcggaattcatttgattattcgtgatttataaagagaccttaccaataagcacctattttgagaaatttagggattagggggacctaattgatatggctgggacaaatatttattaaaaataccgaaatatttaaatttttaaataaatatttacgaaaaaatgccgaaatattgacaaaaatattgaaaaaagtcagaaatattggccaaatttaagaaaaataaaaaaatttgtcgtgtaaaaaataattaactgctcataacattataaaaaattattcatggattacaattgcaaataatgatattttttcgattttttgaatgcatttttccaaaataattaaaattacaaaaattaaaatttgggtcaagaaaaaataaataacaaaaatggaaaaactttttaaaaacaattaaaatgaaaaagttttagggaaaatttttgaaaaagcgcaaaaaaatgaaatatttttttccaaaaatcaacaataaatttattgacgaaaaatgacacccaaatgaaaaaatttaatttgtcccagcccgactaattaaaatcaactcatatcatttccgttttttttaattgagagtttatatgtggccaatttttttatatttaaataataattaatttgacttaaaaatgccaaaatttctattaaatattttatttgtttcattctaaatattaattgacatctgaaaataaaatcataaaatagatggtcattttacattatcaattatttttcttttttttctttttggattttattcgtccatttttcaaattccatgaattccatcgccataataataattaatttacttcatcatgatgcgcaccgccacctgcaccactgacatggtcatgtgcctcgtcaacggagtgcacttcgtcatgttttgtcgcattgcgtccatttcgtatcacatgcatctcctccttttgcatattaatacgaacactctaaaaaataatttaataaaaaaaaaattatttaaataaatttatattatagccatcaaaatgagtacctaagtccaggttttggcctgttttgaccgggaccgggaaaagtcccggtttcccagccaaaaagtcccggttttaacccgaaaagtcccggtcccgttctactctagttgaaatgtatgctttgcatatttgatttaattaacattttgattttacgtgacattttattattattaggttataaattttatggactaaaaaagcccgaaatatggacgaaaaagctcaaaatggccaaatatggtgaacccaaatcgatacttaggtggtgtatttttcgctttttttttctttttcctatgaaaatttgccaaaaccccccaaaatatggctttatatggattaaaa

SEQ ID NO: 15946 - DNA, 2048 bp, Heterodera glycines
  misc_feature (80)..(80): n is a, c, g, or t
aaaataaaaattctttaaaaatcgcaaccaaaaatgccaaaatgaaaacgaatgttaacattaattagacccccaaatgnaccaccactatatgatcacattagcctgggaaaagttaatttttatttctttaatgttccctaccatattatcggagactgcacgttttgcacgtcgctgatgcattaaaatgtggaacggcttgccaaacagcataatcgggatgcataggaccgcaataatgacaagaatagcctcgacaaatgactaagaaattttaaaaattttaaattttaatttttataaaattcacacctggccagggtaccattggtttaggtaacaaccaggcaattccttcccgttgtcgtcttgaaaaccagcatcgcgagacttgaacatgaacctgatttgggcaatttaatgcaattttaaaagatttttttatagaaaaaacgttacatgttgatgagaccaatctaaaaaaataaataaaaatatttattatattatatatttggtaaaataaatgagagatgcattttttggtaaattatgcaaataaattcccaatgctatttttaattgttcttaaaaaatttgattcaaatggtgcaaaaattttagtgatttggacgaaataatagatagtaccaatagagtggaaacgtcgcgcgaagaaatttatgaaaatcttatttttggggtctaggtcttagaagtggtcgtttgtgccaataaaaatttacgacctctgaatattattataaatgtcgtttttgtgaatataaataatctaaattatcaaaattcatttaatagtttttttttataatgcatctcttgttttcgcttaagttcattaaaaaaaattttcttaccaaaagtgaaggggcacagtgcggtccgggataatcttgagctaaaatgggaaaatattattttattccaataaaagacaaaataattaataaaaaatattaaattattttaaaatagatgctttttacttaaaattgttgtcggctccacccaaaagaacagccatttggcaattatttgaaggcacagataaatgaaaattgaggacatgaaaaccaattgaggaatgaacacggtgaacacttcaattggcgattcgaaaaatctaaaattaattgaaaaataaaatagaatttccaaaaaaatcatattgatggaagaaatattacttataattacgatatgaaagtgccactccgaaggtcatttgtgtgatgccaacaatcacactgagcttcattttcattgaattcaaaaagtttagcttattattatccgccaaattccacacgggatccattccaaactaaattgatcattaattaattcgtgctaattttattggcaattttttaattattaaaaatgtaatttaccggatatggtcctctagcccggtcataagcagtcatcggattcaaatggacctccatttccttccccgcttcttcgggtttactcagccatgaatcaatttcggtgtcactgcaaatttcattattatatattttttaattttatttatgattatttattttttatgaaattttaaattaattttttctcttgttttacttaaagaattttattttaaagttatttactttttttctaatatattgtatttaataaacattttaaatgtttttcttttttatttttctaatttagctcatgatttttaatatttattttttctaaataaatttacgatttgaagttttatttttgttattttattttttattaattttctaattcttttttttttaattttattttattatttttcaatttttattcgttttactatttaagttttttttttattaatatttcttttcttttacttatatggaatgttcgcccatgcgctgccaaaaatttggaacgatttggcaaacgcgtcgttgtacagcagaccggcatggatggagaacagtcccatcagcaaaatgatgtaacgaacgccaaaaaacatatgaaaatctaaaaataaaataaaa

SEQ ID NO: 15947 - DNA, 3047 bp, Heterodera glycines
gtaaatttcctttgctttttgtggcgcaattattgcgagtgccgccatcgcatttgccacgagtgtgggccgtgacgcgtgatctttggacaaacaatcgacgagagcatccaaaacgtcggctgagaccaattcgtcgatcagctgttcgtccgcgttaccttttagtagtgatgttcgagaccgaaaatttcccgagactcgagactcgagaccgagaccgagacttgaccccgagaccgagacccgaccccgagactgaaaaccccgagaccgagacccaaaaaacccgagactcgagacttttttcaaaaaattttcctattcgcttaaaaatcgtttaaaaattttttttgactctattcttaactaatttttggtttttttttattttgattcaatttggtacaatatttatcatttcaaaaaagcacaaagcaaaaaattagtttgtttttttcgcagtttttgtgtcaatttaaaaaaataaagggtattttggagctccggcggtgccgataggcgccgccggggaaaatttttaaaatttgagtgcaatttgtgaacaaatttagtactaaaaatgacaatattttatgattttaatttgattagattcacttaaaaaggaataattttgaaaaattggaagaaaaaataactacttggagggatactgatccaacgctaaaatgaagacatgagcaagaatacaacccactgagccacgcacactaaggtaatgaagcaaaaatataccaaaagtatatttatttctaacttacaaaaagccgatcattaggggtgtaaaaaaagtctcggtctcgagtctcgaaagtctcaaagaccgagactgaaaacccgagaccgagactcgagaccgagaccaaaaaaaaccgagacttttctcgagtcgagactcgagaccgagactctcgaacatcactaccttttagactgtcctcgagcatttcccgaattttagagattgcttcaagtctctcttctatatctctgctttttgcattcgcaataagctaaaatttttgaataatttgccgtatttgctgaattagagctcccactaatgaataagaaccacgtcccccacccctcaaaaaaacctctttagacgagcgttaaaaataaagtctcccccaccaaaaaatatatttttaaaattaaaattctttaaaattcagttgcagttttctctaaataatttttttgtctttaaaagtgaatttgaaaaaattagcccctccctgatttagaatttagagttctcccatggaaatacccccccccccttttcaaggagaccaaattcagtaaatactctatctcatatcccagccaaaatccgaacattgggcatgattttcttcagaattgagacagcatttttcttcacttcgtcgtccgtcgaattcattagccaataattcaaataatccataacattttgtatttcaaaaacaagcttttcttttcgtgtcacaatgattgcgagtgccgccatggcatttgccatgagtgtgggccgtgacgcgtggtctttggacaaacaatcgacgagagcatccaaaacgtcggctgagaccaattcgtcgatcagctgttcgtccgcgttaccttttagactgtcctcgagcatttcccgaattttagagattgcttcaagtatctcatccttatcctcgcttttcgcttttttgacaagctaaacattgcaattatcattttctttttttaaattgtattctaatcacttgagcggggtccgcttcttccatttgcttaaaggaagagatcattaagtgattaataatggtaattatttgattatatcactttttgttgttgactcatccgatttgttggaattgcaatctaaagaaacaaaaatcactgtaagctaaaaatatttttcatttgttttactcttaagttacttgagtacggccaccagcgttttccactatgaaaactctcttaaaagaatatgtaagaatatattttttaacagttaaatacaccaagaaaaaatttttcggaaaattattcttttaaattgggcattaaactagagatgtgattattggtcaatgaattaaaaaaattctcatttggctcaaaaaaccttaaagaaatgtgaactggcaagaaatccgggttgatcggtaatcctcaaatcttcattttgaatttttttatcaacctaccaaaaaaccacaatatatttatctaagtcatcttaaatcacatctctatagtgaaccctttttattttaaaagtttaaccgatttatccttttttggagccgaaaatactgtgggaataatgaacgcaacacaaagcaaagttagcagtcgcatgtcaagaatttaagattgatcctaaatagagaccaaaaattagtaacacaaattaagcacttttcgaataaaattcataattcacttaaattagtaatttggttccaactgattagcacttttccaccaaaattcaaattacacttacttttatattgaaaaatttttttaaattctttattctgttgaaatttgggacctgcaaagtgttttttctattcaatatactgatgttcctctttttctgaaataataaaaggatgaccatggtcaatgccattcataaaaatttaccaattacctcggattcggataagattagtcttaaatagggtgctgagtcgttaataaaaaccatgaaaaagggcgttgtataaaaaaccatcaaataaagttatgactagagaccgacttttgaggcatatgccttttttctgcgcactagttccgatatattaagcataaaaaacgcattttccacttcgtttgaggcttctacgttgacttttattatgcctttttttgcctttttcgggattttcgtgccttaaatgccttttttggcattttgcctttttggtgcctttttgggcgttgtttccgaaaaattccattaaaaatgcaataaaatcgggaaaccacaccccctaaaaatgacctgaaaaaat

SEQ ID NO: 15948 - DNA, 1038 bp, Heterodera glycines
  misc_feature (950)..(950): n is a, c, g, or t
aaaaaaaaaaaaaaaaaaaaaaaaaaagcggctttttttttttttgggggggggggggggggggggtgggaaaaatttttttttttttttttttttttttttttttttttttttttttttttttttttttttttttttttttttttttttttttttttttttttttttttttttttttttttttttttttttttttttttttttttttttttttttttttattttttttttatttttttttttttttttttttttttttttttttttttttttttttttttttttttttgatttcattttttttttttaattttttttttttttttttttttttttttttttttttttttcatttttttgttttttcttttttttttttttatctttttttgcttttttttgttttttttctgatattttttgatttagttttttttttttccttttctttgctatttattttttttcatttttttttcttttttatgttgttttatttatttatttttttttttttttttttttttttttttggaattatttttttttttttttttttttatttattttttcttttttttttttttttttttttttttctttcatttttttaatttttttttttttttttttttttttttatttttttttttttttttttttttttttttttttttccccttttttttttttttttttttttttcttttttttttttttatttttttttttttatcatttttttttttttttttttttttttttttttatttaaattgttttttttttttttttttggcttttttttttatttttttttttttttttaaaaaatttttattttttgtttttttttttttttttttttttgatataataaaatttttattattttttatgattgtattacgatttgcttttttttacgattttcttgtctgtacgtatanattctttccatagttttttttttttttttttttttttttttttttttttttttttttttttttttttttttttttttttttttttttt

SEQ ID NO: 15949 - DNA, 960 bp, Heterodera glycines
aggcgtcccgcggaattcaaatgaaattggtggacagtccaaagggaatcagcggaggaggaggaaaaagggtccaaaaagtataaaatgtcggagtaaagagagtcagcaaaggccaaatctgaaaaggaggaaagaaaagacaaaaggaaggacaaaaggaaggacaaaaggaaggacaaaaggaaggaaaaaggaaggacaaaaggaaggacaaaaggaaggacaaagggaaggacaaaaggaaggacaaaaggaaggaaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacaaaaggaaggaaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacaaaaggaaggacttactcggattgagagtcaaaagtgaggacgaattggaggaatgacaaagggcgaagtgacggagggcatttcgcaacgaatacctaaggaagaagaaggcaaaagtcaacaggggaagaagaagaaaagaggaagggaaaaaataaaatttaaaaaaatggaaataataaaattaaaatgcgatggaatggaaatgccctctttttgctttgcctgaacagttccgtgctgtgagcgatcaccgaaaatggcacttcgattgggagaaggcaaagtttgtgggccctttgttggagcagcagcagagaggggacgcgcgagttcaaagaccacagcaaattaattcgcgagggcgcacaatcggagacggacgaagagacggagagagaaggcaactgagacggacagac

SEQ ID NO: 15950 - DNA, 2879 bp, Heterodera glycines
taattagcggagattggcgacggcggcggccgcggtgggaggggggaggggggagtgatggatgagagtggacaacgcgagaaaaatgaatggatgaatgacaaggactcatcacccaatggaaactgacaaaaaccacaacaaactcttctttgaatgtgatgccactcactcatcatagggccaataatgcccttggggaaaagcaaagagcgaccattgccggggggggggcggaaaccaaacaaatcccaccggcggaaaagggactaaaatgggacgtaatgcaaatacttttgggggaaaatgacggaaattcaatttttaaacgggctaattttatataaaaaccgaaggatcaaagcggcaaaaccgacgcattcagcggaatttggcaaaaaattttgaatattttttaaatttaaagaatgccaacaaatttgtttatttttcagttattagcacattcacacccttcattaagttcttttcttaaaatattttttggaatgtttggaattttggagatttgaaaagcgtctaaggaaggggggatataatatggcactcagctgttgtgtatcccctggggaaagggggcaaaaagtcggattttgacacccgccgaaaagagaaagtgcaaaaatgtgcacaaaaagacgaaaagcgaaacaaaggcaaaaaacatctcaattggaatttaaaaattgaaaataaaaggaaaacaatttattgatttggttgttaaatgacacgcgaaaagtgatgacattccaaggaaaatccgcaacatttttttgcggatttgccaaattgcattttggggagggggaggaaaagcgactttccttttttggttgggaaagaaatgcccaagaaatgacggcttatttcggcatatttatatattaaacaaaagtgattttattaatttgaaaggcgcgttgaaaattttatataaattaaaattataattatggcaattaaattttaaatttctctctctctttttgtcaattagttctcattttcacactgccaccagcatcgccttcagcaccgggtcgggtcccttggccgttgtcattgatttggccaatttggcacagctttggggcatccgcagttcgttgcccgtcagaatgtgccagtccagcagatcagccgaatgccattgcacataagtgcgtaccaattcggcagccagcgtggctgggcccggagggcaaatttgggctgaaattaatgggtaaagtttcgaccgtttttatttttttggccacaaattggccattgtgccgtggtttcccttcgctttgtttactcgcaatttgctcctggcattggctgtagcagtgctgaaatgcgcacactctgcccagctccctctcgtacccgtccatttcgtcccccgagtaaactttgcccatttcagcgcccttttccctttccctttccttcgccgcattttcagtcccttccttcggcggatggcatttctgatcacagcgcagaaaggaaatgggctcactgtcctcgagacaagaacgagcgcggaggaaatgttgtcgtttgaaagtgcacaaaaagttggacggggaaaagacgcggtcggcactctatgggaaaggggggggggaaagatagaacaaatttaaaattaaaaaagtggggaaaaatcaaatggcactctcttggaaaaaataagaatttaaaaataaaatataaaaattggtgaaaatggtcggcactccatgggaaaaagggaaaacaaaaatatttgtggggaaaaagcaattagcattttgctggaagaaaaaagacaaaacagaagaatgtaagagaaattgggagacaaaaagagggaaagtcggaaattaaaattatttattaataaaatttaatttttaaactaaatccattaatcttttaatcccccccccctcctccacctgatcccacctgatccccacagcgttcgatgaaacattgcgtctgtcggtcggccaatcgacagtaggccaagaattggccgtagtccaacactttgggatggaacggaaagtcgtaaaagtcggaggcattcatggcgaactccttctcaaaatcgccactccattctcgattgcacgccttggggggcaattagcaaattatgtaattggaaatgcaatttcaatttcaaaatgtcgaaaatgtcatttccaatgactttttctttttcccttttcccatttccatggcaacaaaatgcaaaatttcttttgtaaaaaagcacacatattataaaatgctttttggaattttctgttcaattttattcactttttccgacatttcttcagccaaaggtaattaaagaataaaatccaataaaatcccaattaaattaaatcattggcattttcactttttgtttctcagatgcgattttgtcccattgtgattcgcaattgcaaattttgctgaacgcaacgccaaactttgcttttggcgctgaacaaaggaagtatacggtgttttgccaattaccgtacataattagaaattcaaaaatattttccaatttttctcatttagacatttcgtcgtactttcgtcccattggccatttgatttgttgggaagtttcagcgacattttgccaaattgtgccacattttgcgtgggatgttccgtcatatcaaaaccaatttcggttccgttacgataccatacgatagtccctcatttttttccattttcgctttttagacaatttcctctgatggccattcgctcacttttggctgtctcaattccgaccaatcgtcctttaccgtactatccgtttccctaccaaagccctatttggttgttttgtccctctaccgtaaacc

SEQ ID NO: 15951 - DNA, 3262 bp, Heterodera glycines
agcagaggaatgagtgtcgccgctgccgttcccgcgcgggtcccccgggctcggtcggggtgctgccatgcctgtgccatcgctcgggctcttcggctgagttgtaggcgtcgctgaatctcccgcacctctgcacgtgcgactctcgctcccttccgcactttactctcgatttggttcgccgttggccttgggaggtgtcgtcctgtcgcccagttgatgaaagtgatggggtagctgactccccatgcgattgctcgggagaaaagtgtcgctcccgaccagaatcgtgaggcaattgagcaacagcagcccagcgctgccagcattagtgctgcgccgaacccgaagagggtagacgcccacctcggattgcacgtcgggttggctagctgttcccagcagaaggcgcagctgatcaattcgcactctgccctcgctgggcatcgctgtgtgacgttgaccggggggcccaacccccgccagcattggccgctgcaggagtagccgtggatgagcatttcgtccggtagttcgtagttgatcactgtcgacgtcggtatggtcgtccagcaaccgtccgggcagcatatttcgatcttctccattagttgtccgctgactgtcctcacaccgcgcctcgtgcactgcatgtggcatggcagcatcgtagttgacattcctggctccgctggttcttgcggcgctgctcgtagggtgggctgacacgcccatgatggagctgggcagagcagcgtcagcagcactgccaaggcgaccaggggggaccggcgccccctttttcgtggtacatgacgctccggggaccaaactgctcggtttctccgagtcctggtcgatttcctgggttcaacttcaggtactgcttgaactccttgggtgtcttgttcgtcgtgtacttcctcctctgggttgttgggagttctttcgaattcgttttgttgctgttcgaccgctgttgcttcgggaaattcgtccccgctttcggctgtctgaactgcttgaggtccgtctgcaccaaacctatctccgccttcagatctcgtcggattcggctgaaactttgtaggaacattgaggagacctggggccgtcgaactatctcccaaatattttttctcatgtctcggagccgaatgcgggtgtgccaaaaatcccgtttctcctggtgctgccgaaggcacttctgccgctgtttcgaaaactgccattttctccgtcgccgttgcgtcgtcgcatttctcgtccggatcgtcggggccattccccagagaattgtcgttccgaatttctcgattgacccttccgtcgggctgtacagcttcaacttctcgtcctcgcttttcggcactttcttcgctcacatttccttcattttcttcttcttttgttgctgccgagagttcgttccgactcctctcttcgctctgagtctcaactgcccgtgcgtcgtctccgcatggttcatgtactgcttgatcagcttggtcgtgcatttttggcggtgcttcttccaatgggcaaattttattcactggtctcccccaaattcttccgttcgccattctgatcagcacgctccgaacgtgcccgtccgatcctctgagttcctcgattcggcccatggcccataggttccgcgggtgaaatttatcctccaccaaaaccatgtctccgaccttcggtgtcccgggtgcgttcaccctccgctgagcatggttccatccggctttttctcgcaatgtcattaggtactcgcgatgccatcgtcgccaaaaatgttcgagtcgttgctgtgactcccgccattgcctggctagctgcttgtgcggcgggtcccgccgttcgtcctgtgcctgaccagtcgtgtcgggtgggtccacccaaagccgcccattctcttggatgaagtcgattgggcggagcgggagaggctctcccgccgtgctgttgacgtaagtgattggtcgggagttgaccgttgcctccacttcagcgagtaacgtggcgaagctgtcatagccgagcacagcactgcccagcgtcttctgcaaagctcgttttacgagctggaccgctcgctcaaatatccctccggcccacggtgtgtgctggggagtgaaacgccactgaatgccacgggagtccgaaaaatgccgcggatcatctcccgccatgccgaagtcggacagcgtttttcccatcactgtgaaggtcggggcattgtcgctgagaatccgactcggggcaccccggcgcgcgatgaatctccgcaggacggagatgaagctttgtgccgataagtctcgtgttgcgtcgacgtaaatggctcgcgtcgtcaggcacgtgatcagcaagacccacgtcttttgtcgttgtccgttcgcgtcgagggtcacagtcgggccgaggtagtcaaggcccaccgattcgaatggaatgcgccgccgaactctgtccataggtagctgcggcatagtcggtagggggtagggcatcccccggagtcgtcggcactgcctgcattggccgagtacctttcgcacctgctgccgtgcgctcggggaccaccagtccctcaaaaattcggccagcgttccgtctacgccgagatgatgaagccgcccatggatgtcgccaatgatgagtgctcccgcccttgagtgtttcgggagtatgactggcctactgacttcggcctccgcgcaccagccgatccgactgatcagcctggttactccgtggccgtccacctcggtccgcatgccttcccgtgtttggcattcgctctgtgctgaacggaggagctgccattttgctcgcgccaattcttcgttgcttaggacgggcgggcatcgcccgtgactcgcgctttggcaccgcgggtcgcccgtgccatcattaattttgcgatgtgtccttgcgatgaaccgtcgcatccacgccatgacccgcactgccttcgtccatcgccggaccgattgagtagccagtcagtccgttctgtcgacgcttcgggggtttcctcccgccgggcaacgaatgtggtcagccctcgttcacccagcgagggcccctcgtcttccgagtccaatgtaaaagtaagttccttgggccaatgctcggacggcttgatcagccatgccggcccgttccaccagagcttggcttgctgaagctgtgcgggggagaacccccgaaggacgcgtcggcgggattgtctcctgtcggaacatgtccg

SEQ ID NO: 15952 - DNA, 1088 bp, Heterodera glycines
  misc_feature (1047)..(1047): n is a, c, g, or t
cttatctcttcgcctgtcccttatctttcgctttctctatccctctttgtatctccctctctgcctctctctccttctcacgcactattttctcactgatcaaatacctttttttgcttttaagctttttcatgtgcccgttctctcccatccaattgatgagtgggcgtttttgtggtgctataggattagagggagaagcatcttctgttcccatggctttggaatttttaagcatggataagcaaagcattatttgatcggcaccgcggggtaagccgatttgcttcataatcgaaggaagaggaaaagcatttgtcattcatggtcaggggctttaagccgctcgatcacatttcacgaagaacaaaaacattcggcggcttaacatttgcggtttgatttcggatgaaaattgatatgccccctaggcatatcacagagtccgccaaattgagattaaagctttatcaaaagcaattcaaatacatcatattatttgtatgtatatgtgtgtgatttataatacggcaacgatataagtttaaaacttaaattgcaaaaaaatatatatagaatacggtatatatgtaaaaaacaaaaattctggcatacggtaatcgaatttttttgtaatgggattaaatatagtgacgatgctcgagaattgcaagcctggaatggaattgagctaatcgcgtgcataattaggaagacttctggccttaatactaaaataaggaagtttgatatagattccaaaaatcccacaaaatttggcattcttgcgcgaaaaaatcttaaatagtaataaaataattgagaaatgagtatgaaaagaaagacgaaaaatgaacaaaaagtaatgttttgtgatcgggaacggcacccgtttgttttgcatgcagagaattttttttaaatacatttgaaatttaaattaagtttcgaatacaaataatattattaagtcttaatgtgccttcgaagtaaaaaaaatgaaaatgtgattaaagttatttaaaaaaattctctgtgaataattanggtaattagcgccatccattaaggtcaaatagtttagggga

SEQ ID NO: 15953 - DNA, 1222 bp, Heterodera glycines
aattagggtaattagcgccatccattaaggtcaaaacattttaggggaataattagcgccaaaattcgagtgtcccaaaaaaaagttggtccatttgtcacaccacactggtcgcaaatcgttctgtgccgtcgccgtccaattgcggcggcacacccattttgtctccggccatatcagtaccgctgtgtttgccttgcaccggcaatggcaccgccataagatcgcgcccattgcgccggcgccattcatccgcctaaaacgtatgtataaattgtatttagaaagatcgaaataaattacttatatttacaaataaaggtcccaattagagattaaaaaacgggtattaattagttttctacaagtctaaaagaaaattaattaagaaacctattaagcgggattatcaatttctagctcaagtgactgccaagctgtattaattatgcaattaaaattaatgaaaaaggtaattaagcgtaattatctatctaagcccaaatagaattttcattcatactaattatgcatttaaaattaatttaaaatttcaattaagcgtaattagcgatctctagccataataggcattttatttatactaatttacatttaattgaacaattaataaaaatattaatgtttagtctgataaaatagtacatcattaatatttactactgctggtaaccaatgaataatattattacagccataattagcgcataattatacatattaaacaaattttgtggggctgacaataccaattaattactattagccacacaattattacccttattacccctttccgtgtcaatgtggcacaatctgttgtggtcgccgatggcataccaccgttgctgccgacgtcattcattagtgtaccaatgtctccaccataagcagttgaagcagcagcagatgatgacgcgttgctggccgcactggccacccgactgtcaccgccgatggtcacctacggtaagaaaatgcggaaatgttagggttacggtatgttttcctatttctatggggaggggggctttatttcaggagggggggggggtgggctctaattcggggggggggaaagctggattgagtcaattgactgaccgaactgctcggcgtcgatgtgccaccaccgttcagactgctgcttgtgccggcgccaccattttcaaccggagccgtcgtcatatttgtcgtcgac

SEQ ID NO: 15954 - DNA, 2026 bp, Heterodera glycines
  misc_feature (2021)..(2021): n is a, c, g, or t
gttactgcttaccacaaatgccgcatagtcattgttggcattcccattaattgtgttgccatttgtggcactgttgccactaccaccacaaatcatcggcatcccattttgatgctgttgctgaacagtatgatgatgatgatggtacagttgatatgggcgctgtgagtttggtaaaatatttggaaaatcaatgattttttttcaatttttacacagtaaatcagggaaaatgggattttgggtaaaccccggaaagggtttcgggattttagagaccagtacagggattgtcgggccaaaaatatatttactagggattgtcggggcaaaatcccgtttactgatcaatgagttgattgaaaactcgtgccgtcttcgcccgcgcggagttctcccgttacacccggttttaattcttcacacttttggcacatttacttgctgctgttgctgaatggtggtgccaaaactgatgccgccaccaccgccgccgccgccagctggcatttgtgccactgatgatgaatggccggatggcagcaccggtggcagtgatgccatccgctggtaaggcggtgcggccaatggcacgtccatcgactcaggcggtgactcatcggtgatattattgatgttgttagtgttggcaccgccgccaaaattttgttgggtttgacgatggccaagctccggagtacggtatgcgtccgacgtatggtagccaatgtccgaaatctattcaaaatgaaaaaatatatattccaatagcgttaacccggttaacccggggaaagcctccggcgcccaactgagtacaaatcgcgtgtaacccaccccaactgctgcaggggcatagtccgccgcgcgtacaaaacgccgctgtggcgaatgtgtgttcggcactgagttttgcaccggcacggcaccgcgcagccatgccggaaggtcctcggcgggcaagcagcttttcagcacttggcgcatgatcgctggcttggccaccgggtcgtccgtgacgaacagcttaaaatgcgccatgttagtctggcacaggcacagccactgccccgccgccggtggctccgctgcttacatcggcgccatggaccagcagcagtgcgcccttcaactcgccgggcgcacggccgcgcaccgcgtgcccgccgtccgccgttttatgcgcgtcctgcagtccgatcagctcgtgcgcgtcgtaatggacgcggaaatcccagcggcatttcaccgtacaaagaagccaaagcaaaatccagctgaacaggtagaccaggtcggcaaccaggcaccacagcagcaacggacgctcctccttctggcaaacaaaaagggtggcttttatacggaatttggaaaaaaattgggagccctgaaaatttcgaaaaaaattccgggttacctacccgtccttcacccgaggggcaggcaattaattgttatgaaaaatgaatgcaaaattgggtttatccagtttggtgtccatatccaaagccaaaaccggtcatgaggggggaggggagggaggggaggatttttgtgagtctcggaaaatcgggggcataaaaattgaactacgtgcctttgccagaggggtaattaatttttgaattttttcttttccaatctttggtacatttccagaaaattgcctgataaatcaatccgatggcataaaaggcgggtgctttgatggccgcgattgttagcagaaggacaatggccaacacgtggggtgtatatccgtcacagatgatctcacgcccataggaccaaccaatcgaaaaattaaaataataataattaattaattaattatcctaactaatagagtgctgatagagtgatgaattgaaaaacaagtattccatcaattagttaattcagtaattactattagatgctataatagagtggtcactagaaaatagtttcaattcaataacttgaacctaaaccatgggagggatgattaatttttaaatttaattattattttcgantttat

SEQ ID NO: 15955 - DNA, 3099 bp, Heterodera glycines
attattagggacgtgaattttaggttttaactattttttttgctcaattgatttgaagaaaggagctcaaaaaacgcatttccgcataaaaatttttcgattatgatgtcattatcggtcactagaaatcactattttgggattttgtcactaaaatagtgaaaattcactattttggagttttgtcactattttttcactattttgacatttttgggcaaaattccttaacaaaaatgcaataaaaccaaaaaatacacccctaagaatcgacaaaaaaaatttcaaaaagcactcctaagaaatgaaaaaaattttctcaaaaaggtattttcgtggcaagaattttaattttaaaaattattttttttatgtacctattttgtttttttgcccttaaaaatcccagccctactcatttgcaatgcaatcagtgaataaaaattatttttgctcaatttttggctgaaaattatgtcactattcgtcactatttcggactttttgacactattttgtcactattttggcatttttactcactattttagggaccaggtcgttttggcgccgacgttttggcgccagggtcgttttggcgccgacgttttggcgccaagccaaaaatgaaaaaaaaaaggcaggaagaaattgtaaaaattataaaaaatgaaatttttcgttaaatataataattaacaaaatgaagaaatggaaacaatttatttggtagaacattgaaggtgccaatgagaatgtgccgtctccgaaacattctttcattcgatcagcccaccggccgaagctgtccttcatgcgttattttaggcttttgttttttcgtatcaatttgacgattcattacctaaatacaaaattaagagaacataagccaaagcgaaaaagagtaaatgaagaattaaatccggctctttgatagacttcgtcagaaaaattataacgatttcatcatttctacctcctctctacatgccgccaaatcgtcggcgccaaaacgttttggttgttttaatatattttagaaaatatattttagaaacaaaaagagaattttgaaattttttattttcgattttttgttcgaatttcggctcgggttccgaattggtcgaaatggatgcctggttagtaagcagcgaccctgaaaaccattggaaacatgttttcatgacttttgaaaacaaaaaaattttcttcaaaaaaggggggcaaccaaccatcagcagtattaccttcgcgaaaaatacgttttttttttgttgttttacaaaatttttaaatttgggtgtttttcttttttttattatagcttggcgccaaaacgtcggcgccaaaatgtcggcgccaaaacgtcggcgccaaaacgatacggacccctgtattcgcccagacatttacaaacaccccttttcccaaatttgctgacccatttttatatgactcacgtaagactaaatctaagaaagtttaaaataatattataaattttatataccgttgataaaaattaaaggagcaatgtttttatgatcagaaacacttaaatttattttcaataaaaacaaaataagataatactaattatttaataaattttacatataaaatttaaaaataaaaagcatataataaaataaaaaaataaaatttttatacgacattttcaaaagcaaattacacttttaatttaagaaaaaatgaatcataatatatttagatgaatatgaaaaccaaaaaattgattaattcaaggctaaggaaggatatgtcattttcgttaatctagaaaacaaaaatgtccaaaattggtcataggaaaaagaaaattttttttaaacaattaattatttatttctagaaaaaaagtaataaggaaatttaatttaatttcacaagtgctactataatacgcaaaaaataaaaagtaataaaattaaaaagttaaaatcaataaataacataaaatcaattacttaaaaatcagtcaaggctataacgataaaaaataaaaccaatgagcgcatttaggtagatatatgaacaacaaatttaaaaataagcgacttcagaaattaaatattcgatttatttttgtattcattttaattataatatatgttaattttttaaaaagggacacaaaaatttcattacagcatttacaaaaaccaatttttgacagctaaaaagaacttaaaataaaaaaacgaagtctcggctatcaaaaagaatatcagggaagaaccggttcaaaatattgccgcccgtgataattagaattaaaataatttaacacaaaataattgtatataagagtaattaataaaaattaggaaatcataaataagagtaattaactaaataattagcataaaataatcgtaataaaaataattaataaaaaaattgcataaaataacgtaataagagtgattataaaataattagcctctgattaataaaaataattttgcattcaattttatcaatcaccgcagtaacaaagttattcacaatgaaaattcctataaaaagcaaactgcattataataattaatatgaaaaagttaaacataatggattaaaaaatcttgctatattcaaaattgaaaatgtcgcaatgtatcgtgatggtgattcagtaaacaattattattttattttaatagtaaattttaatcatttatctaatttatatttaacggccaatgaatgaaaagatttattaatataataaaaaaaacatttcataacgaaatttttttttatttatttttaattatgtattcatttaacgtggctgaaatattcgacatattaccagcaggcggttaattgagtatttggttattcattaaaattatcataatctgtaaatatataataataaatagaaaaattttcaaaataaaattcacaaagagaatcgatttcagaaattcattaaatacgctttttataatcttcattctttgtgcttttttttattacatacttaaggaaatattgcgttttggggggttttattcgccaggaatgttagcttttaccggcattaaaccttataagatttgcttg

SEQ ID NO: 15956 - DNA, 2325 bp, Heterodera glycines
aaaatgggcgtttcgcgaaaagttcaatttcaacaacatttagcggccttatcagtacggttcttgtgatcaaataatttttaattatttatttctcggttcgatattaaataaagtatgcttcataattgagttcggctattaaataattcaaaattaatctttatttactataaaatgaggaaatttcctgatgatcacatatagaccacccaaaaatcaaaataatactaaacgaattctttaaataattaatggttaataaagaataaaaaattttatcttttgtaccgtgcgcgggtcaacggttgggcaaaagtaaattatttgaagttttcttttcttctttataatttgctaaaaaaatttaaaataattttcacaagaaccgtattgctgaggccgctgctcgccgattaactgcccgctcaactgactcccttatccagagaatgctcccaattaaatagttggacttatgggacggaatgggaaaaagcggggataattggtgtgataaagagatttaaagatggatgtgataaacagcgctttacaggtgttatgcttgaatatgaaaatgagcatgacctcgagccatttattatgacatgcgaatggcaccgtgaaagcaaaagctgctcaccttcggaagaaacaaaacaattttacattcaaaatagcggaaggaatgatgatgatgatgattaggaaaacctttcagttttgagcgcttcacggttcagcgcccaaatcgaagttagggcacaaaaaaatcttcggtaatacgccggtttggtccccccccccccccccctctaaatttagcttctttaagtcaggtcaatataggaacaaaagtgagaattttcaaaatgttgaattttcgactttttgttcgaatccgggccaggattcgaaattgatcagaataaatgtcatattcgtgatcagccatcctcaaaacccttaaactgacaaatctatggtttttttttgtaaaaaaactaaccatttttgaaacacgagaattcgctgaacttttgagcgtccaattgatttatgcgtgatattttagactgatttgttagttcggaatgagattagtatttatacaaaactcagatttttgtaataaaatttaggtccgcaaaaatttggaaattttgattaaagttccgattgttgtcactttattcattagttttgtgtattttgttatacctatttatttgttctattcagttaaagttttctatttcggcaattatgctcagaattttattttgcacttacacattttctcgagttgaatcaggcagaaaacggtgctggaaaaattttaaacttaaaatgtaaaaaaaaatcaagtcttacagatttttgaggtcctctcatcattatataatgtatagggttgggaaatttaggtaagaaaaatcgcgaaataggtatttaattagttacaaaaaaaaagctaaaatagttattaaataggtacaaaaatccagaaataggtaaataaaattttttattaacgattttttagtagaaaaagcaaacaaaaggtaaaatggttctatttctttataaaagaataattaaatattaatatttacattttaaattaaaaattttgtcaataaaaaaataaaaattttggtggataaatttttgagcaaattttccaattcttagggatgaatttttgaaaaatttttggtcgattcttagggggtgtattttttttcttacagatttgtgagctcctctcagcaggtcccggttgggcaccgggaaaagaatgagagtcttaatgaggctttttgtcagaaaattagtgaccgaaagtcggtaattttccagaaaaaattaaatttaaattattgtgttccacggtcccggttttgcccaaaattctcggtctccccaaattttccaattcttagggatgaatttttgaaaaatttttggtcgattcttagggggtgtattttttttcttacagatttgtgagctcctctcagcaggtcccggttgggcaccgggaaaagaatgagagtcttaatgaggctttttgtcagaaaattagtgaccgaaagtcggtaattttccagaaaaaattaaatttaaattattgtgttccacggtcccggttttgcccaaaattctcggtctcccacaaacctatctattaatattaatgtattgtataacattaaatcatcaatatgtaggatataaaagattcatatgcttattaaacaattccaacgaaaacagtgaggaaaaatttatttttaaaatttaatttaatttttttct

SEQ ID NO: 15957 - DNA, 1968 bp, Heterodera glycines
tgcggctgccgctgctgtggccgcaaccggctggcaagcagtcccaccactggccattgtcggcggcggcagaagcgcacgcaggcaccgcggccggggcgcagccgtgaaatagggccagctgccgatgccatcatttttgggtccggaaaaatggacagtgcgcggaacgcggacggagttgcgcagtgtcgtaatggtgggctggcggcgatgaagccctgctgggggcgtggtgccgacgataccgccggagttacggtagttgccggaggcgtcatgccagcgtcggcgagttttgcgtcaagcaagctgttgttgccaaatgcacaggtcggctgtcgaaaggctgcttaaaaaaagagttttgctgtcaagttaaaatttatggcatatttgcagccctaataactctatacagaaaataataagcattccactcgttatggcaatgcaatgattattttcacatactgtaagccaaatattacggtaattaaacgtatgtctgcgatgttaccgtacttcgattgctcatcatgttgttgccgttcaacagtgcaaatgaatgcagcgatgcagcagcgggcatcatgaacggcatcattggcaaggacggcacggccactgacagcggggagaaatgggactgagatgatggcggttgtccggtgccattttgttgctgcaacattgtcggcggacatctcagtaactgcggttggcgtgccgcggtcaagaaaaaatttggatgcacaaagtgtggcggtggcggcgcggatttgaagatgccattccggtgctggacttgctgctgttgttgggcggccttcttcagctgtcccatcatggcatccaattccaaattggaacgcaattttcgcggcacatgttggccttaaaatttaaaattttcgattttttatttaaaaggttattaacattattatttttaaactattttttaaaaatttattttaattattcaaagcatttaaaaattatttaaaatatttctgcaaattaattttttattttaaaagatttctaaaaattaaattatctaaaattattcaaaggcttttatatttaaatatattttttaaaatttcttgtacatagaaaataaaattttccgtgaaaataaattcaaaaatatcaattatttttcgagattctcgacggtatcgaagaaattaaataaacaccgcaccgtttaaatggtatttaaccgaggcattgcgcgagtctctgggtccatccacggtcactttgacggcatttggcacaatagcgacctgaacagggtgagggtgagggggtatatataattttaattttcgattttccgtaaaaatgtttgattttttttgcctgtgccaacggatgcgtgtgcagagtgatggtcaaattgaaatttttgccgcgaccacttttgccgacaaagcgcaggtcgctgaagcgtgccatttggccacacacttccgcttggccattcttcacctcgcccagccaattctcatcattgccagcattgacggtcacacgagtgccgtccggcatcggaaaaagtgccaaaacaacgaaaggagttggcaacgacttgttggagcttaacaacagagaagggggcacatgtattgtggaaaaatatatttttgccgaaaattttcgattttccttgttggtaccctatcgaagagatacctcacccaaatttttccgaaaatctaaaatttaccaattttctggacaaaatctgttaataaatttcactctaattctcaaaaaaagtcgacaccacaggacccctctatttcccaaaagttgtttgtaaaaagggccgcaaaaaaaattcgtcgcccggggggggggggtgggtaccactcaaaccgaaaccctgggaccgtcactggttattggcagtgtaaagggtggttcgagaatctcgtctccaacgcccaaggt

SEQ ID NO: 15958 - DNA, 1183 bp, Heterodera glycines
ccctccccccctccactaccgtacaccaaccaaccactcaaccaccgccaaaaccacccctcccattcattgcacccgccccgaaaatgccgcaggcaccgcctcaatttgtattttgcgggacgcttctttttgctgtgccgcgccatcgcgcgctgctcgcgggacgcgtttctttgcatgcgaataaaaacggggaatgcggggtcaccggacggggaaaacaattagaaattcccgtttttgccttacatatgatgtgaaaattgaagagcacaaatcgcgttaatattatttgttatttcgtgaagcgcttgaaaattagggttttaattgcctgctgctggaggagagagtcgctaattagtgttaattatttttaaaatttaatataattactctttgtgtcattgatcaacccccgttctgcttattctccatctaattagggtggtgtgtgtttaagaatttatgcaaaattccccccaaatttcgtccagcccatccccccccccgcttttgatgtgtcagtgtgctgcctgctgcgcccgcgagacaacaaagaaatgagcaaaaacggaacaactttttcgtcggcgtcgtcgattgggggctgtggacaacgcgacacgacaactggcgggcgggcggggggggggggaatgtggtggcggtggtggccgcggagcggagatgggacacggcgataagcagcaacgaaacagcgcgagcaaatggcgaaaagaccaaaatgatggtgatgatgatgatgctcatgatcatgatcatcgccggaggggagcgactatcattgaattggacacacattttgtggggcgcaatttgagcgggggggggggtgggcccaaattccaccctgggcctattgagttcccgaaaaattggtaatccagcaggaaattaggaaggaacatcttcaaaaatttaaaaaattaagattttgaagccagccgactcaaaatttggcgctaaatttgctatttgtgtgctgcgcaaatgggcgccgatagtcggcggtagaggggcggtacaacaaccaccgccgcaaatatcgccgcgatctgatcgcgcccgccaaagagggcggggggggggggacttgttggattggttaaccgtggtccgaagaccaaccaaccaaccaaccaaccaaccaacaacc

SEQ ID NO: 15959 - DNA, 1866 bp, Heterodera glycines
aaaaattaaatcatagtaatgaattattttaaattaataaagtagattattaaatataaaaaatataaaaataatattcttaaaattattataatttttcttttatttacccaaaggtcatgcaccgggttgaagctgaacggcaccttcaatacgagaggaagtccagcatggcgagcccgtggcaaaatttcgtgcatcaaatactcacttcaaaaaaaaagaaagtattttcaaattttttttttttgccataattttgttggcgaaatgctttacatattttgtcggccttcatcactcaactccaaatacatgcgcgaacgctggatatggccttgcgaaatgtacacatcggatgcgaatttgtgaaattgtttagcgggcaggaaggcatgcgtgagaagaggcaaaattgagtcctgattttttaaatatttaattcaaaaaaaaatagtaaatttacttttttataaaaatttttagtgcaagttttaatattttgtttaaatgagagttcgcaaatgtgctgatttttcttcagtttagtgctgagtttgaaggtcggagaggaatacttttaaaaagttaggctttttttgtaaaaatcttattaaaaattttcaattttttccctcacggcgcctattggaatctctggcttcttacttcctctgaattgttttgaaaaatagcgctcagcaaaaatgtattacgaaaaaattaagacaaaaatgaataataaaaaaaaaattgaatttttgggcgcataattaaaaaacttgcaaaccctgatttaaatgaattaataaataattttttcttgtcatgcttttaacctcatcaattcgatattcaacattctttttgtatttgtcaaattcggccaaccaactgacagctttgttggccaatccggcctcctaaattaatcaattaaattaatagataatgcccaaaaatgaatttaataaaatattttaaattttagttacataaattcaccaatggccatctgagtagagcaaatatttgctctttacgctcctcataatcaagtggtccatcaaaatccaattctaaaaaaattatataggttcccgactttgcgctcggaccattacttccgctacatttgataaatttagttttcttctattctatatagcataatcagacttcaaattaagaaatcaacgtctctaggcaaggcgcaaacggcggtccctctggcaaaattcaaaaatacacttaatcccaatcggttaaatttgaattagagttcctccccgaccctcggtggggagaaaagtcgaggatcggagaagaaattcaccaaccaaataccggggatggctggaaaaaattaaaaaatgtcggggaggatcaaaacacccttgtcggggaataaattctcataaaaagtcgaaaaacgaagcaaaaaccgctggaatatggacactatatctaataaatcaaaaggcttgatatttgatgatttctagtaaattaattttttccctaattttgattttatattttaaaaataaataaaattttgtatcaatttttatgagtccaatttaccagggtatccaattttttgatgtccaattttctggccacctacacacaaaactgacccaaatagttctcatatttggggaatgccgttcggtaacggtgcagaaatgcgcgactgctgccaatgccatcgccggcggtcggcacaaaatgtgccatgccaagctcagcggtcggcttgctccacataaattgccgcaaacatgccaccgtgaaggcggcgaagctgaccatgcgaaagtgttggctgcacgacagtgcgccaacccgtcgcgcaaacga

SEQ ID NO: 15960 - DNA, 1271 bp, Heterodera glycines
ttcaatgaaatgcattcacataaaatattttctttacaattattttttgaatagtaaaatgaatttgtggcattttatatttataattgtattttttttcataatttatggaaatgaatccggcaaactccgagcaaatttcgatgaaatattcggcggcggatgggacaaaaatgaaaatgaagaaaaagaaatggacaaaaagtcactaaaaattgaacaaaatgaattctcaacggttgatcatatgtgtgaagaaaatggaacagacccaattgatcaacaaaaatgagaattgattaaaaaatttgacctaattaaagaaaagctgaaggaaaaaggaaaatgccaacataaaaacaggccaaaattgagaggaaaattgcaaaattattaggcgcaaatcgccacaaaatatacaaatggaaaacagaattaaatttaaataagattaaaacgaacaaaatgaaaaaaagtttttatgagcagaaaaagaaagaatttattgaacgatttgatgaatttaaaagtttatatagccaaggcaaacagaatgaatttgtgaaggaattgggaatttctgaatttacatttgtaaaatggaaaaaagaattgattccaaattaccacaaaagtaaaattatgattaattaaattaaattatgaatttcgtttaagagcataataccaatgaggacaaattgaaaaagatgaagcaatattttgaaattaaagaaagaaatccaaaaatgagcgacgaaatagtcgctaagaaattgggaatttcacaagacacgctgagaatatggaaaaagaaatttgcttccacttgatcaccgattttaatttagtaaaaatgattttcgatgaaaaaaaaagttttgattttgaagagagattttaaaattttttgacgaaaatgttttcatgcaaataaatactatttattgcattagaggagccgctcctccactccaaaatacaaaatccctttcggtgggagggggttgaaaaataaaacccctgggctataattcacgaaataaggataccgtattttctctaatggtatgcccgtctccattgatctagccgtctctaattatctcctcccctttcgaagtaagttgaaaaatgatctcttcgtcttaatctccccgtctccaattatctcccctttctgaggaggtagaaaaataatatatacgcgggcatataattatagaaatacagtaattgaaattctttaggcctttttatttattatttct

SEQ ID NO: 15961 - DNA, 3022 bp, Heterodera glycines
  misc_feature (2958)..(2958): n is a, c, g, or t
ttttgttatttttttagctgtaaagctcggccgaaaggctgattctgaatggtaaaggcattagaaatcatcaggctgaatcttgcttggattttgtcgggaaaaaacaagaaaattcggtccgttttcacccttcaaaacccaacgctagaagacatgaaatggaactcgcgatgagctcgagattagacaaagtcgggatcaaattaaaacattaatatctgttgaatgcgcaaaagtttggcacaccaactcggtttaaattttggaaaatttgatgaaaaacaaaagactgacgaatctgatggcactcgtagtcccagtattcacgcggtttgtttacatttacatcggcatacacccgggcacggcttggcgttggcattccaatggacaaatggcgaaaacaattgagatgaaaatgataaagatgatagcaacaaagagtgtgttttacgagcgattggatggatgatggcttaataatttgtttatcaaattgaataatatttctctaaaatggcaaatttaaaaattaggtgacaaatgtacaacaaacttagtaacattcaacaggacaggttggacataaattaaattgaatttaggagtcaaaatttttaaaaaatccataaaccattaagtttttcaaaaggcacaaaaccgcattttatttttcagcgctatttttactaattacctaataatttaacaaaagctatttggaaattgctttcgcctgctaaatatgtatttaggtatggtttcagtttattttttgtgtaacaaagataccaaacaagagaatttcctgctgtactacataatttggaattttgtatttgtgattttttttttgaaaattaagaaacattacgcaaaagccaaacactgccatttaaaatttaaagcattttccgggtggtggcttatttttgccattgccattggcctttcttcgattcctttcatccttagaatttttcgaatcttttttcaaaaaaaacattgaaattttgtaaaaaaaaaatatttcgcaaattttcgccattttcaatttccttttgtttcccttataaaagtgtcctcttctcccaactttgcctatttaagcagctctcttttctcgctttcccctgtgtccaggccattcattattcattctctttaacgaagtaccacaacaacttctgcatcccagaacattcgttcattcattcatcagtcagtttttgcatgcttttatctttatttcgctaaactgttgtttatgtgttcaattcaattttttggtttattcatctgcgcttttttgttttgagataactttaaagccttaaactgaaagtgctgccaaaaagtggctctaataatttaagcaaaatgccttttttggttatttgtttagtgcataaataaaattgtttcctgaacgcataaatttcagtagagcaacaaacacttaattatattcatttcactgataaaagcctaatcccttcaaaaatttcagttcataatggccagaccaagaggcggtggaagaaacccagcaaaagcacgcggtgccagggcaaagcgtcgcatcggcaacaaaagaaaagcggccgcagggactgctgcaaacgtgggttttattctgctgctgttctatgcaatacatccatcatttttttctgtttcattttttggcactcagagtgaaagccgaaatttcatcattgcttcattttgtaatgaattttgcctcccttttcaggttcaagctgccgacaggcgccccatttgtccgatctgcttgaagaagatgaccggagtccgtcaggtgcgcaccatctgtgaccacgtgttccactacgtctgcttccaccgttggctcaaatatcgcctgttttgtcccgtctgtgagcgcaactttcgcacggaattgtatcatgcgggaaacgccgtggttgagggagcgtacgccgacggacacgttgtgctccgaactgatggtgaacagagcaacagtggctaattgatcattgatcggcactcacctccaattgtgatcggacaaaaatgatattaattgtatatgtacatatatatcaacactcggacaataaagtataatgtgtgtttttttacttggcatggattttctgaattttgggcaggacaacgtccaattcggcgcacctttgttttatggttttcatgccgcaatcgaaaaaatgacttgccatgataaaatcatatgacaattctgatgtcagattcgtggtaatactggagaattggtgtcccggcgaaaaataaatttaaaaattttagtttaaaaatctggttccttgtgtacttttgatcataattttgttcaaacattaacgaaattttataaaattttgcaggctaatagagaactcatagggttatcgaataacctcaagaatttaaaaaaataattaatttataattaaattttttaattagaaacaaaataattttggtcatctaaaattctaattaaaactttcttagaaccaacagaattaagtgtcttgatattattcgatagccctaagtgttttctactagatttccatttgatagttttttttatataaaatgccctttttgaatgtttttatataacgggtcaccaccgacaaaatacagtatacgggcgaaataggcataaagtagataacatatttgctgtgaaaaaatgaagaaaaaaaaaattatttaggccgaatgtcagccgacaaaagtgacgagctgtgccaaactgttgcagaaatacgacagggaatcgatagaaaaggtaaaaattatcgactaattaatgagcataattaaaacatttgacacaataattaatccattcaggacgctgcttgtttaattcaatgcgcagaagtgttagggccggaaagaaaagatgaattttgagaaaaaaattaatattanattattggaagaaattattttataacaaattatgaaaaataaaatatcgaaaattttcctaatt

SEQ ID NO: 15962 - DNA, 1292 bp, Heterodera glycines
tttttttgtacatacattccttcgcttttgtctgtcatgagcttatatttcaacattatgcttgtactgcttgttatgctcgtccatttattcagaaggtaatttgttggcctccttttttgaaaagggttttttcttctgacaaaagcagttttgtcgcatcaatatgaaattgaaattcataaaacaaaagattctattgttccaatgtgtcggaaaggtttttagaattatattccagccataaaatccctaaatcaactttcttgaagtattctctcgttttacacaccttttttcatttttattggactgcgaccggacaggcgaaccggtccggttattttagaacacccggttctgcccgggtccgtttcggtatggatgggccaaaaagaagtcagcatatctggtactggaccctaatttttattttcgtttttatcccatagccatcgtctttggcatgccaaatcccctcctctttttcagatattccggtcgtctggtggcggcggtgttgcagcgactgttacacgcccgcgttgcgcacattgatggcctcggctggttcgcgttgcgccatggtgagctgttgctggccaacggactgcacttggaggtgcgcgagttgcgcgtccattcgctgttcaattggtggtggacaacgacggcaccgactgtggacggcgcggccaacgacggcggaggcggcagtggtcatcgcatggcactgaacgtgcatgtgtccgtcggcacaattcgtgttggcaaaccggtgtgtgaaacaagagcttgtttataccgcaaaatttttttcaattgtttagttgacagacgaagaaaacggcagcaataaaaaggacatttgtgatggtcatcatcctgaaaaagttagcgattttttaattgaaccgagtggggccattatgtttttttcatagctaaaaagctcaaaattttcaaaaaaaaaaattttttttttgcaaaaagtttatttttaatacccctcttgttatatgtgattgggttggtaaatatgatgtacaaaaagcaaaaaactcaaaaaaaagtaattacggaccgtaaaggaaatagaaattttttccagtgcggtgttctcgactcggtgtcaattcatttgtccaggcccgtgccagaccaactccatctccaagttcagctgcagcaaccggtcgagttggtctggtcaccggtgctgcatttgatggtcaacgacgtggtcaggtcagccgctgctgtttctctcaaatcaaatgcgacaccagccc

SEQ ID NO: 15963 - DNA, 2326 bp, Heterodera glycines
aaattttaaaaatgatgaatttctatttagtttttcgtctgttcaaaaaatattcaattttaggtggtcaacagcatcaaatggataaaattggtccatggcattgtgccaaaaacgttcaccaaggacagtgtgttgcctgctgatgttcgaattcgactgaatgtaagttgctagtacgacatttttatcgtaaaaatctgtttccctttaaatacttttaggatttttgcattagttttttttagtttcactttatttaggccgattttcttttgccagaatcaactttttcatggaatctattgtcgtggacaaccctagttttttcggaggctattggtccccttccaaaaaaaaattttttttcctacaatttgggttggtttaccattggttcatttattttacagcgcctgtctcttcgccttgacgacgacccatttgaaattcagctccaaaacatttacgagctgcaaatggacgaagtgttcgagagggaaagacgcaaacaacttttggactgcaaagtggcacagctgaaggaggaaaacccgttcttcccgggtcaatcggaaatcaaaaaaaaaaaaaatttcgagggttccccccccccttcctcaaaagttggactttcaatcaaataaatgcaaattaacaatttaatttaaaatttctaagattttttgtgaataattggcctaaattttcaaaaaaaattttatattaaaaaaagtttaaggaaaaaccaaaacattgtttaaaaattttcttgaaattttctttgaacacataacaaattgtataaataaataaatgataataattcaggtgagtttcgcaaccaacatgaccaccattcggtgcagccgtgtgcaccggacaaactgcccgaatactccagcaacattgtgagttgttttacacgtaaaactttttctttgtcaaaatgtctagaatttcacaatttttaaaattttgctatgggaaggctcctgaaaaaaacaggagaattcaaaattggcgatattttttttttgtttcattaaatttttgtgtcaacaaataaatggttataatcaaaccattgaactattgcgcgcagattggttggcatgtcttgggaaaattttgaatttttacaaactttttataaaattgctcaaaattttcacaatttttcatttttcccattttccaagggccatgactcctaccgcgccttccgttccgcttacgtcaattcggaggtgcgttttgaaaccaactcgtgggaacagctgaaccggcagtgtccacaaattttgctgtacgccaacacgttcaaatgcctggactttctgatgcgcactctgatgactgtcaatcggccggttaagcggggcccactgttcaaaagtacgcaggccaaacgctatcagctgagcagacacttcaggttgacaaaaagcgtagaaaaaactcaggggttggatttaagcaaaaatttaaatttccggtactccgaaaaaataagcggatgcgccgccaactttcaatttaattttttttttctaaatttacaaccgggcatttttcatttgtaaattttgacttgactaacggttcgaaccctgtttaaaaaaatgttttataataatatggacaaccaggcctgggctgcgggaattacctccctccaaaaagactcttatttattatattcaatacttttttttcaggaatgtccaattgatggcgtcgatgccccgctttctgatctcttattggatgtcattttcctcttcccatggatttcgtgtgatcagcgactcgttgcaatttgcttgcgattttttgctgcaaattcatcctgatcagtcaaatgtttggcacagggaggggggaagaaaaaccaaaattttataaatgtttaaattttaggacggcctcatccgcagggtcaggacagcgtggaaaattctgcacacatcggccgagttggacaatgcccaaattcatctgtacggggaccagcgaccgccgggcgtggaggaggacctgatgaacagctccacctcgacggacagcgcgaattcgtcctttttcgtcggactgtcccgcctcatctacatccgaaagttgcagaacgagatggtcagtgagtgtgcgtacaatgacaaaaatccttcccccaacggtcggtcccagggatttgtttcaaaaaaagttcggaaacccgattgctttttgaaattgtaagctaatagagaacacataaggctgtcgatgctattaaataagttctattaggctaaatatggacggaattatacccaaaaaactt

SEQ ID NO: 15964 - DNA, 818 bp, Heterodera glycines
attcggtgatctttagcttctccaatccattttttccgccgggggattttccactcattttattaaagcccaaagtcagtggcaccgaatgttcttcaaaaattacttactgatcagaaattggcgtgctctttccttctgcaggtttttgtttgccattcgtaatggattgtccatcagcagcggcgactgcgtttccttcagtcgctgctcctcccttctgaactcctccaaagggtcgcctccccgcggcgcctcgtagacggaggtcgacttatgcttcaattccttcaatttttatggaattaattatccatttttataaatgtgtcggctttcccccccctcgtcaattatcgcagaattggggacccggcgtattatcccatggaggtacaacagacaaggcaacaatttaattaaaacacttttaggtttgctttgttttggatggtcaacgcgtcaaaagttctcaacaaaatcctgagcaaattcgtgtaggtgtttagcgatttcatttttaatcgtcattctattcccaacattaacaataagtgtttaggaaatgatcaaagagactgccattccgcccaccgttttgcgagtgcacaacgaacgggtgaaggagtcgcttcagttggtcaacaacgaatacttgacaaaagcgtcccgttcattttgacacaacgccactccatgtcgattaccgtgttcttggaccgtcagcaaactctctatcggaacaaaccatcgtgtccctcctgccacgtcaaactgggaatggcgtccgggcgaccctttgaagaaatgcacaaatt

SEQ ID NO: 15965 - DNA, 2257 bp, Heterodera glycines
agtttcgcgtgcggaattcgtcgtactgaattggcggtgcggcacccaatcgcggctgattccgtcccaaatgttgcggtgtctgtgagcggcgcggggccgccccgcacaattggcgatgttccgctaacaaatcgcgtacgtcgtcccgcatcagttcgcttaagaatcgctttgcgtttcccttcactttttggctctttgccaattcacttttgtgccattcgattgaatatccgttcgtttggtatcgatttggacaacaaatcctcgccctgaggtggcggctgcttcgttggctctttggcgttctgtgtcgaatatgacaggtaaaagttcgggtcgcacagtgtgtccatctcccgacgaccggtggaacgcggcgacagcttcgacggtgccggcacggaagaagacagacggaggcccaacggaggcggcagtggtgccggcgattggtggcccaattgagaggagaagtgcacgggagtggcacgctttgcctgctccaatacctttgcggagaaggtcaattgctaaattgtggcatttccacgaccccccccccccgcccaccctttcgtctgcttacggtcggtctttccgcgtgcgcgtgttgtgtcgagattgggtcgcgcggtgtctgtgcccgcggcactgtgtgcgcttctcgcgctcgcgtgccgatgtcgcgctgcagttgatctgtcctgcttatgaattgtgcgtctctttttcccctgtccgcattgaaccggcgttcatagcactcattcagtgcggcttccaatggttcagtgcgtctctgctgggggaggtgctgccgcagccgccactcctcctgcggagagcgcacctgggcggacggagaacgcacatagtcccgctgaagttggcccacgggcgtgaacgacgcggacgagcgacgcggtcgccgctccggcaaaggctccgtccttccggcggctttgtcaatttccgcctcccatttgggcgtttccgccctccttcgcacatcgccatttgaagctttgtgctggcccaaattttggagggccaattgcgcctccgttggagtggccggcatttccaagtcgtccaccaccgaaacgcgccgctttagtgccggaatgggtttcttcggtgccgaatagtgttctttcaatgctttgaccggaacataggaaaaacagcgcgagttcgggtcgtacctggggaatagcgtgaatcgaaagagttatttgagcttttctcaccttcccatggccaccaattcgggctgtaccatcggacacactttccgcgtcgtcccttccgtcgcccctttctcatcgctcgacgatccctccggcattctgtccgtcccttgggcagaatacttccggccgaacgtcggccgggcacccggcggaagaacggaatgatcacggccgatggttgaatcttcataggcacttcgcatcgggtcattgggctccatttcatccaaatccattgacgaatttctgcgacttttcggtggcaccggcggtggtgacattttccgatttaacgttggcacctgaataaaattggaatttttctttcacaattcgaattgtctttcaattcgcacttcgtccgtgtcccgtccgttttcaaaggaatgccgttccttaatgtcgtccgcttgttgaacagacgttgacgtcatttctggcattatttcgtgttgactcagaggttgggtgtgtgtcctgggcgagtcggagccaatgcccgagtcggcaccgtctgctgctgtcactgctgcttggctctgcggttgtgttgctggtactgcctgaactcgttgcttttgctgctgctggtggtagtgctgtctctgttgattctgttctttgttgttgttttggctttgtgcctttgtccgaatttgaggtgttggcgaatgtgtcaaattttgctgctgcttcttcggctgttcttcttctggttgtgctgatactgctccgccgcctttgccactgtcctcctctttcccaatcactgctccattatttgtcggcacagaattgacaattggcagcgacagactccgttcatctgacaaaaaaggtaatcattgaatgaaactgaaaagaactgagctgaggttggccaacacataaaaacaacagaaaaggaaagaaaaattgtgaatgattttttgatcggaatcgattgattgaaatggccaaaattcattttaaagcaaaattaacagacgcaaaaggaa

SEQ ID NO: 15966 - DNA, 3460 bp, Heterodera glycines
  misc_feature (5)..(5): n is a, c, g, or t
  misc_feature (13)..(13): n is a, c, g, or t
actantctcttanttttgagaaattttatacgttacaaatgctttcgagcatgataggaagtgcggcgcgcaatcgccatttaatttcacagagaatttttaaatttatcttatatccaagaaaaatgactatctcttattttgagaaattttatacgttacaaatgctctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatcagtagtataagacgtattaatccggtgtaaaatccccccccccttcccttaccaaaacccaccaccccccatgaaaaattccggcccaaatttggtcccaaatccccccaccctccctttcatcggacccccctaccacgattcactccccacatattttgatcagataaatattattcgcatttttgtgtgttgcgaaatttgctgcgcggcgcaccaaaaatggtgccatccgcgcatcaaggtcaaaatagtttttatgttcatgacctgtcaatcaaagttcgcggtcgagaaaacttaaaacgctgcggagatgcaaaaataattgcggccactttaccgcagtttttatgttcgtgacctgtcaatcaaattctttgggcgagaaaatttaaagcgcggcggagatgcaaaaataattgcgtcacacaaaccgcagtttttatacacgggaactgtcaatcatataaatgaagggaaggctgaagcgacttcatttcaattccatttcgcttaaggtggggggtcgggggctattcttgcccctcggggcgcttgcccccaaatattcaaatttttccatcgatcatctggatctgtcaccgcggcacggcagcacggcatggcagtgggaggagtcagcagcggcaccatccccaagttctcttctcatcatttgccactttcgcccactttttcaatttgtcagcagcggagacgcatcccaaattcgcttttcactagttgccattttcatccactttcatcatgccctttattgcccccggcactttcgcgtttctttcaaaagagtatggggaattttcggctgggcattttgacccaaacagagcatacgacccaaattcacttgcagaactttcgtaatgacatttattttgcttccattatctttcattttttctttgtagtcaatggcgaaaagagtttctggacggccgatatggatccaaacaaccaacccctccttccaccccgcgtgccccatcgcccagattcccaatcccggtcattgttggtaattttaatttgttttttggattttgcaaatattccgtttacaggaaatcgtccacaggatgaaaattgtttggttttccacaaatatcttgtctgattttttccattttagggcggcagatgttccccgatgacgaggggtaagaatcggaagatgatgaaattctcttgccacctgcgccgatccccccgcaacttggccaccctccgccaaatgtgccggtaatttcggtctcgcttttcgttgctttttctcaaatttccgagtgcttttttcaggcagttcgtgttcaaccaatgcatgttgggcagcagcggctgccgctgagagacttgccacaattcgaggaccatccgcaaaatgtgccggtaattttgggtcgatttttgctgcgttttctcaaatttctgcgtgctttttttcaggctgttcgggtccaaccgatgcaacaaatgcagcaacccgtaccaatgagagccgtgccacaattcctccaccctccgccaaatgcgccggtaatcttgagtctcgttttcggttgctttttcaaaatcccgagtgcattgtttttcaggaaattggtgtgggaccaattcatgatgggcaacaaccactaccactaagagcgttgccacaattcgcccaacctccaccaaatgtgccggtaattttggctcgtttttttttgttgcttttttaattcccgaatgcttttttcaggccgttcgtgtccaaccagttcaacaaccgataccactgagagacgtgccactatttgtcaacccgccaccaaatgtgccggtaattttggctcgcttttgttacttttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgccgccaaacgtgccgtatcatccaccagaaaacgttccggtagttgggtcttggttttcatgcgttttctcatattttcggatgcttattcaggcaatccaaccacggcaacgaccgcgccagctgagagacgtgccactattcgaccacccactgccaaacggacagggtaatttcagaccctggcttctacctaacaccgaaacatcttttcttaagcaaatacatgccaaccccccgagagtgctggaagtgatccgacggctgggcgagtggagaggaagaccaagggacccaagacgtccgcctcaatgaatgaatggaatttggattttgataaaatttgttgttttaattttttgaattgataagggttaaattccgtcacctaaattgtttcaaaattattaaaattttaagaaattagatgctaaacctaacctttgacatagattatgaaacaatgaaaagaaatgacgaaatttttgctttcatgtcttttgaaaacaaaaaaaattcaaaaaagggggaggggggtaccatcgacagtattaccgtaatttttatatggaaatcggataaaaataatgacaacactcgaaatgagcacaaaaaatatgaagtgaacgaaaagtggtgaaaagtgttctgttatttgtcgcggaaaacaatcttttggcaaccatttttgagtcacacgtccgaaaaaagggagagatgtgtacaaataaagagagagagagagagtgcagagaaaaaacaaaacttttttttctcataatttttctctctttttgacgcactatctaatgttttcattattaggaaaaacaacatttacttcgtgatgtta

SEQ ID NO: 15967 - DNA, 1914 bp, Heterodera glycines
ttttggtataatgttgtctaattttgatatttatgtccttttttttctgttaatctatataattatttttcatttagaaatgatcaatttgaagtcaattagtattatttaaggaaatagattattgattcgtatatataccttaattgtttttattcgctatttaatattttaaggtttttcaatttaagcatcttttttatctttatccatcagttaatatttcctttggaatttactggtattcatcatttaagtatatttatcgattatttattttcagaaataattattgcttaaaaatgttaaaattactaagttaaagttggtgagaattgccgaaagatgaaatttttattatgcgagccaatggatactgggtgcctgttcggtttcgttcaaatagactcatatgtttgaactcttagccatttttttaaaaacttatttgatttatttgtttaaattaaattaaattattatttctgtattcgtttttaaactttcaatatgtaaattgtcattttagattttttttcattatctttaattgtttatagatattgaaatgttagcgactcttttgcatttatttctcataggacaaaaaaattaatagcattctttttgttttcattgaatgatattttaaaatagccttaatgatacataatagataccattaaagcaaaagttcaaaaaatgaattttatttaaaaaaaactcggattgaatgaatccattaattaccatttttaaatgcataatataatcattttttagtggcgttcaataaatagtcttaatttttctattattattatttgttttttatagccaatttaattctcattttggatttaagttttatttgtcaaaaaattcttatttggttaagacaatgtatatttatcatataaacttatttttttaattatttcatattttttttgtgttttaggcgaattaattggagttttcgattacgtactgccttcacactaaaaagtgtgcagcgatgaacacgtatgcttcagctgattgtcaaaagaaggccgggtttttcacctgaaaccatatcgttggacttcaggctggcgatgccgcctgtgcgcgaattcttcgactcttgcggggttacaatgccatcaataacagtaacccggctaaacaaaatgatcacaattatcaagccaatgtcaatgttaatcccgatagcatcatcgattttctcgttggtacattatctcgaaattataaaatgcgcctgtaatcatttttcaatgttttgttttttgttggaaatacattgttaaatatgttttaatattaaattttaatatttttcgaaaaaacagattagaatccatgtcgcacaaaaacagcttaccagactaaaccttccccctgactaaaacatcgcctcagactaaaacgccagactaaaccgacccccaccgtaattgttccattcatatttctgataaattgtaaaatattaatattattttctatatatgggaatggtacggtgtaatggtccacatccacccaggagcgccataataagcggggaaatacgcgagggatgttgggccctcccagcatttcaggcagaacctgaaatgtgggagagcgcatccctcccccaaaatgctgctccccaaaatgtcaagccaataacaaaaggtttattgaccagaatgtgtagcaaaaggcaagggaaatggtgaatgatcaaaatggccgagtgatcaacaactgactcaaatcccaacatcactccccttaaatctgattagagcgattggggaaaggggcgggggcggggacaatagcaacattttgggatggagcaatcagagaaagagtaatgcacgagagagagatagaaagagaaataaagagaaaaca

SEQ ID NO: 15968 - DNA, 222 bp, Heterodera glycines
tttttgttttgttgtttttttttttttttttttttttttttttttttttttttttttttttttttttttttttttttttttttttttttttttttttttttttttttttttttttttttttttttttttttttttttttttttttttgttttttttcttgtgtttttgtttttttttcttttttttttctttcttttttttccgcgtttttttttttttttt

SEQ ID NO: 15969 - DNA, 2248 bp, Heterodera glycines
  misc_feature (2244)..(2244): n is a, c, g, or t
aataatcactttcaaattgtcaagtccaaagcattcaatcagaaggaaacgatcgatcagcggaatttccacgcaattgatcagatgcaattcgcaacgcgacttcaaagagttcacctgatagcggaaaagcacttttattataattagcaaatttggaatcatttcatggaaattaatgttcctaatattatagaataatatcaaaaaaaaaaaaatttgtgaaatcacagaaaagttagaacaaaaaaaatttcgaacatttttgttacaaaaattatataggcagagagagaaatcaaaaaagaacagttaggacaatcatatgatactaaaatttattacccttaagcaaaaatgaatatgaatcataataatttaaaataaggtgctaagtgagggcacccacctggaagtagtcagccaatttgagcagcgccagcacatttgttgctacaaattgggaatccgttcaccaaaaattaaaatttcatatttttgaaaatttatcccctattaatccataaaaagaggataattatttttcagaggattacggttgggcagaaaaggtccgatctttgtcatataaaagatggactctaaaaaggcaatgaattggtccatgtcgacgcccaactcgtccaaagtgatcattcgctgctgcttctccttcatcatgcgactgatcaccggggaaacggtcatcagccaatgggcggacacagcgacctgatcaaaatcaccgatcttatcaatattattagtgatctgatcaaaatcattttatcaattatctgaccaggacttatttttggaagggcaaagaaaatcgaaacaaaaaaaaaactttttttgaagaaaaggttgtcatagaaatttggggcattttttcaatttcataatatttttgctctgatagagcgggttgaggggtatttcatttcataaaggcaaatttctgaccctccccttgcccatttatgcctgcttctaaagtcaagccccccccccacagttagcttcttaacctgtttttcaccaattttcacggtcaaatcgtcgtcgggtgagctgtcggaaggcgccgggaacgcacttaaaaatggaaaagtaattttaaaaaaatggtacattaattaattaatagtcgggaggacggggacttaactcggctcccgaaaatgctttggttaagtatttctattggtaaaatcggaattttactattattattagtatattaccgtttctcctccgactttttctcccgctttttgagaattcgaattacaaatgatgaagtatcgtcaaaaatggcaaaattaacttcactgcccttgttcaatgtttttgtctaaaacaaagtttgttgttaattttagtagatcgcatttgtttaaatttctggttctcttaagcaaagcctgcaacatctcttgggactaacccttaattgttggtatcagtacgcattttgccgctatcattcaaaaaaataaatatttcaaaaaagatttttggggaaaatgcgccccataactataaatggtaaaacgcataaattgccagaaaaatacatatcaatcaattgctctcggcttgtaaagaacgtgaaaaaagttatgggtcctcaaaaaccttaacgttttttagagtttttggttgaaaaaatggtaaaagcataaaattttgaaaatttgaattttgcctactgcgctaaaaactagcgcacactcaactacggcgaccagtaggtggggcgccgctcgcaaccctccgcgcattttcggaagttatgagggaggacccataagttttttcaatttattttttgtccaaaactttcggattcgtttttacaagccgagaggaatgattcatatgtaattttctggcaatttatgcgtttttaccatttggaaggttaagtgccaaagccattttagtcctgggtcttcaactcttcagggagtgatttccgcacaaaaaaaaaattgcttacttcaatgattttcggtgccccgttttggtcccaatgccaacggacaatttgtgccaatggctcctcattcaacggattggaagaagaagcattgccaatgtccgcgattttcaatactttgttatagtcggttgtcacaatcgtgaattccctaaaaatgggtctatatacgaaaattaaaaaatgaaattacagtttaacaaatctgatcatttcccaatgtgaagattttccagtanacgc

SEQ ID NO: 15970 - DNA, 1105 bp, Heterodera glycines
cgtgaaaaatgccattgctctctccttctgtttcacctctttgtaagcaatttcttactaggattaaacgagaattttcgtggcttttttaaaggacccattgggtttttcaggaaatcctaagctgataagtgtcgtcgaaaatttgaatccgaaccgaataatatcatattttcacaaaattgtaacattacttttcatcagaattcttctcccgctttttgagaattcggattacaaatgacgaaacatttgcttcgtcaacgaatatttgcacaaagtcttgaaaaaacaatttattaattcaatgaaattatttattaaaatggcccttttacctctaaggatattgataaaattttaaaatttgggaatttatgaaaaaaataagtaaaaatggaaaattttagatttttactcaattttcatcaaaattaataaattttaaatttatttgctattgttttgctcaaaaatgatttttcattccatataaaatagcttcaatttaatggattattcaaagaaattttcagaagttttacactcaattttggaatttggaaaacatttgtcaatagaaaaatacaaattttcaaagaaaaatatatgtaaaaatgggaaaagcctttgaaaatggggataacattttagaaagatgacaaatgctgtgtgtgtgattcattcattgttgatcatcaacatttgtttttgttttattcaactgagatgaatgcatttttttacaaaaatgtgaatgacaaatttaattaaataaataaataataaatacatattttgaataaaaagaattaacaattcttgatgttgttcgacagcttgtgtgtttaatattatttgcaaaattttcaacttttttgttaattttcataaaaaattatagataagaggaactcaaaaaccgttttctaactttttttaccctggtttttttgggtgctaggtcgtttcgtaaaaagtgccactgtggtcgtttcgtaaaagtgccgttataaaaatatggttgagtatagagttatgaattcaaaaatttatgtttgtgtgcgaggtattatataattagtaaactatgaatatgaaaact

SEQ ID NO: 15971 - DNA, 874 bp, Heterodera glycines
  misc_feature (16)..(16): n is a, c, g, or t
agagtcattgacaccngcgctgaaaattgaaagcattttttttgaaaaagcattaaaaccggaaacagcccaaagaagccttttttttcgcttctccccccccctccccccccccactcataagccccgctcacactgctcacactccacaccggcacacccgaaacagctccaaaagccgagccaaaagcaccgccgctgccgtcaccgctgccgccgaatgagcgctgcaaaacggcgccattgtggttgttgttgttggcctgtttttcatttttttaaaatagccatcaaactccccccccccaaaaaaaaccacaactgacattgtttccagcagcaattgtcggcggttgggccacagaaatgccggccaaattgtccacccgtgatgcgcgtccatccacagcaacaccaccacggccatccgacatgtgcggtgcctgtaaaaaaaaatcaaaaaaaaataagaatttttacaaaattcaaccctcaaatttgctggaaattaacccccctgcccctcctcacattccgttgtgccattgcaaaagtggcactgtcagtgtgtgccgtgccaccaccaccaatggcaccgctgactcgcgaaatgcgcgcctgaaaagagcaatgaataatttatttattaacatttttttaagttttttatttttccattaattaaccccatttcctcacttggttgttgtgcccactgttgttgttgcgctgttgtgccatgtcttcctcgcccaccgccgccgctggggttagcagcagctccaactcgccgagcatgacgttttgtggcgggtggcgagaacgggccggcggacgaccgctgttgttgctgttggccaaattggtgccgttg

SEQ ID NO: 15972 - DNA, 1817 bp, Heterodera glycines
  misc_feature (76)..(76): n is a, c, g, or t
  misc_feature (104)..(104): n is a, c, g, or t
  misc_feature (122)..(122): n is a, c, g, or t
ccccggcactcctcggccaaagtcaacgtcgtagaccaaacggcggagaatggcaccacccgaaagaaggggggancagagaggaagggaggggcgaacaaccncaaatgtccaaacggtgnagctgaggaagcaatcaattgctcagcactcgcagagagaattggtgatgaacggacgccccctccggcgatgaacggacgtcccccgccctcctctctctctcttttccctaaagatgatccgttagtgagtaagaaaaacaaaattattgcaaatatgagacagagagcaggggacggataacaaatagcaacaaaatagaacataattttgagaggtctataagagaaaaagggtaggcaaaatagcataggaaagcacaggtccatccccccccctccgtcctctgaacacaaaacaaaaaaagtcatgtatggggcagcgaaaattgtgcgctaaacacaagcccacaccccaccccacccctccccccaatcgcgtggccgttttcgcgtggccattttagcgttgccattttcgcgtggccattttcgcgttgccattttcgcgtggccattttcgcgttgccattttcgcgtggccgttttcgcgtggccgttctcgcgtggccattttcgcgtggccgttttcgcgtggccgttttcgcgtggccattttcgcgttgccattttcgcgtggccattttcgcgtggccgttttcgcgtggccgttttcgcgtggccattttcgcgttgccattttcgcgtggccattttcgcgttgccattttcgcgtggccgttttcgcgtggccgttttcgcgtggccattttcgcgtggccgttttcgcgtggccgttttcgcgtggccgttttcgcgtggccgttttcgcgtggccgttttcgcgtggccattttcgcgtggccgttttcgcgtggccgttttcgcgtggcagttttcgcgtggccgttttcgcgtggttgcatataaaagagaattcataactcacatttatttaacgaaaatttgtttcactcttttttctaacgaatatttattttataattaagtgagtttataaactaaattaaggttctttcaattatataatatggaccagcagcaaaaaattaaaacaaaaagaaacaaagttaagttagaacatgacggcgcactctatgttttcgaacaattgagcgcagattgacttaagatattttggcgatgtgagtttcatggcccgtcagacaagtgcaagggtatgttaatatattattttgaattttgaaaatcttttaaaattcaggacgtttgcacacggatttaaataacgttgtgcagaagttggtcgtgagttcaagattagaagaggtacaacagtgactaaaagaggtacaacggtaattagaagaggtacaacagtgattagaagaggtgcaacagtgattagaagaggtgcaacagtgattaaaagaggtacaacagagattaagaaaggtaaaacagtgattagaagagatacaacagtgactaaaagaggtacaacggtaattaaagaggtaaaacagtgattagaagaggtaaaacagtgattagaagagatacaacagtgactaaaagaggtacaacggtaattagaagaggtacaacagtgattagaaggggtacaacagagattaagaaaggtaaaacagtgattagaagagatacaacagtgattagaagaggtacaacagtgattagaagaggtgcaacagtgattagaagaggtgcacagtgattagaagaggcacaacagtgaaaagaagaggtaca

SEQ ID NO: 15973 - DNA, 1227 bp, Heterodera glycines
  misc_feature (5)..(5): n is a, c, g, or t
  misc_feature (1202)..(1202): n is a, c, g, or t
aaacnttcgcctaacaagagcaattaacaattctcaggcgctgcaaaaatgtgtaaattgaaataatcacgcaaagctaaatgtggcggcacgtgatcacgtgagcatttttatggcgtgaaaaacgagagaaaacaaagagataaaatgaactttgggacttgtaaaaactgtaacttgatagggcctaattttcattttttattggtccctctttttaattagctaaaatagtgcccctttgattggttatcagcccgggcctttttgctctcctcaaaaaaaaattgttctatttttttgtctcacttcttctctctctctctctttctttttttttttcttaatcgttcagatatttttataaattggtccttattcgtttgctaccaggacttttttttttttttttgggggtatttttgcttctttcactctattttcttattctctctctcctacaaataattgttagatttgtcaattttcgatgcagtcagcccctttagcattcagactagcccgggcaaattttgttcttcttttttttgtaaaatccctttagcttttcgctagcccggacaaatgttctcacctcttttctcttcatcttcaatgtccctttagttttcgactagcccggacagattttctcacctcttttctcttttttttaagtccctttagtcttcgactagcccggacagatttttaaaatgtcagacttctttacttgcgtgtacacgtctttgtttcaggccctcaggccagggagatctcccacaaacttctgccggcttacccaattctcagcttcgtcgtcaatgatgggtcgtcgtttcccaaaatgggaaccatccggtgctaccagtgagggatgcgcactgtgcccccagaccaactatgcaccgtttatcccggatggagtttgggagggaatggggaaaagccaaggcgcctttgaccaagccccgaacccccaaacgactcattgactgttaagatgtatttattcattcgatgttggatttaaacgaagcgagaaatcggaataataattgaagtctgttccatcacaactgactgactgatcactgggggaaagagaaatacgaagagaatggggcggagaaacattacaatgagaaaggaaaaacgtgtgaaaatggataaatgtgattgaattgataatggccaataangaataattaaatgaagggaatgcgt

SEQ ID NO: 15974 - DNA, 1820 bp, Heterodera glycines
ataataacctattattctagaaattattttataatatgtgtttttcatattgtctccacattatgtgctggtgttggccgttgattctgctactcctccaacttcgtcctccgtttttctcgtctctttgaaaagcgtacattcgccggccgaattcggcgctttttgaattgactttgaggcaaaagaacagaaaaatgagggaaataaatgggaaaattttggacaaaaattggcccataatgaaaaataaaatgttaaaacataaataaataattgaattgcgattgtttaattgttcacattgaaagtcggctttttaaacccaaaaataaaaataattaaattaattttcatgcgagaaaaataaagtcacaaacttcatctacaaacttaagaatttatggggaaaatcgttcaagcgaaccagattgattttcataaaaatccgttctctaattatcatgagcagggctgccaaaatatgcaaatgcatttttttcctgggttctccatgctataaatagtaggaaaaacactttcttttttgtgtttgcgtataaaagtcgggacttttatttgcatattttggggtttttctgcatatttcatgcatattttgccatttttcgtcaaatattttttgatttgaaaattttttaaattaatttgcatccctaattttcaagttttttttgtgcaattttgcgatttttgtgcatatttggtgcatatttcacgactttatttgcatatttatgcgcatattttggccacttttcgtgcatatttttggcagccctgatcatgaaatttgaaaaaggtaaatataaaatgcattaaaattttttaaaacaatggatttttatccaaaaaaaaaactatattattgcatttttacttctaatttataaattttatgaaaattttgggtccggcggtgggaaattataaattttagaccagcaggggtttttgacagtttataccaaaaatgaaaatttttgaggaatattgggataagaaaaccccgtgaaaaaaatggttaaattatacaccaatcgatacgtctcgaggagttaagcacgaaaaaatatgtctcaagttgcggaaatgccaatcgggagtttggacaatttctcttccaatttttattaagttgtagcggtgatccatttttagtatggaattggggagagagggaaaggaattggtgaacaaaagagtggccaatggccgattcgctccgtttttaatggccaaaaggtacttttgccatttattatgcataaattagcgcggcaatgtccctcctttttccattttatgcataaaattaccagcgagacgtgggttttacaagccttatgttaccttatttcaaattttgagttgtaggcataaaacggaaaagtacctgtacttgtcagaattctcgaacacccttcattcggagcaagttaggcttcagcttaggcctaggcttagggttcagcttaggcttatgcttacttaggcctagccacaaattaccttagaaatgacttttatttgaaaatttcaggggaggaggtcataatacggaaaagtgcgaaaaaaaaagtttttagatggtacggttcgactgcataccttgatttttagacttagctcgtcaagagctttcgaatgataccaaatttgtcgggattcgatcgtttaaaaaatttaaggtgccaagtctctcaatttttagttttgaaccggttcaaaacccggttttttggcatttccccctcgagacatattttttgtgcttagctcctcgaaacgaatcgatc

SEQ ID NO: 15975 - DNA, 1650 bp, Heterodera glycines
  misc_feature (20)..(20): n is a, c, g, or t
aatttacatgatggggacanaatgacaaatttgggacggtgggatgggtgggatcctatcattgtccatgttgaggtgacgaagcatccttccatccagacgttgtactcgatcggcaagttcttgcggcgcaccatcccgtctccctggaaccactcgagcttgaacgcggtggcggctgggtccggcgtgttggtccactccacggtcacacggtcgcccttggtgtcctcgctgccggggtcgaaggcgtcgcaggagacggccacgttgacggactcctttgggccgagcactccgttcggcgggttcatgttgatgcgcttcggtttggggtcggggtcacttcgccgcggccaactcgccgcggccatctcgccgcgagaaactcgccgcgtggccaactcgccgcgggctatctcgccgccgcccaactcgccgcggccaactcgccgcgccttgttttttggctatctcgccgccagatttttttcattgaaaggttacctcattattttgatataaaattaaaaaatgcattaatttatttcaaaagaatcattaaaataacaaacactggtccataacacaatttgaaaccagaaattccgaacaccgaactcaaaattctgataaaaagttgaaaattaaagttcttttaaatttcatattttgttcaacctttgtttacacacacggaaacgaactgaaagtcatccctgatactcatcagtgcttcaataaaatcgtttaaaccattttagattaaaaatcaaaatcgaaaaattccaatttcgactttattcgaattcaggctggtgttataaataggttgaaatggagtgctcagtagagaccggaaatttcaaatttgcggatcccgctgcgggattggaactcaaaattctttgcgggacgggatcccgcgggattaatcccgcattttaaaaaaaatgtgggaatgcggactgggatcccgcaaaatcccgcgcgggatcccgtcccgcgccggtctctagtgctcagcgcctcaaaatacccaaagaaacttgttaaagaattcccagaaaaaaaaaaatttcgggaccaatgatcgacatgattgttctttaaatttatggaaatatagaggaatatatcgttctgcaatttttccttcatgcgttaactttcaatttgaagcatattaaattggagagaaactttgctgaaatataacacattgaatacaattaactgttaaagaatttttgcttttaatgcattttttcaacgaaaaatctggcggcgagatagccaaaaaacaaggcgcggcgagttggccgcggcgaattggccccgcggcgaaaaagcgcgcggcgagttggcccggcggcgagtttctcgcggcgagatggccgcggcgagttggccgcggcgagttgggcggttcccgctggaaacggtgagtttttctttgttgcgattgcatcacttatcacaacttatttatatatctttggtgtttttcagattcaatatttgagcaaccagttgaaaaaggggaagaaacaacggaagaaagcgcaactcaaaaaaaaaaaaaagaacaacactgagaaagatggacccgcggccagcagcagggaacgacatcgaaacctcaagccg

SEQ ID NO: 15976 - DNA, 897 bp, Heterodera glycines
  misc_feature (46)..(46): n is a, c, g, or t
  misc_feature (887)..(888): n is a, c, g, or t
gtaagactagaagcgctccagccctgacctggggtttgccatttgntagcaacattttggtcattctgcccgtcgcattcaattttattgatcagcaaaaaaagttatgttaatataattttgcagatttttcctaatccccctccctttgtttatcgacccttacttctgttgaaccaggggaagtaggtgcaacaaactaaataatccggcattactcatgatccgcaataataactggacaaaatttttcaattaagccaaattaataaacatttcttcggtatttttttagtaagaatgtcttcatcagaaacaaaattggatgaaaaatcaaacgaaattagcaacaatgaattgatgggagaaaacaatgccaaggatggaaatgtgaaaggtttgttggtactttttcagtttaacggattttaaatgttcgaaatttaaatataagtacatttattgcatttaaaaagtatgtgaaatctgtccgttaaactagaaaagtaccggtttctttacttcatttgatttttcaattttttaatatccagaagcaaataactcaactgacaaatcagctgaagcagaagttcacacagacgaagcccagctgggaattgctgcagttgacccaaaaccaacggacttttcggaaaaaccaactgatattcaaaagagtgggaagccagaggaacaacagcaacaacaggtgatagataacatctcaagtacgattattagatgttgatttgcaagtagcaaagcgtttcccgatatttgcccaaatctgtttaaaatttataaacctggtgttttttcttcaatggatttttgaaaaggttatctaatatgtcaacaaattgttttcttaactcaaatgtcgnnggtaacttt

SEQ ID NO: 15977 - DNA, 3355 bp, Heterodera glycines
  misc_feature (3285)..(3285): n is a, c, g, or t
  misc_feature (3298)..(3298): n is a, c, g, or t
  misc_feature (3332)..(3333): n is a, c, g, or t
aattcggcgctagttgcaaagagtacttttttgaatttttttttcacttttttttggtcaatttttttttttgttttttttttatgcagaatttgtttttttaacatggaacgtattgcatactatttaataaactgaaaaaaacattttaaaagaaaatttagcgctagttaaaaattgacaaattttgagttttatcaaaaaccaaaggggggaccctattgttttgcaaaatttttttgagataaaaaatcgtgaatatattttttattcgccataattatgctgttaatacttaatattcatcattatgtgtcaaaaaaacaaaaacaaaaattgaccaaaaaaaagtgaaaaaaaattcaaaaaggccctctttgcaaatagcgccggattttggctccattaaatttttataaaaaaatggacattttattcgaacgaacctgtaattgggtgaaccttgccaagtccggcacagcgtccactcgcatttggttgagttcaatgctctaaaatcagaccttgaaatgcttttcgttatccatactctccccattcctactttgtaaaactgacacaaatagcaaaaccatataaaaagtgagtccatagttcgtttttttttcaaaattacaggcaaatgatggttctaaccgtttctgagtcgggcattacactgaggtcgaacaaatttagagaagctgtcggcttcgcctcctcattgggctgcctgtccaccttttctgccagtagttccttttcagtttgggacatgttctctaaaaaatgctaattatagttcggcattgaaaatgcgattgatgccgcgcgaattatccaggaaaatgagaactgagcgagagcttcgagaactaaaaaaaaacggtggctggacatcccttatcccttactatatcccttactcatatatcatcattttgaataaaaatgcgtatcattacatataaaaaaaatgagtattgaaacgatatataagtcagacactacattaaaaattattgaaaataaaagtgaacaaaacgccaatgaaaaacagacagcggaattagacactatatgttttatcattgattttaactaaatttctaatacttataacttggtgaagggtaaaccaaacaaaaccattttgtgctcattttgatgggaaaattcttaagaatatttcaaagttaaataaaaatttgaaaaaatagtttattagcaagaaaatgaaccatgtgttatctcatatgttagagacatggaaatagtgcgtcaaaatgagagaaaaagaaaaaactttgcccagttgaaaaaatttttctacagttgagaatttcttgaaattttgcaaatggatgtttcaaaatattcatctttttccgttttagttttgtagaagagagtgagagggagagagaaaaggaggaaaagagagagagagagggttaggtgaatagagaagaaagaaaaggaggaagtgagagagtgaggtgaggagggaagagagaaaaggatggatgagagagcaaggtgaggagagcgagagaaaaggagaaagaaaggagagagagtaatgtgaggagagaatagaaaagaggaaaggacaaaaagagagagagtgaggtgaggagagctagagaaaaggagagagagagagagatgtgacgagagaatagaaaagaggaaaggaaaaaaagagagggagattgagaaagaaagagagggagagagagagaggttgtgtagagagagaaagagaagagagagatggagagacaaaaagagagagagagcggtagagagtgcgatagagagagagaggaaacgcgagaggaagagagagaaaaagagagagagagcggtagagtgcgatagagggagaggaagagagagaaaaagagagagagcggtagagagtgcgatagagagaggaagagtgagagaaagaggggaagagagaaagagagagagagcggtagagagtgcgatagagggagaggaagagagaaggaagtaaaagaaagagagagagagagtgaaagagaaaaataaaagagggaaagaatgagaaagaaagaaagggagagagagagagagagcgcgtagagagcgagagagagaaagagagagaaattggggaagagagagaaagagagtgaaagagagagatagagagagcgcgtagagagagagagagaagagagagatggagagagagagagagagaaaagggcgagagagagagaaagagagataaagtaagaaaaaaagaagtgaaaggaaagagagagagagagacagaccctaaaagcctttattttttcataaaaatttgctcaaaatcgcgaaatcgtatagtattatagtatgattaccaaattttggctttatgttctacattcaaataaactgaataaacaaaacagaaacaaaaacccgaacccataaattgcacaaacccggaaaaaccagtaatgtttgggacttcataacaaaaaatattggaatgtctgctgctgtaaaaggatcatggacattgaaaacgctatttctcgcggcttttctcatccgtttattttttattttttatgctcgatttcatgattattattttgaggcgagtttttactgcttttttcattaaatttggtttgactcattttgtttcccggtttcaaatttattacattttcatttgtaattgcttttcccttttaaataggtaaattttactgacattgattatgaggtgtttaccgaagcggcccttttggctcgtgaaggacattcgccctatgaacagcctgagtaccgttacacgccattgatcgcttggctattggtgccaaatggacaattcgccgattttggtgtcctttttatttactttataataaaatgagaaaatcagacgatttttatctatgaaagcgaaccaataactttttgcaaaaatttaggaaaactagttttctgtgccactgatgttcttgtcgcattcctgcacttacttatattggaaagtcggcaacaaaatcaaagaaatccttcctcgcaaaatgaaggcaaaaccattcattcatcatccgtcgtcttccgtcattttggcgtccttttctggctgttcaacccattcaccgccatcatttccgcacgtggcaattgtgatgcgatcatttgtgcactcgttttgttggcactgtttttactgatccgtgtgtggcagcggaagaacgatggcataaccgccacatttctgcgcttggcactggcggncgttgttcacggngccggtgccacccattttcgcattttccctgtgnngtcgacgcatttattgtatttt

SEQ ID NO: 15978 - DNA, 2077 bp, Heterodera glycines
  misc_feature (2021)..(2021): n is a, c, g, or t
ttaattgattttgtttgcatttttatgttttgaaaaactcgccgatttttcatgccaaatgaggattttttgaggtattttaatcggcaaatgaggattttttatagttgaaatgaggattttcaaaattttgagatcgaaaccctgttttaatctttccagtcaacatatatctgtataatttaattggagggttctgcttttgaaatttaattatttcctgtgtctaattagcattctccgaatgttttattctcttttattttaattaattaattaatttttttttgcaaattaattttgttgctgtccaagaaaaattcattccatcactccatttgtgactaattaattttgacaactgctgctgctgctgctgctgctattgacggcgcatcgcatgagtaatccgaagcgtgttcgattggagaggcttcatgcattggattttggtgaatcggatgacatttcggagacacaaagcctcggcatgttaaaaaataaataataaacaaaaaaaattatcgatttaaaaaaataaattcccctgtaaattaagtggatgagtgtaaacatgaaaatcccaaaattttcaacaaaaatcctatttttcttttaaataatttttttaattatttaattttgaattttttttggttttacggaaattttttttgaaaatgtatcaaagaaagcgcaatttacgagggttgaaagtctttactaaagttgcttctcgaccttggagagagagaaaaattgggatccgggagaaaattccctgacaaaatataccgagaatggctggagaaatataaaaaaatgttgtgtaaccataccctcgttggggaggaaattttcaaaaaaaaaaaaaaaattcttagaaactcaattaaagacactttcatccgatttggagtgtaatcgtattcgcaattcttgcatcaaatcggataacaaccctagtccttacagagggcctgagaatagaaatccatataaatcggatctcttgtgacgaaaaatgccaaaacagtttagggcgtcactaatttagtgaccaaaatgctccctaataatcccagcttttaaatgacgaataataatggaaatttttaggctaaaaatattgtgtttttatattatttttcgctaaaaaaagcataaagatgtttttgtcttttttgacgaaattttttttataaataatgaaaaataggaaaaaatagaaaaaaaaatttagaaaattaaattttagaaaacaaaaatatttatgcattcatctttgaatgaaaaaagaaattattcatatgaaatcgaattaataatctctcctttgcatatttaatgtgcatttttcaaatgacaattaaaagaaatgtgtttaaatctcatttcatacacattaaaatccaataatttttccccataaatttacattttatttaaaatttaattttcttaattagctaattaagaaattatgtcttttttccttttaaaattgatgaataattcccttcaatccttcggtttgtgtgaatgaaaacatttgaaggaccatcgatttaattaatcgctgctttatttattcaccttttacaaattaattcccctcatttaaaccattttttctcaaaatttaatcgatattttttaatttataaaaattttttaacattaattttttttaaagatggttctgctatcacttttgccaatttaaacactgttaacgccaaaaatcagcaggtggttatagattaaattattataaaaaaataattatttggaaatatttaagcgcaaaaagatgaacaaccgtgatcattttgaattggaattgagtgccgaatcggatcaccgatcaccagacaaatcatcaaaatttcagtaatcaattaataaataattaaaaattaaattttattttttattattaaaatattaatatattttagaggataaatataattttcccactaagctaattaatttaattaatatacttttttaaattntttagaggaaagatatagaaaaattcacatagtaaaaattaaaatttcttttttaa

SEQ ID NO: 15979 - DNA, 2256 bp, Heterodera glycines
  misc_feature (1524)..(1524): n is a, c, g, or t
tatttttcggattgcaaacggatcatcgattacgtgttggtctacgaggagaaggaaatgacgaacagcaattacagcaacaacaacaattacgatgacaacaacggcaccactgctgaacatggtcaatgtgatggtagtgccaaagtcaatgccaataacgacaccaacaacggcaacaataataataattcacgatcgtccccccaacgatcaccccaactgcatgcacaaaaagtgaattgttttccacaaaaaaaaacaatataaaaaatttctaacttcctgaaatgtttaaagaaaaaccttaatttatttaattaatttcccgatatttttttattttcaaaaattttgaaaaatccaaatgtttaaattgtttaataaaaaaaaaaaacttttaagttagaaatttaaaatttccttttttgtaattattttaaaaattttttggcagtgcaacgccgaatttaaaaaaaaaattataatgaaatttatattgaaacttaatttattataattttcaatattttatagcggcaaatgtacgaggaaagcttgttgggccttggacttgaacttgagcacgcaaatgcaactgcaattgtaaaatttttattcccaaaattttttttctttttttccactaattatttaattaagaatcccaacatcaaatttgtgctaattcacgccccattcaaagtgctaatgcgtcaagcggaattaatgatggtccgaatgccagtgcataggaatgacgtgagaaaggtggaataaaatatttattaaactattaattaatgattcaaaaaattcattaaataattaattcattcattaaaaaattgctttctatttaaattggttggtactacttccccatcgaattgtttttaaattttttagcgattttgtaaattaaaaagaaacagaaattcatcaaaattttaaataaattattgaaaaattattcaaaaaatttttcttgaaattttcgtataagaaaattatctaaaattttttttgaaattttctaagaaattctttttgatggttttgagtagcactccagcatcatttgtcctgtatggttcgaatttttgtttaattttttgaacggtatttttgtatattttaagtattattggaaaaaaggatttgaccctgctgccttggaaatgtttcaaaaattaaatgaatttattatttataaatttctccaaattttcaatgaatctgcgagattttttaaacaaacaaattaaaaataattaattaatttaaggaatggaatttgactgatggttttgtgaatgcctgcttgaagcggcttaaatttctggactttgacccaagaataaagaaacggattgagccagaaacttatttttgtcaaccatttgttgcgcaacactttgaatggtgggtaattaattaattgtggtactaattagcaaaacgcgaatttacatggaaaattttttaataacaggaaaaaaagctcttattttgcttaattgngaagcttttaagatgaatttttacattcttatttcccattaactaacataatattaagtaaaaacgttaaatattaaaaataaaattttttaattttattagtaaattttaaaaaaatattttttttttctttgacagttttgttggctatgaacacccggagacatttttcacccgagctgatcgggcccgtatggtccacgatttgttgatcagagcgcggtatgaccgtggtgaaagcatcaacaaattgcgatttggcatcgacaaactgctcaggaacaggacttacacagctgcattcccacttcatgatgtgaaatttggattttcttatacaatttttagtattaaaaattatattttaaattttaaattaattcatataatttttgtttacaaataattttttctgtttgttaccatttaacggttttaatttttttataaaatccatatgaatattttaattgataatatagaaattcttatttaattttggatttttaagaatgagttgagaattttcaaaaaaatttttagaacggaaatgttaaaatcaaaacacattctaggaatgggatttcttaaatgaacatatttgtttaaaacggaataattaaaatatttaaatcatatttttaatttactccaattatcattaaaatatgattaaaatttttaaacctaattaaacttttaatgcaacataattaaggaattgaataaaaa

SEQ ID NO: 15980 - DNA, 2346 bp, Heterodera glycines
ttttttggtacatgaaacgaaatcaggaatttcagcgctaattacctccacatcgtttcggttaagcctaatcgtcgcaccgagtcacccacagggttcccaaacgcataggctacccaggtgccaatttgtgcattcaccaaagcgtcacccggacgccattcacagtttgacgtggcaggagtgacacgatggttgttccgataaagagttgctggcggaccaagaacacggtaatcgacatggagtggcgttgtgtcaaaatgaacggacgctttcgtcaagtattcgttgttgaccaactgaagcgactccttcacccgttcgttgtgcactcgcaaaacggtgggcggaatggcagtctctttgatcatttcctaaacacttattgttaatgttggaatagaatgacgattaaaaatgaaatcgctaaacacctacacgaatttgctcaggattttgttgagaacttttgacgcgttgaccatccaaaacaaagcaaacctaaaagtgttttaattaaattgttgccttgtctgttgtacctccatgggataatacgccgggtccccaattctgcgataattgacgaggagtggtgctttagggtacctgaaatcgagaaataattaccaaaatgtttcttttaagaaagcaatcgtgttggatagtggactcactgaagcgttttccgataggtatcctcgaaatattgtttgacgctgatcttcccgctgacttggtgtgtgatgaatgtgttctccgcgttaagaccatttccagtgtttggttttgtaatgtcactgatgcgaaaaaatcgtccagaagttccatagcgcggttcagcataaattcctggagaatgggtataaaataattcacatcaaacacattcgcattataattagcataccgacaaggccattgcaaagcgcctcgtagtcactttgagtaaaatcgcctgtctcgaatcttccctgattctctcgaaaaaggagcgtctttgctttgtccaaaatgcacatgtccggaatgtggaaggcggactaagacaatgaatgtaacatggtataaattaattatgggcacgactgatggaacccataaagataaacctttttagtttggatgacgatggcaggtgtcatttggccagggccttggtcgcctgaattctaatgagttaactaaaagaaaaagaacaaaccttcaacgattcgacatcccttgttcactcctacaccaaggaatgagtggttggaatcgaagacaggacactcgttggctccgaacccatagtcggttggcgccaataagtaaacacgagacgaagaaaacccgatgaattgctttctgaataagaagtcatttgagttcttaacagttgggttaaattcaaattttaagactccttaatttttgaaatttggatttggactacacctctgaatttagcccgttgaatagttaaaatgttgttaaaataacatgtttattggtttgaataaattcatgcccgtccatgttggccttctgcgccgttgcaatgtcaaggaattgctcaagtgatcgttccattttcgacacgtcgtttgtgatgaaggacaagtcgttaacctcgaagcccgtcgctggcctgatgatgaattcataatgtttgtaccgtgccgcgtctgggcgttctgcggttggcaccgtgccgatgttaaacatgaactttccttccgactaaacgatgtgttatcattaaaatgccaactcccaaagccataaacctcgatctgtagcttcttcaacgtgaatattgttttcgataaatcgtagtagagtaagttcccggtgtctttcagtgactgctccatggtcctgtagaatgccgagaagacctcacggcatttgtcacgacggttgagtaatgggaaactaaacagatgtttaccaagcatgcaacgcatacatactcgtccctatcccgtggaccactcggctctgaaacgcaacactttcggtccgaacgactgctcactgcgttgatggtcacctcgtagtggtagatggcttgcgtacccagcagtttgagaatgtgtgcctaaacccacagtattagctcttttgaacactacagaaaaagacaaacgtttgtgatgagttgcatcctccccttttgtccggctgttcctggcagttttcttggctcgacgaaggtagcaccttgatccaccctaaacatggatcatgtaaaataataagttttggtcttacatttagcccaccctttcgtgactctagaagctgcgcccatttcttcgcgcttcccgtgttgtggtggttttctggggatttctg

SEQ ID NO: 15981 - DNA, 3092 bp, Heterodera glycines
  misc_feature (12)..(12): n is a, c, g, or t
tcagtcgtccgncattcatcgtcgcaagcgtcgaagggcgtgcttccgttgcgctgtgtgctctgctctgttcggaatgaggccgttgctgtcgtcgtgtccagtcgtattggtggagtcgattgctcgggcaattgacgtcgtttccgccggattggtgtgcttggcatttccctcaatggcatgtcctcgtgttgtgcttggatttgaggcgttggttgtttctttggttgaaatccaatcagggtcatgagtgtgatgcgaatggggttcaggaagtaagcgattaggcagggtaggatgacgtcacggcaaagtaggaatgtggaatatgccgaggcgagacgtatccacccattggattatttcctgtagccgttcttggagccatctgacggtccatccttcgattccgccgggtaaagctccgagtgcttcggctcgttgggtcgtgtgttgttccagtttggttttgaagtcttccgagtcttcgaattcgtcgatgtgcggaaagttggcaaagttggtgtcgttgtcgagctgccactgatggaagatcagtgggtggagatccaaatcgttgtccgttttgttgaggattgtttcgtagagctcgtggatggctgtttgtgccaatcgttggacgtttccattttttgagtcgattcgcacccacaagttgggtttttgttgcacttgcagatgatggtagcgaaattgagagcaacttgcgatctttgagatgagtgagaggatgcgcatctccgggtcgaggaatgcgtcttgtgttgtgtttggcagatggattgtgaccgggatgaacttgtagcgagtcctttgttgtccggtagctgatgttggatagggagattggaacgcaggggaaacacttcgattgttgtttcgctgatccatcgggcttgcagattttcgcgcttgaggagttttcgtgcctgaagcgttgggttgctgacgcgcacgttgcgctggcattcctttaagtaaagctgtgagagtgccattgttgtgcaagttgagcagcggaaagctgtgaagcgagttgttcgggttgcacgttgcgtttcggtcttgtgtggtcgctcatgatgatgtcgaattgctcttttggaatgccgaagttctgctctgataagacgatttgtctcccgtcgcatgcttgcacggcatgcgtctcggtgaaggtcagtgccttttgtcgatcatccgagatccaaaatgctgttgtttgaccgttgagcttggtgaattctccgtggatttcttcggcttcttggaaatcgcacatgaaacaattgtcgtttggacatgctgaagtccagatgagtgaactgttgttttgcagctggcaatactcggaagcgtaattgcagtggtctgcgcgatggattggcgacagtagttggagactgtgccatttgacgaacagtgttgctggttgcgcaaaacaatttgttactgagctggtttgcttccctttgaagagtccagtgattggtccagggaaatccacttgaagttggtcgtttgttgcccaaatgtggttgccaacgtggtgcatttccgttttggcgagtgggcattcttgttgatgtgccattcgttggcagagtcgtttggagaccaacggaaattctttgttgatttcgacgaacttatcgccgacgatgttgtgtaataattttccttcgtcgttttgatgaagcagtgccatgccgttgcgattggttccggtcgatggatcttggtgtacagcgtgattgtcagtggtgtccattgcgcggtgagtgcgggtggtggtcggcagaatggtgagttttccgggcccttcagttcccatagtgtgctgccgtggttggaacaccaaaagacatcgcgtccttcttcggtggtgattgggcttttgggccagcggatcaacttgattcctgggcgtggccgttgttgtggacgtgatctgtacactgtagttgttcggtagtccatggtccgtgacattggtgtcgtcgtggttgtccaggcattgggccgtgtggttgctttggttgaccaaattgttgagcgtgttttggttatggtcgccgttgtgcgtggtggatttgtagtcgttgtgcgtggtggatttgtagtcgttgtgcgtggtggatttgtagtcgttgtccacggtggatttgttggtgccggtggagtcgttgtttgcggtggatttgttggtgctggtggagtcgttgtttggctcagactccgattaagggcgaggactttgtcaatgtatcgctggacgtatggactgtgttttgttgccgtcctcttgtcacgttccgtgaataggttgaggaagttggaaatgtagccgccgtgccatgttttgacttccgcaaattgcttttgtcgagttggttgtccttttgccgaactggtgaagagaaggcaaaggaggctgatcagcattaacgagctgatcacttgttgacttgttgacgttccgggccgggctgaacttgttgacgttgacgtcccgggctcttggtccaactccattggctccggcatcgtttgtttgattctgttggcgattcgtcatgcttctccaatttcccggttgaaaacgaagtagccggccttcagttcacgggtgacgtcgatcatatattttttgttgctgatccattgagcgctgtcgtccttggccaggatcaaagttgtttcgatctctgatcgcatgaatcgatggaccattggtgcgatctgcgctgccatgttgtcggcagtcgcttggtatgcgaagatcaagtgtttgatcttcggtccggggatgagtcggaattcgtccgccgggaaatgtgtgaaccatttggcgtcgtagaagagcggtttgaatacttctgcaacgttgtctccgatcagaattgttgtgcagttgtagttcaggtactttggatgttgtgccttggtccgagctttggagaagatttccgccgtgcgattgttgagccgttcgatccattctccatagttgctttgttgttcgtgatccgtcagtgattggacgatacttcacttgcttgcgtgcc

SEQ ID NO: 15982 - DNA, 2555 bp, Heterodera glycines
cggaaaaattttttgaaaatttgaatgcaatttattaacaaattttgtacaaaaatgagcaaaattcgcgagcttggagtaatttttaagaaaaaatataggaattttgggggccggcagtgcagataggcgccgccgggggaaaattttaagaatttatatgaattttgttagaacttagccaaatttttcagaaattttcttcttttagatgaaaataaggcattacccccaaatcagaacatttcttagaaacaagaacataaagaaaccctgtattaatcagaaaaaataaataaattaaaggaaaacgttagccggaatcgaactcatgacaaaagtactgttagtattgaagcactatccaccaatccacaaataaaataaaaaacaagtaaaatttattttatttcataaaaatttctcgatagttaaaaaaaatcaaaattgtctaaattttttgccttatttcccacgaatatgccattcttaggggtgtattttcacccccgtgcccccgcgggggtgaaggtcgcgggggcgggggttgcgggggtcagagtcacgggggcgggggcgggggcggggctcgaaccctaattttaaatgttaaaattatgattgaattcccattgaaaaaggaatcattttgaaaaattagaagaaaaaataattacttggagaggaactaattcaacgcaaaccttaggaacagaagcaagacacaacaacccactggaccacgcatatgagtaaagcaatgaagcaaaaagttaccaaaaatacattaattttaaatttgcaaaaagccaatcattaggggtgtaaaaaagtctcggtatagagtctcgaagacaggctcagggatttatttgtctttataagcgaagaattggtaagggaagagaaaatggaaataaagttttcgtgcttctctcgtgaaaagttacctgtaaaaaatataaagcccatccgtggtaatatatttatacgtattataaaaatagacataaattttatattgtatatataatttttatttaaaaaaaattgtcgatagtcacatttttgccatgcttttgattgcgtggcagaaacacctaaaaaaaagaatgatttccttttcaaatgccaaaattttattataggcgaattattatccatttactccctaatcatttgtaaatttttaaatgtaaattattttaatttttgccttttagcaaatccccgcttttccaaatgattggcggcgctaaaattcttttttccgctttcatttttatgataaacattgaaggcattttcagcacttacggagatgatttatatgcagatatttgggaaaaggcttttccaaaaaattcacaaaatttaatggcaaaatcaaaaaacggcaaaaaagttggaaatgcgcaaaaaattattgtaaagcaaaaaaagacggacgaaagacaaataaaattgggtgaaaaaaatgtaaaaattgaagaaaatgagggggggacgacagcagcagaagaagcaaaagtcaggaatgttcagaaaatgctgaaaatagtaaaaaatgagccaatttttgacgaaaagattcaaattgatgaaaaaagcggccaaaatttccaaaaaattcaaacgaatttaaaatttaagcaagcgaaaaattggccaattaaaaatttcgaaccaaaaaccgaaaaatatgaagaagaatttgataaggtgaatggggaaatattggatgaaatagccgaaaaagcaaaacaaaacgcataaaataagtttaataagaccattaatgctaataagtagagaagagcggggccgggaattttgggcaaaaccgggaccgggacttgccgggacctgagaagccgggatcgggaccttggaggaccgggaattctcgtcccggtcccgctctactgacaaaaaattattttatttttcaaaaggagaatcaaatgtccggaaatttgttgtatccggcattttaaattttctctgaaatccaattcctagtaataaaaaagataaatcctaaaaatcgcattgaattagtgagcattcccgagaaaaacaaatgatacgatcactgaaaagtcaatgtttaaggaatatgaagaaagcaatcggataaagcaggcaaattccaaagacaaaagcaaacattctgatcattttgatgaaaaagaaatattaaaaataatcaaagaatttgacaaaaggagagaaatattgaaaaacaaaaacatttacaattggaaacaactgaagctaattgaacgagaaattgccagggaattggggacaaaattttacagaattcgagactggaaaagggaatttggactggtgaaaagagcgaaaaaggaggacaaagaaacaaagttggcactgattgaacagtttgacagaatgaaaaatgagcgcaaaatgaaaaagggatacaaaaatgccgagaaagtcggcattgaatgtgaaattgccaaggaattggggacacatcgggacaaaatttacaaatggaaaagcgaattattaagtgggtgaaa

SEQ ID NO: 15983 - DNA, 1900 bp, Heterodera glycines
gaaagcacagaaattatggacaacaaatcaaaataccaatctttgttttgtatttaacgcggagagatcactcactgaaaacgggaaaaatattttcgatcattggcccattctttggaattccctcagtttccgatgaatgcgattaccctttccccctctgccgccacccttttcttcatttactccttgcttcgtcattcgtctcattcgtaatctcacccccttcccccaatccaatggcatcagacgggggaaatggcactggcaaatgtgtggcgaggggccaaacaaacgaaagtgcgctgctaaacaataattttcctcaaacgcgtcatcatgggaattggaaggtggcggagggggcgggggacagaagaggggtaacggacccccggggggaaaggggtgacgaagtcggcaacgacgacgacgacaacgggggattattggcccagccgaggacaacagcagcacagcagccgataacatctttttcaaggggtgtcagtggccaatttgatggcaaaatgctcctcttttgaagtcccttttgcccctctcccttattaacttcggcccaaaagcgacgaaagtctccgccgaccgcgtccatttccttccctttcttttaccatacgaggaggagaccatggccacaaatactcttctcttctgatgcctcctctcatcggattcattcatttgctcccattttgcaaatttcccttttccgctctttcgtccaatttcggcattaattcatcgaatccttcgctgattaggccatttcgtgcccgttcatcggcatcccttaaatagcttatccctcgcccaatttatttttgttttttctttccctttctctcttttctttaattcctccaaatttcctctttcattttcactttttcttccccgaggggcgctatccccgcaattaatttgttttgaggcacataacggaggaaaagcaatgggaagtcatcgcagaatgacaacagaagaaaagagaagcgatggcattggcattggcattggcacagtacggccccaccactcattcattctttcattcagtcattcactgctccgtttttgccatttaaactttcttggggaaagttaaacaaatgcaaatcccccgagggaacattgcaaagccaactacggcatttcggaggacaactcaaaaggcagggcaatttcctcgacagaactctctgctctcttctgtttgaataattagctaatagccattcattccaactcaaaaattttaaaaaaccgatttttattttattgatgaaattttccatttttcaaatttgtaaattcggctcacttttttttcttagaaacagggaaattggccaataaattgcttttgccctcccaatctcccaccttcgccccaaatacaaatccatccgctcaatgcctcgtggccacggcttatgccaaagaaccgccaaatccctcccgcccccgccattgctctgctcccaccctcacaaccgccctcatttttcattacccagccaaattcatggtgttgtgtgccatttgcagccatgccaaccaattgccaattggtcagccacacagcaaacattcattgaaggcgttagccgtcacatttcagcgaatgcttcgcgcaatttgctgctatggcattcgaagcaacggcactttccgccccattttcccacacttttgtactgttttccctcatcttttgttgtccttttttctaaagaaaaagaaagtaattggcccaaccgatggacaaattgcgccattcacagctcttccctgacatttccaaatttggccatgcaaaatgccattcattcccttgggaatgtaaaaatggggggcgggaaaaagttaaaaagtt

SEQ ID NO: 15984 - DNA, 790 bp, Heterodera glycines
  misc_feature (764)..(764): n is a, c, g, or t
ccccccccccccccccaccggtccccggtttgagagtgtacaattcctcacctcaattcttcgctacccaatgcattgctaatgaatgcatttaaacacactaattgactttttcagttggccgagaatttattcagattaaaacaataaatcgaaagcaagtgctaattgagtttacagattttctttttttttgtgtttgccttttcccagatgaaatggccaaagggcgaatttgtggccaaattgaaggggcgggagagacccctccccctcccccttatgccctttggcagtcactcaatcagagttcttaaattggcattgacatgctaataggaagaagcttttgaaggagcggtcaaaacggacgaaataccaaaattttatttacatgctattttaatggaaattttctctaattccgtctgtatccgaagccgaaatgcccagtcgatgctctgcgggcgtccatttcctttctctctcccaaattgggccaattttttcgatctttttcctttgctcacggcgtttcgctgtccctctctttctctgcctccctccccttttgcgcttcttcccttttgctatttttgtcccttttccttcccccctctcttttctcttcccccatttgtaccacccaattaattgggccatcacaaattattaatcgtcgtcatgcccttgggctgtttggcttattatttgttattacttcctctgctcacgtcaaattccatgacaaaaatattactcanaaaattgcctcggtattagaagagga

SEQ ID NO: 15985 - DNA, 3501 bp, Heterodera glycines
  misc_feature (3344)..(3344): n is a, c, g, or t
caatgacgtggagatcttaatggctgcgttggttgcttttcgtcgagaattcattgggattcaaaggcggcaagagtacgtcgatggggtcgacgaccgggagaaccacgacgagaattgatgtcttacgggagtgcatgaccatcgcaagtgcgtgcatgaaacacttccgcaccaatcacctcccggctgagcacctcgccattgtacctgagcgaggatatgacaacgctcaaaatcagtccctccttgcgcttcgcttcatcaaatggtatgaagaacggcatggcgtccaactccaaactgcgcattctgccggtggagagaggaaagttggcaattactctctcgatgcttgggttgaagctgaacaaagggccattgaagtgaacggtaattttacttttaaacattttaaaatattgtttttaaaaataggttgtgtgtggcacgggtgccaaaagtgctttccggatgataatatgctgttgccaaatggaaaatcggccggagaagtgagggagcgggacgcaaagagattggaatttctacggaatcaaattggtcgtgtggacgtttattgggagtgcgagattgagcgaatgcttgctggtgaccgggggatgcggcaaatgttttcgaaatatgttgatgatggtccactcgaaatccgagccgcctttatgggaggacgcacgggaccattgaagctcttccggaaagctcgggatggagaaaagatttcatactacgacttcacttctctctacccgttcatcaagtgaaaatatttattttattattttcataattataaaaacatagctttacgactcgctaccccatcgggcacccaagagtgcatgtgctgaacgaagaggtggaatggacaacatcggccgacaacccctacgatctttcacttctgaaagtttgggtcattcccccgcgaaactgtgatgtgccggttctcccagtgagagtgggtgaacggctttgctttccgctttgcatgaagtgcgccagcgatcacccgacaggcggagttgatgaaaattaccactgcacacataacgattcacaacgtggttgggtcagcacttgcacatctttggaactgaatgctgccctggacgagggttatcgggtcaccaaacttttccgcgtattggaataccaaagcagcgatgatcaattgttcaaatcgtacattgcggaatttatggcgctcaaaatccaagcatccggctttgacaccagtatcaaaggcaatcctgagcttgaggaagcgtttgtgagggagtgttatgagaagtttggcattacaatcgatccaataaagatggagccgaacaaagggaaacgatcgatagcaaagctctgcttgaataacttatgtatgttgtctttaaatatattatttttaaataaatttctagggggtcgattctctcttcgcaactttgggctgtcgcaaacactcatcacagatgaccctgtggttctcgctgaatatttggacaaccggtcgctcgaggtcacagcgattgacgaattggacgctgaacacatactgatcagttatgagaaaaagaaagagtgggtcgaggaacatgcatgttccaatattggtataataatttatgaaaacaaaattcaataattaatttagtaatatctctttggacaacttcggcggctcggctggtattactaaaggcaatgcagaaggtgaaaagggcaccaggctgtgagctactttataccggtaataaaaataaataaatttaaaaaatgaaaattatttttcagacacggatagcctcattttggtccatcctcttgaggtgtgtccattgcaaacggggcctcatctcggacagttcactgatgagtacccgaaccatgagattgaagagttctgttcaggcggagcaaaacaggtacatatttaataacttataatttactaatttaaaattcagtatggtctaaagcttcgccgaaaagctgctccagctgacgctgaaagcgaatatgttctcaaagtgcgaggaatgacgctcaactatgacgtcattcagaaccaagggcttcgatatgagacattcaaggaaaaagttctgcgatatggtgagaccggtgaacctcagccgatcaacattacttacccaaactttctccgtcccagcattaagaatgggagggttacgtcttatccccttcacaaaatttataaaccctttgtcggtaaaggtattgtcggagccgaccttagtgttttagattttggccacacattgtaatcatattgcgcatttcctttgtatttttcatttttttgtaagcatattaatgaatggaaaataaaatttgaaaataattaagtgatggaagttgttagttttaggtgaaaaaatgcataattaatgttataagacacaattttaaaagactactaaaatcgtatttttgctataaacataattagggaatgggagttgtcatttttaggttgaaaagtgcataattattgatttgaagatgaaattacaaaaaaatacacagaaatgtggtaaaatatcgaatttaacacccaaatatgcacatggcgtatgtgagtatgcgtatgtgtgtgtgtgtgtgtgtgtgtggtgtggttgtgtgtgtgtcaccaaaataaatctggcgattgtgtgcactgattgcggccaacatcttttaacgtttcatcattatcatcatcatcattttcaaaccgacccgacgtgtgtgatggggtcgggtccctctctgcgaataagggtcctgaccatcgttgccaaatagggttgtcctcagtaagctcaagcaattccatgggatagagccgatcctcttttccttttgagaatcgttcaattatgcagactatataaggatgatgaagcttgatgcgatgccgagcatagaaatgagctgcgatgttgatgttgaaagggcgagagagacaaccgtaggccattgtaagtgcagcacccttttccgataaacctccaatgaagaaggtcttggtcattccgtttctgtccttgtatgttgtcgtgaccttgcgaccctttagtgaatttaatatgtaagtgcggtcttcaggatggttcagtcggtcgcgaagctgtgaaactcggcaattgagaagctcagcacagaacacactgagaagaaccatttttgacaagaatacaagaatgagcttatctgctgaaggagtaaagcttttatactcatcaccccactcataatcccaagccatactttaattttcaattattttattaagcatcacagttacaaataaatcgggntggtgaattgtagtcaagaattcgtaaataatttggaaatgaatgtccaatagacatgtggtaaataaatacaatgcaatgatgtgcacatgttgatgtcaatggtgattgatacatattgccatttcttgtataccatttttgatttatttaaaaa

SEQ ID NO: 15986 - DNA, 1928 bp, Heterodera glycines
atcatattgcgcatttcctttgtatttttcatttttttgtaagcatattaatgaatggaaaataaaatttgaaaataattaagtgaggggaggtgttagttttaggtgaaaaaatgcataattaagtgttataagacacaattttaaaaactactaaaatcgtatttttgctataaacataattagggaatgggagttgtcaattttaggtagaaaagtgcataattattgatttgaagatgaaattacaaaaatacacagaaatgtggtaaaatatcgaatttaacacccaaatatgcacatggcgtgtgtaagtatgcgtatgtgtgtgtggtgtggttgtgtgtgtcaccaaaataagtctggcgattgtgtgcactgattgcggccaacatcttttaacgtttcatcatcatccacatcattttcaaaccgacccgaagtgcgtggtggggtcgggtccctctctgcgaataagggtcctgaccatcgctgccaaatagggttgtcctcagtaagctcaagcaattccatgggatagagtcgatcctcttttccttttgagaatcgttcaattacgcagactatataaggatgatgaagcttaatgcgatgccgagcatagaaatgagctgcgatgttgatgttgaaagggcgagagagacaaccgtaggccattgtaagtgcagcacccttttccgataaacctccaatgaagaaagtcttggtcattccgtttctgtccttgtatgttgtcgtgaccttgcgaccctttagtgaatttaatatgtaagtgcggtcttcaggatggttcagtcggtcgcgaagctgtgaaactcggcaattgagaagctcagcacagaacacactgagaaaaaccatttttgacaagaatgagcttatctgctgaaggagtaaagcttttatactcatcaccccacgcataatcccaagccatactttaattttcaattattttattaagcatcacagttacaaataaatcgggtggtgaattggagtcaagaattcgtaaataatttggaaatgaatgtccaatagacatgtggtaaataaatacaatgcaatgatgtgcacatgttgatgtcaatggtgattgatacatattggcattcctttgtataccatttttgaatttatttaaaaaattttcgctaatctgagggggtatggttaagacaagactatcgaaataaatcactggtccttccaatcccctagcgtaaatagcacaccaatgagatcctttcttgttgtgagggtctcgatttacaattaacgccgctggatactccaaagtgcctggtgaaggtaattgatcgctggcataacatccccgaaagatttgggccgatcgacgattttgcatcaaaattgacgttaattctattgcatccatttcaatgccttgtctttatccaaagaaatgagcaaaattgttgtaacagtaagctaacaatcagcattaaatagagaacgagaagaccccaacagattgcttgttgataaaaattatccccttccgcacggtctttgcaaagctgaatcagaggaggtagaagagaggagactggcgtgttttcgctcaacaatttttcattctttggaaaagtcgtcaaaattgtggttgattttgtagcagaaggcgttgaagtagtaatggaaaaagatttcctttttagaaattctggaaggcgagtagtgatggtgtatgattttgtagtcctactcattgtcagtcttcttatgtattcagggtattcagggatttgttcctcggaaacaacaggtaaataaatccgaataaagaataaaattatagaaagctgtttgtaattcatatttattcaataagaatttttataaaagtggctccttaaatagtgatatcggtgcttattgatcgg

SEQ ID NO: 15987 - DNA, 1733 bp, Heterodera glycines
gacgaaacgttcttgccaccaatatttccgattttaaatcatttccttacgcgagtaagtgatgccgcgcaaatgtgggctcataacagcggaatcgctatcagacgatggctcatttttgagtttgaaaggcttacagccgccccaaatgccgtaaatgtaaaagacaaaaacggtgaaagtggcaaataaaattttcatattgaaaattaaagaattattttatttttttaattttataagggagaaaaacaaattgtcatgccaatcaaatgacgtaaaaacaaaatacacatttattattattttttttcaaatctctcgtcatttacttccgttaacatcagactatcatcaaatcaatttttatgttaatttctcgaaataacaaatctcataatcaactatatttagcagccagttacatacatatgttgtatatatttctatgattttattttttcatttagtcaattcataaagtttgatggcatttcttcacctcggaactattaaattttaaatgattagaaggcataagcactcaaaataggggacaatcagtggaaaatgaatggtctattaattgcttaattcattccaaaataaaaaatatcccaaagaaatttgcgtgtcttttattattccaaattaaaaattgaggaaaaatgaaaataacaaaaaaatcaaattgggatagttttgttcatcatccgttcggttggtgctgctgttcaggcaccaattcctccaacgaagtgaccaccgtcgaggcgccttcctcgccaaagatcagcccaatgtttttgcccgttctttgcaccttaacttcgacaaaataagaaaagcaaagtctgtgccgtttccactcacttccaacggtctgctgatgccttgctctttggccccgaggccggcgccctggcgatagcccattttggactaaaagaacaatttgagtgggaaaagagaagccaacagacggagacaccgaaacacattattaaacacagcatttcaatttggcctcccatttcaaaaagcaatcgcttgtatggctcagtggttgaaggaaaagtgatcgcggttctatccagcccaacgacgcaaacattttcatcaaaattaaaaaaggatgacgattttgtaattattttgaaggttattgcaacagaataggacagttttgggatcatttgaagtctctagaagagaaaaaaaaactcctaaacaaatgttaagcaagcaattggaagtgatggaagaaagtgatgaggcttttaaattgtttttggaataagtccataaatgtctgcacatttctctatcaactctcttttttaaaatcagtgtaaaaataaagaactaaaaaaactgcttttttaaaagactcgatttgtttttaaattaaaaaacaaagtttgtaaaactattgttttattttcaaatttaggcttttcaacccccaaacagtgggaagcatcgcaaaaatcgtgtgcaggaattcataaacaattccaaggtaaaaaagcaacaacaactcaatttagcaaaaattttgcccggcggcgcttgtcgggtcgacaccgcaagacactaaaactccgattttcttattggctcgcaatcaaaaccgcaatccttttttggacaaaagaaaattgcactcaaatttccattttttgaaaaaagtgcgccgcaaaatgtgaaaagcaacaaaaaaaaaatggtcg

SEQ ID NO: 15988 - DNA, 1412 bp, Heterodera glycines
  misc_feature (55)..(55): n is a, c, g, or t
tgtaaagatgactcgagagtttttttattaataataaaatataaaaagacatttntagaaacataaaaagaccatttttagaaacataaaaagacatttttagaaaccaattttggaaagaattccgataaaggaaaaaccgatcaaaatgaatggaattcaattaagagtaaatttgttttaaatcatattattaaatgcttacctttaaccgttgttgctccctaaaattaaaatttgttgacagaaaatgaaaaaaggtggcccaatttaagaaaaccaaaaaaaaatgttgaaacaattctcttaagtcggggccattcatccatttggtgcaattttaccttttctgtttaaacgacgaataatcagtgggtgcggttgggttgtactcgtcttccaccatcagttcaccaaacaaaaatacctttatagggaaaaagtaatgcccaattaaacacaaaaatatttttggcggcgcaatcgccggacaatccgacggagttggcagagaaatgatcaaagaaaaaaaaatcataaaaatacaatccttacacgtaatactcactcatttaattttctaccatggccaatcccattcaaaaaatgcaaaaaatagtcgttaagacataacaaaaatgccgaaaacccttttccagtctgttactttgtcttctttcagcgatttcggcaccaaagtgaaagcgccggtcgaatcgatgggcaatggaattgctttgtgtggcttcagcttgaacgtgccgcccttcttgttcagcagctgaggcatattcggaagagtggcgggtaacggctgcgcgaaggcaacgccgggggctgatttctgagaaaaatgtaccgaataaatggcaaaattggccaaatgaaaatgcattttttagctttaaaaattgccgaacattttgcgaagcggcagcggccgcattctgtagaatggctttcttggcttcgagttgcgatttgagaaaggacaaattcattttgttgaccgctgacactgctgagacggtgacattttggggtttttgagcagagtttggtgtcggaaagtcatcagctgcactttcaaatgtttaatttaaaaaaatccttgtcaaattgtcatttttttctttttattattcattcatttgctgtcccatttgtcagcttaaccttttttctccaaattctcttctttgacctgcactgatgttgatgattcaattccaatgtcgtcgtacagagacatttaccagcaaatcaaaattatgtagtgaaaatataacttaactacctatttaaagaagtaaagaaccgaaaaatattgagtccgaattttgaaaaatttaagacaaaatcaggcattggataaaacaaaaacatcccaagggattgggtggaagtcggcg

SEQ ID NO: 15989 - DNA, 1691 bp, Heterodera glycines
  misc_feature (49)..(49): n is a, c, g, or t
  misc_feature (72)..(72): n is a, c, g, or t
  misc_feature (116)..(116): n is a, c, g, or t
  misc_feature (1686)..(1687): n is a, c, g, or t
taatttaaattacaaaagaaaccaaaacaaatattatgttaacaatgtntaataaatttaaattaagtgatntaattgataatttaccgtttatatatggttaagaactttttttntaatcgcattttgcagcattttccttgtcataatcgcaatggcacatttgcggacaatttcgggaaaaataaaaaagtttcttaaaaaaattatgattttttttccgaataaatgaattgagactgtaaaaaagcagcttaatattttactgaattaactccccgaaaagattttggagaattgcgaatgtcgaaactattgccgtcataatatgctgattacggctgtagtatctttgaattttgcacttaattgttaaagaatattgtgaaaattcgaaaattaaaaaattctaaatgttttatagatacctatatttaatttgtttctttacaatgttaaatcaatctttttcaggctcattaataaacattttttattgccaattttatattatggatttccttttttaaaacatatttttttatttattaaatatttattcactgatttaatttccttgtcatcttttgtgtttacgtgtctttagaaagaaggttagcattttgcctgatttgctcagctttgccaaacggtccttggcaaaaattggagcgaaaggatcgtctttttattttgctcataatatctttggttgttcaaagacgcaaaaaacaaatttttaataaattattatattattcttttcaaaactatttgtttatttaaaaaaaaatttagaataaacgacaatgttcgaaattttaaaagttgcaattttatcaatattttttacaagtatttttgctgaatatttatatgattctgtccgtatcagtgaagcacaactttctgttaaaatgaaggacaaaaaggacaaaagtcgaccattgggaaccgtagagtaagctcaaatcattggcataacagccaatatttaataatactttttatcggaattaaattaaaaaaataaaaataaattaatctcgaaaaaacatttttatatatgtataatatacgtagtacatatttattatttattcattaatttaactattttcaattttttaatattttttagtgtgccgctcaatgaaaaactctcaaaattggtgcgtctcagcaaaaacttcatcgctcaaatttcgtttagagttagcatataaaacactcaattttcaatgccatttgctaattctcagattgtcgacggtgccaacggtcgcccaattgaaaatttgcaacaaaaattccttcgcttttcccattcaaaatcaccagaacatgaagtgttttttgttgctaaagaacacaaagaatcgaatggtcattaccaacttgaaatggtacaaaattttctttaaatttctttttttttcaaaataatttaagaataattaaattatttttgtaaggtaatgtctcgcgacttcgttctgttcaagtccaggcctggcaaatacaattgtgaacttatccttggcgatagccgaattcgcgctggcctaaaatggcaaatatttgatgcttttttggacattccaaaagtaaaataatttaatttttgctaaatttgattcaatttctatacaaatgattttgtgttttttccagtctcagactctnnagag

SEQ ID NO: 15990 - DNA, 3409 bp, Heterodera glycines
  misc_feature (13)..(14): n is a, c, g, or t
  misc_feature (25)..(25): n is a, c, g, or t
  misc_feature (27)..(28): n is a, c, g, or t
  misc_feature (40)..(41): n is a, c, g, or t
tgcaggtcaatannttgtgaaattngnnattttttgaacnntcgcatctccaaacttcctttcatcctatcagaactcattttgcgaaggtgtaaaggtggcctttgtaagacaattttactttttgttttttggttgcaattggttagccatttctgaaaaatgtccaaatcagaatgtacatcaaattggttaactattaaaaaataataggatttggaataagtaaattgtaaaaaatgagcgaatgttaattaaaccgaacttatgccaagtggcgagggatccctcaggcttagtttttagaatcttaatttttaaaaaagcacatttttctatttttgggttggggcccaaaaacgggggcccaaacgctctggtcccctaactatatgcacttatttgttcatattttggctacatattttcgcccatttgtccatttttgctgtgctcttttgtctctcaacaacacccacacacattgtcacattgtctctttgtttggaaattgttcgggtttccgccttggcctttgtaggtgaaaaactgaaaattgaaaaaggaagcatgtatgacatttatatgatttgataaaccaaaattttttgcaattttccaactttttaatgtacatttaaattaacgaaaaaaaaatatttttaaaaatttattaaaaaacaaatgattttgagttgattttttagagaatcctccgttgtcatgacccataaatcaaaaagagttaatcaatcatttgattgcttttatgtacctcacaatgctggccgtcaaaccaccatcgcccaagcgataaattaccatttccctcatctttgggatgattacacgcctaattaaaaaataataaacaattaatagttaattagccgaattgtttagaaggaaacttaataagccaagcttaaaatgcgtggaaaatggacgaaaaacggggacatgcatttttgtgagttttatcaactcccttcctcccttcctccccccccccccccattttacatccggcggcttccattcaaaacagacggcaagtgatgcctaaacaaaaaacgaaaagccgacaaatgttttttttcaaattaatataccaaacaaaaaatcacagcaaaaagcgacgtcgtcgaaagcttcgcatttgcggagagttgcataattttgcggggttttaccaatttccgtcaagtaaaatgtttggggacaattttggactaatttctttgattttgattggttgacgctgcaatttgtgccctttttaagcgctgttttggcctccccccaaaagactttgttcaccaaaatgcattagtaagcagcagaaaggtgcaaaatggccattagtaatcatttaaatggattaataaaacacgaaatgtcaccataaaagtgtcaattgtgtgatgactgatcggataaaacgaaataaaaaacggcaaaagttcgcaaagattgcagcccaaaaactattacaaacacaaagttttttgaaattggggtgattgaaaggcagcaaataaatgcttaacgcttgaattttaaaagtgtaataaattaattattaattaaatttgcatcacttttcgcatattttatttgctttttcgttttttttatcaaaaacttaatttgtttacgaatttgaagtccaatttcgtgattatcttttcttcagttaagtattttcctgcggtgctttcggcacaattaaattttaataacaaaaattctttcgattcccacttctttttctgattgcgcatttgcctcattgatcaattgatcagaggagtataatcaatttgttaactgatcattcttcgtatcaatgatccatttattgattgtttcattcattgctttttgcactgaactgtgatactcaatctacgaattggtattagttattgattgatcaaaacaacctaatccattaattatgattcaagccactaattgcttgggatataactcggtaaatttaattacacatgctaataagaacagtatgttggcagaaatgtttgagcatggcggagggtcaaggaattgaatccacgatttcctccgtgctctgatcagttccaacggggcgccatgtgccccggtagcacagtggttccgcttccgctctgctggaggcgtgggttcaatgcccacccgccgcggtggtccaacatttctcatccaccccgtttttttcttatttctgtgtatttccatcccaattttcagcttggcattcgcactttgccctcctttgtgccgcatccgctctcctcaaatggcgacagaatggtaaaaggacggcgtggcattccattcatccgactggcccccaaaaatagaaatgtttccgggttttccgaaactcgacttttttcccgaaccgggacaatccctacccaaaatttaaaaattgattaattccaaaagagccaattttcaaaaacaatcgatcgtaggagtagttacggtagagacgggcgccaattttgggatgccaaaacttcaaataatctgaaaacactcttatctggatcgatcaatgctcttatttttcaacctttaaaagagtttcactggtcgacttaaaaacgtcctttggcatttgtccggcattgaatttgtcaatttgcccgaaggtcggctttgaaaattgtgggcaaaaaacattttgggaaattgtccttttttcagcccttctgcacgacgagaacaaaatgtatgaacaaagtcagtggtgatttgctttttgtgtaaaaaatgcttatcttatcggattttctgatcagatttgagctatttctgttgttctgtcccatcctttcccccgattctctgactgatcagggctggtcgaattcaaccaacaagcagatccagaaactcgagacgacggaaccaaaaaattcggaattcaaattttgcttagccccttctatgagcgaaaagcagtgattaaagggacaaagaaatggaagcactggaatggtgttgggtcgttactcaaaacccacaggttttcttatgttttttcataactttttgggaacttaacgaaattttttagcaaggttataagcataaatttttattttgatggtttttgagtaacgctataactccatttgaatttgtcttgcctaaatgctgctctaatcatttgaaatgcttaatgagcgcgcttttttgacaaattctattccgatcatttttgatctgttctccgtttttctctgacccatttgagtgatcattccgaccattgccctccctctcttctttcattccgtcctctttcgtttgggttactcgccgatcacttcgttcctaattcccggcatattttgtatgctaagactcggcttattacctcaattttcat

SEQ ID NO: 15991 - DNA, 2396 bp, Heterodera glycines
attgaataaaaaataaaagaaaaaagaaaaattcattcaaattttttgtaaaatttttgttcattatttgtaagaaatttgccggcatcggaggacagtggcaacccgctcaaatcttctgaggataaccaaaaacagcagcagatggatgaaggagaagagaaggaagcggaggagagcaaagagtaaaaataaaataaaattaatatttagttaataaataacattcaaattttttgtcaaatcttttttaattatttgtagcaaaatgccggcatcagttgacagtggcaatccgcccaaacccaaattgaaagactatcagaaacagcagctgaaggatgaaggagagaaggaagcggaggagaaaaaagagtaaaaaaaaaaattaaatatttaataaaaaaacaaataaaataaaaattcaagcgaagacgaagaatggaggagggtaataagcacaatgaaatataaaattaaatacttaaactgaataatatttttatttttgtaattaaaaattctcagaactttaatcaacatagaaagggtaattttcgatttcaaatcattaaaaataaatatatttaaatgcaattttatatgtataatttttgccaaccaattttcagttctaaagaagactatgaacagaaagagcagcagctgaagaagacagaagagaagcaagtggaagaggaaagcgacgggtaaaaataaataataaaaaatgaaaaagtaaattatttatttattataatattaccatttttgctaaatgcatttggcatataatttataggaaaatgacggtgccaaccgacgaacacaccactcgtcggcggcgtgaggagagcgaagggtaagaaatggaattaataattaattagttacaactttccacccaattaagcgatgaacaaattctcatattgcatgctcaaatggtggcacaatcagctgctgcagcagcacaagtagaagcaggacagttgaaagggtgctttcgccttccttcttgtgctaagaagacgaaaaaggaacaacaaaaaaagtccccaccatattgtgccgccgggaagaaataaaaatgccaccgctcaatttttgtcttttcttatcttaattgcttttgtttggatttgtttaatcttaacttattttatctttttaatttggtttgtttgtttatttttacaattcattttttcatctttgatcactgctcattttgttttattgaattcgatttgcttttttactacatcaataaataaatcgagaaaaaaaactttttttttaatttaaaaactgtgaggatggtgagtctgaaaaaattactgaagcgatttggggaaaggaaaatttaaaaaataaattaattaatatattcccttaaagcatttatgtcaaggttgaaatggcgatgtggcgaaattaaattattgataatttcctagcttaaattctgaaatatttctttaattttaaatgttttcaaaaacagcacaaaaaatccgtataattaaccttgttatgttaaatttttccaaaatcctaaaaataatattttcttcgaaatatctttcaaaatcatgtaaaatttttgtggtttccccgaccagtcggtcccaaattctcggtcccgaactactctacaaaaaaaatacataaaaaaatttgatagcaaatttactgatgaaatttcaaaatattactttaactaaatctttcagtattttgtcccttatactaaaatttttaagattttttaaagaaattttctttaatgccttaaataaaccgaaagttcgcaatttttcctacgatttttgttattacataatttgagttttgagaataggaatttcaaaaaaatcttatcttttatataagtcactttgtgccctaattcatgctttcctaacaagcatgccagatgtgctgatttgtcaacattttgcttgtttcaagacaaatagtacaaatttttttttttttgattttttggcgtgggaaaattgatgttatcaattttatttaaacatagtctcgttcattaagttccggcatcccccttcctcccaaatagtgtaatgcaattatggcataatgcatcattaaactgtgatcaaacaataaatttaaacttttaattgctgacgttgtccaagtggttgtaccggtatttgcgccgagacacttgcgcaccaggggtgtgacttgtctcagaaaagacgagagcgagagtttggcgagaggcgagagtccccaaaaagacgagagcgagagtttggcgagaggcgagagtttttcaatttttttctgtagccttattttttaatttaaaaaacttcaaaatcgtatattaaattaggggtacgggcctgggtatt

SEQ ID NO: 15992 - DNA, 1699 bp, Heterodera glycines
cggctcagttaccataatttcaggcactgatcgcccatttttctgccgatcgcctctcaattggtgcccggtcctcaccaatcgccggtggccccgaccgatagtttcccgaatggaatttctaatcattcgtcgtaaatcgctgctgcttctctggtgaactttctgttgttgttgctgctgctgctgctcgtaatgccttaataagatttattgcattattattaacccatttttattgcgatttttcgcaattaattggggcaacggatttgatggaccaccccagccaaacccaatagcttcagaacggataatatcatctgatccaaggtgatccaatttgaaaacactcagcaaagaatagtgcagaaaaggaacgtcgggtttaagaaaaacccggaaatatttcaaaattattcgcagccttcgcgaattaatatagacaaaaaggaaaagcacaaaagcaaaaggatgcttcttctgctggacaatatcggagaattccttgatgatggctgtttatacatttcattggtcaatgatcattttgtgagcataccaattggtaaatgccaacatttactcacctcagctgttcagcttcgccgctgcttacggttgtggacggtttccgcacaattgcgccgtttcctcggccaatcggcggggcgccgccgtccatcgccgatttgcggcgttgtgcgtttgccctggcgatgaagcgcttgtgccgtcgccgatgcatgcggaacagacgacggacgcacacgcgttggccaaactcggagcgcaagcagcagtggacggacagcgcacagagcaccaccagcacacaggcgccggtgaacaccagggccggatcgagctgacaatgcgcaggggcgtgagatactcagcaatgacaacattttacggtgattgattgattcaatttaggaaactatttaaaatagggtattgaattaaatcaaaattaaaattcaagagtctcgaaatgcgcgttggttgatcacctggcaacagtcgacgccgcaacaccaggaccaattgtgggagcagtgaaagaacacgtcgacaaacggacgccgtcccatgccgccgcccgacctttggtcgtcttcaaaggaaatgtagaacacatcggcagtcggcactttcactcggcacacttggccaacaccgatctgtacggacgcagaaacgaaccgttgagcagcagcgagtccgtcagcacttaaataattgtaattataattatcattattattatttaaactttgtgatatttaaaattaatcattgaataaaccataatttaaaacattgagtattaagacttatgtctctttaaagttgagaagataaaaaaaatagtacaataataatggattcaagctttctatattttttacaattttattttgcttaatacatacacttaattcatagcccgtagttttaagtatacgaattttgccaaaaaatccgtgtatatatcagaaaaatgatacaaataaatcttattaagcgctaatgagtaaataagtcattagataataaagcaagaaacgctttttatcaccttcccattggcccattgcttttgtcgtccattccgtcgccaccgtcgccgactcctccgaagtaatacagctgcgctggtctactgatcagatgcaccacactgagctcttcg

SEQ ID NO: 15993 - DNA, 1663 bp, Heterodera glycines
  misc_feature (1659)..(1659): n is a, c, g, or t
ggggacctctagagtcttggcgaatttggaaatgattggtcttgggtagatctcctaggtgttcattttatcgcttttcttcagcttttcccccgcttcacctccccttttgtctgccttttttctgctgctgtcgttttcttatctgaccaagcggcaatttataagacttttctggcagtgcggagaatggcactgttagcttcatcagcttcaatccgattgcatcggaatggcgccttatgcttaacaatattcgttaaaatccaaagtgattaataagtcaaataaaatttattttagtttattaaatgatttcattgataatttttaagatattcaaatatttaatttctatacaaaattattagatatcatcgcgatgcgttcgcttgtctttcccagtcgaaaatttgtccctttttatttgaaaaaacaatctaacaaatgacaagtaacagacaaactttgcttgaaactcactttttattttccgccgtttgcaatggtaagacacggtaattaaaaagtgaaaataaaaatgtaaaaacaacaaaatggggaagcattttcatagtgatgatgagacgacaaaagacaagaacaatttgaatgtttcagtgaattttttggggattcaaatttgagcattgaataaaagggaaaagagtaaatgcaatttattagagaagcaatgaaaggggcaaaagccgacgaaaaataaaatttaatgaagaaaagtgccgaaaattgaggggcagacaaaagagagagaaaaagagagaggggattttggggacacgaatataaaaatcttttaaacaataaaatttttggacacgaattaagactaaagcaataaataataactatctgtatatatgaaaacaaagatgttccttatatcaatcaacctttggtcatttttgatttttcattaaggatggaaaattcgtattttcttatcaattatctcacgacaaattggacagtttggctctggttcatttttctcaattttatctgcgcattcttcgcaacaacacaaatggccgcaggggtcgaaggcgaattggcgctaattaaacgaaatattttattattatgagacaaatttacattttaaataattgttgcaaaattcacgtaaattatttaaaataaattacttctccctccaaacaaataatgcattttttgccgtctttttcattctcattgctattgctactgttaatgttgtctaattgcgtctgctgatggctgcgttttcgtgaggagggcgacgcaatttcacagcacccgcgacgccacgccccagccttatactgtgtgaaggcaacacaaattaattttttatttaatttaaatgcttaaattaattattcaatttcactcgtaattttccatttacgcaaacgcccgtgttccactgttggataatggcaaatgtggcggagtgttgtgggcaggggccccaggcgttttttatattgtcgcaaacggagtccaatagttgcttaatcccgtcaattcgggcaaacttttcgcttgtgagtgaaaatgaatttctggcattcgcaaaaaataggcctaaataagcataattactatgactgtcccattgctagactaattagcacaaaaccgatttcttgnaaaa

SEQ ID NO: 15994 - DNA, 1516 bp, Heterodera glycines
tttccatttaattttggctactgtattttttgattatgcctacagtatcggtgatgccgttcttcaaatgccattgcttaaaacgcaaaaacatcaaaatttgttgaaatcaaataacggacgaaataaattcttgcaacattatgaagtgaattaaaatttttgaaatttcatttttcgtcggctattagtaaaaacatggggccttcaaataaaatttcaaaaaaaaaaccgaaattcaaaggcgagagaataaacaacataattagcaatatttcgggaagttttggaaaaacctcttactaaattttcgaaatattttggtatttaaatgtattccaagagccataaaacacataaatatagaaagaattttggcaaaaaaggacagttatgaaatgaagtttgaaattgagtccctaaaaaataattttcaaaaaaaaatatttaaaatatagtttagaaaaaatttttcatattttataggatgaatacagttcgcccgtgttcaatttttacgacattacatacgtcacgaaattatacattggtaaaaatatacataatgataaactttctggggtttttaagagtacacaacggtttcataagtgaaataattaagaaaatactgctcgttttccctaatatttgataaagaaaatatttagcttttgatatttttcaataaatattaataagttgatttatttaaataacccaattctcattttctttattaaatgtttgattttttactagttttctcaaaaattaataaattttagcttgattttgtttgcattttttcttctaaattattttttaatatgatattttggatttataaatttttaaattaaatttaagaaaaattactctcaatttttgaaactgtatgcatttttttcatattttatatacataaatgcattttatgtacatatattatagcgtaagtgatttttttatccggccatccaaatacataattattacccaattaaatttttaaatcaaaaaaaaaattgcgcgctcgcacaccgttcaccgagactccgaccgaatgcaaacacctgccctgttgtgggatgtgccattgccaggcatttttgcaatttggccgtagccattcatcgtactttctcaactggactgaacacaacagtgtggaaattcctgccccctctttctctctgctcctcagtttcttttttctctctttttctctctgtggcagcagcagagggcaccggccggccacatcaactatttctccacctcattttctctgtccacccaaacgactttggatttaacgacgtatacgcaccgcacttttactctcttccgtactgatcaacctccacatttactccactgtttctcaacttcacatttctctgtcacgacagacagcaaaacgcggcacactgtgggaatggtggggaatgccagacactgtccacgcccgggcgggtggggaaacggcgtcagtgaacacgagcgcgaccgc

SEQ ID NO: 15995 - DNA, 2536 bp, Heterodera glycines
atgccagacactgtcccgccgggcgggtgggaaacggcgtcagtgaacaacgagcgcgaccgcatagcgcacgcgttgccgttttcttatatataatgaaaggcaattttcgaagtattaattgatgggatgcaagagaggaaaggagcgggtgaggaaagagtgcactatatttgttttgtatggtttctctgccatctttcgtgaactctttcgtttgttctctggcatctttgcctggctatttgttcgctttctttttttgctgtgcttgtggctctgtgctatttctatgctattcttgttttcttttccactttaatttgcctattttcgtatatacgcgcgtagcagggcactttatcaaaattttaagcatttaaaatactgaagagaaatgcacaaaaaaaaatttttatttttttgccgatttcttttaacgccaatatgcataaaattaaaaaatattttgggtattcgtcataaataaaatatttttatctttttaccaatattttaataaatattttttcgttttggaattcatcgcaaaaaattagtgcttttttagacaaaatctgttaacaaatgatcattttatagacttttttttgagtgcgtttgaaataattaaaaaaaggaagcttttaatccaaaaagtttcttttgacagtcctgttaaatatattctaaaaatgtctaaaattcagtcaaaacatcaatttggataaaaggccaaagaaattgaaaaaaaaatcaattaattaattttttctaaataaattacctgaattcattttttgaacaaattatttcactatgtcattttaggtaaattaaaaaatttttttagctttttaaaaaagatttattatttaaattttttccttagttttttcgaaaaattctaacccacaatcgcaaaatgcccacaaccaataataaaaataatgtaaaattgtcgcctattaaagtgaaattttgccaatttttcaaggcacacctccccaagaattcacggtgcaattggacaccgggtccggcgatttttgggtagtggattcggcgtgtggccagaacggttgctacaatggttgcacatcgcacgacgcgcaatggtgcaacgcgcaatgcgacccggaatgttgtggacaaaatggtggctgttgcacgacaacaactgcaacacaaccagtgccaaccatgacgccggcggcacaatttcccggatttcggcatgccgagacggaagtgccaccgtcgtgccaaaatttgtccaaatttgatagccaaaaatccgcttcataccaagagacgaacatgacattttcgattgagtacggacttgggtttgcggccggcttaattggccaagaccttgtgcaggtgagagatggaaaaatgagacatttggatttgtacaattagaaaaatttacaaattttgttacaaaattgtgattttttaatttttaataagaaattttttgaaaatcgggaacttttttcataagaaattttttggaaattgtaaactgaattactaagtttatcaaaaaaaatcgctgaaaatttttttttataattcttttttgcaatttttaaatttccgaagatttttttgaaaaatttctgtttgaaagtttttgaaaagtatttcagtttgcctccgattccaacgaaacagatgggctgagagtgtgtcaagcctactttggccaagccaatcagaaggatacccaaacaccgacattcaacggcattttaggccttgccctgaacacaatcaagcaaaatgtggaccctcttttcatccaggcctacaaacagggcctgttcaaaaagccgttgttctcactgtatttggccacccaaggcgccgcgaatggcacattagggggaggtgaggcatggcatggcactttttgaatgggacccgcaaaaaaatgtaatcagaaattggttccatctatgttggaattagacgctctcgatcccggaattctttttttgttggtcaatccttggtctcggactactgaaaatggctaattgtggttttgcggaatttatgggtggttcttagaggcctatgggaatggttgaggaaatacttattggattttaatgaattttattaagaaagcgtttaaattttaaaattatgttggccttggtaaaaataaaaaaattactgaaacacagtccgagtgttttggtatgatgtcattttaattctttaaaaaatggtgttttaagattactgtacccaaaaaccattgccactatttttttaacgattaaggggcttattaaaaattaatgaagcctaattttggacgctttttactttattgatttagtcctgatatgataaaattatttgaaacttcgttttttttattagttttgactttgggtgatgtggatgatcaaaattgtgcaccaatcaccgattggattccaattacacccaacagattcggcttatgggagttccacatcgatgtgagaagctaaaaaataatttaattaat

SEQ ID NO: 15996 - DNA, 1427 bp, Heterodera glycines
  misc_feature (13)..(13): n is a, c, g, or t
aagtgaacctttntgaatacgaaaatattttcaacagtgtttgatttgagtgttccgcatttctggcagtcctcttttcccatccatcggacactgtccgacggcggctgatgatgcaaccgggcaaaaacgtgcccgactacgcaaatgcatggcactgcattcgggtgaaagggggaggttgggcggcacagacaaaaatttattttttaggggtgggatatgccttaatgttttctcttttcaaagtcaattcaaaaagaaataaaattgggtggaaatttacaaatgggatcctccaagcacaaaatgtgcttttctcgtaagtgtgtgaaaattgtagttttattaagcttcattttttgatttttacccaaaattaaacacttatgaatttcgattctcatttgacgattttaactcgaaaaccggggttcccgtgcgggggaaacatagatggaaaaataaattaaaatgggtacatacttattttgaggaccttatttttctcttgcagcataacgcaattctgcgccgttttcatcttccacctttggtgcttgagccggatgctagaagcaattatgatgcttatctgcaagaagcaaacaacggggacgtgtcaactttcgtaaactttctcgtatttcaacagcagtcgtcaagcggtactttcttaaaatgttttaaattatgaaccttaatttttaaaattagaccttacttattttaaaaactgaattcgacttccgggaatttttcctgaattgctatttaaaacgaaaaaaatgtggcgataaagctggataattgaaatataaaggtggacaaaaatggttgcaaaattgaaaattattgatgaaattgttttttttctgttctgcgtttgaatttttcggttctgaaatcattattttggcgttttgtcactatttttttcattaattcaacatttttttgaaaattcctttacaaaaatataaaaaaaaaccaaaaaatacacccctacaaatcggtttaaattttcaaaaaatacacactaaaaaccaaaaaatacacccctacaaatcggtttaaattttcaaaaaatacacactaaaaaccaaaaaatacacccctacaaatcggtttaaaatttcaaaaaatacacactaaaacccaaaaaatacacccctacaaatcggtttaaaatttcaaaaaatacacactaaaaaccaaaaaatacacccctacaaatcggtttaagttttcaaaaaatacactaaaaaccaaaaaatacacccctacaaatcggtttaaattttcaaaaaatacacactaaaaaccaaaaaatacacccctacaaatcggtttaaattttcaaaaaatacacactaaaaaccaaaaaatacacccctacaaatcggtttaaaatttcaaaaaataca

SEQ ID NO: 15997 - DNA, 1699 bp, Heterodera glycines
aaagatgaagatgagggaatactcacggaaataggtggagtccccaggacctggattaaactaggcttatatatgacgtatgtcgttcagaagagaatgggaaataagcgaaagtgaaaaaattaaataaaattcattttttgtcaagtaaacatgtttaattaactaatcctcatataaaataatcaatccttcaagacttggactacaataattttaaaagcaattatttatattaaggaattcccaaaaaatcattgggatgtcaccgcttgtcatgaaaacctagacatcagtggcgccaaaagtatacccgtctacaggatgatacactctaagatccaatcaatactcccattcaaatcggtttaaaatttcaaaaaatactcagtaaaaaccataaaaatacacccctacaaatcggtttaaattttcaaaaaatacacactaaaaaccaaaaaatacacctctacaaatcggtttaaaatttcaaaaaatacacactaaaaaccaaaaaatacacccctacaaataggtttaaaatttcaaaaatacacactaaaaaccaaaaaatacacccctacaaatcggtttaaattttcaaaaaatacacactaaaaaccaaaaaatacacccctacaaatcggtttaaattttcaaaaaatacacactaaaaaccaaaaaatacacccctacaaatcggtttaaattttcaaaaaatacacactaagatacggaaaaaatccgccaaatttttggtttaaaaatgtcaatatttgctaagaaaatattagaaaggcaatgcaccttatttgcaactgtaatgaatgaatacgaattattttttctcaatttttgcatgaaaattatgtcattcactaattggcatttttactcactattttagttaaacatttcgagatttttggtcactaaaagtcgcatccctacatatagtgtctgtcattcagtggggtaattaatgttttcccttaaattggtcatattttcagataattgttaaaagttgcaacagggaacttcgaaatccaataaccaattaagaaataatttgatttggttattttcggcactcgaaatattttaaagaaaattttaaaatactttaaaagacaagaaaatccattgggtgtatttttctatttctttggttcttaaaatgcttccaaaaatgccataatatgtgtatatgtttcaatgtgccaaaaagcctaagtcgttctaaatcaaactcggggtgatgggttgcgctcggatgcggaatatcaagccgggtttacctaaaaatgacctaattcgggccgggcgcaacctggtttaggaaatgtacatttggggcagttttcaagaaacgcagcgctacttttatctttatttaattgtttcagagcgcatgcagtaggcagatgatgatttgccgttctccatctcaccatcgctaatgacggccggtggcatttccataacgaataagaaaagagagacacgggacaaaaaacagaaaatcatataccatttattatgatcattttattctttccactttccaccattttgcactcttctcattgtccgacttcttcagcagaaatgcccgcttttcacaccacttttaaaactattgagccttcaaattaggggaaaatttccgtgtggcacaaatcagaaaacgctttct

SEQ ID NO: 15998 - DNA, 1085 bp, Heterodera glycines
aatcatcgaaactgttttttccttgaattttttgatcagtccaatgtaaagcaccacaaaacatacatgcaatattcataggaccaaaagaaactttgcttatctctttagtattttgagccttatatttatgcaaatattaacagttttctttaatttctctcttatgcaatttgtcttgtttttttctttcatcttttctgctttttcgtttcattttctctaacgtttgcatatgcaatctgttttgtttgattcttttaatcttttcaaattccgtttcattttctctgcttcttttatgtctttccctatctttttgtaagtaatcaattctttgttcaaaaggtatggcttgggatatattcagctgagcttgtttacttgaaaaaaaagactaaaaaaatatggatgtaattattagggatgggattcttagttttttaactattttttctgcggctttaactcgacgagaaatgcacgaaaaacacattctttttcgaaaatttttcatttttagtgccactattcatcactaggaatcactattttggagcttcgccactaaaaaaaactgtttcggaagttggccactaaaataatttttgccactattttggcgtttcgtcattatttttgccactattttggcatttttgaaaaacttcccaaaattgcaataaaaacgaaaaatacacccctaagaatcgacctaaaaatttttaaaaatgcacccctaagaattggaaaaatttcacaaaaattcttcccccaaattttttttttcttgttcaatatttgctaagaaaatattttgtaactgcaatcagtgaacaaaactttttccttaattttaaattattttcaaattaaaaatagctatttaaaaaattacacccctaaatttggaactttttcgccactattttgcaactattttggcattttttggtcactattagttaattattttgggattttttatcactaaaaatcccatccctagtaatttatcgctaatcgttggtaaaataacaaatttagacataaatataaggatagttgtcgtgtatatgtaaaaa

SEQ ID NO: 15999 - DNA, 958 bp, Heterodera glycines
ttcgtgttgatcggttccctgagaaatgcgtttgggtctcactgatgtcggacaaaatccgcacaaatgacgcgttggacttggccagacagattgcccggacctgacaaataatctctttgacgatgttagcgaagccaatcaaattctcaatttaatcccaaaggacgaattgcagaagctcaacccagaacaaaagtggatgaagctatttgaagccgatttaccgcacttgtacaagttggtcagcattgtactttccgtgcagtctcaaatgcattagtcgagagtgttttcgctttgcggctcacaatggactgatgtcgaaattcgttgaaagtcgaaaccgtgaaggctctgctccagacgaaaataaattttgatctcacttgcccagaaatgtatcagatgctcatttccaatcacaaactgttggatcagatcggtggatgggacaaatactttgaatgactcttttttgaaaaaacaatattattttcaataataaaaccgttgtaattgtgcaaatttgttgtattttgcttttataaaagccaataatgctttttaactgtttttacaaggtaacaatccattttttcaaaaaatcttttttttggggtccaaatctttgttttagcctcgtttgtcctttttttgaaaaaaaaacttggcagccctgaggtaaataaaagcaactacatatttcatcataaactctctttgctttctttccctctcactctctgtcgttttttctctttttatcattctctatttctattctcacttttcttttttttacatttttccaaaaacaaaattggcataacgtctataagcgcaaattcaaatggcgtaaacatcgcggacacacagaaattgtcaaatttatatatggactagcgcaggcgcgctcgcttcgctcgcgcacctcgcgctagctaagatttgaaaa

SEQ ID NO: 16000 - DNA, 1869 bp, Heterodera glycines
aagtaaaaaacactccacttttttctgttgaaattttagtaggctcaaatggaagagaatggctttcaaggttttattgattggatgttttcgagaatttggaattgtctgttgttggagtagcaaagagtgtgggcagaaaatgctcgtctgtgggggtatcatcgaatcctttcatcgtgattcggattcaaagcgttcacgaggccaattcaaaccgatcaatgatccctttaggaattgaatggcaaagcagctgtctgcttttgctccaattttaacattttgttggacaaaatgtgttgtggtgcacttttaggtccccgggcattccctttttatttcccccggcgggggtttgtctccgctttcctcggcgccccattgcttttgctcttttcaaatttttgggagagagggagggggggggggggaatttggcctgaaaagacatcaaccttgtggtttattggcgcataaacaaaacgaaaaacatatacgtaaaagaatttaatgtcattttcaatttcgcaaattgaagaaattacgtcaaatgcacatatcgaagtgcctgctaattcgtgtgctttcaaccaattaaagaaaccactgttttcccatttctccctaatttttgcacttttgcttcatgtggttttaaaaattttattgcatttttgtgtgcctctgaaatgcgacatggtgaaatgaatgacaagtccggggaaaaattagtccggctgactttgcaatatagtcaatgtgtggataatataaaaacaaaaaagaatgaacagcgacattgagtgggaacacaaaatgaatcccggattatttatgtcacgaattgcaaaccggtttctttttaaatttagaaaaaatagagaaattaaagaaaagaaaaaaagaatttaatggggactcctccaccgctcccttctaaaaatatatacacaaaacggaaattattttctcggaaaatttaacaccgctcacatttcaattttggtcctaaaattgcggttattcatagctcacataacaatggcttaatgtgtgttttgtattatattcctttccaaatgatacattttaacacacataatttaatgtgtttacggaattaaattcgtgagttttttccgagttttgatgtttattgctcactgaaatgagaatattgcttttggtgtgtgttcttggcatgtgaaatgaaaatattttgacaattttccgcaaaattggtaaagaagctatcgcaagaaaacgcttcaaaagcgcttttgaagatggattgacttaacatttggaaaatgaatgatcggctgggcaacaaatctgctgtttctaatcttggcctccgatcctctcccccccccgcccaaactttatttttttacattatttttctggtgattttttgtattgacatagagcataattttgactataattttttgagttttaccaacttataaaaaggaccatgtattataatttcattactacaaatctacatttttaatttgataatgttattaaatgagtaattaattaatatgaattatattcacaatttttcagaaaactataagatttttacaaaaaaactatttacgactactttgacgttttgcccgcaatttgttaccaaaaatgaggaagaatcaacaaatacactccctaataatcaacttaatatttttcacaatatacactcctaatagtccaccccaaaattttccaaaatgcacacataacaaatgaagaaattctcaaaaattcatcttcaatttacgtatgacatatataaattctgatgactgctcacgtctgttgagcctattgataactaaatacatatttttt

SEQ ID NO: 16001 - DNA, 923 bp, Heterodera glycines
ctgctcccccgtaaaacagttggtacgcttttgccgttgggggggggggggataagaggcaaaatgaaaagagattgatcagcagaaaaattaaaaacaattttcaaaatttaaataaaaaaaataggggacatgagacgcaaactgtgcaaaatataaaagtttcttttcaaacatagccataaatacgtgtgctgctttcaaattcgatttttgttccattttgtgcaggtctccttcccgctgggccaggccggctacagcgtgtacaaatacattccgtacggaccggtggaggacgtgttgccgtatttgtcacgtcgcgcattggaaaatggcgccatgatgaacaacgtgacccgcgagcgcggccttctgtggactgagctgaagcgccgcattggcagcgcaaaattgctctgatattatatataattatttatgatgtgccgatgtttgaatgcatgtctcttaagtgatgatgctttatgtataggtagtttgtttgattgttttcagcgaccattttcttttcgcgctgttaattattgttaaatgtgcttttgcataatgttattatattgtattgcgctattttctgtcataattatgcgtggaattaattctcttttgctcatcatcgtttttttcctttgttgaaatgtgtcatacatttttcggaaatatcgcaaacggatgttcaatttttgattttcccgtgacccgctctcttccagaccgatgttgttgttgtgcttatatactttatagagcccggagggcttgacaattgaatttttgtcatttttatcttacagttattgaatttgttggtataaaatcccccgataaaagttttaaaaaaatgcaaaaatattttttaaaataacgaattaaattactttgcatctttaaacggattt

SEQ ID NO: 16002 - DNA, 4315 bp, Heterodera glycines
  misc_feature (777)..(777): n is a, c, g, or t
  misc_feature (792)..(792): n is a, c, g, or t
  misc_feature (852)..(852): n is a, c, g, or t
  misc_feature (879)..(879): n is a, c, g, or t
tggaattgtgtatagatattataatttctatgaagccgactttctaaatattactgttattgcgcagcttttccgctacctcctccggcacaggctccccccggagtgaagcaaacacccaagagatgacattgtcgactgtaaagtcaacagtgatctcttgggcgtccatccactccgagaggacccagctctcctgattagtatatcctgggaaaaaggtaattatgaaaaaattttgaaatttatttatttattacctaaccaatcaacatagaacattctcctttgttctccccggcaccgatatgttgaagttgccaaaattttagcaacttcatatttaccctttttcgggttttttgaaaccctttttccgaacgaccccactggcgcatccacaaacatgcgcccctattatttttaaataatagtaatattaatttaaatgaaaaaaaacttacttttgcttcgcgctcttttttgccgtggtgttgtttctgtctcgcggtgtacacaaccgaagaaacggaggaagaagaagcaacgagaggagcagaagaagcagcagcagaagaagaagaagcaacgagaggagcagaagaagcagcagcagaagaagaagaagcaacgagaggagcagaagaagcagcagcagaagaagaagaagcaatgagaggagcagaagcggcagaagaagcggacgaagcagctggctgaggcgaatttgtaggcgtagcaacaccatcaggagaaagcccaattgataaacattgngactgaaattattanatagtaaatgtgactttgtttaaaatcttaaaacttacttcaaaaatgacccgctctccnattcggcacggcgccttttcggtgcangtgttggaaagctgggactttgttgactgcgttgttgcgttgacatcatctgcagcatcatttgtgtatgtgaaaattgagagggatggttggggcgttgaggctaaactgcgtctgctgcaaataaaaaaattaattaatattttcattattatttaaattgatttgactcacttttttggcgcaaccagcattaacaatgccttttgagcctgcaatgcagctcggcgtttcggtcgaacactctcgagtggaagaacatccaaatttgtgccgcaactctcatccaatggccctgtggcgttcagcatcgacacgagcctaaaaatgaattatttttataatgtgtcgtcgaagaattttgactatctcccaccccccataactaacgcattttccactgaaattgtgtccgggatcaccaggaccatttgttcagtttcactggaacagttaaaattttttgaaaactgtcgacaaaatcagttaaagtcattcccctcactcacgcattttccaccacattttccatctgttcagcttcgctaaaataatttaaaaatgcaaaactgtaaaaattttcttgaaaatgaaccaaccccacccgcattcactcacgcattttgctgcacattttccaccaacggacgttcttcgaatgccaaatttgctgggtgtcgctttcgtcatcgtcgtagttaaccaatttgaccattgtgttgatgaacgctgaaagttcggtgggaaaccatcggattttaattattattaattcaaaaaaatttactttcaaaaacactttaagcagcaatgcgttcgaacacgtcgtgactgaaattagtttgggaaatgttgaaaattttttaaagaaattttaaattatttactgtaattggtgaagacaaaaagtcgaaatcgaattgataaaatgaaaattgaagagcgaatgaattctataataaattaattaaatttaaaacataaacaattaagaaatatagcaaattaaaaaacgttgaaaaatacataaatgaaaagataaatggcgaggctattgcattaaattatgagtgaatcgatggcttggcgtccctctcctgcattttggggggtcaagcgaagagggggtgggaaaggattattgacggcgtcattttcccttttctgccgttcatcgtttaagggaccaccccatattcacattaattaataaaaaattttttcattatttctagcatctgctccccccccccccctccatccagcagctgtcacatcactgatcaatcaaaaattttcatgtcggccatcaaaattacatgtaaatttgaaaacctccaataggtttgggtttcgaactcccacaatttaataattaattaatttgaccccctccacccctacaattatctgaccaattagtgcccccccatccggtcaatcaattagtcactaattgactcccgccctccagccacctgtcacttctaattagtgtcaggttgctacggaggcgtatggtttactactaattattttattaaaaagaaaaaatttcaatatattactttttgttttattcataatattttttttcaaaaaggtgaagatcaattttaacttttgaaatggtgacgaggttattttttataaattattttgtcttttttttgcataagaatcaatttttatcagctttataaaggaaatattctttttaaataaatttcggcctcatttccaacatagctcagttcatttctaatgactatttctccaatcacaattttattttctgctgtttctttcggttttaatgcgcccgaacgagaaagaacatccgcaattatgttttgccgggattatattcaatttccaaaataaaacgtgagcttaattccattatccatttgtcaacgcgcgcattaccggtctcgtttttacttttgaacataggaattaatgctttgtggtctgttaatactcttgtcggaatcattgtaatatattgtgcaaattttttcacgccgaatctgacggccaaagcctctaattctgtggtactgtatcgtgattcgtgtttattacattgtcttgatgcaaatatattggtcgaatgcgattttgttgatcaggctggcaaagaacagctgatatcccggtcttacttgcgtccgtcataatcaaaaattttcgtgtcaggtcttccatagcagctttaaaatcggaaaaataaagaacaacataactcagaatttttcctttcaattttgaaattgcagcaatttcggcgttatccattttaaacgatacgtccttttttagcagcttaaatagtggtgcagccatagaaccatcctataataggtcatgaatcccaaaaatgaatggagttccttctttgattttagcatcggcatgtccaaaatcggttttactttcgtccatttttattccgctgcgagttaaaacatggcccaaaaattggagttcctcgatgctgaattggcacttagccacttttaattttagcccagcctcatttatgtcctcaaaaacaaactttaagtgctctaaatgttgttcgaacgtttcgtatgccacaagaacatcgtcaatataaacaaaaacgaatcatttaatttgtctccaaataaatgggtcatgaagcgttggaaagttgctaccgcattacaaaagccaaatggcatgacgtgaactcatgcaaaccaaactcagtaacaaaagctgtttattcttgaccatcgtccattttaatctgccaataaccagaaataagtcaaattttttattgaatttatttttcttttataaattaaaaactaatatatgatccaaatcactttaggtaatttaaaattttttaatatatctgtagattgtggattcaaaatatttcaaatcgatttgtttgttagactttattggacaattaatttgaattggttttttgctaaagaaaatttttttatttgtttcttcgaaacctaaatataaagattcttttgttaaatttgtcataaatatttattaattattattgttattattatcctaaaaattattatatgaatatcacaaatttttatttagtataattacctttttcttgttatttacttcttcaattgctgaattgattttatttttacttaaatattgttttttatgttatcagacaataattaattcgttaatagtttagatggtatgacaccttttttgaaaaatttttcaaaattttcaaaagtcttaaaacatatttctaggggtttataggaccgctgagcacgaatctgacatccatttcgaccaattcccaaccccggacccaagttcgaacaaaaagtcgaaaattcatttttcatcacaaagaaagattcatgcaactaaagcaatacaaatgcacgaaaag

SEQ ID NO: 16003 - DNA, 2592 bp, Heterodera glycines
ttatggctattatcagctgctgttcaaaaaggggtccaactccggcacttttttgtttgtttgcacaccgtcgccccttggcatttccgccaattccaaagtgttactgcttgaactcggcgtctgccggttgtgcaacggatccaccgaatctccaattggcacgaacatttccttcatcgttttgcgcaattcctcccaatttgcctccacccgctcgtatttggccgacttgcgctggtgttggtcgtttgtatgcttccgccaaccgatatatttagtaaactcagcggtacagaagcggcaacggtacaacggcaaattgaggtgactaatcgcaggcaattaataggacaatggccgattaattggccattcattctccggcacttacgtattgcaatggtattctttcattgttatggagtttgtgacatttccacacaaaatgcactttcgctgctcaaatgaggcacaattgaatgcctttttggtattgtccaaagcaccaaagttatttggtttggcagaagggggaatcgaagcaaaaaccttaaaaagtgagggggggggagcatttgggcattcaatggtgcggcggtttgagcggaacgggggataaaatggcggatcagagatcgtttagtcgaataacttttcttagtcaatcaaatccacaaacttagcaaagagtaaataccgcaataccctaaaaattcatttttgttgacttggagcctttttgtatccattttaggcctatttaagaaactttaaacattggagggatagctttgtttttgtttttcattgttattaattactccgtccacctcactgacgcccaaaatgcattcgttgaccgccttttgaagtccttttggaacgggcggcaaattgtcacaattcgtcccgccgggcagagaattcatttgctaatagtttaatcagtttcgcaatgctcgtcattcagttttcgcttcacttaccatggaaaaattctgcgccattttcgaccccccgccggccgcaaaagtgtccatttgctggccccgctgacaatgagtagtgttggtggacgaattaagagacggaatcggagacgaactttgagaggaatgcgcaaagtcagcggactgaacgaagcaaaattaaagacaatttcaattcgaaatggccaatttgaaataatttggaccaattaaaactttaatttgcagttaattgaatattaaaatgaatattattaatatttcaaattaaatttggaattggtctatgtatttaaaaaatgattaattgtactgtattaatttaatttagcttcaattacggttttgtactgttgtggtgccaaagtttccttttgtcggcacttttctaaaatttcctcgcaaatttccttcaaaaatatgttctcagcattctaaagcaaataatattttttaatttaaattgtttttcaattttcgcctctcacataaagcgtgagttggtaatgcatcgatttttggctgtgctgaatcaattcggagggagaagaagcggcaaaagcgcactgattgcatttgtgcgggcgatagttcaaatgggcataaatgtgctgcaacaaatcttcggcaccgaacaatcgggcggcatccgccggaaggcactctttggaatggacgcaaatttggcaatgccataaaatgttgttatcctttgagcacatttcgctaatcaaatgaatttatcgctgttttttgcttttaggcaattaacaaataagtgataaatatattaattgtaagtcaacgggcacagaaatgagaaggtcattagacactcatcccatactaatattaaccatttgtgtgttaggcacaacgattagtggcggataagaaagatgcatagaattggagagatatgagatgtaaaaaggagggctttaagcaaaacctccgctggcgtcgcccccccccccccccgccgcgcgccgaaagagtgtggcacagtgagagagagaggaagagaaaaaaagaaagaaaagagcgaagaagctttacaaacaaacattaatagagaacgagtgaccgaccactcaatggatgcgcacagaaagagggaaaataaataaaaaataatggggaaaggaggaaaggggggggcaaaagaaatgaatgccatcgcttttcttgcagattaaccaagttggagaattactgtatgtgcgtgactcattcacccgctgggcttaccattcttggtcacttttttctcgggacttctgagttttgtaacccgcgagattttatttaaaaactacatatgttgtcctgcaatcgattgccgcatttctgtttcgaactcacagcgccggatacaatgaagaataccggcatttgaaataatttttaaattgtaagagattggggtacccacaaaaagtataaatctgttacatatccaatccctggtgcgaggattttaacatttttttcgtggcttcttaatgctttaaaaataaaaaaaaattgtacttaataaaaaaaaaattaaacacaataaacgtaaaaatttaatggtccgttgaattttaataactat

SEQ ID NO: 16004 - DNA, 1677 bp, Heterodera glycines
  misc_feature (1644)..(1644): n is a, c, g, or t
tggcctctcagttccaaaaacatttgcatgtgtggcgaagtggtttttgtaagatagtaaaggaacaaagggtggtggttcgagtccgttgtgcaacatgaatatttttatttatttttgtccaaaatattaaaaaatgacgaattttgggaattatttttgaaggtttttcccaaccaaattggaaaaacttgatatcattcgaaagctctttatgaggagaagctttttctaagcaactgctaagcaattggattgattaggaaaaagatatgagggttcgaaattttgtttctcgaataactttttagttaaccctttttttgcgtttaaaaacccttacattttgtttgtaatttttttctctatcgatatgcaaaatttggagtggatctaacgtatagaaaaaaaattaaacgtagcgaagtaaattcggtttttctctattaacagagataaagaaatagtacgccaaaaagagaatgtttttttctctgcactctctatttattggttcatgtctcgttttttgaaacggtgtgtttggaaatgtcggttttgcgggattaattcagaaaaccgggtatggcaaaaataaaccacaattcattaaactcccttttgtaattcgtctgttttttctcttagttttgtacagtcaatggactgactcgcactgacacaagtattactgagagcaagcgcttagcgagcccccctcctccccacccctcggaaaccgaagttttctaatgaaaaataggaaatttctgaaaaagtagccttttcttaagaaattccatcataattctcaaaatttcacccgccggcacctatcggcatcgccggaccggaaatttgaccaagggccaattttaaaaaaatgagtaaaaaaaatcggctaaaaattccaaattttttcgttagccttactactgtatgttgtgttattttataaacatttttttgtttaaaaaaatttgtttttctaggaattttttttgatccacaatccgcgcgggatcccgcaaatttcaagtgcaagattaggtaatctcacaaatctaatccggtaaaaattttggtttcaactcgcaaccgtataagcaatttttgaaacaccattctttaatttttacgcaatttataacagaaaagggaatatttttgattaaaaaatgttaggtaattaatgtgtctttatgtaatatgtaaagagacttttattaaatttggatttcagacaattgaaaactaattgtaagtgagaaccaaagaaaagagaatcacaacaaaatgaaataggagatcaaataattttagtttggggcagaattagattgagatccaaagcaaaataatagggagtaaaaagtaaagtattgtaaaaatagacgaattaaaaagatttggaaggaagggaccaaagcacagcagttttatcagccgaagtgctaaggaaaacgaagtcgcgcgggtgccatcttaagtgttcaaatgaacaaataaaagacttttgccataccggcactgtatgactttgtcatggtgttccgaaacgggcaaataggggagaggctcggccaaattcccacgcatatccgtgataacaattctaaaaagcaacaaaatctgaattattgncaaaaataagtctgagtaataaccgtctgtcgt

SEQ ID NO: 16005 - DNA, 1443 bp, Heterodera glycines
aatcagggggtaggcgacggaagcgggtgggaaatagtgcaggcgatgtttatcaccagacctgcatggccatcagtttaatggttttgtcatttgagccagtcgcgagcaaattgccagtctgattaaatgctgcacaatacacagacccgcggtgatgtttgcttctgctcattagaatagttggaggaggaacaaatccatggaggaaatcactgattattggcaaattgactaacgtaaatcataatgaccaaatcaattaaacctcactcattaagcgatgttcgacgttcgtaagactgatatcggcatattaacaaatttctcgagttagtgcctatagcgaaataccccccactgggatggaatgcaactgcacgaatcgccttaacggcatggaacgatgcttaaatcgctgtgcttcttgaaaaaaagaacctgcgcatcttcgtagcagcagacgggaataaatttgaagggctcttcactctctttgcacattttttcctttgtaaagtcattagtgttttctctaaagtcttcgccatcctcaaaatgggtccatcattattaatgcttcgctttgtttggccatttgcaaaaccaaccgaatcaatgggaaagtcgggggaaagtcggctcgactcaattggctcgtccattaaagatctgtcaacaaaatctcaaaacatttctggcaatgtaagcgatgccttggtcggacaatactccgacagattgtgtcatttgttcgtattggcacttttcgaggaaaagtcatagacatcgacggaaaactcactaaacaaataaataaataatcgggttcaatttaataaatttactttaattgtaagcttaccgttggcaaatggaggtccattggaacgtattgcaattggttgcagtaattgtgcagattggaaactgtcattctgtgggtaatagagaggaaaaggcataagcgatggtggacaattagcgtctaaaacacaattgaagcaaattggtagtttttaagtactaacagtaaaaggggttctggtcgagtcgcacagcatgcatttgttgttgctcctgactctttaccgcctggaattgctggaagagttgcgaacggatcatcggactgctgtgttcggcacttcgattcacaaaaggcaaagttagtccaacattttcgccgagaggtgttgtgtctatttctaaattcatttgtttatatgtgtttcgttcattgtcagcaagttgctctgtctgagtattgtcagtgtggtggtcattcatccaatggagtctccgaatatttattcccttgttaatattgctttatttttctttacctgggacaggtgttaatgagctgtctattttgttgtgcttcaagggcaatttcatttggctccgttggcaaatcatttcccaattgttggaaagggt

SEQ ID NO: 16006 - DNA, 2889 bp, Heterodera glycines
  misc_feature (2794)..(2794): n is a, c, g, or t
  misc_feature (2796)..(2796): n is a, c, g, or t
  misc_feature (2870)..(2870): n is a, c, g, or t
aaaacatttccggcgtttctgcacggaaagaaatttgtggggaggggaagccattgaaaattagctagagcaatttatgaaaaaagcatatgaaatgcataacattatgccaatagttttcacatttgtgcagaaaattaatttgcatataaatattgaaaaactcacataaatttttatattaaaacatttcgtgaaactttgtgcctttaaatattttacatttttgctgcttttcataataagcattgatgatgaagcatcattagcaatgggaaatgatgatgaagtttgtttgtttgtctttcaacaaattaaaaaatattatttgtagagctcgacattttgaaaaaaaacatgggacctggacttggattccatatttgccacgaaactggcttcctaaaaaaaacccaaaatccatgtcaaggaaaagcatggttttcttgggctggatccagggcctgtacctggatttcctaaacaaaaaaaacaggaaaatccaggccctagaacaacccaatctcgtcatgggctagatccaggcctaaatctgtttttttttgaaaattggttttaaaacgcaaacaaatatttaaaaataaattaattaacaaagaaaaatccatgcctcttggatccaggtccaagttgagctcaaatcatttgcttacaaattaaaaaatttatttatttattaatttaggccgaatcaagctcaagtagttctaatggaacgccccgtgacaatcattatgataatgaccataaacctctgatcaaggctgaaattgctgctgatctttttgtattgcttaatctcaagactcaactacaagtaagtaacaaaataatttcattcacaaattataaaataggcaatgcaaaaaaaaatttattttaattaacaaatttagttaacaaaaccataaaactcaatcaaaaattttaattttaattatatatttcaattgtaaatgaaatcattttgttttttgaacaaagaaaattttagattaaagatttttagcaagaaaaaaaataaataaattttaaggatcaattagggggtgtatttacgtttttttattgcttttatttaaaggatttattgccgaaagtactgaaaataggcaccaaaaatgacgaaaaagacataaaaatgggcgcataatccttaattattttataaaaaaaatatttgttttagatggattatatgacaaatgaaagtacaacaatggaattagtcaacgagttcaacaaaaaatatgccaattttgtgatggaattgccggacaatttgatgacaaaaggaaaatttgagaaaacattgcataaaattaatgaaaaattggagcaaattcaattcaaaaacgaaattgatattgttgcaaacaatttgttaattatggtaaaattagaaaacaaattcaaaaatggcattgaacaaattgaatgtggcgaaaatgtgtacgaagttgtccaatatcatctcgaaagagtgaattcggaactgtatcgccggtaaacagaaacaattgttttatttaataaatactatttaattagatttttaataaaaataatattggaaaaaaaattatttccttgcgaataacaactatattgtaaaaaaaaagtttttttttctaattaattaatatgattcaaaattatatgtaacttttcctggattctatatattttgggaatttgcacttttcgcgtatattttgtagttttctgaggattttttatagaaaattttggtggctttttgaaaatttatataaaaaatcaaaagcgatttttttgataaatatacacctaaaagtttattttaatgttaaatttttatttgaaataaaattttaaaaaatatttaatttatttaaaatttaaaataattatattctttataatttaagaaaacattacaaatacaaactattgctgttgtcaaaatggaatttgccaattagcacccaaaaattagtgaatgtgttcgattcaatccaaatcattctcactctttgtggctttatggatgaggttgcagtacatcaaggtcttaattatttaattcaataaaaattaattaatttaaaatttaaaagcagaatttcatttagatactcgatcaatgatcgcaaaaatgatggccgaactgaaggaagttgaaaaaagtttggcccaaaaattggaaattgatcagaagcttttggcgcaaatacaaagattggatcgaccaccaagtccttgggaatgccaggatgaaatgcagatgatggcgaggctcgttttaaggggaaaaaattttaaattaaaaaaaataagttatcccaactctcaaaaacctattttttactaaaatagaaaatctcgaaaattaaatttagcataattttcttatcatatttcattaaaatttccaaaaaaaaatttcagggcgcctaaaggacaccgccgaacaccttatgccttatttttttttgaaaatttgatttataaatggcaaaaattgtctttttcgatgcaccactaaaaattcctgcttttctccccggcgctgaaattttttgtaaaataataatttcattttaaacaattatcagccattttttttacttaaaataattaaagattggaccacaatgtgatgagtcatgaaaaaatttcgctgatttatttgcatgcatgtgcacttagactgaccacagaactcggcattttgatcaacgagttggaggaaattggcacagaatggacgagtgccgacgcaattgacgangntgttgaagtcggctgctgagcttgaaatgaatcgtctttacattttaaaaatgtgataattatgctttctcatntatttagggatttcatttt

SEQ ID NO: 16007 - DNA, 1252 bp, Heterodera glycines
aaaaaaaaataattttttggaaggcaaattcttttttataaaaaaaaatattttaccaggaatatttcagaatcccaatttcggattgcgatttagggaattttttgagccctgggaataatttccgattgccgaaattttttgagcccgaggaaaaattcagattaacgaaattttttcagccataggaaaaattccgattgccgaaatttttaagccctcggaaaactccgattgccaaaattttttgagccttcggagttccgattgccaaaatattttgagccttcggaacaagttccgattgccgaaatttttaagccctcgaaaaaactccaattgccaaaatttttaagccctcggaaaactccgattgccaaaattttttgagccttcggaacaagttccgattgccgaaattttttgattgagccctaggaatttccgaatttgttgaaggcgtcgccacatattgctgatttctacaacattttgaaatttttgatgtccagaataatcaaagtattttttaattacatttttttagatgaagagattttgcgacatgtaatggaactttccaagaatgatcagacgatgagaagcaatgtggtgcaacatgagggtccagcaatggaatccgttgcttatgaatcggacaatgaaattttaagacaggtaggtgtataaacaacttttgtaataaaaaaaagtgatcgtcaacaaaccccaataaatagcctgcacaagaattaccaagattttttgttttcgaacttttttagtaattaaatctgatatcattattagtagagctcgacatttttaaaaatgcctgtacctggacctggacctggattccatgttggacctggacctggatttcctggacaaaaatccaggtccaggaaaccaggctattcgggacctggattttttgaaactaattttaaaaatcaaaaaaaggtttgaaaaaatcaattaattgcttataaacctctaaaaatatctaattaataataataatgtgtttttaaatttatttaatctgtttttaaaacttgaaaaaacatcggtcacttgaaaaaataaattctaaaattttgtccaggaaaatcctgggtttttcgtgttctgcctggacctggacttttttcacattagacctggacctggatttcctggacaaaaatccaggaaaatccaggtccaggaaaatccaggttgccgaaaaatggcctggacctggacc

SEQ ID NO: 16008 - DNA, 1125 bp, Heterodera glycines
actggggaaaattttaattgttaaacatatttttactaactctataaatgcataataattttctaatcaaaatgcattttctaaatatattgataaaataacgaacacatactgttggtttggaacgtttccaacacctaaaatgaaatcgataaatggattttcttggaattttataattttcactagaggagcatccctggagcttatgatttatccgcatttcagcaatttatcgccttggcattcatatggcaagacaaactgaccttctttgcgacaagctcaagttcatgaagggccaaaaaacagccgccggtgcggcatcaattcagacggaaaatgtcgtgggcattctctgagtttggcttcaaaatttattaataaaattttttattttcatcaaaacccagtctcaagaaatgatgcagaacttaagaccaattcttaacccaaaattctatagaattttttttcgtttttggtccaatttggccacgtttatgtcctaaatgacatcaaatttttgggtcaattaatgactttaactatcccatattgttaaattgtttcttacttttttgacatattattgtcacgcatagacaacctttcatagcatgttcatttttttatacgatatgaattggttttaacgaaaaaacgcataaaaatcacatatccccaattttttacttaattggccccaaaaaacttaccgctcaagttatggtgtgccaccacggcgtccaactccttttccaacttcgcttgcaaaagcagtagctgcgtgcgtctgctgcctgtccctttttccggaccgatcacaaaaggaactccccagatttgttttgccaatgggttggttttgggcgcgatttgtccgttcgtcgccagacccgtggttccatcgttatcggatcggtcggcctcagtttcgggtcccttgctgtgtgtgccgggatgttcgtttggcttgctccgggttcgtaaacgtcgtgctcgattccaatttcggtttttgccgttgatttcctggatgctggttcggctgactcggcattggctttggcctgctggagaaattcgagccaaatcaaccaacacacacacaaatcaccaaac

SEQ ID NO: 16009 - DNA, 3093 bp, Heterodera glycines
  misc_feature (798)..(798): n is a, c, g, or t
  misc_feature (1026)..(1026): n is a, c, g, or t
cctttttagtcagggaaattctgtgaattaatgctctttttttcctaaaaggcttatcgccctatttaattaatggatggaaaattatggactaaaataagttagggtctacaaaattccaaaaattttcttcaccatgcatgcgttttaaaaatttacttatttataatttttccgtttttgctctcctattttataattcctattacagtatatataaatgccaaagaatatgtattacggttgtgcagcattgaaagtcgtagtcctcgacgcagcatgtgctcgccctcctccctgcttttcgtatgcagctcccccaaccgcagttgcatttctgttccagcatgtcacaggcgttggacacttgcacaacaagaggcggtgcctatgaaaacgacaatttttttttgttgaaaaattatgcataataaaatataaaattatcttttttgtgaatgtttcttaccggagttgttgttggggtctaaaagcagatatatataaaaattaaatttttgtacatttctcattttgtgtgccacatcgaataattctcattttaaaaataatcttttcgaagttaaatcttaataatacagataattgcttaaattaaagagtgcattttgtttaatcccatttttctgcaacattcgcttttgtgtattccaaaaccaaagccgaaaattcatgtttcagttttaaaatttaacaaaatagcacaatttttgctggatttttgatttttgtaaacttttgcccatttttcagccctttttggatttgtgccattanaagctataatgttccgataataaatagattcttactttttcacagcacttaagttcaaagttgtttgagcaacagatggcgtcagctgtgtacccgggatgttcgatgcatgcaccatagccacaagacgaacaaagtttttggattcccttgcaggcagccttcttcaccaccactgcgatcccatccacaatctttccatgcatgtattgcaacgcatttccagcncctttcccaatctcgattgcaacaccagtaaatgggtctaatgcctgccgttttccccggaccaaaaacagctcttcccagatttgttttgccactgggttggttttggctgcactttgtccgttggttgccaaatccgtttttctattattgggtcggtcggcctcggtttcggttccgctctggccgttggtttccgggatgctggttcgaatttcttcggattcgtaaacggcttgctcgtcttcggtttcggttccgctctggtccttggtttccgggatggtgattcggcttgcgtcggattcgtaaacggcttgctcgtcttcggtttcgcttccgttctggcccttggtttccgggatgctggttcgccaagcacgggattggctttggccttgagacattagatccgaatcaactaacacacatattaagacaaagatcagattaattttttattaattcaaatttattccaaaaaagtttctttcttgtctctaaaatcttttgtcatattaaaaattttgttttttttcacttacccaagatggcatgcgatgccgcggcgatcaggatggcgaattggatcaaaagtttgaggcttggggccattggagttttatggttcggatttggggataaaagggagttgaagaattgaataattttcctaaagggatttgaaatcgtttagtgatttttctgaagtgagctgaagcggtatgattttgctgggcctatcagcggctatttatgcagctcattttgggcggagtttgggcttaaagccgaccgatccgtcgatggccgtccgtccatccgtccgtccgcttgcggcggctccgccccaatttcccagcaaattgtccactggttttttacacagaaattggctttttgaattccaatgccaaaagtggtgagtcaccattttgcccatccccaactgctgctggtagctggtagccccataattttgttcatttgttaacatcggaattttctgcttttcccaacgagtgacggtgattcacctctgttttgcccattttgtgagtaatttgtccactaaagcagtgatcaaaaaaagaaatcgctttcccagagatgaacggaagtggcaaaaaagtggaataaattataaaatgattttacaaaaagaattttagtttactatacgaattgattttataaaaagaaatgaatataactttttagggaacggttacggtaaaagtcggaccttttggttaagtttttttgataattgacggataaacaaacgtgaatgtgttttgataaataagagccaaacgtgaaactctctataaatggtatggtaaaaacggtattttcgttaatgcttttaaaaaattctaatttaaaaatgtaacgtagaaatttgtttaagaatattttacagaaaaaataaatggctttcaattccaacaagggcattgaccaagtcaaaattagaaaatgattcataagttttaaaataaaaattaaattagagtttttttaatccttcattttcaataataattgcgatcacccaactcgtactgtttttctcaactcgtactgtacaacaaagagaaattttagcaaaaatttcaatattttcattgatttattattctacgcaaaattcaagcatgcatttaaaaacaaatttttaaaaaatattcgaataaataaaatatcatttcaaacatttttcttagaattttcctgatagtgattgaaaaatgaccaatattgggatttttcgacaaatttttcccattcaaacgaggggattgaacaaaggcaaaaactgaagatataaggaggaagcttaaaattaaccacgaactcataagtcatattcacttagaaaataattcatacggtttaaaataaaataaaataaaataaaattttttttagatttccttccttaattttcaatttgaaattccgcaatgcgtaattgtgggcccactaaaaacccgcaatttccataatacgtattcattcatacttggaaaaaaattaactttatgaagagcaaaaattgat

SEQ ID NO: 16010 - DNA, 2412 bp, Heterodera glycines
  misc_feature (750)..(750): n is a, c, g, or t
caattgacacagcaattcaaagcaaaattaacaaagtcattgacgcaaaccctggacacagcaaataatcgaacttgctaaaatcctcacgagaagcatttcagacgttgtgcagatggaaccggaaatgatatcctcttttaaattcgtctcgttttccatttacaaacaattctaactgacagcagaatgatattaatgcaaaaaaaaatttgatgtgtattttatttgcaaggtgaaacacgaatttgataaaacttggcattttaagacctaaacgcatttttcgtatatattttaggtttctaagcaactattgaatacatatccatttagtatttttgggatttttagtgcatgtttcatgcgcatattggcattttttagtgcatacaaccaccctaccaccctaccctactgatgagttatggcgtcgggattaaaaaggccccataggttaaaaaaatctttgacaaaaaatcgaaatagtctaaaaatgacaacaatcaaaagaactaaaaaaatttgcttgaaaatggtctcaatttaaaaaaaaaattccttatacaccaaaatcaaaattgaaaaatcttctacgggccaagctcgaaaatttttgaaaattttcgacaatagtcccatggggttagttagagataaaggcctggaatttttttagcacccattgcaacttaggtacaaaaaatagaattatttttactaataattggggggcggctatttaggggngggggggggaggcatatttcccaacccccatcaaaagggggctttatctcagggaggattataattaaggggggctgtattttaggaaacatgatattactaaaaacataatttttctttttcgtaagctgcattaatattgaataaatacatgatgagctgtttcaaattaatttttcatgaaaagctgttcgaaaataatttttcactcattcatatgtccttcaaataattttatggtatcaccccccccccccccccaatttatgaggttggcatcgttggcatttcccaagcataaccagtggatgaatgccattcgcatatgaaaaatggtaatgccaaacactgcttaaaaaatgtaaaagccagtgaaaggtatgctagggagcaaaatttattgggcgctaacgtttcgcaggcgggcgccaactgcgctcagaagctcattgaattttccacttggcattatgccaaccaacgcttacgtgggtaaaaggcgtttaaatattggctgaaaagcccacccaaatgaaagcacattaagagaaaattaaaaaagacgcaaatggagcgcctgctgctgcacgttgccaagaagctaatgttataccactatttctttgctttgtgctgctggcagcagatgaatgccgtgggatctctgctgttggggctgcgattcccacatttttgggcatcggcatggtgattccagtattttttgaggcaattaaatattcaaaaaaactttttccacgggatttttgccattttctgccacacctgctctaagcatttggaggattatttaccgttttcggttcgccttactttaattttatcaatgaatttagaatttatttaaggcataaattgtgggctttataacttggggactcgacaattggggatccgaaatttggggattccaattttgggaacccgacatttagggattcgacatttgtggttaaaacaacatatagggacccgacatttagggacccgactttttggggatttaatagaaaaataaaaaattttgcgtatacatttggtctgccaaatttaataatatatttttttgtgaaaagttattttaattttcgagagtagatatgaaatataactctatttttagactcagccacaaggaggtaactaactttgagtccataaccaaccacaacataatatacgaatatatttttgtttgtttttttaaatttatgtacattcactatttttgctaaatttcccaagggccaacgggaacagaaattcgtcaagagcattcaaaaggttcttgacagctttctgtttaatcgcatactgcaacaccaaagatcatttttcggtttttatttttcagggtcatttgttggttgctttgaatttatttttaaccgttacttttcgcaaatttctgggcttgatatttaaagatttaaatatattttctttttctcaataaatcttcaaatgacgcttcgtacaagagccgagtccccaaaaatcggaatccctaattgtcgggtgcccaaaaatctgaatccacaaataacgggttacctactctcgggtacccaagcccgaaatgtccggtagccgtcatagatcattagagagggcaaatcaaatggaaaggggctttgaaaa

SEQ ID NO: 16011 - DNA, 3568 bp, Heterodera glycines
aggaggcaattctcgtgctaaacggtgattaggaactcccaccggggcccaatgatcgctgatgaacgcacttcagctgctgcgagtcaccactcaaactgcgcgaccggtcctggcttgggttggacggagaggaacagtcggtggtcgtgccattggccaacccgccgaaacggtggtgcacccaaagttcgcttttctcggtcaaagttttgagaacgaacaaatcccggtcaatttggtggtaattctaaaaatggcgaaatgccaatctgacaaaaagaacggcggatgacctgcacttccttgttggacaccagcagttgcacctttcatcaaacattcaaaattggcattgacattcacatttcgccaaacctggcccatgtcttcgaccaattcttgaaattgggtaaagtggcgaaagagaatttgcagcgacaggctggtaagcggaacgaagtcactcatggtcatctggagaaggatgcgcagtagttgctgaccgtgctccctgtccatgtccaactcgaaggaatcgccgttttgccatcggaacacggcacggcacattcgctggaccaattgctcgtctatttgtggtgccgaggcggacaattcgccactgtcgccgcaggggaagtgccgtttgaagaaggcgagggcggtggtaatgcgaaagtcgcgtcggatatccatgatgaactgaagcagctcggccaccagcagcttcgtctgcagcaccatctcacggctcatcttcgcgcaggccaaactctccgccgcctccgtttcggcgcggaagtctttgccggtggccgatgtgcgcttcagcagcggatgatgggtcgaaatggacagcgactgaaggagcggcgggggatcggcggtggacgcgcggtcgtacgcgagttgttgactgaactttttggtgagttgccggatcagtttggaccgcgttccttccgcccgatcggtgtttttatctgaaagtgcccatttttacgtccaaattttgcttccgttttatcattaactgaatgatcgctgctgttctctgccagaacaactgtcgacaattaccaacaaattctgtgacaattttaacaattcctggaaatcgtagaagccaaagtgggccagcgcctgaagggaaagcaaattggctaattaatgaaattgataaagcaattaattaattggctaattaatgaaattgataaagcaattaattgcgtattagtctcccttgcctttgccaaattcacaatttcaaatgtcaatcggttttcatgcgcattttctgccctttctctcagcacgggctccccgggccgtgcccggcgtcgaatgccttccaaatattcgtccaccattttcagaatttcgcccgaaaagtccggtctgtcgcgcgaaccttcgccgtaattttcagcagccgaaatgaaactgaaaaaaggaaaattaaattatattttcattaaaaaaagcttaaaatattcactttttgacatttatttctgagggaatgtcacgccaaaggcgcgcgtgacgaacggcggggacgggcgacccgctgaagcgattcaaaagtgagaatttcaagaattaagcccaccgaacgatgtgaagatgaagcataagtcgagtgaaagaagcccctaaaggaaaagcaaaaaaaaagtgccaaaagcaaaaagaaaaatgccaaaacggacttatgtcaaacggaaggcgatggtcggacatacacctgaaaggagagagaatgagaatgagggaaggggggggggcggtagaagcactggaggacgaggccctctgtctattcgcgactgccgatagatgtgtccgaacacggggattatctcgtacgaatattggtatacccaatctattgaatgcatttcagttcataaatccccgttctcgctaattttacgtggtcgagcagctcctcatccttgaggaacgtctcatcgcatgattggtatccaattagataccaatacctcacagcaccgcagacgagacatggcgccttgtcgtacagggccagtgatgtgacctcatactcagttgtgccatcgtcgtcctccgcgatgtcggcagcattttgatccgggtgtcaatgttggcactaataaacaaatttgtccattaaaaatgaggtagttgcgaatggcttctaactcattttgcactcaaaattatgaaaagatctatctcgggatgagtcaaattatcattttttgcctataatctataatttcacaattaatttagacttattagataaaaattaccccgaccgtcccctaatcacaatttcaacaaattttataacacattcattaaattcaaattttgccgccgccaaaacatgtcagtggggcgcttaaagtcacttattcttttgtgtccaatattccctgcactaatctttgttgatcgccccgagccaaacaaagaaagataacatctgttgtatggccattctgacaatgaagaggaagtgaaattgacaaaagaaacaaaaatttggagaactaaagtggatggggaggggggggggggttttagcgatcgggccatactccgctggtcatttctccgaatattcgcgccatgcagtggattaaattcaactgcacgctttgcccgatcggtctgcattgtttttatccgcgcaagtacgcaaagcctgtgctttgtgcgcatcccagcgtccgtaacatcaccgactttttgagcaccgggcagcttgaggaagctgcaacgacagcaacaacaacaacaccatttccgacaactgccgtggtgtcggcggcggcggcagaatgcgcacctccgcccgcgcagctgaccgcatggatcgcggtgtgcactgcgctgctggcgcttttggtgattgctgaggtctgttaattttgggcatttatccgctaaacccctattcctcaattaagcttgtgcgcgccggattcaaagtgcgcaaatttttgaaggaccgcgccttcaaaaaagggatgctgcgccgccatcgccagcgtgagtttctcgctattacatttttagcaaattgtaattaacaatttatacaggaatgagcgccgctcgtcggaaccgccagccggcaagcgcaccgactccgctgatcttgccggctatgttggccggcgtttctctgcgcccgacgggcgtcaatttgactgtggaccgagggaaaatcccagaaaaaacatcaaaatggtcacaagtaaatcatgattactgtcttataaatggagccatttactataagaaaggaaaatcaaacgcagaaagaccaaaattattaattccttatttatacaggaaagaaatttttcatttaattcatgatgagggacattttgggttcgacaaaacttggccagaaatcaaaaatcgattttattgggttggaatgaaggatgacgtaaatatgttaattgatagttgtgtggggtgccaaaaaagaaaagttcaaggatgctgcgccgccatcgccagcgtgagtttctcgctattacatttttagcaaatt

SEQ ID NO: 16012 - DNA, 2483 bp, Heterodera glycines
  misc_feature (16)..(16): n is a, c, g, or t
aaaacgaacctcttcntgatcactgttgtaccttcttctcccaccccgagtgtacctcttctaatcacagttgtacctcttctctttaccgttgtacctcttgtaatcactgttgtacctcttctatttcctgttgtacctcttctaatcacagttgtacctcttctaatcaccgttgtacctcttgtaatcactgttgtacctcttttaatcattggcgcgaagcgcccgtcctgaggccgcgaagcggccgaatgttctcaacaaaattaaaaaacgggcgcgacgcgcccgtcctgaggccgcgaagcgcccgtccggaggccgcgaagcggccaaatgttccccacaaaattaaacaacgtgcgcaaagcgcccgtcctgaggccgcgaagcggccgaatgtcccccgcaaaattaaaaaacgggcgcaagcgcccgtcctgaggccgcgaagcggccgaatgtcccccgcaaaattaaaaaacgggcgcaaggcccgtctgaggccgcaaagcggccgaatgcacttgctcatcacttatcaaacgcgcatgcactagcaacgaagtcctttgcgcgaagcgctcatgtcagcgcccgcccatatataccaaaagtatactgtctacaccgagcaaatactgtgcaaagcatactgtctacaccgagcaattactgcgccacacgctagtttatatatatatagaataatgttgcagttcgtagaaaaaattataagtccccgtggtttgcccggaggctcctgaaagtgcggcattgcttaagcaactttttgaggcgcatctgggaaaaataaggatttttcggtccggcggccagttgagcgccagcggcgctgaaacggccaaataaaaaaaatcgtcgcggttttcgggctgtaacttttctcagggaaccgggagcggaaaaagtccgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggttaagcggagcgggttcgcgccgcttgagcatttgtgcagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgttcaaggcttataactcgtcaggcgttgatcttagcggaaatttgtctaagagcatttttgtagagaattttaagctctatctaatgtgctttatctcatgtttttaccatgaatttaaaaaaagttataaaattaattgtgattttgaaactcaaaaccataggggggaccccatggttttgcatttcatgaaaaaattttttgctcctaaattagccaaaatgcatttttatggcataatttgaggtgctgaatacgtatatacgctttattttgtgtttcagactttttggaaggtggttaaaattttttgaaaaatcgtcaaaatttgagccccggaaaatcctatgaaatttcgaaaattcataaatctcttcgtttttggtcaaatttagtgtaataaagctttaaaaatagagaaaaattgggagaattttatgagatttatttggaatttctatcttccaaaataaaaaagttattccagaatttctggaaaaattcgatttttcagaaaaaaattcctaactcccttctgaaaaagtattttataaaaataatatactcaaaaaatccgcaattttttgctctattttataaattttaatttagcttattatcaattttttgaaaaaagttatagaaataaaagtgattttgtaatttgggaccaaaggggtgtgaccatgatttctgaatgtgaaatttttttcaccaaaaatcttcaaaaatatgattttagggttatttggccgctgatcacgaatatgtaatcagattttactttagacatggttaagacctcagaatccctgtgtgattaaaattaaaaaacgggcgcgaagcgcccgtcctgaggccgcgaagcggccgaatgacccccaaaaaattacaaaacgggcgcgaagcgcccgtcctgaggccgcgaagcggttgaacgtctcccaaaaaaattaaaaaacgggcgcgaagcgcccgtcctgaggctgcgatgaatttctaaattacatcattttctagcgacgcggcgaagccgcgtcccatagcgcgatagcgctttaaaacagcacattaatacacttaatgttttgtctgtttaaaataacaaatgtgcat

SEQ ID NO: 16013 - DNA, 2987 bp, Heterodera glycines
  misc_feature (53)..(53): n is a, c, g, or t
caaatcgaaacacgtcaacttatatggtgctccctttcttctaccgtcaccgncctcaacactaatggactaccgcgacttcggacaacaaagggaaaagggcgaccgcctgtctcctcacaatcgcacattttcaaagtcaacaacaacgacaactactgccttttttacgccttggaactgatgcgctactactcattatatatcaggggagtaatttcaaggaaacaatttagatggattaacaacaaccaaacaacggttttacgacaaaaagtgcagcaactgctccgcgaggcgggtatcccgacaactgaaccggaatacgatgcagaaatatacattcatcaagtgcaagggttgtggaacgtcaaatatcccggtgagtacaaaattttcatatttaacgattaccagatgagcccaatcaccaaatctgatatcaccgattaccaattccctattcttctctaccacaacaacaaccactttgacggcatcaaaactctttcaaaatttttcaacaaaaagaactactgtctctcctgcgagtcgccgtactacaagaaaatcgagcactcattaaaatgtacttcactctgccacgggtgccgtgaggtgggcgttgactatccctgtgagccccaacaaggatacagcaaaaaatgtgagcactgtaacaacaccttttacaacaacagctgttatgagcgccacctccacaaggatttgtgcaccaaatttcaacgctgtgaagattgtggggtaatttataacataaaggttcatgggagtgttgggcataaatgtggggaacagttttgtaaactttgcaagcaatttcatataaaagaagacgacgacgacgggatgaacccctgtacgaaatgtttcatccagcccctaaagcaacaacgaattaagtcatacaggatcatcgcatacgactttgaggcgacacaggacaagaaagtgggcaatcgtttcgaacacgaggtcaactttgcagcggctaccatcatctgcaccgactgcattatcaacagctactggaacaaatcacttcagggaaaaaagtgccaaatttgtggacctcaccgctcaattaccttttcaccttttgactacacggagacaacagtcgaccaaaaaatcatcactcaacaaccgctacgcgaattcgtccattggctcctttttgaccacaacaaaaagtttccaacagtcgcctttgcacactttgggggccgctacgacatgacgatgatcatcaaggaggttttagcgcaaggaattcacaacccggacatcatcaaacaaggaaatcgcctctacgagctgaaaatcagggaaaacgagcatggccccctcaccatttttcacgacagctacaacctaatgcccattaaattatctggcctcatcaaatcttttgggcttcatataaaagataaacaacactttccccatatgttcaacaaatcatcaaactacgataaggtcctccagcaccttcctccacgtgaagactattgccctaaccaaaagaagaaggcggatctgcagaaatttgacgactggtacagcaacaactatgaacaatgcttcgaccttaaagaaaaattacccgaatactgctgcaatgacgtccaaatcctcacccacgccctcgtcgaattacgccgggaattcaaacaactgacacaacggaacggaaaacacgggggaattgacattctttggcaagcaatgaccatagccagcgcctgcgtcaaaaattatgcactcaaccatttgaagccaaactcactcgccatcgtccctgaaaaaggctatactccacaacagaatcaaagtgcactggccatcaaatttcttgactggtactcccacatcaacaatgtcaacatccaaactgctcactcccggtacggcgaatatgtgtttaagcgtgaagggcaggtataccaagtggacggctacatcaaaggcacaaatgggaagcgggacaaaataatcgaggtgaatggttgtctgtggcacggttgtgaggagtgttttgatgacttggacgacgaaacgaggatgccgaacggaaagacgctgcgggagattagggaaagggaagagaagaaacatgaaatattgagcaggtacgtcgacttggaggttatttgggaacacgaaataaatgagaagctgaaaaaggacacagcaatgagggagtttttcgacaactggaaggaccgctcgccaatcaaaatcagagacgcttttcatggaggacggactggaccaatgaaactactccacacagctaagccgggacaaaaaatcagctacaaggacttcaccagcctctacccgtggaccaatttctctacagactatcccctcggccaccctaaaatcatcagtatcccaccaaatgagcagacggtcaactggagctctccatccgacaacccctacaaaggtctgctcaaagtgctacttctacctccaaacaacaacatcaacgtcactgttatgcccataaaatttgatcaacgcctcctcttccctctctgtgagaagtgcgccaaatacatcacagcaaaatatcccaatggcctcaaagacaacgactattcctgtccccactttaaccctaacgaccgggccttcgtgtccacttgcacccatcttgagttaaacgcagcattggaggccggctacacagtccgcaaagtcttccacgtcctccaatacgaccaatggagtaacaatgtcttcaagtcttacgtgagtgaaatgatggccctgaagatccacgcaaccggcttcccgtcatggtgcagcagcgaagaggagaagagtgaatacattgaggagtgctggatgaaatttggaattcatctggagaaggagaagatgaaagctgaaccggggaagcggtacatcgccaagctctgcctcaactcactttggggccgcttctccatgag

SEQ ID NO: 16014 - DNA, 5160 bp, Heterodera glycines
gagtatataaattgaaaacatatacggacattaacaagaaatttgttcgattttttttttagtataaaaaattgtctataaaataatgagacattaataatgccacttaatacccatgaaaataaatatgttttaaacaaaattcgaatatcttttttatttacacatgaaatgagaaaaaaaaaattttttttaatacgcgagaattacgctttttagtttttattgactcgcgcatgggtcaattaggagttaaatattgaaaaatttcattgtacttcagcataattggggaaaaataatattaactctttgccaatgatgaaaataatttaaataaaattaggaaaattaaataaaattgtattttaaatggggttaaagcatgatttaaatatattttgataatcccaagaattttctgttcaatattttcgtttagctttgaatcattatcagtagggctccaatttttaggcaaaaggctatttttttcctgagctccccgtggcctgaaacgtacgaaaaacatgtttttttgggctgttgttaagctatttttcgagttattagtacctattttctaggcttttatttttagagcctaaaaagcctaaaaaattttgaaagaccctatttttgcctattttggcgttttgccgaaaatttgttagcaaaaatacaataataataaaaaaaatacaccccctaagtatcgatttttttggaattttaaaaatacacccctaagcagagattcaaaagtttctgaaaataaatcccctaagaaatgaaaatcttctcaaaaatcgtatttaaaaatttttttggacaattttttgaatttaaaaaataatgtataactcaatactggtttgacttattttatttttttcattttacacccctaaatttgagactttttagagcctatttttcattttttgtagcctattttgggggttttttagagcccaaagcctacctattttagcggttttagtgcctataaattggagccctaattatcagtataaagcgagaatttaacggatttgagaattttctgactttttttttttgaaattttcagggggttaattagggcataaattgtttctctatgccttcaatgccaaatcattgtatatttttttgtacggcaaaaaattaaattaaattgaacttttttttttaccgttcacagcgtttgccttcaaaattttcccgacaatagcattggccatcgaagtcgcatgtgagtcccttggagccggccgaaaaacagtcgcatgccaaacactcggggaaacggtaatggccagcggaacatttgtcgcaggtgcgaccagtaaagttggcaaagcatggacttcaataaaataaaccattttaataatatttcttcaataataattaaattaattatatttcgtcaatttaactttggaattgtaattttttaattattattaaaataaaccattttaataatattttttcaattaaattaataatttttccccaatttaattgaattgaaatgattattttttgaattttaattaaaataaaatcattttaatgatatttatcaataaataatttgattaattatttgtcccccaattaaattgaaaaagaattttttttaaattaatttttttaattaaaatttaaaaaactatttattcatatttcttcaagaattaattaattaattaattatattctccatttgaattaccattccccggttttctgatcgcattccttcgtctttgatcctttctcatggcaactgcactcacgacagttcgggtagccgtagaattcgtcatcgcagcggtcgcagcgccggcccgcgaaacccgccttgcacaaacattggccacttgccgaatcgcaaacctaaaagggcaattaattttattttaaacaacccttagtcgatttgctattccaaatttttggctttttggccctgacccctaaactgatcagaaaaagtgatcaaagtttcggaaaacaataaaaaaggttacttttttaaaaaattcacaaaaaattccaaactcatgcttgagccatcaaattccttaaaaaattatcagcaaaacaattctctatcaattggttatcataaaataaattaaataaatatctgaataatgagatgttagatcgaataatactttgaagaaaaatcaaaataaactcatcatctgtcgagcggatccgaaccaaataagtgaatttttgctggtttttttatttgatcacttttttttttgttgatcagtttgaggctcataagaagtgtgtgtgtttttttgggatttttaattcaaaacaatgacaattttgggcaaaattcactaacgaatttcaaccaaaatttcaatttttaaaataaaaaaaaactaacaaaaaatagttttatttaatgcaaatatttaaataaattaaacatctggcattggtcttttgcaacaaatatattaaaatgatgagattaaaacggtgattgttcgtaaaaatattaattaaattatatttatttatttgttgccatactctgactttttctgcttgcgtgtttttccatgcttttttgttatttcaatggaattaatttttgggaacactaaaattattatttaaaatttattattatttttaataaagtctaacaattaaaggtgtcatgacaactcatacaatttcttaggttaggcctatgcttaggccttatactcaggctttagtttgtaaaatatgagttattcttttgtacgagttgccatttatcccaattaaaatgcttaaactattaattaatttaatacaaatcaaaaaatgccgtacttggtcttccgttccggatgggtcgcaatcgcaaaactcgcactgcggatgcttgtagtagcctttggcgcactgctcgcagcgtaggccaccaaagttgcttttgcatgcacatgcggttgttttcacgtcacattcactgctaaccgatccttccgcatcacaaccacacggaggacaatctgttaaataagttaatattattaggaatttttgaaaaattttaatttaataagcataaaattaaattaaataaataatttttactattttaattgatattaattaattaattagcctttttcaccagctgttatgttcgcgtaaccagctgcacatttgtcgcagagtcgtccagcgaatccgtccttgcacgggcactgtccgtccggtctgtcgggctacaaatttttggtacaattttattcatttaaatacaaaatttattttttttttaatattttaaattaaattatttatttattaaaatgagattgactaaattcatcaactttcgggcatagaatactttaaaattttaataaaataattttaatatctaaattcaattcattttttgaaatgccaaaatttaaaaacttcaccaattttcgggtacaaaatgctttaaaaattttaattaaatgattttaatttcccctaaattcatttaaagaaatgccgaaaaataaaaaattacaacaattttgggctaaaaccctttaaaatccttaattgagtatttttaattctctaaatttgcttttttataaactaccataaatctaaaaaataagaaaatccaagtgtttgttcaccaagcattggctcccctccgtgccattcacatggcaatcacatggacggcactcgggcggatggtaatagcccggtgaacattggtcacagtttggtccagtgaattgtggcagacattcacattgtcccgtcgattcggcacagtttccagtgtgtttggtcgggtcgcagcggcacgctttttaaaagcaattaaattaattaatcagttaatcaggcaattgaaataattttatttatatttaatcatttaggtattgtaatttatcatattgcatattaagaaatttgattacaatttttcgatttattatattttattgcatttaaaataggccattttaaatctgattatttaaaatttatttatcagttttgattaggcaattgaaattttaattaaatttaataatttatcataattcaatatgaacaaatttaattcctatttttcaaaattaggcaaataaattcaatgttttttttaatataaaataaacattttaatttgacaatgtaaatatttaatcattaattaataatttatgatactaaaaatgaataaataacttttgcataattttacatttgatttcattaaatttggcatttttttacctaattgttttaatttatttatcgtttttatttttcaaacactaaaaagactcattttcttgcagaaaattcttgaaaatctcgttcttagaaatttgattgtacactaatttaattattgaaaaaactgttcaaattacaatcatatttgttagaaaatttaaaaaatatatattacgttggcacacatccaattctgaccattctttgccatttggacggaaaaagccgggcgtacatttgttgcagttgatgcccttggtgttgtgttggcaattttgacagtgtccaccgccagaaaatctttttaaaagttcaaatgtttaaatacaatttaaaaaacaataatttcaagtaatatacaaaattaatataaaaaaaacatctcattttccaataaattccaatgaaaattcttaaaaaaaataattaatatttaaactattataaacaaatgtatttttatttttattaaaatatctaatttacaaatataaaaattctcattttcctataaattcctattaaaattcttaaatatataaaaaaccaaaaaattttatttaaaataatttaaacaaattttctttttattactttccataaatgtccaatgatgcttttttctcgtccaattcctcctcataaacgcattcggatgagtggccatggcaattgcacggttcgcacacaaatgggtccccctcatggcttggccgccactttttctgcataaatccggcctgacaccgttggcattgatcaccctcagtgttatgctgcagaaaattggatttaattttttttttagaggattttggcattttgaatgccaaacaaaaactagcccattct

SEQ ID NO: 16015 - DNA, 860 bp, Heterodera glycines
aaaagaaacgagagtaaaataaaggaacggaagatacaatgtgaaatttgtctctcatccctcctttttttgatcccatattttattgttaaaatatttaaggaaggaaagagagaagtattgttttgtatttctgtttttgtttcagtgtgagaatttttttgtgatcattatttaatattacattttttgcgtttttcgtttgtgaatttgtattttttttttttgtttcaaaaaattcgttttatgtttttttaatgagaaaagatatttttaatgtggatttttacgtttacgaggttagtttttaattgaaaattatgttttcttctttggtattggcccttgcagtttgcgggaatgggtgtttttcatttggggttactttctacattgtttttttctttcttttcatagagtaaaaagttttgtttatgttttacttttgcctttaattattcaggtaaattcacattctttttgaatttgatagtatgctgagttcgcttgatgagctcctgtcgattccgtgcgggacattgttggcgtaagttttttttccttttttttatagtggcaattttaatactagccgttcggtataaattttgttttaaatcttttttagaaaaccatataacttcatttaagactttttggttaggattacggtagcgaaatccttggattaaaatttcaactcaaaaacatgtatattttttaatgttttgtttaaatcttaagagtttgtgtggcatcattaccaaaataatggacacaccaaaaaaagtcagcgttgtgatcatgtgggcttcgggggaacaattcctcccccctgagtttaaaactttctgttccgg

SEQ ID NO: 16016 - DNA, 2045 bp, Heterodera glycines
ttttatttgccgttgcttttttgtatgtttcaaaaaatcattttaaaataacaattttttgatgattgtgtctttgtttttgtgttaaataaattatttttttgtatcagagtatgtctaaacattacattgtttagtaacggtttggttatatttgtgtttctgtttttttaatttgaaaagaaaacattgtttttttctttttttaaagagtaaaaagttttgttgtttttctttttttaattcaggttaattcacattttttttaaattgatagtatgctgagttcgcttgaagatctcctgtcggtcccgtgcgggactttgttggcgtaagtttttttctttctttttttgttaaaatggctattttaatactaggcgttataaataattcttagttgtttggttttgaaagattttgttttgtctcttttaagaagcgtttggctgcattaagcctttttcgctttatattacggtagcgaaccctttggttaaagttgtcactaaaaatgtattttttgtaacttttgtttaaatcttaagcaattgttgtggcatcattacgaaaattatggacacaccgaaaaaagtcagcgttgtgttcatgtgtgcttcgggggagcaattcgtcgctactgaatttaaagccactgtgtttctccgttgggtgtgcaaatcggcacggcgcagaagaaacaatcgcttgccgttcttcaggactttctttgggttggaaatgtccttttttgtttttgtttttggcttaatattttgattttaaggttttgaaattggtttgcgttaaggcccagcgctttaactccaaattcgatttagtcgctgttgcgttttttcagctttgaagtgtgtgttgactgctccatttacgctgggcgattccatgtttgctgctgtggtcggggatttagatgcaaaacgtgcggatttgtttgtgtcgggtgattgtttgtcggaaaagttcgggagtctcggaaaaaacgaccagcttgaattgaagcggtcttttgtccggtttgaaggttatttatttattttttcctatttgacgtttgttttgttgcttagatgaggctatgcagattcatgtgctttcgtcggatgttgttgtttgcaattgtaaagtcgttcttgatgtttcttgtcttactacgcctgtgaaaagaaagagcgatgacatgacttttgtttctcacaaagcgcagaagaaatagtttaaaattattatttgcatttgttattttaatttgttttctgttgtttgttttaaaataataagtgctgaagcttgaagagagtcccaaatggagagtaagatgactgaaaatgaggccgttaaactgccgagccacatcgcgtaccttgctaatattaagataaaaacgtattagggaagaacttgaagtaatgatattgagttcttatgatagtgatgccgaataattggtgagattgcgtgccggtgattcgaatgttgaatgattggaatgctggtgggttgagtcccagtgattggaatgctggtgggttgagtcccgacgattggaatgctggtggattgagtcccggcaattggaatgctggtgggttgagtcccagtgattgaaatgttggtgggttgtcccaatgattgaaatgcaggagaattgagtgccagtgattgaaatgttggtgagttgagtcccagtgattgaaatgttggtgggttgagtcccgtgattgaaatgttggtgggttgagtcccgtgattgaaatgttggtgggttgagtcccagtgattgaaatgctggtgggttgagtcccagtgattgaaatgttggtgggttgtcccagtgattgaaatgcaggagaattgagtgccagtgattgaaatgctggtgggttgagtgccagtgattggaatgctggtgggttgagtcccagtgattgaaatgctggtgggttgagtcccagtgattgaaatgctggtgggttgagtcccagtgattaaaatgctggtgggttgagtcccagtgattgaaa

SEQ ID NO: 16017 - DNA, 1928 bp, Heterodera glycines
aagcgaacgctgaaactcaggcctaactttttctattaaacacctacagagcatctcctccctcgcttctggcggaaatttgtctgtcgttgtgttcactagaggaactaatcgttttatgaactcgtccactgacttaccatctttctgatagcaagtagccaatttcctataagctaattccctaaaatgtggactatccaactttgatttaatacttttgagagcattgcttaatgtatttttctcggttgacaaaagtttttcaaaaattattcgcgtgtgagcaccaaagtgtaatttaagtcgatttattttgtctgcttccgaccaataatgccaagtctgagacgtaagtgtccgtctatgtcaagtgatcgctgagtcacggaagtccaattgcactctccacgtagtcgaacagcacaagcacacaaaatccgttgaaatcgccgaagcgggagatgcgcaccatcgatgtgcctaacaatttaaaattatattagtgtgtttttttaaccaaatttgctgacaatatgatcaatttatttaaataagtttctaaattatcacttccaattttaaaccacagaagtatcaagcttaggctgatcacgccataccgtaaacgtctaacaaaaataaaaagaacgccaaaaactgtgctttgagtgcacagataggcaaaaaaaattcaataatctggtcccctatgagttccaaaaatatgattttgggattttggaaagatataccactaattttaagtgaccaaattccccaggcattaaattcaaacccaccgattcaaattgtccgacctcagtcggacttttttcacaatttgctttgagtccgtcgaagcacaatgccgttgcttgatgccaaaaattgccgaagcactgacggctaaataaatacattttaaaattaatttgccaattatttcccctcaatttcaaagtttcgctcaaaatgggccaaatctcaatcaccgtcccaattagcaaggattccctttaaacatactgtcactggtgggcgagtcgaaagtccaccaaggtaagtccgtccgattttgtttgtcgctgcttatgtcacccttttttttgttggtgatgatttgaagaaagatcgttaaattagtttttcgctaaaaagaaataaagaaattaaaagaataaaattattaaatttaaaacaattaattaaaactttttcaataattaaagaacaaataaatttcaaacggctaaatgtttatgtgatggggaaagggaaaatggtaatgcaacatcacacatcggtcaagccaagcactaatgcagcggtgattgcgtcggactttctccgtcagattacaatcgctgtgttcatcgccagggggggggagacaaacagcgatgggaaaggcagggacagcagcagaggaacaaatgcaaagggagagtggcccaaagagtactgtattggactcaaagatttcgaattttaattgtttttttttactcaagaccttaaaactgccgaagcatttttcgcaaatttttttttaatttcaacttcttgtttttcaccctttttttgaagcactaaaatcgccgaagcgtaaaattcacttccatctgctgttgtttactctctttttttggcccttctcattttccctcatttaactcatctcccttcgttagacttcggtcgaaataaagacaaacacttacagtagagcagcttttacagtatatgcctttgtatctccgaagagtattagcacctcaattaaatttttcggatttttttttgacttattcattttgctcgttttctccaacttttcgcttttactcatatactgccgaagcatttaacctctctctgttttggatcttttcaatccccattttcttttataaaaattttggtcc

SEQ ID NO: 16018 - DNA, 2384 bp, Heterodera glycines
atatatattgtagacaattttatttacaacaatgtcgtggactttatgcgcggactgtcactgtatgtgatggcggcgaaaatttgcatactgtacccaagcggaacggtaccctttttggtgcaacagttcttcctcacctattcactgtggtgaacacattatcggacaaaaatgaactaaattgccgaaaaaggggacgaaagaaaataaaacgatggtcataaggactcccggacaatccgtcagcaaatttatattgtgaaaatgaattgaaaaaaatttaaataatatttttttatattataaagtaatgaaaaagcattttaaaaaatttaaacgatactttcttaagaaaataaattaaattgaattattaaacaaagaaatgccgttaataaatctaataatcgcattcgcaagatttgatttttaattattgctcaacaaataaaatttgctgacgaattttgcactgacggagattccgtagagacattttctaagacgaatatcaccttttttgactcaaaattttcctcagcatttttttcggctttcaaattaaaaaaaattattaaaattcatttcataattccttaaaatgccatttggccattggctccctcagggaatggcctttccccgtccaattggccgcagttcggccccatttgtgggcctggggtgccgacaaagagcagtcagtgctcttccgttggttcggcgtcggccttttctcttcgctttccatgccaattatttcgcccggttttccccaacaaaatgccggctttaacatcaattttcacacagcaaagatcatacagaaagcgatgcacgaaggtcattcattcattcaaacattatgaattgttttgaaattaaattgcattttcagcattggcacaattggggggaaacccgtcggtacataattgggaaaagctgcttcagaagagggcattcagcgacatggtataagctagcagaaataggacgaacttcacactttgagcgaaaggattttcagttttcggcatttttggaaaggattttaattgtatttgtggtgaattaatttttgttttcctaaattttttgaaattgttatttcaattttgtcatcctaaaattcattccttggagggttgaataacgttctttcaaatattataaagagatcgcctctttccctgaaccccaattaaataattcattcggttacggtaattcgtttttactttcgtttacagtacccgcacagtttcgccattgaatgtgccgcctcgagcaaagagctcagcgatgaattttgcggctttgttagcacccgaattcgcgtccaattgctgaggagcagcgaatgcgtaaggggcgaagtgaacttttgccacgcccgttcactggtcgaatgtcccgggcacattctcgacaaatacaaagcgtgaggcccaattattatttttaaaatttaattatttgttttattatttataaaatggacatttctcgaattcaaaaaaacagcttaggcaccaaaaacccatcaaaaaagcaccaaaataggcacaaaaaaatgaaaaatcagcaaatttagcgatttttgagaaatttattgcatgtaccgaaccgtaaatgtcgaattcatatttgtcatttcctttttatccacaaatttcactagcgcggagatgaaggagtggcacaacaaaaaatattcgcatattactagggctggaatttttatgtgctaaaaatcctgaaatatgtaataaaatatgtgctaaaaaaacccaaaatatgtgctaaaaaccaaaaaaaaggcctaaatatgtgttaaaaaatgcaaaaatatgtgctaaaaattggaaaaaccaagtgtatttacgcaaaaaaaaatcatatttaatatcagtctttatcaattttcgcccgacctccaatcaaaattttggcgatatcaatcaatttgtaaagtcccggattaatttttccatcagttgaataagttccttccgggaactttgaaatccagtgacgatttaacacagcgtttgatttggctgctttaggcatttaaatatataaagaaattttctaaatgcttaagaaacgtaaaatagtcaatttttagggtgcattttcagattttcttgtattttttttacgatttttctcaaaaatgccaaaatatgtgcaaaatatgtgccaaaaccccgaaatatgtgccatatgtttttatgtgccaaaacgccaaaatatgtgtttttatgtttttataactcgctctaaatcaaaaatagtcggagaaaatgctatttttgggcttctctcgccataaataggccgcaaaaaaatatgttaaaacataaaaatcccag

SEQ ID NO: 16019 - DNA, 1485 bp, Heterodera glycines
tttttcgattttttaacgaaaaccgttcgaccgaccctcttgtctggtctctaatcatcacttttcaacaagatttccatccgtagtctttctcaaactttcccctcccctcccctccgactctcgccgatttcttcatttgatggacgtgttcaatcggttgctccctcggccgggcaatggcaatgttcagttcaaaaaactcagacatacgtcaaattccgccagcattttcgcatctgacgaagcgacgggtgacaaacagcacaacgacgaaacaacgaacaacggaatgatgccggcgacgaattcgccacgggttgaactcggattgatgctgagcaacatcagtgctgaaatgcgacacgggcaaaacagcgcaactgaaggaaacggaaaagcgaatgggacggggtgagaggaaatgaatgaatgaccaataaatatgaaataaaatgacaaaaaaggaatgcattattataataaatgaacaaaatgttatgacaataaaaaaaaggaaagaaaacgaagcccaattcatagtcggacgacaaccaactcgtaacaatgagtttgatttttgcaggaagcagaataaaagctttgtggaagaaaaggccaatggaaacggaccgtcgtcagaagtgaccgctttaagcaaagggaaaagcaacggaacggccaaaggcggcggaaaacgctttctctctgcgcttttgccgggaaagagaaagggacgacttggcctttcagtttcggagcctcgactaaattttgacatcgaaccgtccaaaaatgactttgagttcggcatttattctgagagcacatttcattctttcttttttaagacccacggaaatcgaagggggagaaaatgcgaaaggaggacaaattgcggaccatcaacagaattttggggagaggaaccgattatgcgatggcatttcggacggaagtcgcaaaagtcggccgaattttgcaggggcacttcaaaaggtggcattttggagaatacgctttaggaaatgttatttgctcagtgcttttccatctcacaacacattcattcttcagtacaaatgccttttacacttcgataggtccgtgaaaaattgaacgttcgtccgtcgtccaattcccaccgctcctccgccttttctcctccgatgaatcgttccaatacgacgccgactccgttttcttcaatgcgaactccaacaaacgacaaaaactttgtgaggaataaggaggaaagaacggcgacggatgttcgccagcagcagcaagagggggcgatgttggcgaagttgcggaaacaggtggccaaatcaccaccaacccaaatgaccatttcgatccaattgaccaccaccccaacatcacaaaacccaaacgaacacaacccattaacaacaaacgaagtgacaatcaaccaaatgataactaaggcccggaattttagtcaattacttttccccgctg

SEQ ID NO: 16020 - DNA, 2289 bp, Heterodera glycines
gcacgaaaaacgagttgaaatttatacatttttatggttgtcacccaaaattcatcaattttcactatttttaaccattttaactgtaaatcattatcaaaattaggaaagcttaattcaatttttaaatttaagaaataaattttgaaaatctaaagaaataagctaaaatatttttatttcttattttttaaatatttgatttgccttctaacaccgaaaatattttattttaataggaataatcataaattattccggaaatattttattttttattatgatttttcaggacacaataactgacaaaaaatgcaattaataccagaatatgtaattcaaaaataaaaaaatattcaaaatttatctattaaaatattttgttaaccaaaatttttgaattacataattataacattttaaaatataataatatccctatttataaccaggaaaacaatttttacaaaaaatgcccaaattttagaaatagcgaaaaagccaaaattttcatgaactttgcctttttattcttatataatttcctatgaccacaggctaaaataatggacatcgttggtcgaaaatcaaatggaaacgcgggcaaaaatcggaaatccgacggccagcggttgctgctctctgaggatggatattgctcggggctcgagtgattgcgaacggacggactaagaattaaaccgataagacgacacaccgattatttgtccccacatgacttaaaacatacataatggaagaaaagcttttacttttattcttttcatttgactttttcaatttgacagttaattttgtataaaaaataatttctattataaattaaattcaaaataatttaacgaaatattaaaaagtattattaataataaaaattatagttggtattgagggtttagcatgtgaaagccgacatttaaaaggttaaaaagattcaaatgcactgaattgaatagaaaataaggtttcgtgggcatttcgtgtatttgaatcgatttttgacaatgaaggaggatttgtgaaaaatcaattttcgacattagttcgaattcgggtccggagttcgaaattagtcgaaatggaggtcatattcgtggtcagcgaccccgaataccctggaaaacaaattttatcataaaaaaggggaggggatttaatctttttaaaatttattttggcaaataagcttgataaaatggttatttttattgttttttgaaatatatacctaaactaaattatttttttttcgaaattaagatcccgcgctgaatagcagcttttaaaatgctggatttgcgtgcattaatcccacgagatcccatgtttttttccgtcatatcttattgctgatgtgacatcgatcagagaatttgtctcaataaaaaaaatatgacatcagcctctcaattaaattgcatcagagatatgacatcatggaaaaccgcgaaatttcgacagtggctgatttcgacagagaacaagattattattttattattaacctattcacattaacaagcctgaacccccggatttgctcgaagcagtttaaaattatagttaatattataaatttttcaaatttgatgcagtttcattgataaaaatgatattttttttgaatttttccatctttttcagacacttcgccaaaaaatattaaaaattaatacagaaaatacaggattttaaggcctgagtagtgacccctgtacgattgtcgccccttttggcgctaaattcaaatttgaattttcgtggtgatactctgtgggagggaggacgcgagccttgggagtggggagggacgcaagccttgggcgtggggaggggcacgcgcgcgccgtggggaagggtgtgccgtaggggagggttgtaaaatcaattagatgtgtatgattttttatggtggaaaagcaaaggaaatggcataattaattgttaataaaaagggggagggggtaattaagagtacattgattggtgtttgatcggatagaaagacataggaatggtgtgatgagtgggagtattggaattgattgtggggagggagatcatttcaggagctgatcacacgtctggcagttggggtcacatttttgccccacgtgacggatcatttcgagcttccgcttctccctatcggatcgcctcgctggtgaagagaccgtggacgacgacgacccacagctgctgatcgaactggcggttccaggccgcgacaactcacaatgcgcttgcaccttttgttcggggctgatc

SEQ ID NO: 16021 - DNA, 1218 bp, Heterodera glycines
tcaaatttagcataatgttttttttgctgttctttgcaacttttggttgcgccgttgcttttaatcagtattcgatttcaatcagcatatggccgagccttgacacttcaaagcatcagtattacgtaattttggaattctaatcgaataaatataatattaaaaagaaataacgaacaataatttaaattgttttaataaaattaaggccggaatgaaatgtccttcaaacgataaattctatccaatttatgagccattagtaagtcgtttttcaactcaagaaggtgaccgtgctgagctgtgtacggaggaactccccgctgatgaagaatgcccggaaggtttccaaattggcatttcgatgttgaacggacaaaaagaagactttacatggcagacttgggtattacattaaataaaaataaattttgaaaaaacagcttattaatatgacaaagttgattccttaggattacaagttttgcaactaattaaccttaattaatcaataaaaaaaagttttggtaaactgaagagtaaatgaattttctcattcatttaattaggaaaatatttttgcttaaatgatactgaaaatttgtacggtcgatttgaaaatttatgccaaatttattcatgcagaattaaagcaaattgtttaaaaaacaacacctgaatatttaaaaatttatgcataaaattattaaaaaactaaaataattcttatatagggcgcattttgggtgaataacatcaaatttggagagaataacgttatgtataaaaaagtagaatttggcgttcatttcaagctggatatatccccaaaattaaatgaatcttcgaatattgtctaccgagtgaatgtatattgcgctgacaacggcaatttggagttcaaaacattcacaaaatctgagacagatgtggtgttcagttccaattacaaaacctacgagcaaattggggcagaatatgtgccttccagctcagaggggaaaaaatgtaaaaaatatcaagtcaaagtttggccgagcaatgagaaacggttgagttacataaaagagaagcaagaagtgggaaatgcggtaacaaattccatttgttatacataaaaaaagcttcgtaaatctgcggcctttgtttaattactagagtagagcgggaccgggaattcccggtcatccgaggtcccggtcccggattttgaaaagc

SEQ ID NO: 16022 - DNA, 1455 bp, Heterodera glycines
  misc_feature (1442)..(1442): n is a, c, g, or t
  misc_feature (1448)..(1448): n is a, c, g, or t
tttgtttattactagagtagagcgggaccgtgaattcccggtcatccgaggtcccggtcccggattttgaaaagctcaggtcccggtcccggtagggcaaccgggaaccgggaaaaacaagcactggtaagaatgggggtctgagtgcaaaaattagtgagaaaattggagtaaaaggaaaaaatttagaaataataattaaatatattcgataaagtagcacgaccaactgtgcaaatgacctagtggctagtctccttcactttcccttcttctttcccctggttcattccctctacagaaattaaaatatttgaattttctttttgtacactcatggctttcctatcgacaaaatatgattcttaatttttttaattgtattttatcattttttaaagaaaaccgtacaaattgagcctagtaatctcaaaaaccagccttttttttttgttgaaatttgttaacaaatcacactcaaattttcaaaattttcccggcggcgcctatcggcaccgccggacccccttcttccccaaaagttttctggaaaaagcgcgccgaaaaaagtgatgtgaaaagtatgtaaatctgaatttctattaatattcgatcatttaaagtacaaaatgattgttggttgaaattagtttgaaaatttttattaatttaaatagctttaacttttggattttataaaataaaaaccaaaataaaaatttaattatttaatattttcacttgaaataaattaaaatttgaatttttttttaattttttgaatttttaaaaattcccggttggtcccggttcccggtcccgaacaaaaatcgaggtcccgtcccgacttctcaggtcccggcaagtcccggtcccggttttgcccaaaattcccggtcccgctctactcaattaattaccataactttgctcaaaatcaatatcgatcttggtatcattaataactaactgttttttagcctacaaacttcaaataatgaaaaattttgggctatgtaattatttactgaaaaaggccccgttggtggtttttatgaacaacttagtatcttatttattgttaaagctttcatgagaactacatttagctcttggaacccgagtttgtcgcaagcggtgtgattacaaatggcaaattatataacaatgttaaattcccggttcacttcaatttgatcattgagccgtcgttggaccatgaggcagaaccaatttattacgtaaaagtaaaatgcaatggcaaagaatcgaacacattcaaaacatttactcacggcaacacgaaagttgtgttgaatgtgaaaggttgtacaaaatttgacatatcagtgagcaaaatggacagagaaagtgaaagccccgaggtgcgaatgaatttagtaattttacattaaaagtttttatttttgataatttctctnatactnattatta

SEQ ID NO: 16023 - DNA, 2534 bp, Heterodera glycines
ggggacctctagagtcttggtcacattgtaccaacatctgagagaccaacaagtgctccatcaggtgcatttgaattattttccatggaaataatagaaatatcctgtcaaggctcaacaaatgccgtcaatttcggctgcaatgattgccgctgcctcagcgtcaacccaatttcctccggcgacactgtcaaaatgtaagacacattaaggtatttgctgatttttcatgtcttttaagggcactccattgttacgcctccttcttcgttggcccagggaggggcactcgaggagtttctccgtcatggtctcctggcaccgcaggcttcgtcgtttgcgccttcttcgggcagaggagcagaaagtgtcgggacgagcgcaatggctgctccaacgtcatttgatgaactgtttcaacctaaaatgtccaacacttcttcgtcccctcggacctttccactgaatcagccacaaatgcaccagcaaatactagcgaatgtcccacagagaaatgccacgggcacaaacatttcacatcagcaacaggtggaacggatcaattgtagcacgggaacaaccccaggcatttgtctgacaatgagagggtgccggaaaaccaagcagtctatttccggtactattgcatttgttttttgtttagcaacggcagcaaacacaacaaatttctggggcgtctgcattaaataaacaaatgcacacggaccatcaacaccggcaaccccatcaagcagtgcaacaacacgcaatgttggggcaagctgcagagaaacagcaaattccgcagcaaatgcaacaacaaattctgcaaaatccggttcatcaacaacagatgcagcaacagccccaaattcagcaacatcaattggcccacaacagccgcattttgttcacacaaatgtgccgcttcagccatcgccgcaacacattttgcccattgctgaaccgcaacaacaccaagaacaagtgcaacagttagcgcagcagaaaatggtgaagaagcaaagcagcgcaaatgtgagcgggattattgggcgagggaagcaaaagaattgcattaaatgtcaaaatttaacagaaatacccagtgctgtggcaaggacaattggcaatgaaaaacgcggacacgctcgtccaaatgcttaaggtgtttagttgggtggaatggccttttgaatctccaaagttcacaggtctgtggcaatgaatcgctcgtccaacaaatgaacgccgaactttcctcggtcaacgaaaacggaattcccctcctgcgcattaaccaacggatgcgattggagcacactcatttggaaagtgagaatagctatcaaaatgggatcggtttaaaaaaacctaattgtcccctactgttagatttaatccgaaaaatggagagggaggacaaccaattggcgctgatttgtgttccttgcggccgggacagagaggacgtggtcatccaaacacagaaaatgaacatctcgttcatcgagtacttcagttcgaagagtgccgccggcattgtcagctcgggccccgtgagttcaattgttgcatttatcatttgactggaagaacgacccatcaataatagactcaacagccaagcgcaatggtggcacacatttttccgcccagtgatttcagtcggatgctcctgtcgcgaaatgcgccgaaccttttgaggacggtggagagtctcaacgcgggatacctctttgtgatactaaccaacaaatagagcactgattttgccgctcattcataccttcacacttttaattgttttagggaatagttcatagtttattttatttgttttccctgctaattctgacatttcctattccgtgattcggtgtatataactgtacgtttaatacatttattgtatgacagtaatttaaacaattcaaatgataaacctaagaatgtataattcggaggatgcttcaagtggactcactttgagagtctgtaaaatacgctaaattggcgaatattgttgtcgttggtaatccgtccattataaattcatttatgtgtgtgctgtgtgcctccgtggataaatgaattatataaagggtcacaaaaggttggggcgagtgagtattatttcgaaggagtgcctctatcaggggaattgggaagcaaaaattacgccgcggggcactatggacggagcctaataattggaattaggaagagcttggagggggggaattactgcccctgggatttgggccatcttttggcattgttttggcaaaacgcttttatatgttcatctgacggagaaacggcatttctcgagaagcgcaaatgaccattggcaaaaaaagacgatttggcacagtccaaaaaaatggccaaattttccgctgtcgcccctcccccccccccccccactgacatcggctaacataaaaaagccaaaaaaaagggtaaagacatgcagtgcaaaagggggggtgtgggagtgatgggtccgtccgtccatcgtcccatgacag

SEQ ID NO: 16024 - DNA, 1198 bp, Heterodera glycines
  misc_feature (1171)..(1171): n is a, c, g, or t
gaaaagaaaattcttaagtaaaaaaagagccacatatttttagacaaatgagattttttttatccgagtggatctagggttaggcaaggggctatataaatgtcgtattcgtattcagcgaccccgaaaagcctaaaacagacccgttttccggctttttatgagctttttagacttttggacaattcgtgagtttttactcttttggacaattcgtggcttggacaaaacgtggcttggacaattcgtggcttggacaattcgtggcttggacaaaacgtggcttggacaattcgtggcttggacaatttgtgggtcagcggaaaaaagtttgtacaattgaattttttatgtgttttgctacctaaaaggcgttaataaaaattattttcgtgcctattttaggatttttctgcctttttaagtgcctatttcgcgattttttgtgcctaaaaatcccatccctatacataatggattatggcttttttgcaaagaaatttaaataaaaattattttactttaatttaagctattatttatgagccacccaatttggcaaatcggtctttttaaacgcattaaagaagatttcagtcgattgcttggagtgtaagcaaaaaaacgctattaatttttcatcccccctccctatgatcattcacacattcgctgactgctgatccgtcttctcattcctttaattttagcctttcatcatcgctttcaaatggccaatgccctcccaaattgcgccggtctttccggtaataaagaggcgccgtcggcttttccctcgccaccttccctcccccctcactctctcatccatccgttgtcttttcctctgtttcgtcctctctcctcttttctccttcctttccctccgcccgctctttttctctcgccccctccttctctactcaactctctcatccgctatttcttcactttatccgccaattcatttcctttctcttcatcggcacattctaacagttttacgagcatcgaatcgctgctcagtgagggaaaagagcggcacaaactgcagaaatccccggggggaacggattacggtaagtcactggcaaaggcattgcaaatgcctccaaccaatcgctgcgataggtgtgccgtgttcgtcttcggcacaaagagcgcttcccanaggggcagcagagaaaggcgaacaaag

SEQ ID NO: 16025 - DNA, 1174 bp, Heterodera glycines
attttcgactttttgttagaatttgagttcggggtccggaattaggcgaaatagaattcgtattcgtgatcagcgacccagaaaaccgctgtaaacatattttcacgatttttgaaattaaaaaaagttaaaaaatgttcgaattcgggttaggggttcgaaattggtcgaaatggaggcctgattcgtgctcagcgcctcaaaacacccctagaaacgtgttatagggattttcagaaaaaaaattaaagaaaaaactttcgggaccaatgatcgacatgattgcctaaaaaccatttccaaacccatacataaaggttcaccctttgttatttttttgggggctcccaacagcaaaaatgatttactctcttttgaagtccgtccgtcaatagaatttgatattttaatgggactgccgaggagatttacttgtcaaaacgacgtcttttcacttcattttatttaatattaaaatgcatccaatttaaaaattttatcaatacaaaaaccaaaataaatataattttaaactttgccaaaaatttaattcaactattttatttaacataatgatcactagggatgcgatttttagatttttacatatttttttcctgagatccccgtggcctgaaacgcacgaaaaacatgtttttttgggctgttgttaagctacttttcgagttattagcacctattttctaggtttttatttttagcacctaaaaaacctaaaaaaaattttaaaaacttattttcacctattttggcattttgcccaaaatttgttaacaaaaatacaataaaaagaaaaatacacccctaagaaccgacccaaaaattttttcaaaaaatacatccctaagaatcgaccagaaaattttcaaaaatgcgcccctaagaaatgaaaaatttctcaaaaatttatctccaaaatttatttattttattttcttgacgataatttttgattttgaaaattatgtatctcattaatgatttggcgtaatatttttgccttttgaagaaaattttcgattttacacccctaaattcgaaactttttggcacctattttcccatttttagcacctattttggggtttttttataacttaaaacctacctattttggcagtttttagcacctaaaaatcgcatccctacttat

SEQ ID NO: 16026 - DNA, 2036 bp, Heterodera glycines
  misc_feature (1930)..(1930): n is a, c, g, or t
  misc_feature (1947)..(1947): n is a, c, g, or t
tgacggtttgcccgggccaagcggtgatcagcaacaagcagaaatggatttatcgcttgactgatgcaattatatgctctaaatgttgtatgtacactgttatttgagtgtcgttgtatttgattgttgctcataaattcataaaaagaaatgagtttgcttatttgttaaccaatattttgtaaagtaaaaaacaccccacagctaaactgattatttttaatgacatatttcattaatagggcccggatttttatgtgctaaaaatcctgaaatatgtaataaaatatgtgctaaaaaatgctgaaatatgtgctaaaaacccaaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaaccccaaaatatgtgctaactagggatgcgatttttagatttttacatatttttttcctgagatccccgtggcctgaaacgcacgaaaaacatgtttttttgggctgttgttaagctacttttcgagttattagcacctattttctaggtttttatttttagcacctaaaaaacctaaaaaaaattttaaaaacttattttcacctattttggcattttgcccaaaatttgttaacaaaaatacaatttttacgaaaaatagacccctaagaatcgacccaattttttttcaaaaaatataccccgaagaatcgaattgaaaattttcaaaaatataccctgagaaatgaaaatttctcaaaaattcatctacaaaatttatttgtttaattttttgacgagaattgttgattttgaaaattatgtatctcattaatgatttggcgtaatatttttgccttttgaagaaaattttcgattttacacccctaaattcgaaactttttggcacctattttcccatttttagcacctattttggggtttttttataacttaaaacctacctattttggcagtttttagcacctaaaaatcgcatccctaatgatcactgagcactattttttgaaatataaaaaattgaataattttaaaaattaaatttttttacaaaaattaatgttagttaaagagttagtagctatccgtatcatagtttggaaacaaggggacgcagaaggacatgagtttgaccgctgcactgtcaatataattattttttctaaaaacataacaaaatccgagaccgataatgcataatttccgaaaacttaagcatctgtcggttcactaaagacgcgccgatgcatacgcagtattatccatcttaaaaggtagctttgctaatcgggaaattatcgcatagtaatcattcgattcttggaccttgatgcttatttgctttgagtagatgaacttagcgttgagtatggtcccaacataaggcatcatatttgaaggcagagcggtagacgccagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaatgcgaaaagcgaaacctcggcccatccctggtagacgccctccccgcatntgtcttattcgttcttnccgcctctctggtgttatcgccgccatgtcgaatacgttcgaaagccatctttttgctagcttaatttatatttaccaattcaaaaaca

SEQ ID NO: 16027 - DNA, 2772 bp, Heterodera glycines
  misc_feature (5)..(5): n is a, c, g, or t
ttttncaattgatcaaagtttgcaacaaaaaacagctcaaacatcaatcacaaaaaatgtgattgattggcgatccgacagatggtttttgagggcggcggcgtacgtatgggggggccggtgcaaggaaaagcaacaatttctaatgtgttcattattcattcatttaatttctgtcattcttctgcggctaaattcaccattttgtctctgttttaaaaataaatacagtatttctttaaattttttttgaaatgcaaaaatttgttcaccgctcttcttgtttttttccttcaatatgtcttcgaatgaacacaacggcagcagtgccaatggcacaaaatttccgccttttttgccaccaaacgccaccatccgtcaattcggacggttccgaggcgaaacggcgccaaataaatgagccaccaaaggaggggtccggcggaggtatttttaatcaaaatcatgaaattggacactaattttttcaatttgttcagctccatccctttccgtcgacccgttcggctgggagccgaccaaatgggaacgctttttcctcgtgttgacgcggtgttacgagcgcagtgccgacattcccgcaattattccgttggtggtgcaatgatcagaatttaatttgaaggacggggcgggtgggctaaggctgtttagatttttagttatactttcctacaatccaattacgggagtcatgcattgagacccctactcacaaacagaggagtgggtcgaaacctttcggtctcgataattctaattcagaaaaaaaaattttcgacccattttcatgccctgcctaaattttttaaagtataaaaactccaaaaatggtttatatttttactatcacagagggggaggttaataaaacaaattatgatgagccacttataattatgtgattttttggtttcagtctccgagttggtaaacagtacacgaaacgaatgcgcctcctccgcttttccttcgctttgctggtcgcgatcatcgtctgctttggggccgagttttacatggccaggtctccccagacactttgataaaaaacaccttcaaaaatgccaatttgatattcctcttctaaagcacataaaacggctctattgcagtttacacgaccataaaaaaattgacaactttaatgcaagcaaaaaaaaaaaatccgttttttgcaaaaatttggttttgtttttggttgtataaataatgcaaatttcgctgtttttcagttgggaccgacgcatgcgcaggggccaactgagcgatagcgacgtgaaatttttggaaaagatgcgcgataaagctagatgacaaaagagacacacacacacacatatatatattattttttcgttatgatttccaaaatatttaaaatatctgaaaaaaatatctagggttttcccgctttggattcttaaagaatgtgcattgtgttgttttttgaatatttttccatctgtccattcattcattatttaccatttaaattcggttttagcccccttcccgttaattcgacttttggcaggcaatggcttcgtcgtggcggtgttttcggcactttttctccacttcaaatgcgcgcgcttcgtgtcgtccctttttcgcagcattggccgccggcgcgacagtggcaaaagtgccgaagtcggcggtaggcagcagcagcgaggcacggtttatgtgttcggcaggcacttttttgccaaatttaaatttttttagcaaaaaaaatgataaatttttcaggaattattgcccaatgatggtgagacaacggcggaacagacgaagaagggcgaaagggaattgacagcacgcgaaaagcgttttgacacgacaaaacacggggtagggaaatgcgtaaaatttgatgaaaatgaattggaaaacgaattttaaatcgaattattaaaagagaaaaatgcaaaaatgttttttttttaaattgggcatcaaatttattggagagagacttcacccattagactgcaatatcctaattaataatagcaattagtgacctaaaatttgttgtttttgatgttttgtctctccgcccgtcccggaattttttttaacttttttttctatcataattttctgcgctgaatacgaatccgagtttgtttccacgtgtggctcttttctatagcatgggagcagatcgtttcctgctccggaaatttagaaaaataaaattttatttaaaaaaattagatggagaaaaagacaggggaatgaattgcgcccctttggcatgacaattctcttttatcctacgctataatatgacaaaatgattagcgttttgttgtggaaatattaattcccaactcctccatcaccttaaattttttaatattcgggttttcccttttccaggtccccgactttcgccacgttgccgtcaccgatcagatacaaacgaagcgaagcgtttggcaagttccggtggccccacttggaatagtggcaaccgtgtaaaatttattttaaaaaatttcatgaaaatagtgaattttttgcaaaaaatcaacgaaacaatttttagaatattaaaatttatttttttttaatttttggttgaaaattggacagtttataatacactaaaaaaacattatttatttttgcaaaaaagtgacaatatacgatgaatttgcactttcattcttttccagggccgctttgctgtacgaggtccactcctcctacaggggcaacagaaatgcgctgtta

SEQ ID NO: 16028 - DNA, 2698 bp, Heterodera glycines
  misc_feature (1058)..(1058): n is a, c, g, or t
  misc_feature (1096)..(1096): n is a, c, g, or t
  misc_feature (1104)..(1104): n is a, c, g, or t
ctgaagacttatgaccacatatagaatttgtagtggagtagtaaaagaactgactttcacttaacaaattaacatttttgtctaatttcttggaatatctattattttctataaaattgcgatctcatcttctattttctcaaatagtttggtgtatattgtcattcaatatttgtatttttcaatttatctttttgttacttatctcatctttttattttagtaaatattttaaacctttattcttgttttaattgttctttaaatttaaaactttatttaaaagacaagttgatatttgccattactatgatttttaaattttattccatcaatttatccgtcattatttttatttccgcttaaatggtttggatttctaattatgttaatttttcaaaaataattatatttacataacttgccgtatcaaaattaggagttttaagttcatttgtgcaaagaactatggccattgtctcgaatttttagtgcattcaaaaatgtttgacaatgagaataattgcaggtggtgcctttaagaaacatttttggtaaattaaatgtaggtgttgtcgagcgaatgattgattagtcgatcatttatttacttattaaaaatgattaattatttatgcgaaattattcatttatgtatttattttcttttatacaaacaattttcttttaattttgtttaaattcaaatattttcttttagtttggtgcccgattatttttaatagaaaaccaccaatcgctttttctgcttttatttttattgctttaatccatcttagttttatcttttgtgtttgttatgcttgatataataataatttattcaatattaccgtgagtcttttattagtaagcagatagaatggattttaatttttttgctaaaatagattgaattaattcaggaatgtatgtattctttacaggctgccagatgtgctgcattttgctgcttttcaatggccaaagctgcttttttttgagatgctgaatcggccaaatttgatttgtaaatgaaaatgattggtccacgtcancagatgtcagaggaataaatttctaaaaaggaattaangtttggangaacatctgggtctcgtggttttttcgggacatcatttggccaatttgcgaaatttttaatttccgtttttctcggaccaaaatgccagaaaaatttttctacaaatgcttttttagtcatttgtttatttctcttaaaccaccccatccgaaaaacgagagattaaaccataaatagagagtgcagagaaagtacacataacttttagcgtacgatttctttatttccgttataaaaaaaaactgaatttgcttcgctctataaaaaagtttttttacctttcaaattttctttaaattttgcataccgatagagaaaaaaaatcctgaacaacagctaagttttaagtacaaaaaaagagttagcaaaaaattattaaaacccaaatttagaagcctcattgaaaaaatttcttgaaaattccattttaattattttttcgagcaaacattaaataaaaatgttaatgttgtagagcggagttgaactcccccgcacttttttcctttactatcttaaaaaaccacttagccactcatacaaatcttttttgttataggagctaatttttgtaatgatatgtaaaatataagaattttattttgcgtaattgtcggcacatcacattcaataaattaggggatatatttttttgattcgatgaattttcgagtcaatttcgaaattaaaaaactgcggtataaggcgaaattttattttttaattatttgctgtcttgttatttttcttcttttagttaagtaagtttttaatacgtaagaaatagaaaatagatattgattttttttttcttaaaatcagcaatttgtcccccgcaacccccgcccccgtgaccttcacccccgcgggggcgcgggggtgaaaatacacccctaagaatggcatattcgtgggatataaggcaaaaaatttatacaattttgaattttttgaccatcttgagcaattttgcttatattttttaaatatttgtggtttagtggttagagtttcagcactaataggattctttgttatgagttcaacacctgttgacgttttcctttttttctgattaatacagggtttctttatgttcttgtttctaagaaatgttctgatttgggggtaatgccttattttcatctaaaagaggaaaatttatgaaaaatttggctaacaaataagttccaacaaaattgatataaattcttaaaatttttcatcaagttttttggaaaaatgtgccgcaagaaaaaattttaaaaaatctgagttccaattttccttgagtaaatcatgataatttaatatagctaaaaaaacgaaaatttagcggaaaaatcttaatttttttggtgaatatctgttaataaatttaaaattcgctcctatcggcacgccggcccaccaaaaaaaacctattttttcttaaaaaattacccaaaaatccctaaatttggttattttttagtcaaaatctgtgcaatttatgtcaaaataaatagaatcaaggcgatcaacgaataaaggaatgtggagccaaagaaatcattcataaaaaataatttttttgtgagattttttggagct

SEQ ID NO: 16029 - DNA, 2481 bp, Heterodera glycines
  misc_feature (14)..(14): n is a, c, g, or t
aattctatcctttntgccatttttataagagacattcgtatgagtaagatagaaagaaagacggaaatttaaaaaaaacagttaattcaaaagcacttttttatttttaccagtttcccagtgaataagtaaaataatcagtcataggacagatcatttgttagatggaggaaagtgaatgaatgattaattaaaaaacaaatggaacagtgacaaattagtaaaacgcattttacaatttatttgtagtcagtaaataaaaattccatcagagagacattcaaaatttaaaaaaaaaatgaaaacgatcgcactctttgcccttttaccgctaattgaaatactgctgatcgccatggtcaaccaatgtttatgtatgtttaaaccaaaattaccagcttctaatttaataattaagcattgacgtgcaaaatagactctttcattgaaattaaataaaaaagtacagtacacagacaaaacaacttacaaaaacaaagtcccacaaatccaaatgataaaacacagcattttaattcattactgttcgttcgtacattgaaaagggggaggggtgatttaatcaaattacaaataattcattttcttcggtcatcagcattttactctaaaatttttgaataatttttatattttttaattacattttttctgggtgatttgattgggaaaaattatgctttattcatttaattgaaaatcatataatttttaggcattgattgccgcagtggttacttctttggtaacggttacggtcgaactgaatccatggaatgcgctgggggaaaagactgctttgcggccaaatgccacaatggttcctttttatattaatttcatttaaataaaatatattcacaaaaattgtcagcttcaaatattaaaaatttaaaaaattttgagtccggaggtgccgccgatgtctagagagggttcaaaggaccctacttacgggttatgtcgcccctataccccaaaaatgtcaggatccctatagttttacggattgatcaataataaaaaagtctagatcttttggaaatacaaaatagagaggatttcgcaaaattcagatttttctttttcacagcttcagaaaattacaccttctggggctgtaccgtggaaaacgattgtgacgcagtcagtaaattccttgcatttgaaaaatgcgaatgtttatttggtattaatggtttcaatctttcaaacttggaaatgttgaaacctaacctttgggctcggtcgataaatggcaccagtgagtaaaactaaatttattatttaaagattaagtatgccacttaaataaaaatttaaacataattaatgacaattaacaaacaatgaaaattttcaaaattttcaggtgtttttttaaaacagataaaatcgttttcagatgagtcaatcccaacaggtgactccattgcgctgcttccctcgctgcttcccattgtcattatggcgctatttggtcactttgttaaaactcattaaaatattttaaaaaaatttttgatttaaagcatttaatttaaataacattaataaaaaaatctaaaagattatataggaaaaaggttaaatatgaaattgtaaatttgttttgctttttttattctttctttccacagcttcgcttttccgtgtgttgttcgggtattttttaaaattttaaattgttgtgatttttgaaattaaaaagataattgcgttgagcgtacaactaactggtgcaagttgcaattgggcgtcgcaaatgatgggaataatgaccaataacgcaaaaaacattatgtttcaaaaatctgtgcttttccattgaaattaaactatgcaacaacttcatcaactaaattatgttggaaagaataaatcccatctttatctgaaaatcatattatttgttaaatcaagatatgattttttaactcctacctttttcggaaaaatgccaaaatatggaaacatacacatttacacttggataaaatatttatctgatgagacccaaacataagtgcaaaaaacgcacaattaaaaatcaattttcatcaaattcttatttccctcaaaacattcttctatcattgatttatccgtaattgtcgtgttgaccaataatcgaccattttcctatgaaaagacaattgatagaaaagtttaataacagcaactacggagtgggccatttcgccatcgcctaaggcgcaataacattttttcccattcattcaacaaaaaggacattttgcgattttttaaataattcaaaacgattcatttgggtggcaaaaaaaagttgtgttgttatacggtggcataaaagggagaaaaatagttgttgtttttttgccaaaactttttttttgtaacttaaaagaattttttttttgaaatactattctgcagataaaatggtagagtttatcttgtaattcaaaatatcaattt

SEQ ID NO: 16030 - DNA, 1246 bp, Heterodera glycines
gtggtgaagtgaaccttcttttatttatcatttgatagcacgaaaaaaacgtcgcccgtgacaaatcgcatgaaaatgttggcgaatcaacagcgaatttttatatacccatttaaactcacaattgttgaaacccaatgacgacagtcattgttattgtttccgaaatataaaagcactgtgtaatacgacattttttgctctccctctatcggaactgttggcaaactgcacacaacgtcggccataaaagtcgtcacctggattgtttaaaactagtgagtgaagttaaaaactgcaatcctaggatgtttttaaaaaatatatttatttttatatgttatttatttatttgaaaatttgagagaattagatataggaactttgaaaccaatggggccgggcacgggaatttggaaaatggaccgggacggaagaaacaggacaaaaaagcttttgcagtaatgatactatggcaaaaaattataattttcaaatataagtcaagttagttgtgaaatttacgcccgttcaaaacaaccagggaccgagcttaggtaatttagcgggcctgggtttaccaaaaaaaaaaatacgggaccgggcggcccagtaaaaattcgccggaccctccgggcccacccggtctcaagagataatattttttgtcaaggttttatccgaaaatacgaaaaaaattgtgctgttgtgagttgcgagcacctgaatgtcgccaccctcagccccgcttgaatcgtccgacgaatgatcactcatttttacttccgttgtctgaaaaagatgaaaaattgtagtaataaataatatattttggaccaaaagctcaaaaaatattattttttagttttttcaacccgagaaatgatgtgttttttctgactgtattcagatcagacagtcaaaaattatttgtcaaggatcaaaccaaacggagagatattcctttgctcgaagtatggtttttttgaaaattaacaaaaaattgtttgttgcttttgcgctaagttattgaggattagtttaaaattaatcatttaatggttttttaacggcccagaatcttcaaaataattaaagttaatttattcggttgcttttttagggcttttataatatttcttttttacgtttatatttaaattttacttttattgcagttaatctaagcttttcctttacatgtttactcacttcacagtcgggcggcaagtgaatacaattttca

SEQ ID NO: 16031 - DNA, 3016 bp, Heterodera glycines
aaatcgaatcaattaatatttggcaaatctcttgggcaaacatttttaacagaaactgaagaccagactttacactctttgtccaatgccaacaaatcaagaggctgaattttatgtgcaagcagttaaactttttcgtcaaattgagcgggagcacatggccaatttcaaaatgagcacatatgattatgaacgactaaaacgcagtaatttaagacaatattttaatcatttctttcaatgtattttgggtttacgttcccgataagtataaaatgttaaaatcatatgataattccgagatttttgatggttttgaaatgagaatcaccgtatctcgagcccgtagcgaaacgggatccccgcgcgtgattttgccgggccccaatccgcaattccgcgtattttgaaaatgaaggattttatgggattaatcccgcgactctgaaattttcaagagtcattcattatgcccaatattttatgaaataattattatcagggaacggaattttaggtgctaaaaaacgcgaaataggtacctaaatagttgctaaaaaactgccaaaatagttgctaaaaactgaaaaactccaaaatagttgctaaaaagttgccaaaaattggaaagcatgccaataaatttgtgaattttgcaaaatttctcatctttatcctttttggttgcacaattgtaaatcaacacatttgaaaattttcaagcgtaaaaatttttcgatcgtccgccaaatcatggccagaatttttgctttttgaaaaacagattcttgggggggggtgcattttttgaaaaaattaacgtcgcttcttagaggtgcattttatttattttttattgcatttttcataataattttttttgttgaaaagcagaaatagttgaaaaatagtttttttttaatttcacaagtcaaaatagttgtttaaaaagtttcataagcaaaaatagttgaaaatagttgctaaaaagtcgctctaaatcgaaattgatcgaagaaaatgtgttttttgcgcttatctcaccatatgctatctgcaaaaaaataggtgaaaacctaaaaatccgttccctgattattatgaatttttatgtatgaagttctattagagaatttatggtcatttattcaaaattgctaaaaaaaccggggtaatgttttcaaaaaagttttcccggattgtctgtcccattcctcttcaaaatttaaaaaaaagcgcgacagaaaataaaaggatacaaatattataataacttttttgaattttattgttaaattttagcgggatcccgcaagtttgaaatgagggattgcagaattaatcccggtgttcctatcctgcaaaatttttagttccaatctcatagcgggatccttcaaattgaaatttccgggctctaattatgagcattcgaaaaatatgtacatgcgctaagcagtgatgatttggaaattggaattcaatgacatccctgatgctgagtataggtgttagagcattttataccattcttaatttatagcattgttaacgagaatgtcaacaaatgaatttatgctgcaaaaatttaaaacaagtaattaatacaggggcagggctcggattctttctttctttcaatgggcatcctttattttggttttaatccttttgaaattttgaccgtcctttatttcaaagatgcccttttatatcggcatttttccccattcccagacagctcctatcggcaccgccggacacttccatttgtcaaaaaatttttgaagaactttctcatgaataagtgatcggtcctttgaaaagggaatttggcggatccgagtcccgaagcaaaatttatttgcatttgaaaatatattatgctttacctttacagttgccggagacaatttaagcactactcgtattgaaaaagagcttcataaattgcgcattgggcctgaacaggggtacggacataaattacaaatttaacacttcgattatgccaactgtatagattgtatattatgttgcggtattcattattggatgcagactcgtaaaaaataccataataaaaattcaaatatgggcagaatccatccctgaagcttaaaataaattttttaaaaacaaccctcataatccgcgggggaaatatggttttccataatttaatgccttaataatttttattgcacataattcttgggattcacgaaattggaaaaacaaaataattgaggtcatcataaacattcctttattgtatcaaattttttggtcgaaaattaaggtgttggcttaaaaccgcaattgagggaaatgaatggctccgtgctgaacttttacgttttgccgattttgcacgacaagaccttttgaaaacggtaaaaagaaattcgaacatatgtgacagctctgtaaaaaacagctattctatctaagttttaatgataacacacttaaattcaccttagcgtgttaattatttattgataaatctttagacactcattgccacacaatgtgccaatataaccaacaatggcaacatgacagagatcgaaaaagaaatgaaagcaatcgaaacgctactgggggaaatttctcatcatatggcagattggattgaagaaaagcttgtaagtattgagaaataatgaaatgtgacttctgacctttttggggtcggaattcaatttttggataaccaaaataccaactttgaaaatttttgggtctggatttccaagttccaaaaattttgagcgttggaattctatggtactcatggttatgtttatggacaaatgctaaaccgagacaaattattgtactttttcttggatgaaattaaacgagctaatattttggcgtttatagtagcattttatgagcttcctaatcatatcaatcaatatttgagataaaaatattttcttggccaaaaaatgtgaaaaattcttcctaacgcaattttgatgcttataaaaaatctttcacaaca

SEQ ID NO: 16032 - DNA, 2107 bp, Heterodera glycines
aaattttttcaaaaaaaaaaaaattttttttcttttttttatttcccggttgaaaattttgtggtaaaaaaatgtgggaggaatttttgaacagcaaaatcgggattttaggggaaacaggaacccataccatttttaaggggaaatattaaattttactaagtaattttgataaaatacccttctcatttcccttgtaacggacagtcattttttggtcgccaatgatttcgagtttctcatgacaagcattggcatcgcaataattctggcggaaatttaaaagtgcctaaaaataaaaaaaacatattttaattttcacctttctctgctggttgtgcaatttttcgagaaaaaataaatttttttgggggggggggggagggaggaggattccacacgaaaaaaataaaaaagttttttcagcaatttgttgaaaattaaaaaaaacttattgttagtaaatcttgaaaattggtcgtaattccatcaaatttttcatttgttttgcatttgtaaataaaaaaccagtaataaaagtaagaaaagagttaataaatcaaccataaatttgaaaaatagctaaaaaaattgtaattttttttcgaaatttaaaaaaatttaagttataaaaaattagaatcgagtatgctctacatgataaaattgggtttaaaaatgctttttaaacaatacccacctcatgttggtcccgttggtgatcgaggagcggcggtggaagagcgggcgacggatgtgcgggagggggcggcgattggtggcgccggagagtgccaccacctccatcagcagcaccggcattggtcccagcagctggaaagatattggtccttttcaaatacgcaaaacctcttttcattaattacaaatacataaaagcgaaaaggagaataaataaattcataagcagagattcttaccacaagtcttctcatgatgtttgaaccattgtggcacaattggggccccacaaaatcgacactgaaaaggcatttaaagataaaatatttttttatatataaattaatttattaattagccataacatttatcccaccctgcccattatttcccttgaaatttctaaaatactttagcatttgtacatttgtttaaaaaatattgttgaaaacccataataatcgcattcaaatcatcagcccttgtcattttccatgaaaataaagaatcaccttttccccgtagcgatgaaggctcatgtggcgcttcaagtaggctttttgatgcgttcgatgtggacacaattcacacttaaaaattaattgttatatttgaaaataaacattttttagatacttactttgaattgtttgaagtcagaatgtgtactgtaatggcgttcaagcttccacacttcgtcgaattccatcgggcatttatcacaacggcggggctgaaaaataacggaaattatctcgggccgaaatcttattgcgatttattaatagattttgtccaataaataaccaattttgcaattttttgagcgtatttttttataagaaaaattaggatttttacgcaccgctggggaaatttttttgaaattttaaatgaattttgctaaggggtttgttcaaattttaaaattttttctctttcccgcttcgcttcgacccccccccccccccctcacgacgaacgaatgggaaaaatatattttttgataaattttttggaattttgctggtttctcaccacttttggcactttgcgtcttctcccgtcgggccgtctgttcttcttctcctcctcctcgtcatccacttcgatgtccgcgtgcgatctgagctggcgaaggttaattgcctggccactttcgttggctttttttggggcggcggagacggcgaaattgacggcgaaagacggacctggaaaggggttatatgttgaattagcgaatagttaaattttatgacaattctcagaagaaagaggaacaaagtatttatttccaaatgtttttacgtgaaagtaattagtgaaatgccgaaaaaacattcgaaaaattaaaaaattgatgagcctaataaggtcccttacgcacggaaggggggggggg

SEQ ID NO: 16033 - DNA, 2022 bp, Heterodera glycines
  misc_feature (943)..(943): n is a, c, g, or t
atttatcatttttttcaaaaaacaaatgcttaattttacttctattaatttcgtgcttaattaggagacaatttcttaaaaaagaatcgattaatttattaaccaatcgtccaactaatgcattcaattaattaattactaattacatcattcattattaattattaggtatacacgttgcataaatcaattgctgggcaaatgcggaaatgggtaaaaataatactaattgtttacataatattctcagcttatccatgcgaaaagcagaaaatctttataaatacataaatttacatttgataaatggaaaaagcattttgaatgcttttccatggagaataataaatcaattgcactttctctctcagctgtttatgaagtgagtggaagagaaaaaaaatgctaatccgccgcgtgtgtaaagccatgaaaaagtaattaatttttaatgattgaaatatgtactgaaggggggggggggaattagaaatttttttgaaaataaaaaccaatgagaatcagtaaaaatcagttgttatgtatgacaaattagaaagtgataagagaatgttgatcagtcagtgatcagagattaattgcatgaaacccaaaaaccggaaacaaattactattataattgcatcattatatgttggattagcgaatagttaaattttatgacaattctcagaagaaagaggaacaaagtatttatttccaaatgtttttacgtgaaagtaattagtgaaatgccgaaaaaacattcgaaaaaattaaaaaattgatgagcctaattaaggtccctttacaccaacacgggagggggggggggttgcattagagggaaggagaaaatttccaaaattggtgaaaattcatttttttaaccccgcataaaattttaattccgccctttttcagtttttcaatgtaatcaacncacttccaggcgttgtcgaaagccctgccactgctgctgaaacgacgactccgtttgtcgatttgcgctgcgagcggcgcggccccgtgccgtccaccgtcgcggcggcgattgttgtgccgttgtcgtcctctgcgattgggatagcagcggaaagcgccgttggaagcggcgctgcttcaagcacatatgacggtagtgcagcggaagaaaacagagatggacggcgccatacgggagcggtggttgtggtaacggcactggaggagacggtgcatgacgaaaaactgcccgaagaatgggctgctgatgccaccttaaagcaatttaatttaaataattttttaaatcgaaaaaagtgccttaaaatgtcatttaatgaaaaaaaggaagaaaattcagtcttcaaaatgaaagaacattgtcgcttttcaatgtcaaaaattaatttcagttctgcccttaagctccacgagggacaacaaaataaaacaaaaaaagtggttaaataaatgcggggatatgatcagtggcgggaccaatgcaattagttttttaaaaatttttctcatagaattttcaacgaaaaattttttaaagattttttcttgaaaaatttctaagttttaaaattttaatggcactcgtacaataaaaggtggtgataaataaatgcggggctaaatgccattgaaatcggaaaaccaccaaaagtgccaaaactctgcaaaccaccaaaagtgccgttctctgctgacaacccacttcgttttgctgttgctgctccagcagaggttgttgttgtttgtagagcaacgaagatgatgaagcggaggaagacgaagaatactgttgatgatgtttgaatttaatggtagaagacgctgaaaaaattaaaatataaaaataatttaattgctttttatttaaaatttaaaattacgcgctctgatgacatattgtggcgcgtgagattttggtgaaaattttggccacacattgcgctgcctctgctgcggcggagtgcgaacctataaacatggagttgttgaaaaattgtaaaaaaaacatccccagtc

SEQ ID NO: 16034 - DNA, 1799 bp, Heterodera glycines
  misc_feature (7)..(7): n is a, c, g, or t
tgtttancgggtgaacatgccaaattcaacgcggcctctgtaaagttaaatgtgcagacaggtatcttaatgttcattttcactcaccgataacaattgtctccttcggcccagtcaggggcacaatcagccaaaaacatagcctttgcttcgtcaattggcggaaattcgaagccattcatttttaacagactgtgcgtgtcctccacaattttgaactcgggaattcccttgaaagcggatgtccagcactgaataagctcaagcagcttttctctaatcttctcaggcgggtccgaaataatcatgcttttgaggtcgtccatgacttccttggttgccacttcccgaatgaactaaacccaaaaaataatattattttcccaatgaaaccctacctttttgccgcaattcttaacacaagcttccaaaataagcaaagcatgatgtgaaatgtgcgggttcgaattgcgataacgcttttgaatgtgttttaatgcttctttcacactgaaagaatctttagtaatcgtcataaaggaaattcaaactgacggcacttcgcctccccttatcatatcaacgcattcgagaatgacttcccagtttggctctatcaacgtttgatcagtggccacttctaaaaatgcaattgactgttgcatctttggtcgtgaaataatcacttacctagcgatctttggaatttgtatgacattatttcgtgtcgttttttaagcaatgttatatacctaaatagtaaatgtctgttaattatgatttggttaattagtacaataaaaaaattaaaagcagagaatcgattagaaatttatcagcattaataagcgaacatatgaaaggaaacaaccacagcttactatgtattactttactatacgttttcatttttcttttatctcacaaaggaacataatgatgagtgatgatgacaaatacctattagttttcaataaataaattgttgtgcgcaaccaaaaataaatttcagaaaatattggtttgtttgttcgacaaccaaagcgaaaaagaattagataattaagagatttattcagttaacaatacaagtgctttattcaatcaacgcaaaagaaaaagcagatctgtactgttgcctctcccttgtctctaatttcaattcagccaattcctcacgagtgcaccattgataatccaccacattgtctgaagtcatgtcaaccagtgttatcggattcggcatttttcggtggattagaacaggaaaaaagaagatctaaaaattccattcaaaatccgattctaatattcatttcgactcaagaaccccggacccaatttctaacaaaaagtcgaaacttattttttagtctctctcaattttgatataaatacggtttaaactaatgaaacaagcaaaaagtaatcaaagtctggtacttttctagtttaccgggtatttttaacatacattttcagataaatgtgttttagaaattagtgaaaataagttttaaggggttttcaaggtcgctgatcacgaatccgggctcagatcagcgctaccattcactacatgagctgtacagggacaaagaattgataggtttcctgtaccaataataccccattggcaagatgccaatgaggatatcatccatacaatttcgaatttttatttttgtccgagttcggatcaggggttcaaaattggcaaaaatgggtgctatattcgtgatcagcgacccccaataccccttaatagttattttaattaatttctagaacacatttat

SEQ ID NO: 16035 - DNA, 1139 bp, Heterodera glycines
catcggaccctaaacgctgtttcatccggtgggaatatcgatgcactaaatgcgagaacggtgcattaccaagaatttgaaatccaatggccatttgatcaaaatttggaaacatatgagcaatacatttttctgcagtctgaaaaattagaaacacatataaacaaaggaaaatcggtactaattcggtttgtatccacatttttggtcaatttgatttaaaaagacccacccttcgttaaaaaattgcttgaaatctcaaaatttttttaaagttttggatttcggagggggggggggcgggggctttagctccctcagctcctctggctacgacattgtatctggctattttaagaattgtttagggtcagatctaattttactgtcttggcaaatcttttatggtctggtgaactgaaatagagcaggacaaacttgaaattgtccgtaaaatttatttttcgcagaaacaacacaaacgtttacattgccaattttcattaatacctgtcgcaatgtatcatcgccagttcgtattaactgtggtaaaatccatggcgatacataatcagaattaagagcatcagggaaccgttgcttcacaagcaaagccagctttttttgctgcatccttccaaaagtctttagatttttgtcctcatccgtcgttgtttgtggcgaatccagtttgtactgcttggtaagctgttcacttttctcgaaccaatcatctctaagttgagcagaagagacattaatttcttcgtcaagtgcgctaaggtcccttccttcgttttcaagttgtcgtcgcttctccaatagccttaaagcaaagtatgaaaaaacaaaaacaaaaaagaaataaaacaccgacttttcatctttttccaactgaagttcaaagtcacatttgtaagacgacttctgattggcaaattcagacatcctataaaattgttcttcaacttccgtcattggtggagcaacaactggaggacggtaaatgagcaatgcgacttcaatacgccattttgagggatccaatttggtgtttgttgagtagaaaaagcgagttgaattacgaaccgaacgagaaaaagtcttcacaaacatctatatagaaaataaatatatgc

SEQ ID NO: 16036 - DNA, 2452 bp, Heterodera glycines
  misc_feature (1391)..(1391): n is a, c, g, or t
tgttggagaacgacgtctctctctcactcgggccgaggggagaagagaactctgtggtgtttggacgctctatctcgggccaagaagagtgcatcttagagggatgagatgagtgtgggggaaatgagacctgcgtagctcagtggttagagcatcccgcgttatgggaggtgtcgtgggttcgagtcccactgtgggttgatcttttacacttccgcaccacagagaaatacaacatggcgaccctggcaggacccacatccggatgactcggtgaaatgtacgagtcgcctctccgttctatgctatataccgggccggtgatagcatgtagagaccggggaccggtcttcataaaggccggggatgttggagaacgacgtctctctctcactcgggccgaggggagaagagaactctgtggtgtttggacgctctatctcgggccgagaagagtgcatcttagagggatgagatgagtgtgggggaaatgagacctgcgtagctcagtggttagagcatcccgcgttatgggaggtgtcgtgggttcgagtcccaccgtgggttgatcttttacacttccgcaccacagagaaatacaacacgccgattaacgccgccattgatggccaacaaaatgccgttctgccgaacgcatttggttgctcatagtgccgacagacaaattttaagcaagcataattaattagtttttttgtttgtctgatcattagtgattattggagacatatattgtttttttatttcatattttaaatataaaataaacaaattttacttgcacaaaaaataattaatactttataacaatggagaaataatttttattaaatgtagagtaaattatagaattccataattgagatttactatttattattttctgaatattaaagttaaaaattgcaaaaattagtaaattttttgcataaaaattagttttcacgcaaatttttccctgcacaattttttgtatttcccgatttatagtttacaaaaattgggttttttgaacttttaattcttataaatcataactttttggtgagatgattaatcgcttagcttcagcttatgaagcttctaaacacgtagagctttcgaatgataccaaatttgaagaaattaactgacgaacaaaaaagttatggccatttccatttgaaattgtacgaaacgccattgtacgaactgccttgacaccgattttaggagcgtattttccaaaatattccatttataataaggtgggtataatttacgagtttttttaaaaataaaaatgccgaaatatgcaaaattggataaatggaaataaaaaggcttccagaagcatcaaaccaagctaaaaatactatttatatttacgntgtcttttcttgaaaaataagtttgcaaaaaaaaaaatggaaatccataaatccggtctctagtaattaataaaatagaaatttttcgtccaaccaaatttttaaaaaattatgttattattcatttattttgttgcggattttcttatgtatttgcctatcttctttctcttttgctgatgaccatgatgggcttggcttgttcataagtaaaattcttcgacaaatcaattaaaaaaagaatattttgttttctttttatattctcacattatttatttaaaaattacttttaattaattaattttaaatgtttatccaagcaataacaaatttttttaaagcttttgttgttttgaaacaaatttctaaaaaatttaggtccattaatgcagagctgaatttcctcgccctgaattttcctgggttttgttcagaaaatccaaaatccaaattaaagacggaattcctgtccccaggtccaggcttttttcaaaaactgagcaatagtagtttgtattaaaaaacttattaaaacaaatccctctattaaataacaaattaattttgaatccttgatagtttctgttggaaatccaattaattaatccaataattaatctataattatgcctttttgaaattaatctcatccttttttcaaatatatatttctctcatttttctttgttgcggattttcatttgtatttgcccatcacccttctcttcttttgctgatgaccatgatgagcttgttcatagttgagttttagttgtgctgctcattcagaatataaaacaaaactaagtatttttttgatattatgtcgatttttaggaattttctttttaattttcatggacagataaattgatgccaatgtttttgttacgatttgatcttaatttttactaattggaaattttttaccgctcaaaatattaaaaaacaacaacatgcgttcatagggtttgatgagttttgcccagaaaatccagaaccagcttaaagatggaatacagatccccaggtccatgcttttttcaaaaaattgagct

SEQ ID NO: 16037 - DNA, 2351 bp, Heterodera glycines
  misc_feature (5)..(5): n is a, c, g, or t
  misc_feature (2332)..(2334): n is a, c, g, or t
  misc_feature (2338)..(2339): n is a, c, g, or t
cagcngggtggtcgaatagtagcacgtctctcagctggcgcggtcgttgccgtggttggattgcctgaataagcatccgaaaatatgagaaacgcacgaaaaacaagacccaactaccggaacgttttctggtggatgatacggcaagtttggcggcggatgggcaaattgcggtactgcgtattcccgttgaatttgtcgaacatgaattccctgaagaaacacccagagactgagaaaaagcaaccacaatttgatccaaattgaagtcacatttcgcggtggatggtgaatttgcggcatgtctctcagcggcaacggttgaggcatcggttggacacgaattacctgaaaaaatgcattcgggatcttgaaaaaaagtaacaaaagcgagccaaaattaccggcacatttggtggtgggttgacaaatagcggcacgtctctcagtggtatcggttgttgaactggttggacacgaacggcctgaaaaaagcattcgggaattaaaaaaagcaacaaaaaaacgagccaaaattaccggcacatttggtggaggttgggcgaattgtggcaacgctcttagtggtagtggttgttgcccatcatgaattggtcccacacccatttcctgaaaaacaatgcactcgggattttgaaaaagcaaccgaaaacgagactcaagattaccggcgcatttggcggagggtggaggaattgtggcacggctctcattggtacgggttgctgcattggttgaacacgaattgcctgaaaatgcactcgggaattgagaaaaagcaatcgaaagaaagacccaaaattaccggcacatttggtggagggtggaaaatttgcggcaggtctctcagcggcaatggttgttgtatcggttggacccgaacagcctgaaaaaaagcacgcagaaatttgagaaaacgcagcgaaaatcgacccaaaattaccggcacattttgcggatggtcctcgaattgtggcaagtctctcagcggcagccgctgctgaccaacatgcattggctgaacacgaactgcctgaaaaaagcactcggaaatgtgagaaaaagcaacgaaaagcgagaccgaaattaccggcacatttggcggagggtggccaagttgcggggggatcggcggaggtggcaagagaatttcatcatcttccgattcgtagccatcgtcatttgggaacatctgccgccctaaaatggaaaaaatcagacaagatatttgtggaaaaccaaacaattttcatcctgtggacgatttcctgccaagatagatatttgcaaaatccaaaaaacaaattcaaaattaccaacgatgaccgggattgggaagctgggtgatggggcacgcggggtggaaggaggggttggttgtttggatccgtatcggccgtccagaaactcttttctccattgactacaaagaaaaaatgtaaagataatggaagcaaaataaatgccattacgaaagttctgcaagtgaatttgggtcgtatgctctgtttgggtcaaaatgcccagccgaaaattccccatactcttttgaaagaaacgcgaaagtgccgggggcaataaaaggcatgatgaaagtggatgaaaatggcaactagtgaaaagcaatttgggatgcgtctccgctgctgacaaattgaaaaagtgggcgaaagtggcaaatgatgagaagagaacttgaggatggtgccgctgctgactcctcccactgccatgccgtgctgccgtgccgcggtgacagatccagatgatcgatggaaaaatttgaatatttggggggcaaacgccccgaggggcaagaatggcccccgaccccccgccttaagcgaaatggaattgaaatgaagtcgcttcggccttcccttcatttatatgattgacagttcccgtgtataaaaactgcggtttgtgtgacgcaattatttttgcatctccgcagcgctttaaattttctcgaccgcgaactttgattgacaggtcccgaacataaaaactgcggtaaagtggccgcaattatttttgcatctccgcagcgttttaagttttctcgaccgcgaactttgattgacaggttgtgaacataaaaactattttgaccttgatgcgcggatggcaccatttttggtgcgccgcgcagcaaaatttcgcaacacacaaaaatgcgaataatatttatctgatcaaaatatgtggggagcgaatcgtggtaggggggtccgatgaaagggagggtggggggatttgggaccaaatttgggccggaatttttcaggggggggggggggggttgggnnngggnngggggggggggg

SEQ ID NO: 16038 - DNA, 950 bp, Heterodera glycines
ccggggtgaaggaccaaaggggcccctggtggttgatcaggattggggggcccccagctcccaatggtccctgaaaacaggggccaaaatcgccaaaatggcgatcagcgaggctattggggagcccatgctcctccccgacgggaaccatcacgccgtgaactcacggggcgcctcagctcgtggttggagaaaaaccacgggccaaactggtacgaaatggcaaacattcgccgtaatgcggaggaacacctccgcagagaactacacgaaggtgccatgctttgcgcggcacatcttggcccattcacgaatgtccgtttcgacggatttttccgttatggaccggccaacacgcacatgtccccaggacggactttccgggagcattttcgtagacgcgggttccaagtgaacccgaatttgccatgcctccaagaatatggaggtttcagccacagccaacagggcattcatgtcgattattttccgatcgacatgatcaacattcaaaaaggactcggtgttggtccgagaccgcctccaactgaggccgaaattttacggcctcgccgcatccaagcctatttggcatttgaggaaattcctcatgagcaagaggagctcaacagaagagccctcttcttcgaggtcattggccttcgatcaaacagacccaacgatggcactgcaaaggaggaaggcgctcaacagacgcgccctcaagactttcaacgaaagaaagagttagatgatccacacactgatcgtcaccttgaggaccaaccaagaaagaaaacctccaacggaccaacgcgccattgaaagaaggatgaccgatttcttcattgcgcgtgccaaagaacttcgcgggggtagttctgtcgcagaagcgacagatcttatcgattattttttcccttcccgcatatttttgttccctccccctt

SEQ ID NO: 16039 - DNA, 1141 bp, Heterodera glycines
gtcaatagtaaaaataattcaaaaatgtttaaaaggcccagaataatagtaggggtgttccaggtggcataaaacattaattgattcattttatcggcaggattttattagagaatcatgcagaaaatattaattatttttaaaactcaaaaaataaaatagtccaattgctcctcagatatatgatgttgtctaggatttccacatgagggggtacggcttaagagaaatagcaatcgttaccggatatttatataaagagtcaatagtaaaaataattcaaaaatgcttaaaagacccagaataataggatgctgtttcagcaggcataaaacattaattcattcatttaatcgacaggattttattagagaatcacgcagaaaatatttaattatttttaaaactcaaaaaataaaatagtccaattgctcctcagatatatgatgttgtctaggatttccacatgagggggtacggcttaagagaaatagcaatcgttaccggacatttatataaagagtcaatagtaaaaataattcaaaaatgcttaaaagacccagaataataggatgctgtttcagcaggcataaaacattaattcattcattttaatcgacaggattttattagagaatcacgcagaaaatatttaattatttttaaaactcaaaaaataaaatagtccaattgctcctcagatatatgatgttgtctaggatttccacatgagggggtacggcttaagagaaatagcaatcgttaccggacatttatataaagagtcaatagtaaaaataattcaaaaatgcttaaaagacccagaataataggatgctgtttcagcaggcataaaacattaattcattcattttaatcgacaggattttattagagaatcacgcagaaaatatttaattatttttaaaactcaaaaaataaaatagtccaattgctcctcagatatatgatgttgtctaggatttccacatgagggggtacggcttaaaagaaatagcaatcgttaccggacatttatataaagagtcaatagtaaaaataattcaaaaatgcttaaaagaccctagaataataggatgctgtttcagctggcataaaacattaattgattcattttaat

SEQ ID NO: 16040 - DNA, 3181 bp, Heterodera glycines
tgtcactaagtatgtgattatcggatattaacattttgtagtcaaagagaaacagcagccttagttcaaactcataaaaactcctatttaattctttcggtggccaatattgaccgaccacatacccggaaagtctgaatgagtctgcgctcggtgctgacattttcgctgcatatgagaataatttatatacaggcagtggccagccgtgacaatatgaaatggcgaaacaataaatccggtgcatcgtgctgaaagttgttgctcattggcacatgttgaacgggcgaccagtaatacagtccatggagacgagtgttctggtgcgattcgcctgccaacagactacataataaggttttaaattttggggcgtaaaaaaagttttaaattggtattcttctaaatggcttatcaacagaaaatcaaaaatcttcttaacagttcttaggtaaaaatgcgtgatcacgactattagctttgattttgcaaaatattggttttgtctatgattttcatcaagcagttgatttaaaaaaattttaattttatgtagaactctgtttcctgtaacccatattcaaaaaagtataaactcataaacaactagaatgtgctaactgttggagaaatgtattttttgttttcttatcttttgaatttaataatttagtttgacttctccatatattaatggcttattcaaaaactatttatgagttctatattttagaatatggagttaccggcaacaacgttctatcaaaatttttgaaaaatcatattcttgataaaaaaaaaacatagacaatatcttgattttcaacataagagctcgtagtcgtgatcaacgccctttttacctaaaaagcagaaaaatttttttttctgcggtaaaccaattccgaagaattaccattaaattcaattaactcacacgaaaagtgcccacttctggcattgggtcaaacgttagcccacattgccctagacagtttttcagttgttttttcgtatacgccgagtcaccaatataaaaaattaatcctatataataaagttgagtgtccgtatgtatgtgtccgtgtttgaatttgtgtggcgatttgttttgtttttgcgttaaaaatgaatttgaaaaaagtagagcgagggaaaggtgggaaaatagtgcactgtctgattgtctgtctacgcgggcagcggcgggtgagaggggcatacagtgaacagacgcgtgctgctgtgcagcagcagtctgttggacgcgtgcgtgtgtgtgggagaaggagggagtgggaaaaaaagagagtaaattgcaatggaaaagaaaagagagtaaaagaaaggaaagggagagataatgggaaatttgtctcgcatcccttccttatttataacccatcttttattatataaaataattaataaaataatgagcacatttttgtgtttgtttgagtggaaaatccggtatatgaaggttctgtttttgtgtgtaagaaaaaatttgtgtttatcattgtttttttgtctaaattttttttttgttaattgatgtgattttgatattaaagcttttgttttgcttatgtaaacgataatggagaattgtttgattaaaaaaaatgcattataattcgcttgaatgaaaaaggtttgttacttaaaaacgttttttgtacttttccttgcttataatatgaaaagaatctgatttggtttttgatatttgttttgaataaaaagcatgttatgatagtaataaaaaatgaaagaaaaatcctttgatggatagaaaaagcaatataaatgctacatctcatgttttgcctgtgttcgagtggaatatttatatgcaattgggatattgacgtgccacttgcgggatcaaatttaggtggaaagttttaaaaggtcagttttaatttgaatttatggggtgggggcaataattatacaccatagtgttttgatttattatgggttatatttcaatttctggattccttttaaatagttctgtattccgttgctgaggttgagttccggtgattgaaatgtcggagaactgagtcccggtaattgtgttgctgaaggattgatgagattgagtccagtgatttgaattcgggagaattgagtcccagtgattgaaatgctggagggttgagtcccgttgattggaatgttggtggattgagtcccagtgattgaaatgctggagggttgagtcccgttgattgaaatgttggtggattgagtcccagtgattgaaattctggtggattgagtcccgttgattggaatgctggtggggtgagtacagtggatcaaatgcaaaaaattggaccccggggaatgaaaggctgggggttgagtccccgggatgaaatcccgagatttgatcccagggattgtaatggagggaatttggtccccgggttggaaggggggaagggatattcgggattctttggggcggagggcccaaaaaaaaaaaaaatttttccccggggcttctttgttttttccccctttattaaaaaaaaaaggggcccccccccccccccaaaaaaaaaaggggggttttttttttttttttttttaaggggggggggggtttgtttcccccgttttttttttttgggcggggaagaagaaaaaccccccacccccccccaaaaaaaaaaaaaaaaaagggggaacccttttttttggggggggttttttttttttttttcaaaaaaaaaatccccccccaaaaaaaaaaaaaaaaacccccccccccccccccccccgccccccaaaaaaaaaacacccacccccccccctttttcttttttttttttttttttttttttttttgggagaaaaaaaaaaaaaaaaaaaaaaaaaaaaaaaaaaaaaaatggggggggggggggggggggggggggaaaaaaaaaaaaaaaaaaaccccccccccccccccccccccgggggggggggggggggggggtttttttttttttttataaaaaataaaaaaaaaaacacacccctctccctccccccccgcgggaaaaaaaaaaaaaaaaaaaaaaaggggggggggggggggggggggggggggggggggcccccccccccccccccccccccgcgcgggggggggggggggggtttttttttttttttt

SEQ ID NO: 16041 - DNA, 3521 bp, Heterodera glycines
  misc_feature (3154)..(3154): n is a, c, g, or t
tgtaagttcagtctgtctgtcccagctgatcagcagttaagagggcacacacacattcttagattttgacagtggaaaggtcagctgatcaaatggtcgatgcattcgatcaaatactaattgtgttcttagttcaattgattttaattggcccattctcctcatttccgattaattgcggtacgaaatcaaatttagttttggccaaatatttcccaaaatgtagtgataaggcgctctgattctcacagtactttacgttccgaccaatttgtaccattctcaggtcaatgcatcaattatcttatggtttgataaatctgaatatatctcaacaagttggggaagctattgaaggaaaaaaaactatgggtcgggccggctttgaacctgagtctctggctttccggaccagtgttctaccagctgaactgccgaccatgccttttgcagctcccaaccccgcccatttgctcgatcatataggatcaattgccgcctcaattgagccattaatcttcctctccgggaaggcttcttcctctctgtctcaaatcttatgcatagatattgatctttgatcagtgcttgcccagtacaatccctgtcatgaatcatgatcaattctttaaaacctgattaatgccaaattcagcccacagattccggtcctgatcatattcagtgccctgatcaatcgatgcccgatcaaattccggtcttgaccaacagttagttgcagagtcgtacaccctcccccgctctctgtcacttttcccattcgatcactcagcctttcctcccatttctcgcttcttacgcccatccacccatgcaacgattcccacgtcagtggcaccccgtctgccgttgttaaactgcaaggccccctccccggtggcgcccgttacgctccaaaaagcatttgccgctgccgccccgtcgacgccgccgcccgccgtcatcatcgtcgcagctggcgacagcgcggcgacggtcaccggcgccgcttccgctatctttccggcgcatctcttcccgcgccgcttccgctcgctcgcccgcccgtccgctaaacgaagcatgcgaagcaataggcgagagcgccatcaccatccatcctcctcccatcgtcgtcgtcatcgccgtggtcgtcgtcgtcatgtcgacacaaagatccatcctactcatcagtgtcgttcaattaaatccctgcgatttccctccctcgcccccctctcgggcttaattatcatcccccatgataatgtgattgtgataactgctgataatgatgctaatgctaatgatgatgatgcgattgtctgtcctcctctcctaccggtccatttcgcctcaattgacgtgctgacgaccttcaaccgctgctgttgctgctgctggcgaaggactctccgccgccactcgagacgcccccctcccgccactcccgggccgattgtgtcgggaataattaaatggaattgaattgaataatttgtttaaattgaattgtcgtcgttttgtttaattgtttttgtaattgcttccttcttgcttcgtgctgctgatttatccttcttttgctcctctcttttcaatttcttatcatcattttcgttcgtttcattttctttctttgtctcgctttttgctgctaatttcctttctcccctttacaaatgctttccctctttccctgtctctttttttcttcctttctctctctctctctcttctctctccctctctctcttcctttcctttctcactatctctttctttctctctctcttttacttcctcttctctttctctctttctctccatttcatcctgtttcttctcttttagattaactcatccaaaaaagcttcttcatcttgcgctgccgcttcttcttcctcctcctccacttctgtctctctgcttttcctcgtctcttcttcgtcacgtgctttttggtctttgatcgttgatgtttgatttccttcgtccggtccaagatcacagtctgcgtatcatgatcccggaacttccgcagcaacagcagcagcagcaccagaagtttcatcacaatcagccaaatcggcgcgcccatcgtacgaacagtggccattgggtacaaaaagcgaaattaattaatttaaattataaaaaaaaataaatttaaaaatttaaaaaaattgaactacctaaactaaagttaaattaaaactaaattaatttaaaatttaaggatttaaaattataaatataattataatgaaattaattaattaaattatataaataatttatattaaattaactcaatttaatttaatttaaaaaataatgaatttaaaaattttttctattaatttctttattatatgttaaatccacctcacattgcctgctgatttatttatgattgttcagagttcgtgccgcgaatcggaggatgaaattgccgccatgtcgccgtccgtccgtcgcaattacaaagcgtacacagtgatgcaaaagtccggcttccagcacactgagtaattttttatagcaaaaaaaaaaaggaaaagtcggcgggaatttcgttcggaaaggcaaattcgccgacaaaagtcacgggtaatttgaatctgtaatggtccaattaatatgctcaaaaaaatctctcttgatggattatgggagaattattgagatagttcaattaatggcaattagggaagttaattaacttccctaaatattcacatgcatattttttcatttgattattaaggataaaacggacgaaaaccatttttttgaaagtatttttccatatgcatattttgcatattatgcatatttcgcgatttttgtgaatattttggcattttttcaaaaatcctctattcaaacggcctcctctattaaagcagccctttaacctctaaagatcgaaaaatttcaaaaaaaaaaaagttaattttttagttttttctctaaaattttttaaaaaattgtaatcttctaacaaatggaaatttatgctaaaattttttagctctacccttaatttcactttatttgcatattttgaacgctgataattgcaatgtttataaaaaaggtaattccgatcactccttcctcccttatcagcagaagtgatcattgtcanttgggatcatcaattaaagggggcgattgcgatcagctgttcctatattttattatatttggtagcatttttgtctagacgaagtgaaaaatatatcactggcaaaaaaaaaaaagattttgtgctgaaaaataaggacattaggtcgaacctaaaaatagcttattgttagctaccaatgatagtaaatttttaaatttaaaatttttaattttataaatttaacataattatagagaattctttgagatatctaaggatttttccaagtgtagtgtggcttaattgaacttttaaacattttcatgcatttaacatcattaaatttttgtgtaacataaaatatgacacatttcattcattcata

SEQ ID NO: 16042 - DNA, 863 bp, Heterodera glycines
atacggtacgtgttttagcgagcaaataacaaattttaatttcgattaaattactcaattaattggaaagggtccgccgcccaacctcaatttgtgttaaatgtcgaacaattagcatcccattttaataggtctaccgtagtttataaaattacacctacacaataagaaatatggtaaaatgttaggcctcggtgggtggaaggaaatcaacgccactcgtccactcgcagctttaccattgacaaatgagctaccaaggcacatccgccctttcttaattagacgggtctaattatccccctaattgcccagcaatcttcgtattatggttatggtcattaaagaataaccctgttcagttacattgatcgctcagtgctcaattttttgcgcggcattaaacatgcgtttgaatcgcacactcattttgtggtgcgcactccaattgagcagcagaagagttgggatgtaatcataaaaaaaatttggccactaatgtaagcgtaatttaaaaaaaaacttaaaagcaattaaatgtaaaattttatgaaattttttttgataaaaaatataaaaaaattaccacgaaaaattaattggtatgaagaatttttctgataattttccaattccaattcgtttaaagatgcatttttagacttcaaaggtcctaggaagtgtatttgttcagtaatttctgaatattttgaataccgcgggctttattaggcacaaaaaagacacaaaaagttcatgttaattaaaaccctaattatataaaataaatttcaaattgtttattagagccaaattcagacgttggaccggtaaattggacaccaagcggaaaactggacacc

SEQ ID NO: 16043 - DNA, 2703 bp, Heterodera glycines
agtaatttctgaatattttgaataccgcgggctttattagaaacaaaaaagacacaaaaaagttcatgttaattaaaaccctaattatgtaaaataaatttcaaattgtttattagagccaaattcaggctaaaagatttgtttttggacgcaaaaatgttgtcttcaatctcataaaaatgctttttacaggccaatgtctgattgtgacttcattacttcttgtaattcccgggatttgagtgtttgacatttgaggacccgacattttgggaaacattggcattaaaatgctttaaagaaaattttaaattaatatgaattttccctcccccgtcctatcgtatgccggatctcaaaaataccgtaactttagaaatattttcattgcatagaccaaatccatttgtccattgggaaaaccttttaattctaatagtgatgaaaaattatttttaatgtatttctaaatctatcataaataagtcgggaaatgtcagtttgtcccaaaaaaaattgtgtcctcaaatgtcaaatacttcaatttcaaatcctcaaactccgtactacgtttggaatgatttccccgtctctctgttagattgtgctgattgtgagcttcgcataatttcgtgcgctcatcagctaatgccttatgctgttgttgatgatgcctttcatcgaacaaatgtggcactgttcaattggcttcatttgccgcgcgcggacggccgccccaaatatttccactggtgctccgagttggatgccaacgaaagcatcaagcaactgaaggaggtggaggggagggcactcaccgaaacggggcattaaagacaaacagaaaatgaataaagaaaaaatgttgaagccaaaattcactgaaaaattcaatttttaggccactaatcgcatttttgccgctatttaggcccctaaattggatttttcacccctaaaaatcaccgcctactatattaatcaatgaaatcattcagaaattcatcaatgacacatcgcctgttaattattttgtcaatgcgccaaagaaaaattatcgctcagaggatgaaagccttaacagccgctatgattacggccaaagtttcgtcattgtgaatgagaagacgcaagaattgctgaaacttttggcacggggctggtgttggacattaattcggaatcaaattagttgggactggcagaatgccaaaaaaagatcatatgccggccggtctgaattcataattgcactgaggcatgacaagcatgttgatctcgaatgaatcaatgataataagtgagcaatgttggcttaaacattttgttcaccgcggctcaatttgaattgaattttgtatcttcgttcgaatcaattttttgaaaaaaaatttctaggaaacaaatgtaaaacttttaattagtttttggaacacttcaaagtccaatctttggtggtcccatcagcttccacgtaagagtccatgctcagagaatgtccgccctttgtgatagaaaattcgcggacatcttcggcaacaacaccatgtaggaactttgcgatgtaacggggaggtgcgtcatcacagaaacggaaaaaaccctaaaaaagcaaaaagaaagtaaaaatgcttaaaggaaaatgagaaagcgaaagtttagtcgcaaaaaaattgtcaaaattttgagtttttcaagcggtggacgatgaaatacaacaaaagtgtaggcaagggcagccccataaaatcgaaaatgaaagaaatatttgaaagcatgtcctcaaaatttgttactctaaaaagtgtgaataaaagcgcggtaaggactaaatgaagatagagttagccccccccccccgccgccaaaattagtggtctgactgccaacgctcatgaacacagcataattaatgaatgcttaccaacagaaatctttcgaaatcccctgcggggatttcggccccttcctccggaggatgcatggtgaaagttttgacaacgtcgcctccttcgtcattgtaaatccacttgtaaatggtctctaagccaaaaattccatcgacagggcgcaaggtcggagccacaagccagtcgggaacggtgtcgaaatacgggcccaggtcgtagatgccggtgttttcggcgttacgacgctcatcagcgacagaagcgttacgacggtcagcggcagaagcattacaaacagaagtgattgcgccaatttgcgaattgaaaagagaccacaaagatttgaaggcattcttcgactcatcagtcggtcgagagaaaatggccagttcaatacgcttgcgggacaattgcttctttcgttcggtgaaaaacgcggcgacaaaaccatcgaaaaaactgaaaaaaaaatttataggctgtttaaaatttttcacatttttaagttgagggtgacgaatggatttggaaatagtggcagggtacgtattttcaggttataaaaaaggaggcagcgccatgaaaagagccccgttcagccttaatttggaagggcggcgggaagtgcggatgggtaatagtgccgatggtaccccacacccccactttaaaaaaatttttttttagtttttttctcgaaatagtcattttaggggttttcaggatggaagaaaccgattccaatatccattccgaccttaaatgtaatgaaactacctcaaagccaccaatg

SEQ ID NO: 16044 - DNA, 2129 bp, Heterodera glycines
aacaatttacaacgaagggctgggaaaatggtagggtcataaataccacccagggtgtttgggagtcgctccaccctgattcgctgggcaaaggtttgaacaccgacaatgttgaccacacgcagctgatggatttccagcgtgatgctctgtgtgtgttggatgcgccgaaaaacgcgtgccgccattttatttgcactgtttgggtgggacactccggtgaggaccacacgcgccgattggaagaccagcgcagccacagttttgcccgctgttgtacggatgcgcatgatgatagcgtggaagcgcctggggttgtattcggtgtttacgccacgttgcgcaattgccaaaaattgctctcgagttaatggttgaacatttattttaaaaacaacagtacaattggaaattgaatacatctacaaaacaatggacaaaatttcaagagggaaaaaagttttgtgatctccgcctccaaattcaacgacacacggcaaattagggtggcgcaagcggatgccgtgttttatgtagtagtgcatccggacctttaatttgcgtggtaacaaaaaaaataataataaaaaaccgtaatgccgaggtagcctcggtaagctggggcggagtgagtgtccaggatggacaggtcattacaacgcactggaaaattgcgcgcggacgggcgcaggtgggcagtgcgcagttggacggagcgcaaatgctccacaatgtcccggcgtttctctaggcttttgaaaagcacaagcagctcatgggcactgcatttgaaccgcttgcagaggtagtccacgagcggaacagggcgacggcgttcggcgcaaccacactttttcggagtgcctaatttaaaatttaaatgccaaatgaaaacaaaagcaacttgttgctggcgcctcctcaccaattggagcgagcggctcgcgcttcatctcctcgtcaatcaggctgatccaactgggaaatttctgttgcaataggcatattggcacaagacataaatgtagagcaggcacaaaatagaggaaataccaaagattaaaaaattcttgtttatgccccactctgctttggctggccatacctcgccagagagtggagatagaccctttgttgatacatttggaaatgtcgagcccgcctagcgcattcgaataacacaaaatttgtttgcatttgccaccaaacaatccgcttatgacgcgccgaatgaaaattcacaaaaatttggcaccggaaaaactgcattttttcatgggccagcataataaagtaaacccaaaatgtaaggaaatttaaattggtcatgagagatgtttagttttttatttgtccccatcctttttatgggaaaaaacttttcgagaaaagctgaaaaattttccacttgcatcagaagcagactcaaattcttcaacacacaatataaaaatattacgcaagaacttattttacatcctttttagaaatgatacataaatttttattgtatatagttgcacacaagctttttttcgctgccaatttatggcagttgccaatcaaaagggcgatagttaagcattgagatataaataattcgtctagagataattatctcaccattttgtcgggagagctgaatagatttctgtagcaataggcatattggctcaaggcatcaatgtagagcaggcgcataaatagaggaaatatcgggagattaaaacattcttgtttagcttccactatactttggctgtccatacctcgccagagagtggagatcgtacctgtgtggatacatctggcaatctcgagcacgcatagctcatttgaattacgcacaagttgtttgtatttgacgccaaccgattcgcgtaggacgcgccgcatgagagttcacattactttgactccggaaaatcttcattttttcgtgggccgatcatagttaagtaaacgcgaaaatgtaaggggacttaaataggtcatgagagtatgtttagtgtgtcatttgtcccatcctttttgtgggaagattcatggggagaaaaactcattcgtgaatcacttgcccgtcctgaggccgcgaagcggccggatccctcccacaaaattaaagacgg

SEQ ID NO: 16045 - DNA, 2553 bp, Heterodera glycines
tcttgctatcgaattagcccatatgagtggcctcggattaatccatgccatggctcgatcgagacggggacgcaacaaaatcttgccgccgaaatctagccgcaaaaaatccatagccagctcggcagcttatacataggcttaggttaggtctaagcattaggcatgcttgggcctaggcttaggttttatttttttcaatttttactgtacaaattggcattgactcagtcaaaaagcgactaggaaacgaacaaatggatttttagctgaatgcttattttaaatttcaggcagcgagattttggggtgcgaacatcgagacaataattgacactcgagagtcgcgtccgagacaaagacctcccaaaagtgtcgagaatcttaggcatgaatcattgcttaaaatcccgagatttgagaccaaaaatgtgctaaaaatttgttttatcttaattgttaacatctgatatgctataacatatctgccccactttaggcaatgtgccagcaacaacagcaaactacaatttaccgtacacacacagtttagcggccagcggcagaggcaccagcagcagcccatacgcagtggcacaacagcgccagtacggcggcggtgcatacggtagtaccaccagcagcggtggtgctgggacggcagactacggtggtagcagcggaagccactttggcggtggctacggtaattacggacagcagcaacagcggtacggtagtgacggcatgttgcggcaacatcaaagcaatgacgggccgcagcaaattgatgaacaggtgctaatggacatggtggacaacggcaatagatggtggacaagtctcagaaaccaggatcaattgttgtccatgaagttgaacctttccttggagttgttgcacaatgagtccgtcgtgtagtttctgtttctgacatccataatcgtccttttttgtttcaatttgtcgaaagtatagcttggaatttgaaaaactcaaaatcaggtccaggattcgggaattaaccggacaggcttttaggattaaaaatctctttttcttgactcccgatccggaccaatttttcaaaagtgccaggtcggggaattaaaaaaatcctaacaagatccggtcctgttgtaaaaattgactcggatcagggaattcaaaaaatcctgacaaatccggtcctgttcttccgggcttgaatcgagaggcattacaaaagtcgagattgagtccgtgccgtataatgcagcaaaagataaatttcagataggtcatctcctttcgaaggtgtcaatttctgacattttgtttttagaattctccagccatttccgttaaaattggttcagtgcttttcgtccctaatcccggccaaacttattttgaaattttaggtgattttttagactttgatcttttttgactgccgcaggttaaaaaaaaagcccccatacattgtttggattaccccagtgctctccacgaaatgatagaaatgggtttaaagtgaatttgaacacttaaacagccccaggggcgtcgcagccgttttttaattatgctttacccctctattagcatcaatggcaccacccgcacggcgatgatgccatcaacaacaaccacattgacccgcattacaacaaaaatcggattggcattctgttcccgacgcccgcttcctctctggccgcaactgaacatgaacccgcctcctattgggcggattctgctgctgtcgcagttggtgatcgtctgctgctggttgtgctgctactgcttgcgcttgttgtcttggcgcaacaacgggccactgccgcacttttttgatctttgccgccatttatgttttgataattaattaaggagctcaaacgttgacaattttttgggttttggagacatcacgcaattttttttaaaaagtgcgcatacaaacaaaaaatcatttttgggccatggctggaccctgtcagggtttttccggactcgtgatcctggtacattttgaaagtttgacccggatgtggaatccataaaaaacagctaatcctgtgaaatccggtccgggccatctgggaaatccctgctgatggattaactagattttttgacttcataaaaatttttttgatagattaagaattcgaaattttaacccaattttgaggaatttttgcccagcatttttttaaccatatttcaatgtttttccatatttcgtccatgttttgtttttttttctttaattaaagttgatacccacagtaattttttaaattttgtatttttcgttatttggggaaaacccaatgattcgggtcaaaattttaggtttgcccctaaatcggtgtcccatcggctgacaatgagcctaatttagagacgcaaaacaattagagcccttaataactccccaaagcacattgttccggtgccttttgcatggattctcctgttaaaccattttttgatacgcaacttaaacaacaatatattaatgaatgaataaattctgagagcgcatgctttatgctttttatt

SEQ ID NO: 16046 - DNA, 1633 bp, Heterodera glycines
tattttcctttttgcttcaacatttcttaaattgcttcaaattttgaatcatttctcttttttgttgatcaattggtccttctctcgcattttgatcacttttgataatatttttgattggaatattcgctcatttgatcaattgattcgattacatttattctttattttctttttccaattagtctcaattttgacactgtttttctcttgaatgaacattaatatttaagttcatttgaaaaataaattcgtaatatctttttttttatttttttgtaacagcggagtgtcacgttaagccatcgcctgactttcacgttactaccatttttttttaatttgatcccaaattgcaaaaattgataatgtcttccttctataactctcccccgattttttcaggttattggcctgagtcaactttccattaaaaacataaaaaataaatttaattcttacaatcttcttcaaattgaacggcaaataaatttttaaaaacaaaatcaaagaaaataaaattacaaaaaaataataattctaatgaaactaaaatagctgaaaatttattgtcgcacctatttgggattgaaattttgccataaattttatctatattattccattaatatacaaaataatttttgaatgtaaaaaattacaaataaacttttgtaatttatctaattgaaattagaaaatactttttgctcatttgccttaacattattgttgcaacacgaactctttgcacgcagaattgaacaggtttctgcattgaaagcatttaaaatcattgacatcttttctgacagaagtgttcaaagtctttataatgttttattataaataaaacaaaaaatgaataaaagacagacaaaatttgatgaaatttttaattttttcgaaaaattaaatcatttgacccaaaataaataataaacttattaacacagtaaaaccaatccaattttcgatttaaattatgccaaaaatattatctaaaaactaaataaataaataattttttaatatatcaaaattttcaaataaacatttgaactttttctaatttcgattaaaaatgctttggcttacggagccgaacaaaaaaaaatggttttccttgaaaaatttttcgcgcagcgctcagctgacggaataaggggaacatgaaaagcgcaaatcaaaatgggttcggcagggcaacaatgaatgtatttgtagaggattttgcaaatcgtgactcgttggaatctatactactaattcgatgctgtaaattagtgagtccccattttaaactttactttttattgacacgaaaacttgcgaaaaaataaaatagaaaatggcagaaagataaccttgaaaattaaagataataaataataatgtttatgaaattgtttgcctggccggtaggggtcagttgcgtttgagcaaagcataaaccaccataacatttttctttgttagccagatttcatatatccggcatcattcccaatctctacatggaatgaatactccgaggatataatgctaagtgagcgaacatataacaatatggaagcctgaacatgaaccatattgcaataaaaaattgcatacggaaaactatatatttttt

SEQ ID NO: 16047 - DNA, 1183 bp, Heterodera glycines
  misc_feature (1153)..(1153): n is a, c, g, or t
tacaaacaaaaaaagttatggtggtctaaacttagttcagacgcaactggcccgtttcgtgcctggctgaccagctcacccaaacaatgaaaatgccgcaatgaaatttttttggatttcatttctgaatttttcatgcaattagcctttagattttctcacaaaaaataatttcgtttaaggaaatgtttgcgcagaaagaataaatgaattttttaattataaatatatttaaaaagcaatcaactacaaaaaagaaaaacttttttcgtgtaacctgtttttcggctaaaaattatcatttatattttcgttttatgtgggttttcaatttttattcatttcacaatactcaaaaaaattattattcttaaatcaacgtattactaataaattggcatcgctaaaatcaatgtttgtgagatttccataagattttttttaatttttcatacgtcattaatataaattcatggattacgcaaatatttacaatgtttaagcacttatttaataatattattgttcatttttataaaaatataaaaataattctaaaattaattcaattctttcagtgaaaatgtcaatgcactattttattgccatttttgcatgcatttctcaaatttttggcactgcaaaaggaatgaactcagaaatgggatttcagcctcattttcaacaaaacccatcatcatttttacggaaattaggtaataatgccttatctgagcttttaaagtaattatttttcagaattggctaatggggtcaaaatgttgataccaattgaaaatgttatagcttttttgaaacagttttcccaacttaattcattgctcaattccgatgattttcgcatagtttgtttgttttttaacattttaaataattaaaaatattttagcaatgcgttgatattcaaattttacaaataaataaagaaatcaatgagataatagagacaaatcagctgaagattggacgagatttatgcagaattctttacaatttgttaatgagttgtaaggaaattggatatgaattggatggaaattctcgcttaaatgccccttctgccgtaagttaaacgcaaaaaatgaaatttaaaatttaatttattaattttgtgtgtaagcttgaacacaanaatggaagcacattatgctttatcggaatg

SEQ ID NO: 16048 - DNA, 1323 bp, Heterodera glycines
  misc_feature (23)..(23): n is a, c, g, or t
  misc_feature (61)..(61): n is a, c, g, or t
gataatcataatatgattactancaatgacatcgaaattatttatccaatccaaaaatcancatgtaaaaagccatttgcaatctaattaattgctaattattttttattaaaaagaacaattgtgggattaagccaacaaaatttgtgcaattttgttgcgaaaaaaattatgatggacaatccaagtgaagaaggacagatgaaatggattttgctgatatggagatgaatgattgattagaaggggaaatggaatcaattaatttgagaaatattttttattttgaattctttccaagaaatatttgagtattatgaaaattctctttccaaacaaaattagctagaatggtttgtcaatttaatgaaatggaatttttttaatttgatagataaatgtcgaaattttgtcaattatcggatttgacgtatcccgaaaaactttaaatttgattgttgtgcacattttaggaaaaggttcaaattgccaaaaccgtaatatttaaccaatattaacgaaattaaaagagtttgagacgaaataattttttcccttaaatacattcaaaaaacacaaatgaaagtatcctggaccatttataattaatctctctttaaattgaatatttgagaaacgaatcactgtaaagttgccatgtcttccatctgttgccccaggcactccaatccgtctccatcttagttgagaattttttttaaatcaaagcctctagcaatcgaaaacatactggaatttctggcaaaattcgaccaaataaatgaaattgaaagtgatgaacatcaaaaccaacaaaaattgaacaagataaccaaaatgagattcgctagttgatcaaattggtgaaaatgaaaaacttaatttccgggtggctcataacaaatttttattttttaaaatatttattccgttttacaaattacaataatttaaggctttaacaataatcactaatttataaaaatgattagattaccaatagataaaaaatatagaatataataaaggccatgaagttgtttcagtctccaataaaccttcaaaaaaaatcatcgatcttcttttctcttataagcatgacattatgcctttggaaagccaaactttgcgagtgttttgatcatacgcaaagcttaatggccgatcactgctactgctattgtactgattgcgcagctcgtcaataccgtacaacaattttggcaagaaaaatgtgtccacattggccacattcacacaacaagggaaacaaaatccacagttctaattgtgacatgggtgaggaccgcaggcagcaagctg

SEQ ID NO: 16049 - DNA, 1782 bp, Heterodera glycines
aaatcgacccggctgggcgcgaccagtcaggtgttataaaaacgaactaagtactgatttttcacctgttccgggccagtggttcgcagtgaaaccaaaagtgcgaaaaagccttcctccaacgaacaagcaaaatttggcgatgcaaaaatttgttgcgacaaaaagttggcgcggcggtggtcttcctcagtgggaataaacgcacgaatggtgcgacttggccctccgaaactgtacagggtgcctgcctctctcgctgccaaagccttaaaaatcacacaataaaaatcaaaaacaattaaatttgatagaaaattcagattttgatttgggcttactttgtatttccattgttttctctttttccgtttcgaaaaaagtaataaaccaaaacattcgagctcatcaaaacccttcgatagaaaaactcgggaacaaaatggagcaattcgttgttcagttcagggggaagtttggtgttaattttgatgaatttcattagtagggaacaaaaaagtgttaataatgggacaattccgacaaaaagtcgaaaaaagggaccaattgggtttctgaaaataaatttatttcaaaaaaggaactcccacgactttaaattgattgtttaattaacgcagacaatttaaacatacaaggttttcctgaagcggaagaatgatggtgaatggaaaggccattaaaatgaagaacaaatgagaataaaaagctggaagattgggaaaagtcttcattttacaaataatgaggattgagtttttcaatcaaagattatattgaatctaatgcgatttttagggcttagacatgactggtgccggcgaacaagctcgggctaaaatgcagggcttagaaattccgggctgaggagaaaatataattttagcaaatttattttaatggtcccagtgaaacaccacacatagaggagtaaaattgtttcgatttcttgaaaaaagcgatctatgcataaaatgtgaattttttgaaaaatgattgttcgaatcagggttcggggttcaaattgggcaaaacggatgccacaattggttttcccaacaaatttttgaaatctggacgcagatatcagacaagtatcggcaaaaataatcattttttagtatataccattgaatatacattgttgattcatacataaatatttgaccgaagcaacaagcgtaaatattggcttaagaaacaacaaaaagaattaagaaacaatttttatttgttaaaaacattcatttgttaatggggtctttttgttgtccaccttaaatgacggactctgctctttttgggttatgagaatgcatgaatgagtaagcaaaggcagaggtcactaaccccctggtttatattctcatcatttgcattaagtcattcattcattcagtagcagcagacagagaaaaaagatgaaagaactatgcagagaaaaaaaaacaaagaaaaacagacatagaatttattgattattttctgaccatgactcgttgtactaggccgattcgcactgcctcgattggaattgtccatctgttacctatataagtatatgaactgtcagacgtgtcagtgtctgccccgcccacataaaaagacgaatcgatttattacgaatcgggtttttatcaaggccaaaaagattgggattggatatatgtatgtaaacaaaattggaataatatgtaccttaggataatttaaaaaaccatcaaatacatcgaagccctcctcttcaaaaaataaacctta

SEQ ID NO: 16050 - DNA, 3331 bp, Heterodera glycines
aaacaaaaattcaggcgatttctgaaatgcctgttccgacacacgtgtccgaggttcgatcatttttgggaatgatcaaccattaccaacaattcgtgaagaacatgaggttcatccgacagccattggacgaattgttgaagcaggacaaagtgtggcaatggtcggcagattgtcaaaatgcttttgagaacgtgatcaagattttgaaatctgatcagttgctgacacactatgacccggcacaagagatcattgtatcggctgatgcttctgagcatggaataggagccgtgatctctcaccgctttccggatggaagtctaaaagccatcgcacatgcatcatcgtccctgtcagcagcagaaaagaattactctcaaatcgagaaggaaggcttagcgattgtttttgccgttcaaaaattccacaagtatctcttcgggagacacttcgttctgcagacggaccacaagccgttgttgtccatttttggcaacaaaaagggaattaaggcttgcacagcgaatcgattgcagagatgggcaatcactttgctcggctatgacttcgaaatcgaataccaaaatactgctgattttggtcaagcggatgttttgtctcgcctaattgcgaagacaccagtgccggacaacgaagtgatcattgcaaacattcgtgagagcaatgaaacgggagtgttgaattttgttacgaaaactcttcctctcgatcacagtgatttggctaatgccgcgaaaagtgatcaggtgatcaaaaatgtgaagaaatttgtctgctcacattggccaacaaagaacaaaatggccgcagacattgttccgttccatcgacgacgagacgctttgaccatcgaggatgaatgtctgctttatgcggacagagttgtgattcccgcatcgcttcaaaaagatgtcctacaactcctgcacagaggccatccagggatgaaacgaatgaaagctctcgccaggcagtacgtttactggcctgggatggacgaacaaattgagaattttgtcaaaatgtgcaacgaatgcacaatggaagcaaagatgccggtgaagagtgagcttcactcgtggccgaaagctgacggaccgtggaaacgcgtacatttggactacgccggaccgtttatgggaaaaatgtttctcataattgttgacgcgtactcgaagtggcccgaggtcttcgaaatgcgttcatcgaattccgcggctacaatcgacaaattgcgatcactctgtgccagttatggccttcccgaaattttagtcacggacaatggcacacaattcgcttcaaaagaatttaaggaatttgtgaccgaaaatggcatcaaccatctgttctccgctccgtataatcccatgtcgaacggacaagccgagcgttttgtcgatacgttcaagaggacatgtaggaagatcaagggagaaggagcatcggaaatgttgaccacatttttggcaacataccggaccacgccttgtgaggctttgccggagtgcaaatgtccggccgaaatgttcctgcaaaggaaaccgcgcacgactttggacttgttgaggccaaagccaaaggcaccgataattcgagacgaggccatggagaagcaattcaataggcgccatggagccaaaccgagatcttttgccttgggcgataaggttctcgctcgtcatcgtctttctcagccttggcgtccaggaaaaatcacaaaatgtaaaggtgtgatttatgacgtcgaatttgttgatggaaagtatggacggttccatgccaatcagttgcttgtgagaagcactgacgaaaacggcacaaacgcattgaacgtgttcaatgatgcgtttgatttgccattggcaccaccgctggttcagcatggaggacaagcgcaattgcctgtagtggcacccgctgctgtcatcgcaccagccgtggccgaagaacccgtcgtggaggaagctgatcgagcccccgaagtgcccgctcaacgacgatcacagcgaaatcgacgaccgcctgatcgctacactccatcatgaacggacggatcagacggacgaatcgaacggacgtgtaagacggacggatcattggaagaaccgaggaaaagattttttttattggggaagatgttgggatcggtactattttgtccgcccattattatttttctctatttctcttccctccattctctcctctctctcttccctggttggtcccccataaataccccgcgccctctgacctccccgtcattcatttgtcacccatttattttgcttatattgttcaatcaatattcgccctttgtcctccgtctctcttctcttcatttatttatttatttgtgtcttcccaacttgaataaacctttatttattcacttcgccggtttggggtttgacggcacaacaattttacaacgataaaacaaattaaattaaaataagtttatttatatttatttacgtaatgatttttggggtgatgtggggggaaattccgacacatttgcaactttgcaatggtttttggggatttttgaaatggtcggaaatacaattactggaaatattcgggaatgcaaaagtagggacccaaacaaagggagaaagagtcgatgagaatgaagaatttatttgccataatacatttttagaaaagaaaattaattttgtcatttattaaaatttgtggtgatgatcatcacaaaaagtgcacaaggtagtgccgacaattttgagaagaattaaatgagcattaaatataaaagagataaaatatcgttcaattgttcgcttttaaatcaggattaaaacataaggatatcaaattttgttccatttgttcattttttctgatttgcttttatatattttagaaaataaaaatgcattttcacagttttctgggataaatgcatattccgccattttcgcttttttagttcctattttaaaagtcgggtccccaaatgtctggtccccaagttgcaaatccccaaaagtcgcttcacgtttttgattaacatccatttaggtgctttttgaataacatcccagcaccggtccgggattcccggctcggtccccgtcccgcttcaacactacccaaaaataaaatatacggaccgccgtggatatattttggatagacatgacccatatccgcggatatcatgtcacacattgaaacgctttcttcttaaaatatttttcaattttttagcatcactcattttgggattttctcaatccattttgcaattttttgcaattttttctttttcatttat

SEQ ID NO: 16051 - DNA, 3790 bp, Heterodera glycines
cttcaataaaaactctaagtctaaacagtcattcaaattttgcattttttaaattttaaatccaaaattagcacaaaataagcacgtaaggctgaaataagcatattatagctttctaagacccggcccctccaaataagcacaaatcttagaaataagcacacttgggaactctagatttcacaaaaaaaatgaacaaattttgcgattttgagttccggcagtgccgatggggcgccgccgggaaaaactccgtgacaatcaccaaaatgatgatgaatcagcatagttaagagcatatttatatcgaaaatttaagtagctataaaatgcataaacagcaataacaacaacaaaaaacaaacggaaatggaaaatattaattaaagggaagaaatttcaaaaaaaattcaacataaacctgaaaattatgtaaagcaaatacgtgtattatggaggcaataaaataataaattaacaactgctgaagagaattcagtggctgctaaaggaaatgccaaatcaattaattggatggcattaggcgacaccaacaaaaattattaaaataatataaacaaaatgaataaattttcaccatttaatttttataatcattcataattttgttaaaataaaacataaaaattaagcattaatattaataaaatcataaggtaacaacaaataataatgatgatatattcggttttggtgattatttttatttctttcatcggttcggcaaagtctgtgaatttaggtgatttaaaataaatttaaaaaatatacatttatttttagaacaaatttttaaaaatattgacgagaattactcaaaattgttcaatcttccactcgatgaaaatgaaatttctgacagaaatttggaagcttttcaaatggaccaaaatttgaagttacagttggaagcagcaatattttacagtaatgcaaaggaaatggtaaatttgcgacaggatgggaagccaaagaaaattcgtgaacaaaatgccaacacattaaaagttttggttgaaaattttgctgcgtccagcacagtgtcccttgtaaatctgtgccatttgtggaaactttggcgcactttgggcgacacattgggtaacttttattaaccattttttgaaaataccctttggataggccaaaaaatcttttaattgaaaatttaagtggaaaatcccaaaattccaaagaatgtaaaaaattatttgaaaaatcgcgaccaaattgatttgaacggcgtggaatgtgatgaaagcattggccgaaaccgagtttttgtcagagacacggcacttgcgaatttcagtgcaattatcgcactgttgcaacttcaaaatggcaaactgacaattaaatttggaattgacgaggaatttcgaatgatgtatggaatttgaaaaataaatgcattttttcgaatttttgtgcctttttccgcttttttgtacctatttcatgccaattttttggcgtttttaataattacttaggcttaaaagtggaaaaattatttattatcatattatcagaatttttaatatttaaaaatatcaattcaactcaaaaacaaggttcacacattttctagttttttaaacaaatttaatgtagtttttttgccatattctggctttagatatttcataaaaagttttaaaaaacatttttttggcaaaaaaataaaatccctttcttatgcataaattttttatttaaattcgctgacaaaaggctcatacatcaaatttgcgcttaatattccgtaattctttatttttcagagatttgccaaattttttcaatgataaaagggcgaaaaaagagtcgaattttgcttttcaaatacgacatttacgttcaatggacaaaaataaattaatgattcgaatgaaggacaaattaagggaattaattggcccattttttatgaccaaattggaattaattcgaccgattgagatgaatttcggtgatttttattgaaaaataataatttaccgaattatttttaaattatttccctcaacagatattgttggtgacaatgaattggcgatggattatgctaaatttttgtcacaagaacatttggttgaggaaaaagccgtaaccaaaatatcagtgagaattatttttggcagaattatgcaaattttcgcccgaatttacgccatttgggagacaccgaaaatcaaaatattgaaaaaaacaattttaaatttgtggaatggaaaagaattgcaaacgattcacaccgatttgaaaatgccgggcctgaaagcagtgaccaaatatttcgaattttacctaaaattgttacgcattttcaattccagccaaggcattggcgagcaggaagagcaaattggggggttgttgccgactcaaacattcgccaaatttacatgggaatttgcggcaaaaaacaaaatgtttgagatgacatgggtcgcactgcttgaagaccatgccaaaaacattttgcggttgaccgagtcgaccacaccaaatgcattcaccgcacttttgaaggattcgctgatgaaggaaaagggcacaaaggccaaattgaacggcttttttacgaacaatacggaaaagggggacgaaatttacgaagcattggccaaaaagtaccccaaattgaagcagttaatcgctagagagggtttgtgtgtgcagggcttcggattggattccgaaggatttaccctcatttttattgcttatttgggggtcgaagagcatttttaggaaaatttttgtgttgttatataaaaaatataaacaataaaaaataattggcataatgtactttgtcagcttcaaaaaacattgagtatttttgatttcctaaaaatttggattaatgatagttttttatccattaaaaaacttttaaattcgcagttcagccctattcaaaacagaatgttttgcggataaaggaatgaatattaagtgatgatttcaaataaactgaaaatattctctccttttctcacaaattaaatttcataagactttcaacaattaaattttaaagcctacttaattgaaaataattcagagctatctgatgatcagattcgcgatctacaaattaggaattacatccgatttttaaacgtcacaagcagccgaaatgagtcgatgaaatcgagattcaagctcaatctattgctttattatcaatggtaaacattttggctgctttaattggggaaagggaaaagatcactggcaaattgaaaaatgagggatgccagttttgtgaaaatatattttcccctgttttctccatcatattaatagtaaggaaaaacacttccttttttgtatttgcgttcaaaaattttttctatgattttttaaaaacattttaaaatttttgtttacaatttggtatttatttggggcttttatacattttaaacaaatttatttaagaaaacttttttttttgacagggtgaagcaaatgagagatggtcaaaattcagcagaaggaaagaaagaatttgatgcaaaaatgggccaaattgaaattacgatggatttggtggcggatgaaaacatggcaattgaagcatatttagtgacagtggaagcgaacataatacaggaacttgagcagttcaagcagaacaaatttctggtcaacaatggcacgccaattaaacggcacaaagaaaagtggacgaaataacggaaaggtcgcccagattcagagaggcattgaaaggtgcaaattaaaacaatgg

SEQ ID NO: 16052 - DNA, 1228 bp, Heterodera glycines
tcgcgcaaaaagcgcagcacaaacagcgggtcggtgccctcaattttcaggatggacactgaagatatcgggcggatttgcctaaatgccatgaatatgtggggaaaaaaaatattaaattgtagccccagaagaggaaagtaccgattttcaaccataaatgctttaattttattttacatttttctatttgttgtgagacgagggtttgacataccgccctgcattttaaattttcataaaaaaaattgttgaaaaaatttttttttgaaaaatttcggtttaaattttttttaatttaaagaggagggggggggggaatatttttcatcccatttttcggatttataattaatgtgtttgtgtttggtatttacttttgcctgtgccaccggagtcggtctcggcactgtccccgccgcccgcggcaaccggcgacttcagcgactcgggcacgcacagcgcgatgaacagcaagtcgagcgcggcgatgccggtggccagcagcaccaccgcgtcgtcggaataggcacggctcagataggcgcccaacgcctgtggcacaaatcaaaattttatttatttttgccaaaatagaaattttttcaaaaaccaagcccttctcctccattttatgagtcaaataaaagctatcatgttagcactccaaatcaaaatgtttaattatttaaaaaaattcgcaggtttagcaaaaaaaaatttttttttttttcaaattaaaaccaacatttttggttttcacgccgtattttccaataatttaatataaatataaaataaaacttgttacaatgtatatcggaatgtgtaatatttttattttgattttttggaattaaaaaattggaaaaaaatgccaatttcttactggagatgtgaccaacgaggcggcaaatgtggcggacaccaaaccgcacgcagttgtccgctcgctgcgctccgttatgtccgccacgtaggccaacacgacactgaacgtgacggagaacaggccgctcagggtgaacagtgtgaaataccacctggaacgcaacaaaaaaaatgattggaaaaatttaaaaaaaaaaatttttttttaccctggaaatttttttcaatcaaacaatagccaaaaaagtgataaatttaggcagaattgaaagaattttcttagtttttcataagggtgggataaaaatatatgttcatggaaaaattgaaatttttt

SEQ ID NO: 16053 - DNA, 2546 bp, Heterodera glycines
ttttttttttttgttgggtgccatttttcccgttcttttttgtgtgtgtaccagggatggcacggaattccgagttccgacatttttggggtcggaattccgacttccgaaaaaatttatgggcctcggaattccatccctggtgtgtaccatgtcgaaattttcaggcacggaatgggcacacaggtgaagaaaacggtgagcaaaaggaagggtttgcggccacaaacgtcggacagagcgccgatcagaggcgagctgagaaaggagagaatgccctgaaatgggggacaatttttgtcatggcatttgttagttccttgaatttttttagtttttccatgaattttcctgaatttttttaaatttttccttgaattttcctgattttttaaagtgtttccttgaattttcctgaatttttttagtttttccttgaattttcctgaatttttttagtttttccttgaattttcctgaatttttttagtttttccttgaattttcctgaatttttttagtaataatgtaaaaaatcttaggctggaaattttttgaaaattgattttgcataaatacaaaccttaaggcccaagatgagaccgttcattaagaatttgttggctggaaatgtttcggccaacacattgatcaccggaacagtcagaagaccccacgagaaaaatctgaaaaaaaataaaatggaaattgaaaaaaaaaaatattgctttgaaaaaatagtcccgtttttccataaattcccattaagattttacggaataattgcacaattaaattagccctcagcattaagaataagaaaacacagtcttcaattttattaggaatattaattctgttgtttgaaaattaatagtttttttacaaattcattgacgattaaatgatcagatacaatcacttttaatcgcttatttaaagctgtttaggcgatcagtgattaaaaaaaaacacttaattttgaacccgattttggacaaaggcgcaaaaattttgaatattttggacaaaggcgcaaaaattttggacaaaggtgcaaaaattttgaagattttggacaaaggcgcaaaaattttgaagattttggacaaaggcgcaaaaattttgaatattttggacaaaggcgcagaaattttgaagattttggacaaaggcgcagaaattttgaagattttggacaaaggcgcaaaaattttggacaaaggtgcaaaaattttgaagattttggacaaaggcgcagaaattttgaagattttggacaaaggcgcagaaattttgaagattttggacaaaggcgcagaaattttgaagattttggacaaaggcgcagaaattttgaagattttggacaaaggcgcagaaattttgaagattttggacaaaggcgcagaaattttgaagattttggacaaaggcgcaaaatgtttgtactcgagaaaaatgacgattaacgcgtgcacaaggctggcctcgcgccgtacgcgtgccgaaccgacagcggcggtgccgagcatggcggccgacgcggcggacattcgtcgacggctgacacagaacagtgagcgggcacgtctgctcatactgtgccaaaaaagtggggagtgaaattagtggaacaaaaaatttatatttttttttattaaattcataaaaactttggcagtcaatttttggcacagccttagcctatattttaaatttttccataaaagagccgagagaaaaattactaaaaaaagaacgaagaaaattattagagctcacaatcagcctggacttggatccaggtcaggtctggatttttcctggatccctaggtccaggccatatttttcggcaacctggaatttttgtccggaaaatccacgtccaacatggaatccaggtccaggcttttttaaaatgccaaactctaaaaatacaagttttttttttgactttttatcagaaaaatttgctatacatacagtgatttgaaagaatgacgatcacaatgacatcagcagcagcagaaaacagtgaaagttcgcaatttttttatccgtgacgtgagaatgaaattaataatatcaccgatttggactgtttaaaaaatatataaattcaactaaaattaaaggctattcgccaaggctcccagatctgaggctttagcctcattttgtgttttttggataggtcaatgtggcttttttttgaaatgaggcttttttgagaattttgaggatttttgaggctttttgtggcttttcttagaaattttgaggattttgcagaatctgttaaatttttaattttgataaattggcattatgtttttgacaattcattcaacttttctccgcgctaacaaaaatctttaattttcttttcttcaaacaaaattttgttttttttttcatggaaaatgaatttatttttatgtttggattatagaccgagatttccaaaggggcggaccggaccggcctgatattttctgaagaacccggcttccggcaccggccttggaaaaccggagaaac

SEQ ID NO: 16054 - DNA, 2095 bp, Heterodera glycines
  misc_feature (5)..(5): n is a, c, g, or t
  misc_feature (15)..(16): n is a, c, g, or t
tatancggtactacnnttgacacggtttcctacaataagcctacaaatattgccgttttctctccgctagccgaagttgaatttgtccaagacttaaataccttcccagttgtctgctttaaaacggggggggggggggcgttcggttgggtcaatggcaactcgtacgaaggcagctcgtactttactaaaataaagcctaggcccaagcaagcctaggcctaacataagcaattgtacgagttgtcatgacaccgttcggttcggtcggctttacgtcccaattttatgccaagaaatttaaatgttgccattagaattggacattttgagaaaggcctggacttggatttcctggacaaaaatcatgccatgaaaaatcaagtgttgtaaagggctggcccaggccttgacctggattttttgaaatttgtttaaaaacaaaagaaaatttgaaaaatagggacgctgggattctgaatgtgtaaaaagggtttggccctcatttggggacacctctccttccataccccgttttgccatatcctcctcctcctttggcactgctgatgggtccttccttccttccgtaccccctgcttttcctccccccccgtgccgtcccttccgttgcttttttgtgctgtttgccacctcaccttctccttctgcaactgttcgaagatgggcagccattcttcgaatgccaatttcttctcgcccttgcgtttgtattcttcgcccgccgctttccaaaccatcgcattggtcggcttcagcccacacgcgcgtgccacgtcgccaatttgcgtggcgtcgattttgccctccaattctgaaaatgatcagtaaaaagcaaagccaaaacatttcaacagaaaggtgatcagaaatttgccctcggcggataaatttgatcggaaattgcctccattgaacataaaatttggtccaatttgatatttggtccatttttgctcggcttttgccttaccctcatcgtaaaggttgaagatttctttgagttctgaaattaaaaaaacacaatttaaatggcaaaatgttgttgataagagcacttttttacctccttgggacggcatttctctgctcttccgtttggtaattcttctgctgcttttgttggtgaaatgttttgtgggactatgtgagatgagtgtgtaacggcggaagaaacgggcaaaagaagtgcgggggcggacagatcagtcagcggagaatggaggcggggggggggcagaacgatgagacgaagaagacggcagagatttatgggacagaggagagaggaggggggggggggttgagtggttttagctgaaggagaggaaaagcggacgatcagcagcaaacagagtagaggagggggagatggagtggtgatctgctaaggttggcggcaaatgcttcttatgctctacgtccgatcagtcgacgctctcctctctccccctctctctttctctctccccctctctctttctctctccccctctctcttcctctctctcttctctctatctctctttctctctctatcttcctctctctctctatctctcttcctccctctctctctctttctctctcttcccttctctctctctttctctctcttctcttcccttctctctcttcctctctcttccctccgcttctcaatgtggtgagacaacagagcgccacagaggcaaaagcatcggatatccccggaactgcttaaagcatggacgaaacggagaaggtggagaagcgggtgctgctgttgggccaaggggaatgaaagaatgaatgagtgattgaattcgaatggatcgcttcgatcggtggaagcggcggattggaatttgtgtcggtgtctgctgctgctgtctctgtttgctgattttcatttgcatttgccatgcctcctccttcgccctcctgcattcacacattcttttccgtctctttacttctcttccctttgttttttggccaatctttatttctctgtcgctctcccacttccccgctctctctctctcccaaaagctctctcctccgctctctccttttctttgttgcccttgcc

SEQ ID NO: 16055 - DNA, 1681 bp, Heterodera glycines
  misc_feature (1651)..(1651): n is a, c, g, or t
aagatggcgtgcttcagttggacgaattcatcagctggcgatgctcacttgatcagatcaacgaggcatgggacaaatttcagaggggcgaagggtaaaataaaaataaaaatgaattttataaattaatttatttttattgaaaaaaagaatccgttcaatgatttccgtgtcaaatgaatgaacgaacggaatggaagaacatttgaacagaaataatgataaaaaaaaagatgggagaaagtgattgaagatggacagacgcacatcgattgatcagagaattggcaaattatcgccatttaaatatttaaaatttaatcacaatatttattttaaatttacaaattattagaaaaaaggtcaaaatgatttgaaaaataaaagtgaaatttgtaaggaaaattaaaaaatgaattgccaaaaatttctcagcttgtaaaactgaatattttcttctgctgttaaaaaattattttttttatttaaataaaaatatttacagaaatttctttctttattccatgcgcatattttttctatacatatttttggttgtcctatattattttttaatctttgttgtaggccaatttaaaaaaaaagaatttggcgggggagggcgtcgggtcgacaacagccaaaatgcgaatggggtcaagccatgcaaatcgatgacattaaaatgaataattttgggccaaaaattcagaaaaaattcattctaactgcacaaagtaattgcgaaactccgaatgctcctgaaacaacttggccagcaaattgttggcattttattcagatcacagccgactagcggatctgagtgctcaatgagcggcttcttcgccagcacacgttgttgttcttattggcaaaaaaaaaataataaaaatattcaaaaaatgattagtggccagagattgcattgattgtggaagaatgtcccattaatttcaacgaattttaatttatttttaaatacacaccctcaaaatgagatgcagaaagtgcgcaacaaacatttcacttcaaataatgcctaaacaaataattttgagctaataaatgggattaagcagaaaaaaaaaaattaaatttggctaattctgcagaatgtgtatccctaatttaactttgttgttttgtgctaaaaattggtatattggggattttccgaggtgttgatctcctgattatgaatctgatattggatttgtcatatgacattgtaaatcaatgatttatcaaatctgttattttttaagtactcgttttccaatgaaacaccacaaatgaggcaaaaacttcagttttggcactccttttgcctttgagtattagtcacgcaaatcattaacactttctaaatttaagcttttccattggagtgttgagcagatgctctttttgctacggagaatttcttttttcaaaaaattaaatttaaaatatttttcttaatgaaatccatcagattggcccaccttcaccatttcgcattaggctgaaaaagattattttctggttagcgttagcaatggcatttgcgaacaaataagctgtcttcgcccctgtacttattatattaaaaaagtatttatttttgttttttcattgacttcctccaataattaatttatttcaccanaatttacaagtgcccgaaaatggtcagaag

SEQ ID NO: 16056 - DNA, 1279 bp, Heterodera glycines
aaaatgaatctaaaaaattaaaaataaagtcttgtattcttacaactttttgataattaacttgataaaaagcaaatacaaaaaaaaagaacctacacgcaggggaaccgaacctggtgtttaaaaaacagtgcctggcgcactaccactacaccacttgacactatgatgaagtgcaaataaatatttattttatttattcactaaaaaactttggcacggaataactcggcactcgggctcattccgcaaaaaataaaatcacttttcttaagaacccatgggtgctctatccactgaccaaatttcattctgaaatcccacggacaccctaggaccttcctttgtcagcattcataaaagttttgctgcagctgacgcaatctttccggtagttgtcgtccggtgtgcaaggcctgccgacaccgattcgtccacagtttgtgcagcgggccttacactaccgagaatggtcgttggcattgtcaaatggacattcacaaggaaaacagtagcaatcacgcccaaacacagcttttccgacaccgcagcggattccatcaaagtgattattgttgtaaaaaagagagatcgatgtatcgaagttgtctggtccatatttatagatgggcttgtactcgccagatgctccaaagacgaaaactttgaagattttattgtacgttgcattccagtaatctacgatgggagggatatgaacggcagcgtcgtattcgttgaggttgaatgggattcctgcggaagccataagtcgtcgtacgtcattgcgttgccggtcaaagtattgattgagatactcggaaaaacgttgtttgctcatcatatcggtgtggtaaatacggctaagttcgagggcatagaaaaggcagaaagagtcgttgtttcggacacgcaggagatttgcttctttaacgatgtgacgaacattctttggggtacgaaacccacgaccgcgaatttgttgttgtcgaggaagagtgctgacgtcaagtgttgttgttgttgttatggtaaaaggtgctccccatagcgacccctcacgcgactttgactgtgccacctccagtaaacgattcagaattgcgtcgacggtattcgaggtatattggcgtattggggtccagacgggtgggttaagaagttcggatgaaacggtggctccaagacggtcggggttgattccgatttcgtgggcgagtctaacagcggacagaatacagttggtgaatatcgctcgcacgagatactcgggattgcc

SEQ ID NO: 16057 - DNA, 2637 bp, Heterodera glycines
catttctggacatattccgaagttgaagaattcgcggaaaaggatgacgttatcgaatctgccaccaaagtgcgagaaaatagacgatggatacctgatttaattagcaaattattaaaaattagttaggaaaatcttaatcactttttatcaaatcccgagagaagccactgcgcaaattctgtcatcggtgattcgcacacacgcattgagtccacttgagtgttgttgaaggcacggtgtgagaacgtgatggtgcggaattcaccgcaaattttgcatgccgtacggccggacagtgattgacgccaagtgtttcctttgatgcaaattgaacaggccacgtgggctgagacaaagttgacgatgtgtgcacgtttgtttgggccaataatggtgttttgcgttgtttcgcagtcgaaggcgatgagacggaatgccttgggatgcttcggcttgagtttcttgatgaaacaaccccgccccttgtcatggtaattgcggcaagtccaacagaatttctcctcgcatacgtgtccctttcttccgtcacgggtattccgttcaaagtcccacacgacaccgcacttcttgcactttttcgatttggtacagtaattagatgtgaggtggtgttgatagcattcagcattcataaaagttttgctgcagctgacgcaatctttccggtagttgtcgtccggtgtgcaaggcctgccgacaccgattcgtccacagtttgtgcagcgggccttacactgccgagaatggtcgttggcattgtcaaatggacattcacaaggaaaacagtagcaatcacgcccaaacacagcttttccgacaccgcagcggattccatcaaagtgattattgttgtaaaaaatagagatcgatgtatcgaagttgtctggtccatatttatagatgggcttgtactcgccagatgctccaaagacgaaaactttgaagattttattgtacgttgcattccagtagtctacgatgggagggatatgaacggcagcgtcgtattcgttgaggttgaatgggattcctgcggaagtcataagtcgtcgtacgtcattgcgttgccggtcaaagtattgattgagatactcggaaaaacgttgtttgctcatcatatcggtgtggtaaatacggctaagttcgagggcatagaaaaggcaaaaagagtcgttgtttcggacacgcaggagatttgcttctttaacgatgtgacgaacattctttggggtacgaaacccacgaccgcgaatttgttgttgtcgaggaagagtgctggcgtcaagtgttgttgttgttatggtaaaaggtgctccccatagtgacccctcacgcgactttgactgtgccacctccagtaaacgattcagaattgcgtcgacggtattcgaggtatattggcgtattgggatccagacgggtgggttaagaagttcggatgaaacggtggctccaagacggtcgggtttgattccgttttcgtgggcgagtcgaacagcggacagaatacagttggtgaatatcgcacgtaggagaaactcgggattgccaggcaggtcttcaatgatgtaggacgattttgacgattggacgttaaactttttgttgaagacgctttcggaatctagtttacggacgtagtccgaggcagggcgaacgcgttgacgtttgggagccattttggaaagcgatagagaatagaagaggttagagaggaatttggagcttaaataatgctcgggtcagaggagtaagtgcaaggaagagggcaatcaaatatttaaatagtcatggtaaaaattcaataataataagagagagagttgaaaaggagatttttaaaatttaaagttacaaaaatattatatttttgtgtgagttgattatagaagtaaaaaagtaattgttattggaacgagcgggtgagaaaattaatattgaaaaattatgatttattttgttagctttaataagtggtaggtaactaatggattagaaagtaaataaataatgagcatcaggaagaaaaaatgggaagcctgactggtaacgcgcataggatcgggcgcatcaggaaaaaacgcctgattgggattgcgccaaggcacatcaggtataaaaaacggcctgacttgggaatgtgccgagaaagattcatcaataataataatattttaaattatattctgaatattcggtaaggaaacacatcttgacctgaagagcagcgcactgccacccatgaagcacaagacgacagggcacctaaacagctcgggaaattagtcaagttaagcgaatgacctcaagccctaaaaggcaattgctgccaggataaacggtgcttatataaaagacaaccgccctggttaacagcaaaagtaataaagaaaagttattttaattcaaaaaaaagagaaggagggatggggtaggaatgagggagcaggagctaaggaggcacatctagacatccggaacaaatgaccagcggaagtgaggatttggcttgaaatggtggtcaatttataggcgccataggaatgggcggagattggagcgagaagcgagagcggcagttgttcatttcgcgttaaatttaaatttgaattt

SEQ ID NO: 16058 - DNA, 2372 bp, Heterodera glycines
tgcttaccatcccattgtttcgtttgttcatgcccattgtcagcggatcgttcatttgttttgcttcagttccgtcgtcaatcactccaagcaaagcaaaactccgcttctaattaatgctaatgcgctaatccctccccccccccagccgcctttcttccatttttcttatccgttaattcatttcgcctttctctgaacgtcaaattgaattgaattcgctgtgcttttcaaagtgtttttggtctgctgctgctgaacaattaaagaagacaaagaaaggcggcagaacggagacgaaaagcgaaaagggatgagaattcggcgagtgcggcgccttttccaccaccgccactccccccaaaatccgcgcgacgtttgtccccagcatttttcaacacattgtgagctcaagaagaaattgtgccattctctgcacaaaacaaacggcacaaataacggcgaaaagccaaacaaaggcaaacggaagaagcaacaacagaaacaacaataacaacaacagctggggcagcaacgccttctctttagccgaagtgtctgacactttctgccatcaattaacgtacatttttgaatttaaaatcttttaaagttaaattggatacgattcattgttttgtgtttcttattgttcgtccgatactttcaccgcttttctgtcacttctccccaatgtttcggtgcttctcccctttccttcctcataggattctgtgctttctccccctttcttaggtttcgatgcttttcctcttttccctttgcttaggattcgatgcttttcctcttttccctttgcttaggattcgatgcttttcctccctgcgtctccccgtctccgttcgcttcgccgtccttcgcttttgcctttccttttgttccttccacttcttcactttgccattgctcaacgcgacctctccccgtccctttcgccttcccccgtcgcttttcgtcctcaaacttcggcttcttccgatggcacttcgcttggccgcccttcggtcacttttccttcgcttcacttatctttagatgattttgcacattccttacgcatcgaaaaggaccatcaggtgggcaatccgatgcgagcagcccaaaaagtgccaagtgattgttgaggacccttcccatctgctcgatgtgttcctcccctcctcatttggccattttcgtcagtttatcgcccgggtgacggacatttccatcgtcgagtgctcacttccttttctcctcatttaaaatttgtttcaaaaccccagggaatttcgaatgcgcgacgcaaatcgcacctttttggcctctttggcagattcctcggtgattaatgtgcacggattgagcccgggccacaaatataatgtggccattttgggacgacgggaggcggagagcagtttaatccgggaagaccaagtgagcagccaatgccaatgtcggctgaactgcgcttttgcaggtgctgatggaccctgtccccttggacttcggcgttcacggcaattcgacggcaatcattgccacggcgaccaatgtcacaatgcgggcccagaagccggacagggcactgcaggacactttccgcgtggagtaccaccgattggacccgctgaagcgtttccccattttggatgtccacgtgcgattaacgttccagcactttttctgtttgtttgagccccaacgttcaggacattcaagagcaacgagaagtggaactgtacttgggcaatttgtcgccgggaagagactacgccggtgattaaggaaagcttttgatgtcattccaaaaaactaccttcagtttccatcacttcgctacgtgaggaattgccgagccaaccgtggcgtggcattgtaacgacgagtgagtttggtcgaacaaacaaatacgaatccaggggacggttcgaaaagagggcgggctatattcgaatggcaatttgtcatcataatttgccattctttaaggaccacttcggcccgggaatttgtcggtggctgagctgaactcgacctgtgtgttgttcagctggctgttgccgtctgattctggcacggatcgtttcaaaatcgcatatggcatgttgcacgggcccaacagtatgaccaaagtgagcgcatgaaacagaacgccaaacaatagcaacttttaaatattggatttccagctcgagactgcctttcccaaccaacagacggagctttgccagcacattttgcccggccgtgtgttcatttttgcggtcattgcggaaaagtcgcgtcaaaggtcggagccggcgactctctcccgcacaattcggcttaagggccgcgcgaattgagtgttcagcccgacttgaaaa

SEQ ID NO: 16059 - DNA, 1896 bp, Heterodera glycines
acatgatatgagctaattaataagttagcctctataattttctatctatctaaaaatgccaatttattaatatacttcattgtcattttgattagttgtcctaaattggcaatgtttcttccttttcagctcaaatgcaccaagaattcatgaagtcattcatggcattacttctccaacaacaaagtcacaattggataatgcatttggtggagaagaaaaaagcaaaaagtaattaaaaattgtcaaaatatttttaatgagtaatttcattttttcagcgtcatcaatgccaaccattgttcaacaaactattccaagcatccaagtcggccaaacccaacgcccggcgggagggaggagcggtgcccttcgtttggccaaatttccccaacccaacgcagttcaattttgcacgaaggagtaattaaatataaaagcattaatttattaaataataataataataaagtagctgtaactattcataaatatttagtacatcaaaagaaatccttgatttagtctttgcaactttgagaacaaatttaaatgagaaaagactcaacaaatgatttcaaaaatatataaaaattgaagatgaaaatgcatattattttatattgttcactttttgcattagatttcctttattttattaaatttctgtcttctatgttcaggattgtgactcggaagtgacaatttgtccaccatcggctcggaacagtgggcgaagtgcagcggtggcagtagcgagcggaaacggcgcaaaaaacgatgaaaatgccgtttatacggcatcatccccccctcgatgcacaaccgactcatttcgacgaaagatcaaatccatggaatgccttgggacattggtaagcaaaatgaatgtttttttgttctgttcatttttggctttatttgaaaaatggggcatgaaaagctttaaatataaaaattataacagatatgtaaacgagaaatccagtagggagggggaggggggggtcggagaccaaaaatttcaaagtcctccattttttgcttttcaaaactttttggcggcgtgcttttttaaaaaattttggtgaaggggggtggggagaggtccggtggtctgataggcgccgccgggaaaattttttggaaatttgagtgtgatttgttaacagattttcagcaaaaaagcaaaaaccttgttaaattatttaatttttttagtcagggggtgtcgactccctccccccctattaattaatgttattaaaagctaacagttcacataccgctcgccaataatcgtacaaaaacggcacaaaattcaggacaatttttcgacgatgacgccgaacaaataccgtaaaaacagtgccgacccgccggtggattgcaatggcagtgacgaggacgaaaatgaggaggacgatgaaaaacagtgccatcaaaaaagacgacaacggacagtggaggagggacaggaggaggaggacagtgccaaatatggacaacggagtctacaaaatttgcacaatttgcaccccacggccaatcgaattgctaacggggcaaaacagcagcaaatagggaaactgacaaaccaaaataacaacggcacatttggtggaggaggaggggtaacaacgcattggagcacaagcggcacactggggtgaaacgaaacataatttactaattggcaattgttgggaattttatagggttgcacgggcccgggcacccgaccgggtcgggtacccgcacgcccggttttttgaaaatccaatacccggtacccgacccggtaggtccgggtaccaaaaatacactggtaagaatgggggtttgagtgaaaattagtcaagaaaattgtttttaaaggcaaagattaaaaaaaaa

SEQ ID NO: 16060 - DNA, 1098 bp, Heterodera glycines
atagcactttcgaagccatcaaattatttatttttagttggatttgttcattattgtccgatggatcgactcccaagtgtccccccttctcattctggggaaatcgttaagtgtcctctgattagaatgcaaagtttcaaaaaatttttgttaaggttcaaaaaagttacgtacaaaacacttaaaaaaactggttttctaaacatttctggccataatttttttgaaccttaacaaaaaaattttgaaactttgcaggctaatagaggacacttaaagctttcgaatgataccaacaatgttagatttggtcgacaaagaaaaacgttttagtccaaaaacttggctggcgccgaaacgacctagtcccgtaccccatttggtactgtacctgtacagtttagatatcacataaaaaaaattttttttttttcaaaaatacactcctaacaaataagaaatgaaaaattttctcaaaaatttattttcttggcaagaatttttaattttaaaaattatttggttctaatcggttttatgcgtcccatgaatgaccacagtttcttaggccataacttttttcttacttggtcaatacctatattcttggtattaaacaaaagcttaaggtctatagaagcttttgtaatcatgtcacttcactatttcggacttagtcaataacttttgtcaaagtcgactaaataaaatcattctttgtatcattcaatagcacttaagactcaagaaaattgggtaaatagatcgatcgaaaagtccagcaaacgaataaacgcgaatggttggggggtgaggaagcgaagagagcgaccccttgggcagggccgcttaaatagacattcgaaaaaatgggcggagtgacagacggcatgataatgcgatgagaaaaatgggacaaaaaaatgcgcagaaattgtgatgtgaaaagtgtgaacaaagaaatggcgcataaaattaaaatgtaaattgggagatgtgaaaagttaaggaattttgaaagaaaagactgtgtgcaaattgttttgctcaaagtttgggccggagattaaccagttgatgagaaatgaatttgaaaag

SEQ ID NO: 16061 - DNA, 2045 bp, Heterodera glycines
acaaaatgtactgcttcagattcaaaaaacaaccaaactgttaggagggcacaacaaacaaaacaaaaaccgtcattgaacgctgtcaaaaattgcaaaatgccatcattctctgaattctattacatatgtactttgcgattccgttaaaaggcatttaaccaattcaatgcctctaattggatttaatttattgtacgctttgcctttgaccagtgagggagggatgaaggaagggaagataaaagcaagcaacaggaggagaagcgggagagagagagagagagaagaaaagccaaacaaatcgagacaaacaaagccaatcaatgcagtgcgcatagtgtggagaggggagagagagaggggggaagagagagagagagagagagagcaacaataaacaaaatgagacgacaaacaaattagagaagggcagcagacacaaaaaatgatttgtgatgatccaaatcaaaacaaaaaataaaaatcatccatccatccatcaatcaatcaagctttgccatcaatcggtgtttccaatattccgttgccgttggtctgcagttgtttctgctgctgggccttctgctgttgtggtggtggtggtggtgaagctgatgacagcggcggttgttggtcaatcgacgcggcgagaaaaagcgcttaaaaacaaattcaaagaaaaaaaaaatcaaatttttcaaaaaattttagccaattttttggatccagcaggcccctgatttagaaatgaaatgaaattcatataaaatttgtcttactactgtaaaattgatacaatttttcagaaaatttcaaccattttctcatttggtgcaaaggctcgaaaaatttttgcaaattaacacaataagaatttttcaaaaatttttccaaaaagttggaggggtgaaacgtggtgcaccctaattttccatgcctaccatgattgtcggcaatggacacgcccaacactcgatatccgtccaaatgtgccgaagtgatctgacgcggcttcgacaccaccttctcatcctcttccttgatgcccagcccgagttggccaaccgtgtcgcagccgaaaccgaacactcgacctgaaaacaaatttttatcgaaaaatcaaaaaaaaaaatgttgatgtggaaatcagctatgaattgtgagtccaaaatgtagataaattttgtaattgaaaagtgttttattatgggagcaccccaaaatctctccaccaaaatttacaaaaaaaaaaaaaaaaaatttgctttttcacaaaaaaattttctatcgagaatcttattgctagaaattttttttctgactgaccatcatccgtccaaaatatggtggcgcccagcgttgcgtccacgccggccacggtgttcactccgtccggcaatgggatgtgctgcagtgtgtcatagcgccagtgctcctcgtcatggttgccctgaaataacatttatcttcaatttttttaaacgttttcttggaaaactttcggaaataattaataaaagcatcaaaaattttcgtgaattttttttagaaaaatttcaaaaatacacaacctgccacgtgtcgaggcccaacgcgttgtccgtgttcttgccaatcccataaatttggctgtcgtccccactccgacagatcacatgctgcacgcccgccacatgggtccaccgtttttcggccggaaacgcggtggcgcaagtgagcagtgccaccttgttggactcctcttggccagcggcgatggtggccggcgactttggcttgggcggaccgattccaccgtcatctgaatatacgttgtggaaatgttttaattttgtttaaattttttggagacctgcctcccccgggagcaactcccccctccccagaaaatttaaaaatttttttttgtaaaaaaatgcaaaatttttttgagcgttttttggaaagttttcgaaaaaccattaactcattataaaccctataagcaatggcaactcctccagaagagaaacttgcacaatgttgaagaaaggcaattcgta

SEQ ID NO: 16062 - DNA, 1596 bp, Heterodera glycines
atatatatatatatatatataatatatatttatattatgtattttttatttttatttttactgaattatctgaagaataaaaattaaattccaaaggagaaaaaagtggtaataaaatttaaaaaattatggcgtttcttaaagcatcaattttttttttctaaagcattttaattaaaaaaaaggaatttcattgtaagaaaaataaaatgacaaggaatttttgaccttatacgggtcgaccacttggacgtaaaggatggcatccaaatccagctgaacattgtccttggtaattgcttcttgttgtggaatttcaatgcacatttccttcaaacagtgccgataccgtatctcgtcgatgagagggtatacgatatgcaccccctaaattaaattaaaaagatttacttcttgcaataaataaattattttccgtattattgttttataaaataaaatcactacggcattaaaattaaaaatattattgttataaatttaaatatttattattaaattaaattttttggtgtttaataaataccgaaaaataattttaaaaattttaattttaatattaccggctcaagaatgcgatggaattttcccgcacgttcaacaacccaagcatattgatgaggaacaaaatgaagaattgtattgaattttccacctttaaaatgttttgaatgcatttttatctgtaaaaaaattaaattaattatcttttattaaaaaaaatttgtattttttaaaaattaattttattaaaactttctaaaaatataatgaaaatagaaaattcattcattattatttccaataaaaatttaattatttcactgaaaatcgtaattataaaattgaaaattccgatctatactaagttcagacattaaacaaccgatgaaatttaaaattaagtgttcgccaaatttaacaataaatttgaactgatgaattacggaaatcaaaaacttgtttttcttccatttattggaggtaaactgttgaaatgaaattaaacaaaaaaagaaggaaaatttagtattccatcaataaaattttcaaataactttaatgacttaaagaatgtgtgctcatctatttgggccaattttcgttctaaagtcagtcaggaatttaaatgaaataattttatgtatttaaaataaaaaaccaacattttcaacaattcttttttgttgttgaaaaaaaatgatttttatttatttattttttactattttaaatcgtaatttaaaaaagtgattttaaaggcatttaaataaaaattctggaatgttccgtaaatgcctaaagaatgtggcggcgttcttgcaataggaccatcagttatcaaagatgggtgaatcattccataaacaattggtacataaattttaatcgttaataaaaattagaaattgtgccaagagataagaaatatttgaattaaaataaaaaaaaagaaatagtttttaatttatttttcgttctctttaaaattttaaatgaaaaaaattagattgaaaaataccagttttaactgattaaaaaattttgagaagggtggagcacggcgatgcgcag

SEQ ID NO: 16063 - DNA, 2741 bp, Heterodera glycines
  misc_feature (21)..(21): n is a, c, g, or t
  misc_feature (226)..(226): n is a, c, g, or t
  misc_feature (313)..(313): n is a, c, g, or t
  misc_feature (351)..(351): n is a, c, g, or t
  misc_feature (362)..(362): n is a, c, g, or t
  misc_feature (1791)..(1791): n is a, c, g, or t
aaaaggagccgcctcacggcnggggcagcaccaaaagccccacattttaaaaaggaaacggccgatttcacataattttttcatctttgctaagccaattgaagtccgacgaaaactgtcttaattatttgcctcaataaaatgtctgacaaccgaaacgaagcggaggagaaaatggcgaaagcaatgtaaaattaaaatgccaattttcaatttcaatttttanattttgttttccttttttcagttttatctctggcgacggttggctttgtgtgttcgaattgcttccggcttcacaacttggccttgnaattgcgatgatcagccacccgtttgacttctacgtgnatgaacacttncagactcgctactggactctgagatccatgaaaatcaaaatgaagttcgaagcggatggcacccaagaaatggatgttggccatgccaattggaatcgtttggaatacgcaaaagcccgttgcaaagaaaagcccccgatttcaaggccctttcattgaaggggaattttgtggatttttttttctgtttgtaaaaaaaatccccttcatttttcccaggggaattccaaaaacaaaggggatttccttttttccccccccttttttctttaaatttttccccccccccccccccctttttttttccccctccaaccccattttttttatacaccccccttttgggggccaattttttgtccaaaatttttggccccataagcccgcaaaaaaaattttgtgggctcctattttttaaaaaaaaaagtatttgccgggggttggggaaaatatcccccgctaatttttcccaaaaagggcccccacatccccgggggggaaaaagcgtactaaaaggggggtttcccccccaaatttcccccaaaaaaaaaaatggggaggggaaaaaaaaaagagggggggaaaattttttttttcctccccccccccccaaaaaaaaaaaaaaaaaaaaaaaaattttaaaaaaagggggggtggttttttttttctcccccccaaacaacccaccacaaaaaaggtgttttttttttttttttttttttttttttttgtttttttgtttggggggggggaaaaaaaaaaaaaaaaaaaaaaagggggggaaaaaaaaaaaaaaattttttttttttttttttttttttttttttttttttccccaaaaaaaaatatttttttataaaaaaaaaaaaaaatttttttttttttttttttttttttttttttttttaaaaaaaaaaagggggggggggtgtgaaaaaattttaaaaaaaaaaaaaaaaaaaattttttttttttttttttttttttttttttttaaaaaaaaaaaaaaaaaaaaaaaaaaaacccttttttttttaaaaaaaaaatgggggggggggggccgggggggcgccaacccccccccccggggaaaaaatttttttatattttttttgtttttttttgaggaaaaattccccccccaatttttaaaaaaaaatggggaaaaaacaaaattttttccaaatttatttttgggacccttccaaaatgaaaaaaagggaaacggggcaaaaagggtgtttgggggcccattcccggcttttttttaaacccattttttccctgggggaaacatttgaattgggggtcccgggggggtaaatagcagggggggacctgaccaagccttttttttagattgggttagccttgggagagtggtatgaaaaatgacgacatggaaaaacggagaaaatatggggtactntccgttatggtacaccccccgaaacttttttaaatatttttttctagtcttattttagtgctgaaaatgaatccggcatgtttttttgatccgacgtcattacaaagaaaatctcttacattataatccgaatttataatgctgtgtcataaaaactaaacatcaattgaatggctcgcttaagtacacaactttgcgggtaagatcaacgatcattttcacgtaaaatcgatttcttgtaaatgacctcggatcaaaaaaacaattccggattagttttcagcgcttaaaataagtatagaaaaaaaagaataaaaaaaccataacggaaaagtatgaaatatgtgttataggtagggtgtccaaaatatggatataaaatcgtcaaatatggcataaaatatggatataaattcatgaaatatggccataaaatattgaccaaaaatcgcgaaatatggatataaatggcaaaaatttgaaaataaaattcctaaattaagaattaaaatttcttctaattcgaatgcaaaactttcaaaaatggctaaaatatgttattaaaaatcattttaggaaaaaatagtaataaagctaaggtttaattagtttttagccaaaaacaacattaaaagcgaaattttcgcttttatccttttttgacacaaaatcaaatttttaaatttgcattattcaatattctaaagagaattttactaaaaatttttttttttttttggaaattttttttcgggctttatgggtcaaatataaatatagtataaaatcgaattaagaaattaaagcactcgctcagctgctgttccatccgcttctctattgaaccccctaaggctgtgaagccctccctcacccagtacattctcccgacactgctctagcggactacaagtattttgtccgaaatgagctatttttgaaattttctt

SEQ ID NO: 16064 - DNA, 2366 bp, Heterodera glycines
  misc_feature (5)..(5): n is a, c, g, or t
cgtcncattcgttcaccaattcaaacggcaccattggcattgacggcacatgaacataaaaatgaatttggtaactgacggaagaaatggcattggcacggagaaaatgctaaataatttgaaaacaaaaaacagtgatttgccaaaaatgtaggggccacaccagggatggcatggaattccgatttccgaaatctaacaaaattcctaaattattttacagttcaaattttctacgtattattatggaattaggttatttattagcaaaatttttaacatttggtctaaattaaatatatttgtaatgtgctttttaaaattatcatttaatactttttatattcttgccgtgtgaatacgatccatgtcgtttaaactagggttgctccccgacccttcggtgggcaaaatgtcggggccggggaccgtcgggggcatatgtcgggggtcgggcggggaggggttaaatagtcggggatcggggaccccgatcggggaatgatgaaaatttattttgtcaaaaaaacaatttttattttttcaattcccgtaaacaaaattttcaaaactcaaaaacttctttgtcttcactttcatcatctgattcagattcgtttttggtgccagtaaaagtgcatccaagttgacctttacaatcaaaatttgtcgaacagtattgccggaaagccttaaattagcaaataaattaaacatatttattgatttttgacctatttcgaagtgaattggtaaagataagtccagcttttgagaacagcctttccgagctgactgatgtagcaggaatgctgtggaccatccttgcaagttttgacaactcgggaagacgagcagcgttttcatgccaccaggaaaataagtctccgttcacttctaacctttggcctgccttaaagcaagcaagttcagcttcaatttttgatcaaaaaatctgagtcaggatctccagaaatggtcgaagggatagaaattctacacggtgattttggttgggcccagatgtcatctaaaaaattaaattaaagatttatgtgtgattttgccgtacatttctctatactctcattactgcttggacttaattcttggtaagcaaaggtcggatcaattcctgacccaactcgaccaaagtcgtcaacatcaaaataagcatccatttctgttgtcgggcagaccaattcttaagggataaaaaattcatattattttaatgacctaaattaataataattcaaccaactttcttttgcaaattcaactaattgcttttcaacaaccctccaatttcaaagtcgttaatttccaaatttggcaaattttctgggacaatgtcgaggcgcgacttttttgatgggccaacaccgaatccaagtctttctccttcaatggttaaaagaacgtttaaaattttctcaaaaaggtattttcgtggcaagaattttaatttaaaaaattatttttttatgtacctattttgtttttttgcccttaaaattcccagccctactcatttgcaatgcaataagtgaataaaaattatttttacttaatttttgtctgaaaattatgtcactattcgtcactatttcggactttttgtcactatttcttcactattttggcatttttactcactattttagttaactattttgggatttttcgtcactaaaattcacagccctaataatcaatatatttaaacttaacctattttaagaataattccttatattatcattattttagaaattttataaccatttatttaaatattattacatacttcttttgttatgaattaaataaaatttgacagattatgtttaaatatttcaaatataatttttaacgtcatttactatttttgtaatttttgctgtttgaaaacaaattaaattattttttttccagctttgtagtgcaaatgttgtatcaaacatttttaataataaattattctaaattggtaggttttatcaaaatatatttaaataaatttttgctttttaggattggtttccagtcttattatataacataacttttttataagacaaaaaacattttaattgtttattttattatacagaatttactgaaaatttaatggctaaataaaacaacttttatttatatttttaacaaaaattgaaaatatttgaataattttatctttaaaataccttcaaagttttctggtcttaatgacaataataaaaaaaatggttatgaaaaaacatgaaattatatgttcatttgaatatttagaaaaagaaatgttgattaactattttttaaaatgttatcatacaataaatagaagtaaaataagtaataaa

SEQ ID NO: 16065 - DNA, 1395 bp, Heterodera glycines
atttaaatcttttaaaattattttggttttgcgtataaatttccttttatttctgttcttttgtcctcttttatttttagcgcctgtaataaaaaagacttggcaaaaattaattgcttatattttacaatataatttaagtcaaataatttatatggtaattattggtagttttttaaaattcttttttttcttgcaatcggcttttttctttgctcagaaagtttaattaagtcaagtttttacaaaaattatacattaattttttaattaaattttaaaaacaaattaagttatggtttccatcaatatttaaaatatggtaaattatttttatattgttaactttatgtttgaatcatgctcagtagtatcagacacattaattccccccccccttcttaatcgccctcattccttacaaccaaaaaaatgtttatttccttcgcaggaatttaccaatcaatgctctctctgttcaattactgcacgtctctgtcccttccaaacgagtcgcgcagtaattgacagccaactccccctccccctccctccaatttgacaatcaccgccaatcgttccgtcttttttctgctgttcacttttgcttcacactcacaaccccactgcgcaaccaagggatgcgtctgtcaattgcatcattactctatacatatattttttctttatgtattcctaaaaaccattcgttttcagcttttataaaataatccttatttaaaatcattttttaaataaattaaaatcactagaaggtcgataatttaatctttattaacggaaatttcatgccatctcgcaatttttgtccatattttacgaatccaattaaactcatattccccattttttttttgcctttttggtgattgcctgcctattcgctatgttatctgaaaaaaacgttttttcttaaaatttgagtttccttctccctattattttacttttttaaaatctatgactcaacacattcacattttttattgtgttttttaaaattttaattaccataaccatttattagcctccaaaatttcgcaggcagtttatatagccttgcgcgcctcaattggcgcgcgctaaggctaggcgccttcgttggcgccgactgcatgtgattaatatttttaattaagttaataaatggttatggcaatttctatatcaaaatctcgcggccagttatatagccttgtgcgccttgattggcgcacattaaggctaggcgcctcaattggcgccggctgcccgcgagactgttaaatagattagaaaaatatagatttgtatactttaaattttcttgatgaatgctttgagttaataataggtctgagtaatcgattaaattttttaagttttttaaagttt

SEQ ID NO: 16066 - DNA, 3640 bp, Heterodera glycines
ctgggataatccccgccctccccggggttcattccctttaatcaacgaaaagtttttgaatttttgcgaaattaaccttcttaatttgcgcttggaggatgggaacatgaacagcgccgcgtgggactatcttttcctgcacaaatttggaatggtaaaaaattaattttatgtatttttatgttttaaaattttttagcatgaaaaaatgatgaaggaggcattcatcgccgagctgagttcagtgataaacacacacaatttaagccgtttcctttacgcttacaatcgacggacgaacatatgcgaaataattggcaaaaaattggcaaagtgtccaatatttgaaacgaaaaattattaattaattgattttgaaatcgaattttaagtaccgacgtgctccttattaccgggtcgcgcgcgccgcacaacgaagtccgtgccaaaatcatttaataaattgaacatttaatttaatttttaaataggatgttcgacatatgttcgaaaacatgcgccgtgataagagcacgttgcttgtcatcgacgaagtcatagacgtacttgctgaagctgttggtttttgtgaaattattgtcaaattattcaaattttgtttttaaattgtgtgtttaatagctgttaagtttgtaaatatgaatttgataattagccaaactcctaattaggcatattaactcatggatttagcccagtcgtgttgcgcgctcgctgatccttttctgtaagggcttcggcgaattgagcggcgtagaaacaccgggcattggccgtttgcgatcggcgagcatgtgggtattagactcggttaaatgatagtcttgaaaaaatgatagggccgacaagcactgcccgaaaattttttttttttttgaaaagagctaacaactttttgggctacaaatttcaaggtattttctttttcactaatatataaatgtgatgacaaataaatttaagtttttaaattcataaacaaatcgcttaaatttaataagaaagtttaaaatgatcaaatttcaggagcatggaagaagctgatcgaccaacgcgcaaattttcatcgccacccaaagaaacgatcgctgaagacggtaacctacagaaaaaagataccgtaaaaattgctcggctgacactgaaaaaggcaaccgcagtctaaaagaaaatgcagaagaaaatgagcttattataagacaattatttatgcatttatttgttggtctcttgacctattgatatttggtataatatctattccaaaaaataacggtttttggtgatttttattgtaaaaaaatgaaaattaagcaaaaaaaataaataattgctcggcactgagaatgaaaatccccgaattaaaaagatttatttatttatttttgcaacaaaactgggcaaatcaaaccaaaatgatattcttgagaaatgtaaaggaattgctgagatttcgtcccgatagtgaaaatggcgatgattttttggcaattgagtctcaaaaggaaatgaaatcccaaacacattaagcatcttcaaataaagccgtacttcctagcaaaccgctaattgctgataaaataagatataaaattataatttaaaatttccattattactaattttttgccatataaaatcgataaaaaattacatatatcttaaagatataataattttttttgttaatttgaaattatgacgtatgtatgatatcaataaaaatcaatccaatattcatcatatgcataaaattttatagcaaacgaaattcatttcatttattcattaattccatcaattttatttcattttcattttttcttggctaattttatacaagaaattattgcgagtaaaataatatgcttattaatttaggctttaatcattttcagcctaatacatattacacaatcctgacttttcatatgactacttttcccacaaccgtcgccttcctcacaattttcctagcgcatttatcgctattttatgatgcgagggtaaattaattgattgtttatttcaataattagtcttttttttaattttcagtgtgatgattccttctctgatacattcacctcgcacatcagcttatattgatacttccgctaaacaaccgcaaaatttggtggaattggacttggaagaagtgcgcaagttgcagcaattcatcggacaaaatgccatcaatcacattgttgttgaggatggcatttttgccggaatgttctcctgtcaacagaacatcgaattccgattagaagacgaggccattatgggtgatggcaaaatgcatcgaatgctgttctcattcggagcaatattaagtgccgaaattggtggaccagaaaaaacgccatatgaaaacagcaaatatttgcgttcacttttgaaagcttacgaatgcgcgggaggggcattaaaacaagttgaaaaaaggcataaaattctattaaattataattatatattttgaaacagattatttaaaattaaaaacaatattaatacaatgatttttatttaaatgtttttttatttatacgatttttaaagtcaaataaatgatgaacccgccaagcggtcgttggtggccaaattacgtaattttggaaaaaggtgggatagttatatttgatgaaaataccgagtcccgatctcatctattttctgtattgtatctactcactggcttccgtctcggttttcaagagcattatttcattacagatggattttgtttttaatattttcgttgatatagatgctaatgaaagttaaaaaatggccgtcgacgcttgatgagtcctcaaccatttcataaatgcgaaaatttgcgggattaatcccgcggggtcctgttccgcaaaaattttgagttccggtccacagcgagattcacaaacttgaaattttcgggactctagtagatacaaaaaaatatatgggagctgtctgaggacgcgggggtctaatcgctaacagttgagaattggtcggaatgggtctctcttctgtcaaacatggctactaatttggccctctgcatagtcaccatagcatttcgttatatcgcaatttaagtaaaaaagacgctaaaaaattactgtaaatttaaaaaatatataaattatattgatctaaataatacaaatatgaatgttgatctccgcatacaaaaaagattgggagccgtcgggggcggggggggggggtctcatagctaacagtttttcaattggtcaaatgggtctctcaagcatggctaataatttataattggtcgaaattgatctatcaagcatggctaataatttataattggtctaaaatgatctatcaaacatggctaataatttgggccttttgcataggcatcatagtatttcgttttatgggaattacttaaaattttttcattaacagaagttttgaactcccacaattgatcgatcctacaggtaaacaatttcaacgaagcttacccctttttgtttttctgtttcagtgtcccaaattttgcaattttaccggcattttgaaaaaaattcaattgtcaatttaaaagtggaaataacatagctactgctgactgataagaagacctgca

SEQ ID NO: 16067 - DNA, 3753 bp, Heterodera glycines
tttttttcttaaaatgcttaaattgcgattaagaaaaattttaggacctgctgaaaaatgagattcaattaaaattatacagtgtgacccaaaatgatacattcacctccgaatttgtgtttttagactgttctaattagggctaatggtttttgcctatttttcctaagcttccagtgatctgaaacgcacgaaaaacatttttttcggttgtttttgagctacttctaataaacgacccaaaatttttcaaaaatacgcccctaagaaataaaaaattttctcaaaaattcatctccaaaatttatttatttactttcttgacaagaatttgtgattttaaaaattatttagctcaataatgatttggcctaatttttttattttttgaataaattttgtcattttacatacctaaatttgaggctttttagtgcctattttggcagtttttagagcctaaaaatattagccctagttctaattgactaacttggtttgaattgtacaaagcaatgaaatgtgtaattgactttttgagaagcttcaaaaattaagcttacatgaattatttcaagtttttggggcgacattttccaatattatgaatttttgaaagtgaaagtatcgttttgtgtcacctattttataaaaaattggtggatattgaagaccaaaaaaagaaaaatttcttttatcaattaaatcaattcttattatttgcgtctttttcattgctttgcataatttcaaacaatttcctcaattaaaacattctaaaaactcaaattagggggtgaacgtattattttgtgtcacactgtaatggttactaaaattacctgggtctttaaaggatctgccctttgatttttcaggtttttttgttttctccaattgtccacttttctttattattttctccgatcttttgagcacttcttaaattatatgtgatatgtatttttatggttttaacgccgcaaagttttttaattagcagttaataaattcccaaaaaatacaaattatgagaattttttcaaaattcatatttcctcaaataaataaaagtaataaaataaagaattctcgaatgaaaattaaaagatttgattcgaaagtatttttattagtcggtcgaaatctctgggtctaaaacattttcgttttaagaatttttatgggaaatttaagagtttttgcctcaaatcttccatgtccccaagaatccggcaacattccattccgttatcaaaaagcaataaaatttacgtgataaagtaatgccggccaattgcgtcaaatccatctcttcagctgattcattctcacatttttccttggagcttaaacagcctccgaatatttcataattgaacaaagcaaaaataagaagcaatacaatttttatattcatttaattttattcagcgcaatttgtaattggattaaaatgaaaaataataaaaaatgtttccccaactgaattttatgctaaaaagcgtcaatattaatcaatatcaaaaaccacttacgtataagcatttaatgtttagctcatccctatgggctgatactcgaatatattcgagacctaaataaaccccaaaagttaaatttttctcgagtcgttagttgggctgagattatcgcagtgttaaataggcacaaaacgccataaaaatcaactaaataggcttagaatcacttttaaatatttaaaaaataatttttaatatctattttttttgcaaaaaaaattattttttagagtacatttcagaaaattttttttaatttttcagaagaaattttataaaaaatgaaaatttgtacgaaaattgcgaaattttggattttttggggcatttaataaaattttctttaaaaatcctcaaaaattcaggaaaatgctaaaaactcagcattaaaaaacactaaatatttatatacatttacaattgaaatataatcaattctttcgatttttttgatatattttgctacctaaaaaactttttttttgtttctcctatttttatgcctatttaatgcctattatgagatttttcctgcctttttagttgcctatttcgcgattttttgtgcctagaaaggaatccctaatgaaatcaattgacgttattttttcggtataaaaatttcctctttatttgataataatccgttcgccattaatccgttagcaaaatatggattataaaagacagttttacgtttattgacaaataaaatcctctcagattgcgtcggttcgctttcatcttctgatttttagcttagctcatcaatggttatcgcgtgatttgcaaattcaactcatttgcttttctaatcattgcattatttaaatgcccaaatgagcagaagaccaagaataatgcaaaaaatgtaaaggcacaaaaaattggcagagaaactttaaataacaaaaattcagagcaggggaaccgacgtgggggaaacgatgggggtgggtaaaaacctgcgccgtttaattcacctcaataaggtcctcgccagtgtaccgcgtcggtggctcctgcgcaggaaatgccacggaaaagtcgtcaatgtgaaaagtgccgaacctgccaaacaaagcctggaaaaatgttttgcattcagttttcataaaaacataaattgataaatgaccataaaatgaaaaatgaaatcaagaataaatgagaataattttttgcccatctaaatgaaattcgcttatttcagtcaatgcgctcgtccagcaagtgaaccgaatttgcaactgtaagagatttttgtaaaaattaattaaccaaaaaaaccgtccatggtggcgaaaattttttttcattttttgggggtacaactgtttaaagggttttcggttgtctgaggatccgattctggcacccatttgattttataagaatagcttcattttttctaaactcaatattgttttattttacatgtttgactgaataaattctcaatagatatatatgtataacggcagaagtgtcttaaaattctttttctttttgggaatgattttccagctcatttcccctttttaaattatcattttcatttggatatcatcttctgtatcagtcacagattaagtatagataaattattaacagggatgccaaaaatatgcacgaaaagtggccaaaatatgcgcataaatatgcaaataaaattgccaaatatgcaccaaatatgcacaaaaaaacttgaaaattaggggtgcaaatttaataaaaaaatttttttttcactagtgcatttgccaatgagctacatttcctttataaaattctccttagcaaatatttgacattttttaaatcaaaaattttctcatgaaaaataaatttggggaaacaatttttgaaaaaattttccaattcttagtggtgtatttttaaaaacatttttggtcgattcttaggggtgtatctttctgtattttttaggacctatttttaggggtgtattttccgtttgtactgcatttttgttaacaaattttccaaaaaatggcaaaatatgcataaaaattcataaaaacccaaaatatgcataaaggcccaaaatatgcaaaaatatgcaaataaaagtcccgatttttatacgcaaacacaaaaaagaaagtgtttttcgtactatttagagcatggagaagccaggaaaaaaaaatatgcatttgcatacttttggcagccctaattatta

SEQ ID NO: 16068 - DNA, 2712 bp, Heterodera glycines
gttgacttttgtaattcagttcagaattatcagaatagcttgaaagtttgcatgaaaatactttgacataagccctatcaccctgcaaaatttcagattttttcatactagtaaaacatttttacaaagaaccgcctgtttttaaaacttgaccaccaagttggcttaggctggaaaaagcggattttcttaaaaaattctgagtgcataaaaatttctgaaatttggcagggtgttaggactcgtgctaaagtattttcatgcaaaatttcaaactcttctgaaaacaatgcattgagttagaaaattccgcttggcgatttgtgcaagtttttagcacctaaaaatccgttccctgtccataaccatatttaattctgattattctgatagcgtcagaataattatgattaacttatcagcagaataacaaaattgttttattttgtgttccaaaaccataaattaattctggtcttcattaaaactttatcaatgttctcatgagccagaataattctaagttcggtgatgctggcagacgccgtgattcgctttttaaatttttaaaatcctcataaggcctattcaaaattatctatacgatgataaaaaaatacaaattaggcgcttacttcccatgcgcatatttccgatgtcaagcatggaaatttcctaacaaataagctatttcttcaaaatttgttgctgactgacggtgccgctgagcccaaaggaaatttatgaagttttaggtgaattatgaacagaattagtcgacaaattatgattcgcaatttagagccaatttaaagtgtaaaatggaattacctgaaaagttgtttaaattaaataaaaattaattttttccttcgcgcttcacctcctcttctttatgtttcatgtttttgcccgcattttctgctttaaattattgaaaataatgagaagtattttgatacaatcgtactaaaatccctgtggtaatagtacaaaaaaaacaatatttacaaaattattgcttcgtgctttcgtggcattggtcctgatttttccactctcttcgtgatgggtgttttcttccggtcagtctgtccaacacttgtctattgtcatcctcttctgtttctctgttcatcttcctactctgtcctcttttatcttcctcttccccttccgttctcctcctcatccggtcttccctttcttcctcctcttcttcccccttttctttctcttcctctttttctttctcctcctcttcttccgtttctctcttcttcgtcttcctctccatctgatgtatttcttcttcttcatccgtttcttccacctctttttgcttcatttttattctctttgtccgttgcacattttcgcccattcttcccagcgaattttgctcaatttctttcagcaaagtttcgttccatttttggccatccgattcccacaacgcaacggaggtgcagcgttcgactgaaatttggaaagttttttcatttttatctcggtttttctgcggtgcggtgcctaccgtccgttccccaaaatgtttggaaaaaattcaacagaatactggtaccaattataccaaaattaaatgggaccaaaaattacgtccgatcagtggggagcgtagttgttgtgcagtgaccatcactttgtgcgtgccgttcctcccttcccgggggtcccttttctgccgcggtgctggcacaacggccgattcgagcagtactttctttttgccaaaatgccgcaggaaagtggcacggaaggggcgtgagaagttgtagtaaatgacgaagttgagggacgagttgaacaccaccaaaagattggaaatatcgatgatgtaattgatgcgccatgacaatgcggtggacagatgcttaaaagatggttggttgtgctggtgcaaaaatgtcgatacagtacactaacaaatggcgcaggacgggaccccgcgcaggatttttcgggatcccattccgcaacccgcatttttttggaaattgtgggattttgcgggatattcctatgagattcgttctcgcaaaaattttgaattccaatcccgcagcggaattcgcaaaattgaaatttccgggatctaaaaaacaattcataaattcaaaaataactctgtaaatttaaaagttaaattaaggctaaggagacacaaatattttctattaaaaaaccattatgagattaaaatggtcagaaagaatcatttatagaaaatccaactcaattagatgagctgatcatttgtcatcagatggaaaatttctcgagattgattaattaccgatacggaacaacggctttttatacatttgtgcagtgatttgcatttggacaaattaccgtttcaaaaatgttaatgagcaaggcaattgagttgcagagaatgaacagcaacacgaccaaaatctgagttcagtgagcaataaatttatggacagtcggaaatataaattattgtaaattcaatatttagtcactgactaatgcggtagaaatttaaattaggccccaataaaaattgaaaatgccatttttgtccaaagaacccatggttcaccagtgccatgttgtcctcggaattgccgcgtttgcagatcaccgtgccgacgatcaccgccgtgttcagagcgatcagaataaccaaagggccgacggcgagaaaaaaggcgtacaaat

SEQ ID NO: 16069 - DNA, 3063 bp, Heterodera glycines
tttttcaacaaatcatttgctggcggtgttgcatgtactgatgcttatgtcagctggttctccatcaactttgctctattttggctgaaagaatggacagcgtgcaaatcacatcaatcttgaacgaaaaccgggggaccgcacgagtctttcggggctgcttcgccagtgatcaattaccgcctccggtcactctacagtatcctgcagcgctaattgtgaaccgggacccacattacaagggagggtctcattggtgtgcaatttatgcgaagggaatggaagaaccagtgatttattatgacagcttagcccaaaaaataccatctgtcattgtgtcatcattcctgaataagtttccaatgggcctaagaaaaaatattcgttcctatcaatcccaattagtgtcaacgtgtgccccacactgtattgtttttgtgtatcatatgtcacaaggtcattcatttcaacaatttattgagaaaatggaaaaatcgacaaattccgatctgtatgtaatgataatgatgaataaattggtcaagtaaaatgcttagaaaatgctaaggaaaaaatgcaaattgtcaggttgactaagctcagggagaattctgacatacccagcatactttttcaagtgtgggttgaacagccaaaaaaattcaaaaccatcacttcggacctccggaaaaaagccatgagaaagcattacgttcatcggttgttgcagaatccacggcaaatgttgacggtagaaaattccacagcaaatgggccgtttcatgagccaaggagttggtgagctcattgcaaaatcgagcagaagcccaaacaaattcccaatggcaattgactaaaaattttgtgttgtcattaaaaatttaaaaattttcgcttacatttgttgcatgggtcatcacaaaataagtctcgaacaaattcgttcccagtcgtccgtagcacaggtagtgcaggagctcatttcggctgaggtcctgcggcagttcttcctgtagaagcagtctccccactttcttcttcttcggtgtccttttctcctcaaacatcacatcgaataatgcaataacacccttctaaaaataatttatgtaataaaataaaaatggtgaaaataccaaatattcaaagcacttttggcgctgactacggaaacactcgaattggtaacaaacaggaccaattggagctcgcttcacactggcaaataggcagactaatggcacgaaactgatcagctcgctgttcaattcagccggcaggcgtcgacgaagtttgggctttttctcactcattggaaggttcaaaggattagggcgtttcattttccaaaatttgaataaagaatgatttcgatttcttggtgggaataattttggtgcgcaagtgggcgtggccaaagtgcacacatcgtacacccggtcattttcccgattcattttaaaaattttcatctttttttgcacatctgctgttttcctctcctccctcacttatcttttgctttatggggaccatattatttaattgggaattttcgggaccgtataattaaaattaatattttgctgttaaccagggcggtagctataattacaaaaagcaccgtttatcctggcagcattttgccttttagggcttgaggtcgttcgcgtgacttgactaatttcccgagtcgtttaggtgccctgtcgtcttgtgcttcatgggtggcggtgtgctgctcttcaggccatagttggtttatattttttgactattttccatgcccaaatatttattattcattcaccattttacgccattttccatgccggcgctcgcatataaataccgagatttttgctcactcctcaccctttctcagattaaaaaaatggacaatcatccctgaaaacgatcctctaacttttccattgaccatattctctccgcacctaaaaggccccgacaaggcttcctgatcaatgaactcttgggcgtagtccacttccttggatctgttcaacaaggcgaaggaacatcaaaacaggccaaggactacgttaaaaaattggacaacagcattgaacacgtggccaaattccactacgtaaaagtcaagtcaaagttcaccattacggatttgccaagcacgcctgaggcactgttggccggaattttccaacactgcatcgacgaggctattgctgacagccgtgagcgcaacatcgaacctacacacctcggctgtatgatcagcagccctctgttgaaaggcggcgacatcccaactccagtgcgacagatgactaacaacactctcgacaccattctcaaccagttcaaaaaagtggcgcagtccaaacaacagaaaaatgtatcgttatggggtgagccgtttaccgtcaccataacgacattgaatcgcaatggactgccacccaaacgtcgagtcaaagggggagctcgtcgtccagtcaaaactgccgttcatcaccgaattaacgaccaatgtctgattaaaattcgcaatcccgatgaccactactgccttttctatgcgctgcaggcaacaatggtcgacaaaacgtgcaattggcctcgctggaagttttcccgttacttgaacaaccaatacggacagcagggacaacttcatcgtgatgcagttgagctcatgaagcaggtgaaagcaccaatggacttggatggctacgacgcagatactttcgtgcctctcattgttgatcactggaacaatatgcagcaacaacaccgctttgctgtgttcatctttggatcgttgggacagtataaaccgatctacaagtacattgacaacatttacgacactccgctgctgttgtacttcaatgaggaccattttgatggtgtgcagaagcagggcggtctttttgggcaaccatactgcttggagtgtgagcgcccgtaccgaagaatgtcgacacacagtaaatcatgtaaggcgcgctgtgtgctgtgctcacgtgttggacctgctttaagatgtccatcatccgccggcttcttcaaaaaatgtaa

SEQ ID NO: 16070 - DNA, 2321 bp, Heterodera glycines
tgcgaaaacccctggagttcacaacaaaaaaaagctcggaattccttttttcgaccttttttttgtggaccagtaaagcgtacgattaccgaaaaccctctcaaacaaatgttttgtaagcaaggtgtaattcctcttttccagtttttatgccctttgttgaccatgcagactgggaattggtgcaaacttttgggacccgttcggctgcggtgcaattttgcgttgacgaaggcgcgccgcgccaccatccaaatggaatcagattcatttacgcattctgcacatatcctgctgggtgcggcgggcagtttcggatgtgagttaatgtggactcaaagtatataatgtacaagggttaggctgggggtgggggaggtcatgccgccacccgcatggggtcagcgggcgtcgataagcaataagagaagtgtttggaattttgacccaaaaaggcgaaaaaatgtttaacccgaaggtacaaaaaagttctctaccatataaaacttatttacgagtgtggtcctaaacaggagaattgcattttaggcgcatcaagcaggtcctaagcactgtctatttcgaagcgtgtgctgaattggtcaaattctccgacttttgcgccaaatatcgcgtccctttgctccattacctttggtaattttggatccacatgttggttatttattatttgtctagttttgatttagtcaaaaatcattgcaacatcaaaaatccctggaaacgtgttttcacgactttttagaacagaaaaaaaattttaaccaaaaaaggggcgaggggaggcaaactttactattataattggattctgcgaccattaaaaccccaggatggtataaatcgaataaaaaacaaaattttccttgaaaaaatggggagctccgtctatgaataaatgttggtttttgcggagccaagacaagtcagcacttattaagggcacccatcaattgggaccttgttgaacatgttggccaccgcgtgaccggattgccattgattgaaaatgcaaattgcgtttggtatcgcgataatggccaaaacaaaattaccgttgtgtggtggatgcccgttgtcgctataaaatgtcagttgtgataaccttaccaaattatatgttttttgatttcattgtttcaggtgcttgaaacgaggttttgggggctttgtgttgatggaatcagagggcggacacaatgatcactgatttttttgagcacatcggaggaaatgagtgttcggattgccagaattgctgaactgaatcgagcgaaaacaatggaaccatcaaaatattataaatattgcttttttgtttgatgaaaataggccaaataaatttattgcgtgactatttgtttgttttctttgccataggattattctttttgaagatttattcaattggatatttattgaagggatttgtccccgtgcgtgtcccaaatatccaaccaaataaaaatatatagcatgcatccgctcgcccccctcgcaagttttttggaaaaatgtgccgcaaaaatgttaaaatctgatttagtgatcccgaatgcactgaaatttacgatttgcttatttcctccccaaaattgttaaaaccgataatggaagatgaaaaatataataattagagctcgacttttgaggcatatgcctttttttctgcgcactagttccgatatattgagcataataacgcatttttcactctttccaggacagagttcgaaaaaagcaaataaattttaaattaatctttttttgaagatcaatccggctgttcggtttttggagccctccgacattttgtctcaatgggtcgtcgcttttcctggtcatttggaagaatcgactgtcaggtgggtcgttgagtttatattaatgtggactcaaaatatataatgtgcaagggtaggctgggacaccactttcatttgtgaaggtgtgttttcgtttttgaaattccgaattagggggtgtattttataaaattttagccgtttcgccaaaaaattaatattcactttttcaaaaatcgtaaaatgatgacccggcggtgctgataggtagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacattt

SEQ ID NO: 16071 - DNA, 1934 bp, Heterodera glycines
ctttccccattccctcccaaactccatccgggataaacggtgcatagttggtctgggggcacagtgcgcatccctcactatgtccactattcaattgtccggttctgtccaaccaaatgtcctggagcccaataataataactggaatagtttatggatcattttcagatgtttttcctcatccgtgcaacgaaattttcaattcaacaccgaaatttggtcctccttttcatgataacaatggctcaacagcagaaagcgcatttcacgacttttatggaaagcgtagttttgggaataatatatgcaaatgacagtgtcaaaacggcggagacacagagatgaaatatttttgggtttaattttattttttgtattatatatattttttttggcatttatttacgcatgtcatggaatttgttataaaatcgaaatttccgcaattttctttttttatacaatatagggctggaaacaaaattttgaaaattttagggcaattttgtgggccgacggtgccgagataggctaaaaaggccagtttgaggattttttccccaaaaatcatcctaaatcagcaaatttctcaaaaatcaacaaaaatcagcatcttaaaaaaaatcagatttgacccttgaaaagcagccaaatgctgataaatctgcagttgggagcactgctaataactttgctcgaaagtatttgcataattttcagcgcatatgttataaatagatctcgacttttgaggcatatgccttttttctgcccattagtttcgatatattaagcataataaacgcattttccacttggtttgaggcttctacgttaacttttattatgcctttttttgcctttttcgggattttcgtgccttaaatgccttttttggcattttgcccttttggtgcttttttggcgtttttccggttaaaaaaccagaaacttttgcatttatgttaactcctttatatacgggcactttagaagcacacccacgtataattaattacgtaatagcaaattaagaaactcccatatcatttctataatgttaattttagcaaatatagaacaattttttatgttaaagttgtgagaaaatttgatttaaatagtaatttccggttgaattttaagaaatttggtaaaaaaatgttttaattagtgcaaaaaaataatttaataaatattaaaaataaaataaattttttttttatatttgaatatgtcaaatattacctcttacaatatcttaattaacatgaaatgaaatattcttttatattaaaaaaaaatcatactatttattaacataaatttagcgagctattttcatgggtgtctttaacatatttaaatccaaatttttatggaataaatgacaattaaatgaatgttttcatttttgttatgaatttacaaataaaattggaatgaatttaattatacgcacaaataattgaaaaaaaaattatttttagcaaataaataaattagctgactatttattattcttttaagtaaattatttagtcagggaggaatcaaaattaattttgcctagtaaaaaaactcaaattaaaaaatattgctaacgcaattttatatccatagatccaatacatgaaatttgggattttaaaaattattttatttaaataatatatttaagagattgttgcactggatgaagaataaaactatattaatcatctttttttcaatcacttttacgagaaactttgcagaattttattaaaatactatttctcaaaaattgattcaatatgtatcaaaaataaataaatcagtataaaaagaaaaaattcttactaatatttttttatgaatttaaaaatgttaattttatttattaaaaaaaataactcaattttgtcatttgatgtttttttagcttgaataaa

SEQ ID NO: 16072 - DNA, 928 bp, Heterodera glycines
gctcaacttcgtctcccatttcctcgaaaatgctgcgagatcgagaacgacggagatgctcacgttcgccaaaatcatccaacttaaaaattattttgtctaaaaatcattttttgaagatggtatactaaattgtcaaacttccataatgctcaataactgatttcaaaaataaaaattcaagacccttcaaaaaaccacaaaatgagtttgtcgaactcgatttaagtaaaaagcatttaaagatacatcccaaagtgcttttttctaaattttccatttcttaccccaccagcggccccagaatcagcgacaaagtcaaggccagtgcgactggaagtttcaaagcggtcctcgcgcaaagtaatgtcatcaattcggctttgattcggctgatagtcttttatcgggcccaaatcgaagtcatggatttcaggcaaattgtcataaaagtcggtgatcacctgatgacaaaagagatccatcgtgataatctttttgatgaaaatgaataaatttctatgcccacctccggaatgtcgttgttggtgctgttggcaattccgctggtccctccactctcccgtggttctctctctcgcaaatcgtggtcccttgcgctgcccccagtcgctttgaatgccattttcagcttcagaaacgcctcgttgcagtcagtcatcacataatgtgccttttttgagtaaatgcgcacaattccgagaagcaaatgaccggtggttcgaagtgaaagtttaacctaagaaaaattggtaatttacggttatctgtgcggagattttcagaaaaattttttttaaagaaaacttgttttaggggttttcagggtcggggaaaccgattctggcatccatttaaccaattttaaataattgaagcgattttatgcataaaatatgaatttttt

SEQ ID NO: 16073 - DNA, 2062 bp, Heterodera glycines
gcgactgatgcgacgactgtcgttgtcgcagttgtggcatcgtctgttgttcggtcgtcggacttctgcaaatgcctttcttcgggggcctcggcggtgccaccgacctccggcaaagagttgcagcatcctccagcgcccatcataaagttggacaacggcgactgttggtagggcatttgctggtgccgacccaacggcggatggcttcgaggcggaatttggggcggtgtctgaagtgccaaaatggtcgaatttggactgcaactcagtagcaaagacaaaaaaaaagtatgtgcctacttccggtgttgtaatgccaatttccacgtggtcatccatcgtccgaccagttgaggaaggcgaggaacactccggcgggtaaacagcgggcaatttcttgcgagcaagcggcggttttgccaacggaaaggcgggcaacgcggcggacagcgatgggccgagctgtggcaaagtgggcggcggtggctgtgccactcgctgctgttggtgctcctcaagtggaagtgataacattgccgacatttggtgatgtggcgccggagccggcggttttcgaaacggttccaagtggtgaagcctttgctgctgcgattggtgctgctgagcggcgggaggaaaagtgaagtgcgactcgccagcggaaagcggcgccggaggccgtcgtcgttgctgttgaagtaacgcggcacttggcgatgtcggcgaaccgcccgaggacatttggcggtgctggtgaaaagtggcggcagccgcggcggtgggagcgtactcggagatgaacgcggcattgatgcggccgcaagtatcaccaagccatcgagggaattggccttaatcgaggaaaggcaattaattcccatctcttttgactctcgacaatctcacccggactgatgtcaacgatggcaaagttcgggtcctcggccaatgccattgacatggacgagccggaagcggagccagcagaagccggactccgagtcggcacattaatgtgtgacggggacagcaatgcaccaccaccaccaccaccactgggcgcattgcacggcgagtggggcgaggaggcggacgattttgcactcgatttggccgtagggaaacgatggaaagtgccgccgctgctgccactgatcggagtcttttgctgcttaacaccgggcgatttcaacgcttcgggagggtgttttggtttctgaaataaattttgtaaaatcatttttttacttagttttttaccgcatttggaatttctccatttttcggttcgactttatgtgattggttgtacaggtaattctcgaggtcgtctttgtccttaaagccgttcaaaggattcagcgactcgaggaagtgctgaaaaggacaaaaaattaaatccctttttttgattcatttctgaggaccataaatcgcccaattcgtccaattgtttcgtttgttgttaattttcgtcggggttttttctcctcctcaacaatggaggagaaattgtacttaggccgttttgagacggaattattaacacggaatgatgaaaaatgttttttggcaacgcaatttgccgttatgttgaagcaatcgggcggcggttcggaagccgctttggcatggaaaggtttgcatgacggagaagcggctgacctaatgaaaagcaccgtaaggggatttggacaaagaaggtccttttataccacaccattttctgtgccaatttttgtccgtttctttgctgcgcggcgtttgtgccgacaatgcctctggcgccgttttttcggcaggcaatttgccagaggcaaattttgggtaaggaccaacaacagcagcagaagggactgccgatgttgcagcaaatagtgattgtgctgaatcagcttccggccctttggcatcgaataacaaatagtcgtagccgccgttgtgaggaggcaaacaactgctgaagatgggttcagtggcaccgcagaacaaagagaacatggccaccattggagcgattattggaccaaatggaagaacaattaaggacgacaattga

SEQ ID NO: 16074 - DNA, 1225 bp, Heterodera glycines
tgctgatcacttcaattagcagtgatcgagagtctcggactattcctttgcctacgagttcctcttgaccaatgctgatcacttcaattagcagtgatcgagagtctcggaaaattctttgatcgagagtctcggaatagtctttgacctcgagttcctcttggccaatgctgatcacttcaattagcagtgatcgagagtctcggacaaagaagtgatcgagagtctcggacaattctttggcctcgagttcctcttggccaatgctgatccctacaattagccgaaattttcagaaaattctttggcctcgagttcccctgggccaatgctgatcacttcaattagaagtgatcgagagtctcggacaattctttgatcgagagtctcggacaattctttggcctcaagttcctcttggccaatgctgatcacttcaattagcagtgatcgagagtctcggacaattctttggcctcgagttcctcttggccaatgctgatcacttcaattagcagtgatcgagagtctcggaaaattctttgatcgagagtctcggaaaattctttggcctcgagttcctcttggccaatgctgatcacttcaattagcagtgatcgagagtctcggacaattctttgatcgagagtctcggacaattctttggcctcgagttcctcttggccaatgctgatcacttcaattagcaggatcaagagtctgggaaaattctttggcctcgagttcctctgggccaatgctgatcacttcaattagcagtgatcgagagtctcggacaattctttgatcgagagtctcggacaattctttggcctcaagttcctcttggccaatgctgatcacttcaattagcagtgatcgagagtctcggacaattctttggcctcgagttcctcttggccaatgctgatcacttcaattagaagtgatcgagagtctcggacaattctttgatctcgagtctcggacaattctgatcacttcgattagctcttggccaatgctgatcacttcaattagcagtgatcgagagtctcggacaattctttgatcgagagtctcggacaattctttggcctcgagttcctcttggccgatgatgatcacttcaattatcagtgatcaagagtctgtggaaaattctttggcctcgagttcctcttgggcaatgctgatcacttcattagcagtgatcgagagtctc

SEQ ID NO: 16075 - DNA, 929 bp, Heterodera glycines
  misc_feature (914)..(914): n is a, c, g, or t
gatcgagagtctcggacaattctttggcctcgagttcctcttgaccaatgctgatcacttcaattagaagtgatcgagagtctcggacaattctttggcctcgagttcctcttgaccaatgctgatcacttcaattagcagtgatcgagagtctcggaaaattctttgatcgagagtctcggaaaattctttggcctcgagttcctcttggccaatgctgatcacttcaattagaagtgatcgagagtctcggacaattctttaatcgagagtctcggacaattctttggcctcgagttcctcttggccaatgctgatcacttcaattagcagtgatcgagagtctcggacaattctttggcctcgagttcctcttggccaatgctgatcacttcaattagcagtgatcgagagtctcggacaattctttggcctcgagttcctcttggccaatgctgatcacttcaattagcagtgatcgagagtctcggacaattctttggcctcgagttcctcttggccaatgctgatcacttcaattagcagtgatcgagagtctcggacaattctttggcctcgagttcctcttggccaatgctgatcacttcaattagcagtcatcgagagtctcggacaattctttgatcgagagtctcggaaaattctttggcctcgagttcctcttggctaatgctgatcacttcaattagcagtgatcgagagtctcggacaattctttgatcgagagtctcggacaattctttggcctcgagttcctcttggccaatgctgatcacttcaattagcagtgatcaagagtctgggaaaattctttggcctcgagttcctcttggccaatgctgatcacttcaattagcagtgatcgagagtctcggacaattctttggcctcanagttccttcttggcc

SEQ ID NO: 16076 - DNA, 1471 bp, Heterodera glycines
  misc_feature (18)..(18): n is a, c, g, or t
ctttttatttttcaattntggcccatccctgatatatatttttctacacctaagattatgtatattcattcccttatattcctttatagatattttaaaatgttatttataatttatacttaattttcatttttagcatgaaaacaatatcttaaaaaattatctatgattgatttagaaaaataatgaaattgacaaatagaaacttaaaaacactaagttactaattttcaatttaataatttttttgaattttaagcgcaatgaatactgaaaatgaaattattaaaaaatatacaaaaaaagaggattaaaattgcgcctgatgtcgattgtcctcgaaataaaattaaaaaatgaaaattaattgaaattttaaaataagtttatattgtatgtcgaaatgtcaacaaacttaaaaaaacgaaaaatgttattgtaaaaattatgcttattttgatgaaatacccgatgaatttaattaacaaaaaatgaatgaaagattactaaaatttaaaattataccttaaaatacatgcatatcaaataaaaaaataaatataagatatattttttgatttttgacttttttacgaaaagaaaaagtttttaaatcctgaatttgatgacaactttaaaaaaaattgaatacaagaattagaaattttgacattttgacaacacagcctgaaaatggatatactaaaaatttcatccgcctcgagaaattaccaaaaaaataatgataaataaaataattttacatttatgaaaggaagagttggcttgtaaattgtacaaattttataatgattattatatatattttttatttatggtttaaataattgctgttcgccctattcgaaaatagcaagttttatgcgttaaagccacagaaatcaaaaataaaaaaatcgaaaatgataagataaaataaaaagagccataatatttatttagtttttagtaatatatatttgaaatctaagaatacaaaatttttccattataatttactgtaaaagcgcatacaaaggacctcaggtgtccgtagagtttcggaacctaatttggtagatatgtagagcgagcacacatgggtttttaagaaaagtggttttaatttttgcggaatgagcctgagtgccaagatatgacgtgccaaagttttataatgaataaacaaaccaaatagttatttgtgacacagtgcagtgtccagtcgtttagcggtaatgcgctaatccgcgttttttaaccccaaggttcggatcccttacacgcaaactcattttttaattttaatttttgcctttttatgcaatgcaaattatctaaaaaagattttctattaacaaaaaatttttaccaatttaacgtataagatattcaataaaaatattagaaaaaaaaatttatttttaacagaaaggcatgtataaatcattgcatattaatcttaaatgat

SEQ ID NO: 16077 - DNA, 2332 bp, Heterodera glycines
caaagaacataaacaattatttcttttctataattatacaaagccaaaaactttggcacgtcatactcgggcactcagactcattccgcaaaaaataaaaccatttttctttaaaaacccatggggtgtctctgtctcttatccccaccaaatttcattcgcaaaccccacggacacctgaggaccttcctttgttaggttatcaaatttaaaaagagcagcccggaacgaagaaataatttaatgaaactctaaaaaagtgtcttggctcccactttttctattcgaaattttctcaatcccataaaaaaaatcagggatccggtctgggcccggtcgaatacccgattccgtgtataattaatttaatttaattcttaataatttgaatatttacaaaattgagataaacgaatttaaagtaatcaaactaaatcgcgatcattcatttatccatatgtaaaaaatattattcatagttagggttgtcatttttcaattttcaccttttcatgaaaacagtgatcctaagtgaaatattagtatcatttacccaattgaagaaagtcttggggaatttcgtaattcgtatgaatttggtctaggtgtcctcccctaccatttatttgttctaattgcgagcaagaaaataagaaaatgtaaactatttgacgtattacttattaataaaataattattatacattcgaatataaaatttattttaatatacattggaatatcagacccttaaaatgaaaattttttattgttattgataaattgagctcgttatattttagtaaaaaaatttacattaatattatttttttatccttaccagttccacaataattatagtaaatagcaagtaaaatcacaaaacataaatgttaggattttaatttaaatattttgatcaagtacgaattttcacgccctaacagaaaaaaaagttaagactacctaaaattttaatgaatttattaaacatatgtaaaaatatgattgatatttattcttaattaaaattttatgtgttcaaataaattaatgaagtggaatgttaaggaataaattaattaaaacaaataaatataattcattatataaatcaaataaaaataaaatctgtaggcctttaatgcgcacaaaattcgaccgaattgggcggcataatagattaacaaattaaatggttaactcttaaaaaaaaattaattttgattattgcatttttttcaaagatagctaaaaattgaagcacaaaattttgataatgtaagacataagctaattaaattgccgaagcatttaagcacatttcacattcattttaatctttcttttcattttcattttaatttatttattttcccgttagcgatcgatccgacactcctcccctttccatttatgtctatttaagctgtgatctctctattgatattcacttaatcatgattatgtagtttatttaatttatgtaatttttgtgactttatttaattgtatttaattgtaattgttatttaaatatttaaattcattgcgcatttattttatttatttgttttgattttatttgtaattgttttccatgcttttcctgaaataaagccagtccagaatggaattggaattggaatgagttggggagggaagtgggattgatcaccccaggaccccctcataaaaatgattggatttctaagggttgggagtcccaaggcctaattcagcacgttccactggcatgtgtgttattataataaataacgcacgttcaaaaaaattaacttgtaaaattttaaattaaagatgaaaaaataaaagtggagctaaatatttgagagaaattaaaatattcaataaatgtttttttccattcgatggaatcaggaaaatttattattctaaatgctgactccttcatttttttatcttcttttaatgaatttaaatatttacatcaacagaaatttgatgattttaatttatccgtctttaaggcgaaaataaaacattttatgactcaaatgaatattattttaaattctggagagtgttgcgattagcaagaggaatactaattaattatttattttttgctacatattctttacctatttcgccgataaaatcaaaattgcgcaaaattaatttatgcaaaaactttgttttaactggtttcaaatctgagaccagggacggtctaaaaaggggtatgaggtgtaagacataagctaattaacataaattgccgaagcatttaagcacatttcacattcattttaatctctcttttcattttcattttaatttatttatt

SEQ ID NO: 16078 - DNA, 2926 bp, Heterodera glycines
gggggggaggacgaatgtgagggagggacactttgacctgctgacaattcatccattctttcattcattcatccgttgctcatccttatttcctcctcctcttcttttgcctgttctccctcttctcttccttttattccaagctcattcattcgtgcgcaaattgctttccagcattcattctcgataataaattgagcagaacacgagagttattgagggggaggggagggaaaagggaggggaagagggaagaaagggaagggaagaaggaaaaggggaggggaagtaaagaagggtgaggggaaaagataggcgagaaaggaggggaaacggaaaggaaggggtaaagagaagtgaggaagaacaggaggaggaagagaaggaggaggagcagagagtagggtgagaaagaaggagcgccgaatgtctccagcagcacatcagcagaaggattaacttacacaagcaatttacgggtgggcaaacaagtgccgaagggtgcgtttgtccaatgtccccttttttatgcttttcccccgtccaatgcaaatgggaggaggacactcccctccctcacatccattctcggctcggcatttattcaatcgttcgctgggcctttcgctcgtccattgtccgtgccatggcattggccattggcacttttcgcagcactgtccaaatatggcttggccacttctgcttcttctttctctctgtttcgctctcgctgttcagaggactgccgcaaatgcaaaggcagagaaaataatgtgaaaacatagagcattatccctctctctttctcttcttgtctctaatctcatcaaagcctcatttggtgtgaaaaagcatcacttttttaaataattccattggattcccaaaattgcttttggtaaaattcggaaataaatgtaccgcagcaaaagccacaaataaatttataatatatatgtaaatattgtatatctttggacactcaacgcctttagacctgtaataatttagtctaaaatgcaagaaccaaaataatttctttatggaagcgcccgttataacgcatgtgatgacagagcaaaagtgtggcacccagcgagcggcgccccacttattgctgacgctgccgtagtcgactgtcccgtttttggaaaaaaatattctcacgaacgcaatttcaattttgccacttcactcaagcagactataacctcaaaaaaatcctacgaattcatatatgcattaatgacagagatcaattagtgtttgtaggacattcatgcgctttacaattcagtaccgaaggtattggccacttaagtcccgcatctttggttcctcggcttcttctgatcatttccttattattttcccattgatcactctctcctctctttctctcctcctcatcttttttgactactgctgatcacttttctctttcttcctctctttctctgcctactctctcctcctcgcccattcctttcggctggctgatcgctgcttctccgttcacctcttcccaatgtgatttatccgtttccttcgccacaattctgctgattgtgagttctgcactttcttcgtccgtccgcctttttccgttcccatcggtgccaatttgatcgaatgaattggtggcactctgatgagttgccaatctgtccgtcgtccttcctcaacaaaatgtccgaaattggctgttctgctggccttccctggggtgatgggtcccccgttgcccttctcccccctccccccttggcccatctccgccaactgtgtttgtgctcgctgctgattcggctcagctgtcaaacaccgatcggtccgaccgaccgggctcgtttatctccaaacaaaaaacatttgatcgattgatccctcccctaactctcccaccaaaatcactccctcactttcgccctccccacccgcccccactctgtacaaattctgcgtacattttaaggccacatacaattttattgctgagatttctccaaagggttggttatcaatagggatcggattttgaggtgcttgaaatcaaaaagtatactaaaataagtgcataaatttaataaatcatgaaaacccaaaaataattgctaaatcagtaaggagggggcttttttactcatcggtgacagttttttgttgtcaaatcgctggattatgaaattaccattgaaaaataattaatttgagtttgccttgttttattgaaaagttaattagcattaatggccaattttaataataattaaatgtttctgacttccgttttttgattgagttttaatatttaattcattttaaaatttatgaagggacatttgggcattttctttttctccattttataatattttatttttaatgcaatgtttttgtgttcagtttcgtctgtacattttcttcttgccattcccgaatttatctttttaattgttttttttcttcaatttaatttggccgaccaataaaagaccaatcgcaaaaggatgagcaaaagcgagtgagttttatttgtggtgatttttcataggaaattttgcttaacattttccactggtcaacattaacaattaggcaatttttctcctcttctccaaccacaaagccagccccaaaaaagcattttcagatcattcattcattagccttgtccattctctcccatttccattgagtgatctttcgggggagggggggggggggggagaagcaatagcaaaagcattgtccgctgcaaatgcttaataacaaaagcagcaaatgttgtgcaaattgggacaatgacaatgaatggacaaatggatgaacgaatgaacggggggagggaataagccgatgatttttgcggaccgagggggggggggaatggtccaacagcacaaggaatcactcaaagtca

SEQ ID NO: 16079 - DNA, 2335 bp, Heterodera glycines
ccgcatgctattatgtggaggacatggagcaaaacagcagtgaaaatcaaggttttatgaaacgggcggcacggttttcggatggtcgaatgtgtgaaacaatggttaagctgaattttgatctagcgcatcagaatgcacggatgcttaacaaccaagacattgtgttcacaattcaccgaaacagcgatgcgcttcttctgcaaacgccgccttggaagaccgtacatgctgatggtacggaaacatggaacgaaaacactgatgagtatcgtatccggctacacgataggcgtgtttatgtgcgcacagtagacgcaacaccaagcctgaaccttgcaattagtaaacaattggagaattctttcgcaaaatacgcgcttcgtaagggggaaatgcgctccgtctttttgggaacaggtcgaaccgagctgtcacataacgtgttcacctcaacgctgcctcgccgcctgatctgcacatttgtctcaacggatgcctattccggcgctcgtcatctgtcaccgttcaaatttgagcatgcgcatgtgcgatcgctcagcgctgaggcaaatggacaaacatttccctccactccgtacctgttttcgttcgagggagggcctgacaacaaacaacaacgcttcatacgcgcattcgtggacatgtatgctggccttgggctcgacgaaacagacaacaataaaacagtgtcaattgatatgcaacgattcttaaacggatgggcattttttgtgatcccgatgacctccaccctagaggatacggcaggatttgagctaatccgtcagggtacgtgcactgttaaggtccaatttgagcagcctataaaagcggacggttatgaaatgttgatcctcggcgagtttgactccatcctctccattaacgcagatcgtgtgctcagcacagacggaagtgtataaataatctggacgcttgctaaaatgaattcgttgcaaattcatttaattctgaacagattacaaaaaactaagcataaatttattggcgtcttcccgtccaataaggttccacttgaacgtaaaagattccctcactgtatggtaataaacactggcagagagggtacaaagggtgaacattggatagcatgttacgtgtcaaatgcacgtactgttgaatattttgacagcttgggtgctgaaccgaatgcggatttgtcatcatacttgaacaatttttcaaaaattcacataaacaaagagcaaattcagtttgtcaactcggatgcctgtggtcatttttgtatttattttctggtaagcagatgctcaggaaccccatactgtaaagtgatggaaacgctacgtcgcacacgaagtgttgcggattttcttgccaaatggtttgtccgaaacttggtaataagtcctgcgctttaaacgggactgagatggcggtgttgtgacacgtacgcatacatgtacactatcccttcatgtataaaagggcgggcgattgagcattgtagcaaatcgctttacagaaaaaaaataatgatttttgcattaatttggcttctaagcattactatttgccatttgtctcggggcgaatggataaatgttgagctgagcgttgacacgccaaatttttttgacggctccctaagatcgttttccaaacactcaccctctgcctatctatttgggtacaatcgcaacacagcctgcacagttgaaaggataagaaatgtcaatctgctatacaacagcgatgctatgtggcgcatcacgctgactgatgttcacacattcatgcgcacgggagagacaacaatagaactgacacctgacgcattgccattggcatgttttgaacatggcaatcacaacttttttattttcgacctaaaaaatggagcaaatgaagtggcagtgatgcgtggtcaaaaacaaaaagttgcacatcaactggcctcatatggacgcgtattatttgaccacatcgatgctcggctgtatttggtagacaagagagaacggcgcatcaatgagctgtccatctcagacttggcgcaatggtggctgatgaataacactgctgctgctgctgttacaggaaatggcaataacaacgctacacaccagcttcgaagcacttttgtcggattgttgcccgagcaaaaaacggattatttcattgcttcaaatcatgtgtacctgattaggagaagacgtgtgtataagttccgactaggtggctaccataatcagtcattctcacagctccagtttgtgaccaactccaacgacactcgtttcaattttcttctgttgaagaaaaggag

SEQ ID NO: 16080 - DNA, 2441 bp, Heterodera glycines
  misc_feature (2204)..(2204): n is a, c, g, or t
tttatatttccgcaggggttttagaaaagagacagaattagcataaaatagcgacacataaagtgttggccacagtgccgtacagagactgcaaaggcgtgcagaagacttccttgcttatatatttccgcacgggttcttagaaaagagccagaattagcataaaattagcgacacataatgtgttggccccagtgccgtacagaggctgcaaaggcgtgcagaagacttccttgcttttatatttccgcacgggttcttagaaaagagccagaattagcataaaattaacgacacataatgtgttggccccagtgccgtacagaggccgcaaaggcgtgcagaagacttccttgcttttatatttccgcacgggttcttagaaaagagccagaattagcataaaattaatgacacaaagtgttggccccagtgccgtacagaggctgcaaaggcgagcagaagacttccttgcttttatatttccgcacgggttcttagaaaagagccagaattagcataaaattaacgacacataatgtgttggccccagtgccgtacagaggctgcaaaggcgtgcagaagacttccttgcttttatatttccgcacgggttcttagaaaagagccagaattagcataaaattaacgacacataatgtgttggccccagtgccgtacagaggccgcaaaggcgtgcagaagacttccttgcttttatatttccgcacgggttcttagaaaagagccagaattagcataaaattaacgacacataagtgttggccccagtgccgtacagaggctgcaaaggcgagcagaagacttccttgcttttatatttccgcacgggttcttagaaaagagccagaattagcataaaattaacgacacataatgtgttggccccagtgccgtacagaggctgcaaaggcgtgcagaagacttccttgcttttatatttccgcacgggttcttagaagagagcgcagaggcagggagatgggccgagcggtgccatcgccggtcgttcccattcagcagcagaaaaggacgaccccgaggcgcttccccctccccttccaatgccctcccgtcgtgccctgctcattcactccctgccaatagcccatcggcagtgcattttgcctatgccattttacgttccgtatttgccacaacttttgctacattaaatatggcccatttgcacaaccatttaattttgccaattttttaaagcacataaaatcaaaggctgtttcccctcaaatgctttgtttggtttgtgtttaattaagcctgtaatccgatgctttctccgatgggccaggcgggaagcgtggggggaagggtggggagccacgcatgttgtggtacacgcatcgattatggaagccgcgcatgcactagcaacgaagtccttgcgcgaagcgctcatgtaaatgcatattctttcatctctcacaagccaactgtctacaccgagcaattctgtgcaaagcatactgtctacaccgagcaattactgcgccacacgctagtttatactactatagagaaacgttgcagttcgtcttaaaaactaatttgagtcgaacggctgtcgggaggggtctgaaagtggtggaagggtcttacaactttttgaggcgcattcaggaaaactataggttttccgctccggtggccagttgagcgccagcggcgctgaaacggcccgaaaatttttttgtccgtctttggtggcctgtaactttgcgggaagaagcgggagccgaaaatgcttggaggtaggattttaagttggaatgtttgggaaaacttggcgcttatttggcggggctatctgtaaatgccaatgctgcagaaaatggcaaaatttggcacccaatttcggcattttcagtttttcgggaataactcgctgggggttaagcggagcgggttggcgccgcttgtgcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggctttttgaaaaaatttcaaaattttccggaaatagaaaaattttttggcctgaccgngacatttcagtccccggcctataactcgtcaggtgtttgatttaacgaaaaatcgtccaagagcttttttgtagagaatttcgagctctatctaatgtgcttttatcggtatttttatctttaatataaaaaaaaatataaaataaaaatgaattttaaatgcaaacccaagggggaccccatggattttgatttcatgaaaaatttttttgctcccaaattggccaaaatactttt

SEQ ID NO: 16081 - DNA, 1894 bp, Heterodera glycines
  misc_feature (944)..(944): n is a, c, g, or t
tagcatttttaaattataatattatataaaatcaatacctatccataattctaagcagtatggtaattacgtaatttgcatttaatgcgcttcattacaacatctcaattgccactctctccgatgccaattttgcctctctccccaggtttgatgccgatttgtatctccattgcgtcatctcatttcatgccagttttttctcccccttcccgattttcatgctaattttgtctctccccatgtttcatgccaattttctttctttccctctctctaacactctctctctccgatgccaattttgcctctctccccaggtttggtgccgatttgggtcggtgccggtttgcttcatctcattttatgccagttttttctcccccttcccgattttcatgctactctcaccatgtttcatgccaattttcttcttttcccttgtttcatgccttatttcggccctctcattgtcatgccaacgtgggatttattgaaaaataatatgcaggataattgtgcataaaaagcaattgctgtttcaaattggcatcattttttttctcatttttgacaatattttgagagatcgttatcattgcaatgccaatgcattatcattatttctttatttcttacatattcatattcatttttattaaaaatataagcaaaaatttagggttttttgaaattgaaatgttttccacagtttcatttgcaattatattgattatagaaggaggatgaaagtttttaaaaattaagcctaaaattcaaacataacatataccagggttaccctttgtccttattttaagatttgtccttattttgagggtccaaatcttacaaattttaaatgttcttatttgtaagatttgtccttatttaagctctttgtccttattttagtcttattttttttgattcagagagaaatntagattttaaatgataatttaaaagaaatgtttttgaagcgaattaatatccaaagtctttcttttgcttgaattatttactttatgcgtggtccagtgggttgtgatcttggttatgttcttcattttatcgttggatcagttcccctccaatcaattttttttcttctaatttttcaaaattattcctttatcgatggaattcaatcataattctaacatttaaaatcaaaaattttgtcatttttggacaaaatctattaaccaagtgcacgaaaatttcaaaattttcgccggcggcgctcccaaacccctatttttcttaaaaaattggctaaaaacagcaaaaatttggaatttttgacaaaatctgttaaaaattgcacttaaattttaaaattttttccggcggcgcctaccggcaccgccggacttccccccgcctaaagaaagtattttgaaaaaatgctgcaaaaaaaagccttttgaatgaaaaaccgcaaaaattgatcattttttgatgaaaatatgttaacaaatcagaaagaaattacaaaaaaattttccggcggcgcctatcggcaccgcctcgaccccatccccgtcgcccattcctcaaaattttttggaaaaagcatgctgcaaaaaaattgttaaaaatctgattttttgatcccgaatgaactgaaaataatttacaaattgcttatgttttccacaaaattgttaaaatccattttcggaaatgtataagtttctcatttctaagcagaaattgctcagaaaataattggcggcgagaaatgttggtaatgcttgattctgttgaataaaaatgcgatttaatgttttggaagcgtgttttaaaaaatgtccttatttttgaccctaaaatcttatttttgaccagcgatgtccttatttcgggaaattttcaagggtaaccctga

SEQ ID NO: 16082 - DNA, 1996 bp, Heterodera glycines
tgaattctctaagaaaaaatttacccggccattttgctgttcgcccgcagcagcgtcgtaatgcgtcgacaggactcctacaaaatttttgtgtttttaaaaatcatctttaattaattcaaattttacctgtgtcgcttccacacagtcccgtctcagtctctgctgaaattttgttctggtgaaggagcacaatgagtaaacttaatgaatgaagtttaggcaagccatcccacacaaagggaggaaaaacaattttgctttttatctaagttttactttacaaacattttttacaaatcgaaccaaaattagttgaaattttcaataaaataactgaatttttcagctgttttttcaaaatatttaaattgcaatgtggacaaaatccgaattttcagaagagtgcatctccgcccttctccgttgttaatttcaaaattgcatcctttctttcaattcttttttgtttgataaagtcggatcaaagaacatcaattgggtcaaagctccgatttcttgcgacgcaaattggccaaatttcacgggcaactcggttttggaatgattttccagtgttaactcaaaaggataccccaatacgtttttttggcttggaacgcaccggaggagagcccttttgggtttgaatccgaaagtaatttaagcctaaccctaaattcacattaattatttatcaatttgttgcacattttcctcaaaattcgattttccatgttcttttgctgttcaccaaatgctgtctcaaaagaaccaacaaattgctgctgataatgaacaaaattaatgcgtcagtggaaattgtgtcagtagaaaatgcatcagtagaaaaaagtcgaaagtcaaaattttcgaaatttggatttttcttccaaatcggtttaaatactcggaaacaaactgaaacccatcaattcttcaataagagatcatttatgccgtttttgaaccaaaaatgctaaattcgaaaatttggactttcgaatttttgttcggattccgtccggggttcggaatttgaccgaaatggatatcggattcgtgatcagtgattctgaaaacctaaggaacttggttttttataacaataaaatgttcgctgacgcattttctactgacgctttttccactgacgcattttccgggcgccacccggcgccaacgccgaaacgacagcgccgaaacgacccgttctccaaaattaaataatatttatcgtcatcaagatattaatttcgcaaatatatttcaattcatagagtcaaactcgaacttactggactgacagtgatacacatgggaaactcttttttttggggggggggggggcggaggtgccgaaagactataaattgcaatttttgagttttacaaaaaaaaacagcataaatcaacaattttgaaaaattttcgctttgaaatcattaattaaatggagggactaattaattaacaaacatataagcaattaagcaataaaatttcaaggaataaaaagtcacagactcaaaaatcaacatatcgccataaatttaaaaaaaagagattaaattcaaaaatattggcaaaatgtttaacaaagattttttaaatttttggccattttttaaagttaggggaattttttttttgaaatgtaggctaattgagaacctttagggctgttgaatagccaatacgagcaattacaattaattattccccaaagagccgggctatcgcccagttaaaatccacaagttaattagtgggagaagaagcaaaccaatgcagcagaaaaggccgtgggatttttaagtgaaagctttcttaaaagctattcaatttcgttatttatttttgtcagttagagaaatggcttatattgtatcaaacgagtttaaaaaggaaaaaatagcaaataaaattaaatttattaatttttataacaggtggggaccttaggctaaataaaataagtgagaattttaaattt

SEQ ID NO: 16083 - DNA, 2824 bp, Heterodera glycines
agtttccgactcatttcgttttttgttttcttaaggaatgcttttagaccggcgcaggcggaggaattgggcgtacttatgcacttgaatttgcacgcagaggtgccaaagtgataggttagtttagataatattacaatggaaaatgttattacaaaccaagtgaatgacttgggaggggaccgccacggaaaatccgcgtcgacttcggcagcagacaaagtcgtagccgaaatcctagcggcaggaggaaaagcggtgccaaactatgacaggttggccatgggaaatggcaccctatgaagcagccaattggacagtgttgaaaatggagacaaaattgtgaggactgccatcgataattttggtcgaattggtcggtctttataatgcacaatatgtaaaagtaccttcttgggttctcacttcagatatcgtgataaacaatgctggcattttgcgggatgtcagttttggcaaaatgtctgagttcgattggggtttgtcatttttatgcctttggcaattttttaaatgtttctttttttatattgatagattcggtaatgaaagtccacgtgaaggttctaattgttctcactgtcttaatttctctgttttacttttcctaagggtgccttttcggtgactaaagcggcgtgggaacacatgcgggcgcaaaagtacggacgtttggtgtttacttcgtccaattcgggcatttatggaagtttcggccaggcgaattatgcagcaggtgagacgaaaaactgaaaaactaacgggttggcatgaccaaaaaagagaccgatggatttcaaggagtagtcgaaaatggaatcttgaagaaaaaaaaacacacatcataaatacaaatattttaagttcaatgactcgataaatagtgcagcaacccgctgaaacgccttggactaattttaattgtttagcgaaaatggcactgattggtctatccaacactttggcgttggaaggagcaaagtacaacatcgccagcaatgttttggtttgtattcccactatattctattaattttaattgctcatcttcctcattttgaggtgccaactgctggttcgcgaatgactcaaacagtgatgcctgaagaattgctgacggcgatgaagccagaatttgttactccgcttactgttttcctggcacatgaaagttgcaacgccaccggaagagtttttgaagccggggcggggtggtatggcacaggtcaatgggctgggcttgggggatagggaaggccaaggagcggaaaatggccagaaaactgtcaattatttgagcattttggccaaccaacttttacataaacgaaaattttcaaaagttagaaaaatctatgtaatacaaaatttttgaagcgctttcgaaccgtaccaagaatgtttaatttggtttgaaaaaaatcgtgatgcggtcgacgttttgttcttctccgcttcgaatcacagtgtgaaaatgcgtttgtttttgttttagttgagcagttccgttctcgaggaaaagttatcgcagaaccaaccgtggagaaatgtcagtttgacattaaaaatgcgcaactttgacaatttttttcagtggtcgaaaattgggaggaaatttgcgatatgagtggggcacagcacattgggagcatgcgagaagtgatggagaatttgatggacgccctcggggtgaacaaatccaaaatgtgatatggcctttaattaggccccgtaaagccggtaattaacctaaccaaactttgtagattctgagccaaattaataaaagtgccataaatgattttttgagatgattcaagaattttgttgagaaagatattgacaacggctaaaaagttgaagggtgggcgtgggaagatgggatattcggggcacgaccggacatttggacaatgggcatttcgacagacaacttccgttttcttggcttatatcgactgaattttagcattccattttcctaagaacttcaaaaaatatttggttttttactaaagtcatttttattttttaaaaattctttttctgtcgtaatgtccgctgtccatttctgtccgaatgccattggagcattcggggggagtcgaatcgcgaggctttgcccccggggctttgttccgccgtttgccgctctccctgctgatattcttttctttctgctccctccctcggcttcatttcagtccgctgtgctgcagtcggctgctcaactgttccaccatcggatcactgctcgcttgacggcttgtcgagcgccgaatttcctgccaaaacaaattgaaagcatttgcattttgatcattgcaattgtcggcttcgcttttacttcgatgcgttgttcgaagttcgaatctctcgaactcgcactcatcgattgctgctgacgattcgcttggcgttgactttcggtcattgcttaaaagcgattgttcgttacgctgtcaataccaaacaatgacagatcagagaatgatccgctcactttcgtccctcaactgttgcacaaatttcaatggacttggcacatttggcggggatgtgtagggcgggtagggcccgaatctgtgattggcaattgtccaaaagaggggagtccgtcccatcgatggcttacgattcctctacggtctgtgtgtagtgttggcgggtgattgtccgcgtggtctccaggctcgggtcgatcactgtcacgggcgttgtggtcgcgtattggtggatcagctcgcgtgggttcgtcacccggtagtccttcttaatctcatagcgcattcccggctcatat

SEQ ID NO: 16084 - DNA, 884 bp, Heterodera glycines
cccaatccgttggtcgcaggggccttgccgaagtccaacggagtcgaacggcttgagccatcgtatggtccgcctccaccgttcggtcttcccgctccccgtccccccattcgcggcccaccgtctccctcccaatttttcggatgtcctgctgctccgtcttcggcgggtcctcttttccagtccttcggtgccgttccggtgtctcctccaaatccgtttttggttggaggaggagcggattgtgccgacgttgggcgaacggaggggcccagctgatcagcgaggctggcgaaggcgtccggctccgatgcgcgcgacccgcgccctgcgtccgaagcgggaaattcattggggttgtcgctgtgcccgtagcctttcaacgaatcctccgtgggagcttcaaattcaattctaaatcctctaagttttacgttccaattgacctcctgtgctccatgtcttctccgttatgcgaaccccgggccttcctcggtcacttttctcaacaattctttgttggatcacttccacctttggcgtaagatcgcgcggcaatcgcttcaattcgactccgtcggcggccaccacaccgtcgccgatcggagcatagtaaaagcgtcgaggctttatcgatttgttgacaagcgccggatcagtcacaagctgagcagagaaagggagggatgagagacggaattcggattggtcgggtgactaattaagtagtggtcactcgctaatctcaaaatgtttgatggttcattttcttagtaagttcaagccaaatcacctctcctcccttccatagcgttggcgtgtaagcaacgcccgaacccacgcggtcgccgtatccggaaaacggagtttcccgttcctgtgaa

SEQ ID NO: 16085 - DNA, 3219 bp, Heterodera glycines
  misc_feature (2419)..(2419): n is a, c, g, or t
  misc_feature (2425)..(2426): n is a, c, g, or t
  misc_feature (2436)..(2436): n is a, c, g, or t
  misc_feature (2447)..(2447): n is a, c, g, or t
  misc_feature (2482)..(2483): n is a, c, g, or t
  misc_feature (2499)..(2499): n is a, c, g, or t
tttattcgcctcggggggggggggaggaaattagccccttgaagttggacgaaaaatgtgggagagatgcaaattgaaggacgaagcaacggaattgggtgggcaaatgcaacaaatgacaaggaaatgagcgaataaaaggccaaaggttggcacagaataaaagcaaaaattggggggaaatgggaaaaagacggaatcagaacaaaattaattggcaggcagagaaaggcgggcaaagattggggggcaacccaaaaaagggacaaaagcattttcgtaattatcatttgccgggcttcccccccccccccccccaacagctagctgcatattcaaatgcccaaactaacaattagcatcgatcgatgacgggagaattcaaatttctatacttagcatttgcctcaattttttgaacttaaattaacaaaaaaagaatatgagtgcttttacaccaacttaaaattttttgcttccatacttttgcaccgccaaaaatttggtcaatttggttacggcaccttaactttttgatggcttgactaatcaggatagtttttctagattaatgttagtcttttgttttggcagagggaataatttcattcaaacacttaaatcttggaaaaccggtttttatttaaaaaattttttgcttccatacttttgcatttgactgtattaaattttgaaaaataaagccaaaaataacaactttttccaaatttttaatctattaaactcgatcattgcactttcacccgcgcaacgtccgcacgattcggcatatttctgctcgtgcattcgctgcccgtttcatcgtcacaggcagcactttgcccgaggcgaacaacgaacgcacggcaaggcgaatgatgttcagttgtgcccgtcaatggtcacagttaaataatcatattgaattggattttatctatgatgtagccacagttattgttgcatttgcaaaataatatttattcaaaaaggcaaatgtgaaaatattcattcatttgccaattcgttgactttttttacaaattctttttttacaaattgcggtaaattcccaccgccttttaacaaaaaaagtaattattattttcgactttgtttgccaaagcacaattgacagaatacttcgtggtcgagtctgaaacagaataaatttcaaatattttatttaaattttaagttgaattaactgtgcttaaaacaagataatggtggggactagagaccggaaatttcaaatttgcggatcccgctgcgggactggaactcaaaattttttgcgggactggatcccgcgggattaatcccgcaaatcccgcaatcccgcaaatcccgcatttaaaatttgcgggatcccgtgcgggattgcgggattttggaaaattcgaaaaaatttcaattaaattcaaaaaatttccaaaaatcaaaaaatgctgaaaaataaatatttaggggctggcgggatgcattaaaaggggctgatgggtcgactaagatttttcgattggatccgacggtaaaaagttgatcggaaatcaaattattaacggttcataaatttgactatttttttcttttcaaaaccacttttttgcggtgcaagaaatcggaaatttttcaaaaaatatacaatataataaaaaaatttctaaatattttaataggctaaattttttaattcttaaccaagtaaaaggtatttcacaaatgtttttagtatattcgcttgaaaaaattattcaattattttatcaaaatctttttttgtcatttttcattattttagaacatttttgggaaaaggagtgactatttacacgttttttacagcgagattttttcaaaaactttttgggaacttggaggagagtacggcggtgccgataggcgccgccgggaaaattttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgagttaactttaattaaatttattatttaatttatttaaaaatatttggcattctgtcttagaaaaattttcaaaaaaataataaaatcccgcataatcccgcacaaaaaatcaaatttgcggatcccgctgcgggattggaactcaaaattctttgcgggacgggatcccgcgggattaatcccgcaaatcccgcattttccaaaaaatgcgggattgcggactgggatcccgcaaaatcccgcgcgggattttgcgggatcgcagtctgcaaaatttaaaagacataatgtcaaatatttcttctgaattaatttatacatatgaaagagttatgtcgattcattngagctnntggccatttntagattctatntaaaaagattaaaattgtttattttttaattgtgnnataatttcatttattnggtaaaatgaaaatgaaaaaaaacatagataaaaaggcatataaacattattcacaaattcgctgcttcatcacttcaaatccctgggtttcagcaacatgtttgaatatgctgaattgatttgcagtcgattggataaaaaagcgaatttggcagaacagatttttcagtgatggcaaaccgtccaaaaaggcattggcataaaatggtcggcacttttcgtcgattctgttcaaataccgaacgtaaatgtccatattcaccagtttctgctttctcttcaggccactttggaattctgacttttgacccaataaactctaaattacttaaaaaattaaaacggagtttctatcaaattgattgttgaaacatttttatgcaattaattgaatatttagtttcaatttaaaaacatttatattttaattttatggggcacacttcaaattctttgacctgcagtcctcaggcgccaaatgaataattacgagtcaaacatttgaagtgtggccccataaaagtaagtataacatttccaatatatgtataaatccctctctaataaattaaattattttttattaggtaattaattagtcaattacccccccccctttatttgccaaccttaatattgtccataatatcgtccacaatttctgcctttccgcggcatttcaaattgaaacgttggccaaatctttcaatgatccacat

SEQ ID NO: 16086 - DNA, 2075 bp, Heterodera glycines
aatccaactaaaatgatgctaaaaatggcaatttttccaattttggccctttgtaaaaaaattcgaaagccggcacaacatggacagattttgtaaatgaatgaaatgccgccaccaaaaaacgaacaggaaatgtgtgtgagtgtgtgttgtgccgtcctcctccgtcggcttcttccttttcattttgtccgaggcaatttgcccgggggggggcgaaatgtcgacggcacaacacaaaaaagagagggggggggggaaatgccgttggcatttttggaagaaaaattaagcacttttttcgtggattttggtggacccccgggggcataaaatggtgccgtcaagcgaaattaataacagcaaaaaaacataaaaaccaatggcgacagcaaaataaattgtgttcggaaatcaaaagaaaatttttaattgctttttcctctgcccattaaaattttttttgtttttaatttttttttttttttaatttttgccggtaatttttaggaatttgaaattttggcattgtgatgggtttagagtaggtagggggttaaaccccgaccctcggggagagaaaagtcggggaaagaggaggaaattccccgacaaaagttgcaatattcagcaccaaataattttcttagttcaaagtgtgagagaattctttccagatttttctgacacaaaatgtataaatttttcttttaaatttaaagaaatttgaaaatttttttttaatttttggcattttgttgggtttaaagacagacagatgctggtatgcacaatgctaaggatatttatctgtagctagcgatatgtggatagggtagctgcagataaaaaaatctgcagataaaatccctatgcacaatgctagcgctaactatctgcagctgaagatttttttatctgcagatacccatccgcagcaactctctcgtcacacatctttttatcttttctatccctcaagagaaattttctaactcaaatttggttagcaaaatttttttgcataaaaagccgtaaaaacttattcctgggggttttcgaggtcgctgatcatgaatctgacatttatttcaaccaattcctaacccgaactcgaaaggtcgaattttcggtttttgttcaatcatcatgaaatgtaaatcaaaaaattttagaggtattaaaagtcatttagtacaatttttcaatttttaaacttatttttgggattttaatcgacatttctatcgaaattatcctcatctcgatgaggatagtgattttaatctgcagataggtagctgctaccctatctttagcattgtgcatatgtagcctagctgcagctgacgctaaggattatttgtaaaagaaactgtcattgtgcatgcggattttaatccttagcattgtgcataccagcatcattgtaccgctggggattgatgcgaaacatcaactgaaatgaggggggggggggaagcattgaaaaagtcatgcgaatcgaaaatgctcttcttactagcgcctcgagatttggaggtctcaaaaagttcggttccgacacagcatggattggactgagatgacaatggactccaccatgtgcaccagggctgagccaagctcggcttagcactcgaagcagaaggcgaagcccaatttttattcgaaggcaaagtccgaagctcgaagcccaaaaaacccgaacgtttcgaagttttcgaagccgaaacttttcatgtttttttaattcctaatattttttcatcataaaatttcagttaaatatcaaatttaatcaattaacagaacggctagagatcaaccaacccatttttaataaaataaaatatattgaactttttgatcaaaatgtatttagaaatttgaaaatttttataatacttatagtattcacggtttttgactcattttaaaaatgaaatggaacttttgggtgccggcggtgccgttaggctccgtcgggaaaaatttgagtacaatttgttaacagatttacaccaaataatgaccaaattttgcggctttaagctactttttaaaataaaata

SEQ ID NO: 16087 - DNA, 3025 bp, Heterodera glycines
  misc_feature (96)..(96): n is a, c, g, or t
agcaaatttttactttttcactagttatagactaagaccaaaccatacaaataaaagccgtcggaccccaactgtccatgaagttaaaaaaagacngcaccgcaaaaaaaggtagtttgatgtcaaaaaaatggacaaataataaaattaaaatatttatataatatttttaaagtataagcttttatttcatgaaaaaactttaaaactctcgcctctcgtcctctcgtcaactctcgtgttttttgggactctcgcctctcgccaaactctcgctctcgtctttttggagacaagtcacacccctgctgtggccctatacctatcaattcctcaccgtatacatttactatgtgatactgtatttagccaaaaaaattaaaaagcattctctaacataatgactcacttgctatacattcgaatgaaagccaacgactgtccgggggtcgcttttatccgatccggtgggtgctttttaattgctgtgctgaagaagtgcctggggtaaaaattggcacactgtaaaatggcggtttagtatacaatcggactgaaaaattactgtatgtccgctatttttattttccacgctatttcacaggatgtgacatctcattcatttcggagtcgttcgcacggaaggccaaccttttgggaaacattgaccgttccgattgcgagacaatattcgtgccggcttttcgaggtggcaaattgcttggctggtgagtgggtttttttaattttgaaaaaaatcaaaaaaaaataaaattttaaaatgtttttctttatcacctaggtcttccaatatttatacttagttttcgtttcacgttttgcagggtcaacgatgttcaagttcgtattgatgagctcaatttgcaatttgtgtaccgtttgggagtgatggcggacaaacatttgggaatgtaagtttggcgtattgtcttttacatatttaaacatttatttatttaaaaattaattttaaggtattgcccgaagaagttcgacatgctgtatgttttaaaagaagaatatttttccctacaattataagaaattgaaaaattattgggtctgcgccgaaatggcagcgccgaaacggcacttatgacccagttttaagccaaattttccttaaaaataataaaatttagggaaccggccactttggcgccagccattttggcgccaaacgctataacatttttatttctcattcaaaataaataagcttgatatcattttaaagcgcttgatagtccctaatagcctgcaaaatttcaaaaaatttaattgaaacacaaaaaagttatggccaaaaaacctcaaaaaactgactttttctggccattttggcgccgcacgctatatcttttgtcaaacagaatttattttttctaatattttgcaggctaataaagaacacttaggcctatttaatggtatcaaaattattttatttggctggataagaaaaaagttataacactttaaagttcgcggcgccaaaatggcccgcgccaaagtgaccccgaccctaaaatttattccaatttccaacacagccttgcatcggatttgctgtatgccattgaagtggacatcgaatttagcaaaaaagcgatcactcgcaaggacaaaatggccaaatttttgaccgaggaggaaattcagcgcgaaatggcggacacctactgaagaaacgaaagaaagaaagatgaatggacaaaagtgatcggaatttatgatcaaagaaacagaaatcaaacaaataaacattttggcggaatcattttcatccagaatcactttttttaaacgaaaaaatttcattacacacggaaaacacttggtgattccctcctaaataaattggtcagtaacaaatttctgagtgagtttatacaaccacgcatacatatgcaatatacatctactaatataatggaatatacaatggaatacagcattttatggaaggaaaagattttgctgatttatcatatgccacgacgacgactcgcataacaaaaaaaatgccatgacgacgactcgtataaccaaaaaaaggccacgactcaattttgtgtataaaaaatttgattttttttgaaaaatggattttgactttttgttcgaatccgggttcggggttcgaattgggtcaaaatggatctcagaatcggtttttctagccctaaaaacccctaaaacaagtttattctcaaaaaattggcgttttgttgttgtttaattttgtgtcattaatttttttgtttgcttgtcatttggtgtttaggattaccttacataattgtgttagtttatgcagtctgctactgctgaagtttatctgcctcatgtattgatttgtcctcgccttttttcatttggatggaagaaacgattttaacttttcttcgacatttgtgcatatttgtggacgacgacaccaaacgtcgtacatactattaggccaactcgtactaacaaaatgccccgttcttcgacaaaaaaattgtcattacttttgtcaaggttggcccaattaggtacctaaacattcttggtatcattcgatagcccttaaggttttttatttccttgcaaaatgaaaaaaagattgataatgtttaaaaaaaacaataaatgtgttactccctgacattttttaaatttctcccaccaacattgacatttttttttgggggaggggggcgggtgggatttcctccatgttccctgacttttctctccctatagttcgggatggattcaaacataaattgtaatttgaatgctttttcacaaacaaagtcattgacatcgtcgtggggtatggtatgggcccctaccatatcaattacggcaatcatgtcttttattggtccctaaaaaaaaattttttaaagtttcctgaaaaatctaataacatatttctaggggtgttttgatgcgatgagtacgattcaggactcctttattggcgagttccgaaaccgaattcgaacatttt

SEQ ID NO: 16088 - DNA, 1210 bp, Heterodera glycines
tagggcctagttaagctgtaaaaaaaatttggggctatttgaatgagaatagaaagagccaggtttgatgaagttttggtaatccaaaaaaaatccaaacatttaaaaatctataaaaaatttaaaaatgagaattcatgcgagattttctggaaataagcttaatagggcctagttaagctgtaaaaaaaatttggagcgatttgaatgagaatagaaagagccaggttcgatgaagttttggtaagccaaaaaaatatccaaatatttaaaaatctataaaaaatttaaaaatgagaattcatgcgagattttctggaaataagcttaatagggcctagttaagctgtaaaaaaaatttggggcgatttgaatgagaatagaaagagccaggtttgatgaagttttggtaagccaaaaaaaaatccaaacatttaaaaatctataaaaaatttaaaaatgagaattcatgcgagattttctggaaataagcttaatagggcctagttaagctgtaaaaaaaatttggagcgatttgaatgagaatagaaagagccaggttcgatgaagttttggtaagccaaaaaaatatccaaatatttaaaaatctataaaaaatttaaaaatgagaattcatgcgagattttctggaaataagcttaatagggcctagttaagctgtaaaaaaaatttagagcgatttgaatgagaatagaaagagccaggttcgatgaagttttggtaagccaaaaaaatatccaaatatttaaaaatctataaaaaactccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaatatgg

SEQ ID NO: 16089 - DNA, 2037 bp, Heterodera glycines
tcactaatctttttcctcactcacactctctctttctaacattctctcttacgattaattttcccctctccactctcatctctctctcttccgcactctctcattcctctttttctctttaactctcttcctcattccttttactctaactctttctttctctctcctctcatcctttttctcatctcactctctcgatttacaatctcttctacctcattccgcgatctcttcttccttttctttcttcctttattttctcaccccgccttttttaatctttctctctctctctctctgcttctttctttctctttccctcgctctctcccgggctccttcttctctcactctctcaactcgttctcttttctttctttatcttccctcttttacctgcctccttattctctcccttcaacacattttcttttcacccgcccattctctctcttactctcccctcacactattctctattttactttcccctttctatcccttctgtcttcctctctcctctcactctctccgcttcctttagcattctctctttctatcaccattcctcccctctctgttctctttcaccattcattcatttatttgtcattttccttttgcttgaccttaatcaatattatttgtgtgccttgtccttttatttggaataaacatttgtttattctctacggactcatcggcataacagaaattaatggagaaagtgaaaaacaaaaaattaaattatttatttcatttaaattatttattcatgtgcatatttggcttagtggctaaaccttctgcctttcattatttgtcgcatgggttcgattcctcactgggatataaaattttcaaattttttgtgggctttcaaatgataccaatcattagtcgaaatgagaaaaaaatgctacaaaaaatgctattacacttctggtcatacttttcttggtaaataattattaaggaaagtgtttgttagcagcaagtcgccataaacatatgaccagggttcccagatgtgaggctttagcctcattttgtggttttttggaggtcaatgaggtgaaattttcaaaatgaggctttgaggctttttgtgggtttttgagaaattttgaggttttgtgttttttttgttaaattttccaaaaaccacaaaattaggaattttttattgaaaatctgctaaaaatatggtcaaaattctcaattttttcccctttttggacaaaatttgttaacaaatcacattaaaaattacaaaattttcccgacggcgcctatcggcaccgccggcccccctttgttccccaaaagttttttggaaaaagcatcgcaaaaaaatcaacttcggtttttcatgcttagaattttacaaaatgctcaaattgatcatggacaatcagaaatataacatttgaacattttaagcctgcccggcaatagcaaaataaaaagagaaaagattatgcgaaattggcaaaaaaccaaaaattaattaaaatattttaaagtttctaaaataaaaatgtttcattttagtaatgctgtcaaatttatctctacggtaaatattgatcataggccccaaactcaaaaatgcttaaaaacggtcagaatcgatgtaaaaaagtttgaaatggatagaaaaaatagaattaggggcgcgcttgcccattttcaggatgaaaagtgccgaaaatggagtgccaaactcagctggggctcaagtgaccgcactataaaaagcattcaaaagacattttaaataatttttctagggtaatttgtggcgctgatcacgaatatgacctttattttgcaaaattccgaaccccgaaccctaattcgaacaaaaatttgaaattcataaattaaaaagaaaaatatttaggggttttcgaagttgctgaacacggatggcatccattttgaccaaattcgaacaccaaaccctgactcgaacaaaaaaagaaatttaattttcgacaaaattcaaaaataagcctaggcttaggactaggc

SEQ ID NO: 16090 - DNA, 1342 bp, Heterodera glycines
  misc_feature (38)..(39): n is a, c, g, or t
  misc_feature (64)..(64): n is a, c, g, or t
  misc_feature (67)..(67): n is a, c, g, or t
gattggacaagctacgaaaaaataagagattaatgatnntaaatggatggattctgtgagtgtntcnaagagttaattataatcggttgactaatgcccggcaattctcaatactgtattattttgcaactaaaatgaagtctatataaaagtcacggtcggtttacggtaatatgggacgtcacctacagtatgccgaaactgaatttccccgtccatttgaccggttcatattcaccatagcttggcgagcaatgttcgcggttagcgcgtgcacgagtcgcggcatcagtgccacaaacccgtccgcgccgcgcgccggaggcattcgctgcaacagcgtgcgcaacacgtccagcaacaggggcaacagctgctgctgtgactccgacgaaattagcttatcagcagctgctggagaagatgaagcggaaaagcccgttgttgttggcttatcagctgaagcggcggtgccaatgccaagcggtgccaacgcgtcgacaagcgcgtccacaatgagcggacagagctgcacatttttttaaattagtccgattttgccgttatgtctttaatcgattattccacctggccaaactcgttgagcacagtgtcaattgcgatgtgctgagggtcagcaacttggagcagtgggccaaggagttggagcagtgcacgccgtttggtggccgaacagtcggcggagctggcgaattgcacaaaaatgggcacaaattggcagaacaaactgtaaatgggtacgtacgagtcactattttcgagacaattccgactaataatgccgcaatcgctttggagttttactcgccgactatcaaagacataattacccaccgctgtcgccagaaaagcgtccgccggtaattgcaccgttccggacaggtggagggacggtgcaagtccaacaagtcggccatggcctgttcagtatcgaactcagacgagtcggcatcactcaacgccataaaatgttcgaaaaactgaaatgaaactccaatcggtaagagaaaaaaagtggcgccaagatggccagtgctcaggtgaccaaactggcaaagaaaaatgagagccgagaatttggtactcgaaagacaaaatcaatcaatcaaaaaaaataatgaatgattaaacaaacggcgacctgcttcaaccgttccgcaacgattgccgagttcggctccgccaccaacgcattgcgcgtctcacagcacgcaaccgaaggcgcagaagcggcacagaaatgcggacggatcggaggcattcttagaaataaatttccaatttaatgtgagccattaattcttttcaaattaaaatatta

SEQ ID NO: 16091 - DNA, 1334 bp, Heterodera glycines
gacgacgacaattttgagcgtgtccagcaacacaaaggaaaattgtttctaaaacagtccatgataaaattgacacaacagttcgattgagacaatatttatgaactttgatttttttttaccatttgcggcacatttttgtcctgtgatgccgatgacaaaagcagcaaccaaaagcatcgcaaagcgcgtaaaagtgcggcacaattgccgctattattttgcgccaaattgttttgctgtttgctaatgattgacactccttcggcacacatcctcgcgtggacaccaccatcgttggcattgtgaccagcagaagccattgccaaagtaccaacgtcttggagaagcagggcaatccgatcggcacggcggaatccatcctcctgcgaaaatagaaaatatatgccatcaaagttagggagaagttgccctttgcccttccgtgccacactcgccgaaacattcgggagaaagaaactcgggatcagaaaatttttgtttcaatacaatacattcaagggtttgataaggccgatctcaagtaatcagcagttcttcacatgatccccattagaagaagaacgggatcggatcccgccgggacgaagccggccatttccgtctcgccagtttaatcccgacaaaattttgagtattgtaatttaatttttttttcttttgtgaccaaaatatggaaaaataggattttgtttgagtccttatacacgtgtatggcttaaaatttagtcaaaaagttatggattcttgcattgcttgggacggaactggcggggcggaaccgctccgggattttcttcgggttcctgttagtctcggtcccgtttttgtgagcagggcagggataacgccagtcccgaaagtgtgattttcaagcaagaaaatcccggtccattgcccaattttggtctaatcctggtccaatttgttttaaagtccgcactcgatttcccaccatttggtcacaatcatcgtctttttgctgctggatccaatcggatgtccaactgatcagttgctgctccgcaaaaaaggcaaaacattgccgtcgttcctcccctgttgtgccgtcctcgtcgtcggatggtgtcaatgccaatcgttttgccatttcgtggacaccgacagacgcggcactttccaactcaacagaaccagtggcgatagacaatgtgttcaataaaacaaaaccaatggctgcactctgtggggataatttggaggaggggacaaattgaccaaaattgtatatgaatttaaaaaaattgatggcatttcgcttacaaatttttggtcgttcccccaagggtttt

SEQ ID NO: 16092 - DNA, 2040 bp, Heterodera glycines
  misc_feature (94)..(94): n is a, c, g, or t
aggaaacatcgtccgaatgattgataattatcttacaaagtacataaagcaacttctgaaaaattatgcacatctgaaaatttatcggcaattntcgcttctctctccagctcacagatcagagttttttgattgtttccgacttgggaattgacaatgtaaataaagcggaagaaatgtttgacaaagtgtcactgtcccttccaacaatagcaaaatcaatgcttttgacattgacaatgaaagtacattgtgggcagcgagcggtcggagctcacaaagaaacgattgcttttgtttgatgaaagaaaagtgagttgtggagaatgggaggaaaaaggccgtgatgaccaacgcccgggggatgggcgatgaaagcggcgggtgaagcagagggaaactgagagacggggaaaagggtccatagccaacaaacactcttttctcctctttttctttctcacctcctgccacattttccgctctcttttcctttctctctctcacacaaatgtaaaatgaaatcggtcgggaaatgaaagccaatttacccggtgtgatcaaacgtcgaatacgaacaattgcaaaagtttttcttcattttttgaataagattaggataggtaaaatacctatttctgctgctggtttcattttcctttttctgcgcttcactcactgtgcaggaaaagcctagttcctattacttcctttttttcttttttataattcactttggcgtactatttcttcccatttactgatgaaaagacagaatttattccgttcgaatgcataccttatataatttttacttcattttcagaatggaagttcccgccgactattctcttcataaacacacttttccaaacgggacgaatggtttgttgggccatgggaaatgattgcaaaaagtacttttattcattttctcttgacattttgactcatgcttttggatacgattgatgctcttttaagagatgtcccagcagcggaggcagcaaatgtctcactcgagcgatgaacggagttgccaagaggaggagacggaggaggagcaggacgaagaggcgatgctttacacggccaaataccgtcatttgctcgagtattacaagcacatctccgaagttgtcattattagtggtacttattaaatttacggtatcaaaaagccaagaatttgaaaaaagtcttagataaagttgaaatggaagccggttttgtgctcgcaatcagcagtagtgaacttagcataagaaaaatattgtcagcttttttttttgcttttgattctgtaaacttaataagtaatttatttgctttgtttttgaaaagcattaatttttttgaattctaattaagatgaataatcgtctcagacatcgcatttaccatgtgaagaaggaaataaaccatctcaaacagttgaaacggtattacttttactcatttttttttgtttttattttctctcaaaatttttgtttttaggcttctttgtgagcgtttacttttccgaagggttgaaattatcgacacaaatttggaaatccctgacaacgattcgggcgtacacagcgccatggaattggttggggaggtgtttaatttatttcttgttttgttattccctttggtaattattgttcaatttgttttgtttccctccccacatttcttcccatgccacagattgcgaatgccgccgccgccgccaatccctcgcagccatccgccgccagtggcaatgcttcgcacggcaccgctggtggcagcgccggaggcggtgggcggaaacgaaagcgcggcgcgacgtgcggcagtgacgaacagccgcaaatggcgacgagcggaggggagggcgcaaaaagtgcgtcgtcactgttatttgagttttgttggaacagttttttgcttcttcagcgatgccttttcatctcggcaaacaacaaacgacgccacgagcaaaaacgtcgcgcggtggcggcgacgaggcaaagcgaaatatcatcaatatcatcgaaagcattg

SEQ ID NO: 16093 - DNA, 1572 bp, Heterodera glycines
agtaaaagcgcgagggggagcgggtcgaagtccaaaatttcgtgggagtaaacccatgcgaattgatgatatatattttcttattttgctgtgaaaagtatgggattggcgccgccgggaaattaaaagtttgaggcaagttttggcacgtacattccttttacagtttcttcgtcgtcctcaaaatgccaacatcgtcgacatcttccgccgcctcttcccccacccgctgccttggtcccctcttcgtcctcatcggtttgccatcaccacccacaacaaccaaatgtaagtaacgggtgtagttttttgtaaatttccatttttccgccgctaaccattcttattctcattgtcagcagtgtagttgttgctgtgtcagttcctccaacaacagcaattacgaaccgttgtccgaatctgatttatccgctgaggaattggccgagcggctcatccaccggcgctcatccatcgaccatttactgcccgaggcgcccgagccggacgacgacgccgacgctggtgaacaggaaaaggggaaggatcgcaaggaggaaaagagcaagacggagagaagagacgccgtttttggaaacagtaaacacgaaaaggaggaaggaaaggacaaaggaaacggaggagaaacccaacaacaacaacaaaggcagacaataacgcaagaagaaaaaacaccttccagtgaagacgaacagcataaacaacagatgatgacaaatacaactggtaagaatatctgcactcctggcccctaaattcctctaagatttcaaaatttaacaaaataggcaatttcagtaagatctgttgaattcttttcctgttgactccaaaactccttacttttaatgatggactcataattctttttagttgtaccaaatttcatgaaacagtcctctgacgacctgaccgaagaaaaaagtccgctggcaagtcaatcgcacaaccaacaacagccaccatcaacaacaacggcgtcgtcattttcgccgtcctcggcagtgacgccctttgtgcctgctgctattgcttcagtgtcaatttatgcagcgaatgatggtgaaaagagacgagaaaccgaagaaaaaaatgttgaccaaaataccactgttgccgaagatgagaatgaagatgacgatgaaatggaacaggaactgtagcacataccatttgatattagtttaaataaatgccatttttatttgaaaatattaaaaatttttttctttctctcaactttggtcattacaatttgacctggcaattatgtagtttttgtggtttctgcgaaaaaatcaccttttctaggatagaaaagtgctgatcacgaatctgccaaatgagctcagtttttgcaaaatcattgattttgtctatcattttcatcaaatttggtttattttttctaaacttttttctacgtggtgtgtatgctcgtgtatcttctgaacatcatgtactgaaacaaatacctatgtcggcagcatttcctcatttgaaccacgtaagtgtcggagagaagtcttcagtgcaccccaagttgcctca

SEQ ID NO: 16094 - DNA, 1574 bp, Heterodera glycines
  misc_feature (1538)..(1538): n is a, c, g, or t
ggggggggggggagccattggggattttattcatttttcgtatttcattttgcaactccaattttcccataatttgacatttaatttataaaattcaaaaaaacccacctctttctcttcgcggatgcttcttacaaattagcagcagaggaagcaaaaagacgcaaaagggcagcggcgaatgaccggcgattggaaggcgaattcaacgaaaattgggtagaaaaaataataaattggacaattaattattaatcgcctttgacactttaaaatggtattaattattaattaatattttaatataaaaattctgctaatattcggtaatttgcataataaatgccattttgagttagtttttgtggttttctgtgtcattttaagcatgaaaataaataatatttttaacttttgtgctaataaacggcggaatttttcggggattggctaacagaagaaacagcagcaaaagtcggcctaaaattgatcagaagcgatttgatcggcctgggcttcttgttctgttccactgctgcgcccatccacgcctaacaaccaaagcttatcagccgatacatcaaaacaaaccaatcccatcccatcccatcccatccaatccaatccaatccaatcatcattataatcacccaattgtccgtcatttttacagagaaaaatgtttgacgagtttctgaccaaatgaaaagcgacaaaaagaggaaataaaaataaaatattttattattgtaaaacaattgagcaaagaaagcaaaaaacgagctaagaaaaaagcaaataaaatattataaattgtaaaaaccgactagacaaaataaaaagggagaagaaaagaaaagagaagggaagagaaaggatgagtaatcagaagaaagaaacattaataaatataataaagaatgcaaatgatcagaaaagcgatggcatcgtttcgttcggcactttgccaatcaatcgaaaaaacattggcattttggggtggcagcttgttcagatgacacaaaacccgtttctggcttaattctgcatccaattccgttttgcttcacccaatttgacttccctcaactcacaagcgaaaaatgactcaaaattaggtcccccgaatactatttaattaattgttttgtttttattctgccgctgatcgaagatggcaaagtcgacaatgcgccatttttcgcgtgccaaatacgaagggaaaaggccgctccgtcgcgtgcgtcggtttgtgccctttgaaaagccattccaatgattgccggcaacgcctggcaaaaaaacggatgcatgcatatgcttcgtctgctggcaattctcaaaaaacaattttcgtcacttctgatcaaagccaacagccggcagacccctcaatagctcattaactaattaattactacctcactaattaattaatatttcatttctcgcctaactaattatcaactcattgcgcattaattaattatattaatataattaattaattagttggcccaccgatcacatcgccaggncttagttcgattttgttcgtcagtcttcggactaaa

SEQ ID NO: 16095 - DNA, 2461 bp, Heterodera glycines
cttcgggaatagttttttagcatgtaaatggtattattttatttgtccctattttaactttaggtctcatttccccccccccccccccaggctcacctgactactgaaggtgcacacaatgtatctgctcaattagaggagcaaatcattttaaaataagcaaaaatgttagaatttacgagcaatgcgccaaaatgtgcacgtcggcaatgacaccgagcaaagaccgatcggagtatcgattggagggaagagcggctaaagagagaaggagtgggggagaaagagagtgatcggacggacggacagacaaattcaattttaatgattacgatcggtgatgcgtttgtccccaattcccccttttttgcccttttgcccaccttcggcactttcgtcgtttgcccaaatttcgaatcccttctttgcccactccgtccgcgcttcttcgatcaccgttttgtcgtcagtggcgatgaaaatgcgctttttcaggggaaggccaagaaaagaaaattaattattaaaggtaattaaattaatgaaaaaacaaaattaataataaagggaagagaattaaaaaggcacgtaaaaacaatttaaattaattttatttttcgtatttattttataattttccctttttacccaatttcttttgctccgtgcgaaaccaaagctcggcccatcgcatgtactcattgacatgatgaaaggccgcctcagtgccgactttgtcagtacggcgaatttgcaacccgacgacggggcctaaaaagggaaaatggaaaataattaataataaaaatatttaaattaagggaaaatatttaaggcatttaaattattattcttcagcacagcaaatgtgagaattgacttgcccaattcgaagggaattctgcgcattgcttcttcaacgaatttatttgtcctttcatttttacgcattaaaaaagcgacaaattgtccaaggaaaaacacctaaagaatgaattaaatgaatattaaataataattaattactactaattaatcaatcaattaattaatgaccggtgggtttgagtggtgagtgagcaaaacatcggcaaattgtgcggggaatgcgagtggaaggtgatggggacgggaggagagcccatcgaccacgggaagacgaacgattcggggggagttgggctgattaatgccagtgaactgatcgacgacgacggacaaaggcacctgacaaatgaggggaaaaagcgtagaaaaaaaacgaaaattgaaaattcgaagggataaaaaacttagaaaaatcggaattgaggatataaaagggaaactgtccaaagtttgtccaatgctgtgttattttacatgttctgcgaaagtgcacgagccgaccgatcggaaaacggcggcccatccgtcgcgcgaatagcgccactcggcgccgtccctctccaaaagcatcgttcggtttgtggccgccgccattaacagacagtaaacgacgtggtgaaactgacagccgaagccgcaccctttgttcagctgaaattcgtccgttttcagtgccatcgatccatcaaacaaaagcaatcgatcgattgatcaggcaagcttatcgattgatcaatcgatcgatcggtcgtttgaattggtcgacgatcatcacccctccttccccttttttatttttgcttttgcctcgcacaacagaagtcgcgcctttccgcactcttttgggtgttgcagcgcgtgcagtgcgttttgaatgttcgaagcgacgcgtgccaacgcccggcggtgccattgttcggcgccgtcgacgtgcgcaaattgacgcgagtgggccaacaaatggagtatctgatcagcaaaagagagatggaaattgatcaattcttcgattgtctgatcagtccgtccgattcttcgaccgtgtcagaatcaatcacctgttcgtcattcaaaagttgctgtccgtctctttgaccttccaattgctcttttctgctgctgctgcccactctcaaatttcacttttattttattttgctaaattaccgtacacctcgtgtacagtagctccatgatcagtctgttcaactctctccgtgccaattcgtgctccttcgagtaaagttctgctgcctgcccattctccgattggtcggcgtcttttgtcggattgattaaattcgaattctaaatttattttaattattttttaattgttttaattccttttccctttttcacctcttctttcagtctttcattttctcttctcaatgcttccaattgttctcccatttgttccatttcaatttgattttcgtcgcttttttctttttcgttcttcgcttttcccccttaaattttgcctatttttaatttcttttctctttttcctctttttgactttctagtggtcgttcctcgtccacaaattgtgccattgtcctgcggt

SEQ ID NO: 16096 - DNA, 1015 bp, Heterodera glycines
ttttggagaaaaaggattaaattctctcgtgaaatcctctgctcgtttctaactacatttttttacattagtcaaaattgccgcggagtcccaaattccgcgggtcgcgcatcgcgggtttaaaatcccgcggtcgcggattcaatttctcgcgttcgcggatcgcgcaaaaaaaaaaacgctgcgaatcgcggtcgcgctacacccctatttgcatcaaaagatttcattttttagtttatcaaaatttttggaatttctatttgtctatccaaaaataggtagattgcttcaactacacattaatcgcttctcaaaggtttttatttagaatggtttcttctttaaacaatttgctacccagcattgatttccccttcatttacttgcataatgaaatggtcaaatatttccatgacagagacaaaagcttggaggaacaaagggaattgtggctgcagaaaattaggcatttgtctgatgaggaaacggtggatttattggcgggaacggacggaaagatgatgagtaatcggatattcgcgcaggtataatgaaaaccttattttttacaaaatagaggagttctggttttttagcgcaatgccgtgacccgacttgaggcctccggtgttcgtgtgggctatgtgttggcagagcattttgccaaggatttaccgcgcttctcgaacgaattggacaaaatgaagttcatctgcaaagagttctgggccagcactttcggaaagggagtggacaaactgagcacaaatcatcaggcaatttttattgttaactaccaatatttcaaggtctatatacatttagggaatttacatcattcaagacagcaaatttcacactgtcacaccctttgccgagggtgctcagtacctcgctgattccatcccctatttggcttttcccgccggcctcgtcaggggtgcactcgagtcactaggtgtgtttcataaatactgtaaatactgaggggtaggtataacgcaaaaacatg

SEQ ID NO: 16097 - DNA, 1925 bp, Heterodera glycines
ttttgataattgtctaatcgcgacccaatagcttagacaaagcttctaaacatgttaagctttcgactggtatcaacaatgttggcttgagataactaagaaaaaagttatagtggaaaaacatgctggcgccgaaacgccaggtgacccagatactgtatgtcgagacaggaaaacgtgtgaaaaaataaaataaaaagtctcccgatttccattgataatttttcacatcagacccccccccccaccctttaattgatcgacattggaaatcttaagacccaagcaatcctattttttgaaaaatattaaataaaaatttaatatgaatgaataaataaaaataatttgcttctgaaattaaaattctctcttcgcattcattgcccaattaaataaaattaaaatttcataaaattgttcttcaattgtgtttattcgtagataatttttcggtgcgaatacgtaaaattattcggacgaacgaatggaattctccggcaattcctttcctttcgtttcgggaagcaaaagagtgaaaagccctgcgaagaatgaaaaggcgccgaaaaaaagcattggcgcaatggaagaaaactttgcctaatttcgaaaatgattttcagatgaattttcacttttttaccatcactcggacactcggcgcaaaaatgctgctcccctaaataattgtaaaataaattagaatttgtttgttggacgaattcacttgtgaaacggccgtacaaatgcccatacaaaggccacgattgaccgtcggaaacacttcggaagtgtacacgaaaagacccgtgaaagaagacgaaatggcgaactttccgatgagccaaaggacgaggaaaagttttgggctgtcgttgagaaggacagccaaaaatgcagaagcggccaaaaagtgagtgaaagaggtgaaaagacgacgacccaacctgcaaatgcattaagacaggaggacagattggcatttagcaatgaatgcacttttccaggaggaaaggcgcgaataaatacgccggcacttcggccaatgccaccaaagtgaaattgacgaagcgattgccggccaattgggcgctgaacaagctgaggccgtagtaaataaaagtgtcgcaagtcctgagcatggaaagattcaccttcactttgaattgcaccaaattattttgttgaccaaagaaagcagaacacggtcaggtagaggatcagagtacgatcggtccaaaagtggcgcacttgggaagcattgcttaaatcaccgttggcattttgggaggggagggggggggcaatgatggcgggaaatgagtggctgatcgaaatgtggcatcgatcagattccttctttagtttttcttttgctaattgtctatttccgaaatacagtatctctgcactttctgttggttacggtagccctcactgatcagtcaaatcgttttcccaattcgttcccacctccgccgttcgttttcctcgtccctttgctcttctttctctttggcaatttgcccaatgaattggtccaattccgtgcttccaattgcgcgtgtccccgccttcgctgcgcatttattcgccttttccacccattttttcacgtcattcaatttctttccggccaccaaaaagtgaaaactttcaggaattgtgctgaaaatgctgcttttgttgacataaaaaattattggaagaattacaaaaaatagaaaatgccaaataaaatggacggccccgacgcagcggcgattaattgttgccaattagtggtgaaataagccaccggggccaccaaacagtagccgagcacccacatcagcccgaacagtaacgcactttgggagcgcagatggagcggaatgctttaatgtgcgagcacccaattgagcatggcacagccctgaggg

SEQ ID NO: 16098 - DNA, 1962 bp, Heterodera glycines
  misc_feature (1801)..(1801): n is a, c, g, or t
  misc_feature (1817)..(1817): n is a, c, g, or t
  misc_feature (1878)..(1878): n is a, c, g, or t
  misc_feature (1896)..(1896): n is a, c, g, or t
ggtaattaccggttttttgggtaccggtaccggtaccggtaccggttttttcaaaaatgaaattaccgttaccggtttgtctagtaccggtaccgccggtaaaaatttgcactggtaagaatgggggtctggtcgagaaaagagtaggaatttgtgaagaaggagaaatttttgagaaaaaattaaattttatttcatttagtcatgggagtacacacatgcacatgtggtgtagtggttaaactttctacctttcataattttttgcctgggttcaattccccacttggatagaatattcctcacattttctttaccatcattttaattaaaattttaattttaaaaaatatttcaacttttttctttcatgttaagcatcctaaaaacccaaaacttaatcaattggtcatttttttacaaattctgttaacaaatcgcattaaaaaatacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggccgctgatcccttgttttgcaataatctgaattttgaggtctacatctgaattttagtgttctttatcctaaatttgaaaaaaaaacttggtcaccctcaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctagttttgatttcttaaacatattgataattttgaaatttttggcacaatgtcattatttaatatagaattttttaagtttgacgcaaatttggaatggactaattatttaatttgctatatttagtcggcatccaattctacgaaaaaatgtcgttcagctgtttcgaacagtgcggtggaaagtaaaaggttttatctgtaagaatcgaattggcaatgtcgaaaacgaaatttgcgaaaagcggcgacagagggaaaacgaattggtggcgcaatttgaaatgaaacggcactttgaaatattgacaaaggcatgggcataatgcagcaaaagcgaagcccattttggaaaaatgataaataaatattaaaatagatgatgaaggtaaaaaaagtataatgctttaatgtgacagttatttttaaaatattaatatttgattatcgtttcctctccattttcctaataaaattataatttcaaaaatttttgtgaaaacattttgtacctgattgtttgttgtttttttttgatgaatttaaaaaataaaattgttaatggattattttgaacaaaaaagattaaacgttgaattgcagatatttttaaaattaaaaaaatcaaaaatgtctatgaatttcgattgttggaaaatttattagtgggattataaattatatggactaaaaaccccaaatatgtggactaaaaactgcagtaaagccgtgaggtcccactacccagtgcttaatgagggatttagtctaagggagccctcttacgcgtccgtaattaggcccctcagggcttggaagggaagggatgttgatggatgcctgngggcgcctccaggcgnggatcgattggccattcactgaatgactcccgactgaactccgatttgaccctttggctgnttatccattgccatttancgcccctcggggatgggaggagcctatcgagaataaaggggggggggggggggggaaggggaaagg

SEQ ID NO: 16099 - DNA, 2307 bp, Heterodera glycines
tgatacaaagtgtaaaaatattttctattttcctcaaaaacttttcatttttggagggtggagaattctgacccttcactttttaattgaaaaaatataaaaaagtgctaataaatcaaaatttgttcatttttaatgcttattccgctgtcagttcaaattaaactgtgaacaaaattcgcgacaaatataaaaaaaccaaatttaaaaaattaggaaatttaaaaagggtaaaatattgtttagtttacactgtcgacaaaaaggactttcgtacatttgtccaaagaatgacctcaaaagagtcttcggaaacccattcacaagtcgcttctgtcagcgaaccaaaacgaccagtgccatcgcagacggcacaaacgcaacatatcaattttgctgctcagatcgggaggccaaacattggactgccaaattatgccattccatcggaccaaggcaatcagcagcacttaatagcaaaagcggttaatgccaatcgacaaatgacgaactaagcatttgttggccacacttcaagtcaaacaaagcaacaaaaagcacaaaattatgacacaaattatgggcaaattggacgaaatacaatgccagcacaaggcactcaccaaataagtaaaaaattggaaccagcttatgctcttagtgctgttccaagcagtgctttgctccgccctgatcagcagattggcaaccattccgcagttagtttttatccgggtcaaatcgacccgaatgcgcagtcaactctgggtcttggccctgatcagtttcaccagtatctggcacaacaaagttatggcattggccccagtcaaataaaccaaaatttgatagaagcaaatcacctcattaactcagagcaattatttgggagtaatttgagagcacctcctgaagatgtgcagtattttaccaataaagagctcaaatcggacaaaacaatcattgattatttaaacagtcactgtgtgactgatcaaagccttttccttagccaaaatttggttgagcctttaaccgattcaaatgtttaccaagaccaaataaatatgctaattgcagaaaaccagttctttaatcccagtgatcaaacagagtcatatttgaaacatgatgaaaatttaaatcaaatgctaattaattttgtggcttcttcatcaccaaataatgatgaaggggattatcggcctcacctgctcaattcatttaatcaccagcagggattgttgcagcactcacctttggacagtgattatcatctgaatgatccctttggggcttcttcatcgtcgcaaatgcaaataaatccgtccaattatttccattatcaaaatgtgccgcaagattcagctaatattgatcaaagtgaagtcgaaacaaaaaacacggagcaaatggcaaatgaaaatgagaagcgaaagatgaaacgactaattgttgaggacgaagcaggcaaaagtgaggccaaagcgaaaatggaaaagcggacaaaaaatcagccaccagaagcagtgggacgacagtccgcttctgctggcgaattgccgggacggagttcaatcagtcaaagtgaaaagcaaattggtaattagaattcaattacctcttttataaagcattttgcaaattaagtccaacaagtgcttcacattgttggcctgactttagctgctcttggcaaagattcgccctccattgatcgcgttttgaatggctcaccaaatcatgatcaattttttgccattatgagagaaataaagccgaatgaagtagtggcacacatccaaaattggcttttaaacgatgaactgatcagaggaaatacaatgtacagagaaatgatcggcgaaatcgatggacaaatcggcacggcatttggccaaagccttttgaagtgaaccggggcaaaccgggattttctcgacaacgggtttaatttcgagtctatttttttgaaattacacaacgaaaacattggccaggggtagtggccagagatttgttcttgaaacccaatttatttggttggtaaaatggccaacagcttgtttaggaggcgaagttcagaaaagaaaaatatattttttaatttttgatataaaaagcgtgatttcatttaatttaaataaggatttgtctgaaactaatctgaaattacattttttaaagcgaactcatcggaaaagaatcatcggaagatttttcaaggacgggcgtgcttttcttttatagcagtctttacaggaaattaatcggattattggaggcgccatacgacaaaagcgatgc

SEQ ID NO: 16100 - DNA, 2779 bp, Heterodera glycines
  misc_feature (40)..(40): n is a, c, g, or t
  misc_feature (1372)..(1372): n is a, c, g, or t
  misc_feature (1374)..(1374): n is a, c, g, or t
atatgtgaaggggatcctcgaatcccgtgttttctggtgngcataaaaaattgggcaaaaaccagaaacattttgaatggttccggttattaaaacacattcggttggtctctcatggctatgcattatgttgagggaagaattaaattaaaggggattttagagcagaagcaaaatcagttcctcgaggctgaattaagacaacttggtaaacccgttagagaccaagtttctgtttttcggggagtgtccgaaacatccccattttcggaccaattaactcaccatttcccaaaccaggagaagttggacgacaatgccaatctcaacttggcggagggaagcgatcggcgaattggggagaagttggacaacgaagccaatctcaacttggcggagcgaaacgaacgacaaatgtggcacaaggcggtcaacgaggacgacacggttggacgagttgagcgagtgcaaacgcgaacgaaggaagaatggcgaaaatggagggaaaagaaagtgaggaggacatgaggaggaagttgcgaatggagaggacttgccaatctgacaaatcttttctatcacttaattcgatgttcagggacattcattttttactttgcccaaattctcaatttctgtgcattaattatgctttaattttaaatcattttcaatcatttaaattgttaatttctatttctcatttcctctcttattatctccgacacacatctcttgtaaattgacggcggtctcatccgccatatttaagccattcattttttcccatctctcttcacttcacttcgacaaacacaatttaaaatgctttaaaaaacatttttattgctcttcgcatttccatcaaattgctcaataaaaattcctcgaattttgagaacaacggaaggcaagggattggaggttttaagtgattttccgcctcaaaactaaatcacaaactttttgaaaagaggcggaaaaccatttaccaatttattggcatttggattttcactcatttcgtcaaatcacattctcacctcaccaagggaatttgactcaattcgaccactgcgaccaattgacacggacaaccattgcgccggacaatcgggaaacattggacaaattgacgccgacaattggacaaagacaaatcgcgcaaatcggacattggacgcacagaccaaattacaaattggacgcactgacaattgggaattggacgaactgacaattgcgaattggacgcactgacaattgggaattggacgcacggaacaaattggaaattggacgccctgaactggttggacccttgacattgtgtgcaccgtctcggagcgtgtctcagcgcgcaggccaaacncnaattaccaagacgtgccccggacaactggcgaccttttgtacacaggcgggttcaattttttttcccaaggggaggtctgattaatctggtctcatccagaattaatcagtgcgttaatttttgttcccacctcctcccaaaaaaggcaatcaagttcagtttggactgaaattttcgaagtctcatcttcgaacagtcaaacatttaaattgcccaatttgaatttgcccgaaaaatctcggcatttcatttccaattcacattttttttgtgtttttgtccaattacatttattcaaaaaatctcgaaatctcattttcgagttcaaagttttgtccaatcccataccatccaatttttcgaaattttattttcgagttcaaattttttgtccaatcccatttagtccaaaatttcggaatctcatttccgagggtctaaaaatttgtttttttgtttttgttttgtgttttgtttttgttttgtttttaacccaaattgtccaaactatccgctcttgataaaatcagagtcttagctctgacagtgcgtggtaaaaaggtctcacaaatcgtgaatcgtgtacccttccccctttctgggttttttgttcccctctttctggtttttgaattactgattctcaactcagaacgcagttcggttattgattaaattggagtctcagttccaaatttttaaattgttcggtcactgttcggttattgattattgaattggagtctcatctccgaaattttcgaatttggtccattgatttgagcaatgacagcccccccatccagccattaattagggggtgtgccagcaaattgggagccattattgggtaccgaaattccacctgacctgggaataaatgccctaccaaatcaatgccaaagaaggctgtacaaattcagaaaccttctgaatgacttagaaaaggtggtacaaaagattgaagataatttgggtttggctaatgagtatattggtaaactgagtcgagacaatgcaatccgtaaggaaacggaaatgcaggaattaatgcaggagttacaaattaatgagaaacaaagggcagctgacgttctcattccaattttgagggacaaaattgaggcattagaagagaggttagacataactcacaacacggatggtgacactacctccgcatggtacccctctcaaggagcgtgccaatgcgtaaaaatttgccaaaaactgagcttaagagatttgatggtagtccatctcagtggataccattttgggattactttcgtacaataattcatgaggactctcatgtcccaaaaatcgataagttcagttatttagactcatgcattgaaggcaaagccagtccaatcattcagggtattccaattagtgaga

SEQ ID NO: 16101 - DNA, 1125 bp, Heterodera glycines
aagagaacagaaagtggaagagaaagtggaagagaaagaggtagagaacagaaagtggaagagaatgtggaaaagatagcaagaggaaccgaaagtggaagaggaacagaaagtggaagaagaacagaaagtggaagagaaagagaaagtggaaaagaaagagcaagaggaaccgaaagtggaaccgaaagtggaagagaaagtggaaaagaaagaggaagagaacagaaagtggaagagaaattggaagaagaacagaaagtggaagagaaagtggaagagaaagtggaagagaaagtggaagagaaagagaaagagcaaccgaaagtggaagagaaagtggaagagaaagaggaagagaacagaaagtggaactgaaagtggaagaggaacagaaagtggaagaagaacagaaagtggaagagaaagtggaagaggaacagaaagtggaagaagaacagaaagtggaactgaaagtggaagaggaaccgaaagtggaaaagaaagagcaagaggaaccgaaagtggaaccgaaagtggaagagaaagtggaaaagaaagagcaagaggaacagaaagtggaaccgaaagtggaagagaaacagaaagtggaagagaacagaaagtggaagagaaagtggaagagaacagaaagtggaagagaaagtggaagagaaagaggaagagaacagaaagtggaagagaaagtggaagaaaaagtggaaaagaaagaggaagagaacagaaagtggaagagaaagagaaagaggaaccgaaagtggaagagaaagtggaagagaaagaggaagagaacagaaagtggaactgaaagtggaagaggaacagaaagtggaagaagaacagaaagtggaagagaaagtggaagaggaaccgaaagtggaagaggaacagaaagtggaagaagaacagaaagtggaagagaaagagaaagtggaaaagaaagagcaagaggaaccgaaagtggaaccgaaattggaaaaaaaagtggaaaagaaagaggaagagaacagaaagtgtaagagaaagagaaagaggaaccgaaagtggaagagaaagtgtaagagaaagaggaagagaacagaacttaaagggaaagtggaagag

SEQ ID NO: 16102 - DNA, 1177 bp, Heterodera glycines
ttttaatgtaatttccaaatttagcagggaaagcccgaattggagatgcactgtttgcaaattagaacgataaaattgccatttactgttttgcaagaagtgtttctgacaatgccggcaacttacaaagttgtaaaaatgaacgaaaaaggatgggccacattgttcatgactgagggtacattgaaacaattgggcaaaactagtactgtttcataaagttttagtcgagacccgcgcggcatgttcatcgaagaattgagaggaaatgttttggaatgtttttttattaggtatttattttttggcatttgaatggatatcaattttattgtatgtatttgagccaagcttggctaaagaatcccagtaaaataagcgagcgataaccctagttgtgtgtcatttccactcgaccctcccaagaacaaagcttgaccattaagcaaagtttatgggatggcgtcagaaaagggcaaaaagccaaggaaaaaagtggggaatatcgtactaataatccgacggaagaaatcattcagaaaaagtgccagccaccgttcgattgcgaatgtaaaggaacagtgccaccgaagcctgggctcggctcatctccgggaacagctccaactcctttttggtcattcgatcgtacggcagccgggcctgggcagccgcggaacggagggctgagagaaaagaaacatttgtgaggacaaagaatttattggtaaatcattaaaacaaaaaatatatggatggggagagagggggagggattcattcagccaatccaaaaaataactgaataccgtttttagaaaaatcggtcggtgtccgactcactaattaagttttattgaattttgcactttattttgccataattttcgattgtgtcggctgattgtctcaaaatacgcacacaaatcgtcgtcctcccaccgatacacatccatcccatgcagttcgcgtgtgcccaactgtgctagtgagtttctgacgccatagtccacattttggcgtctcgagcggttcggcggtcgagacgctggtttgaagcgctgattgttgtggttgttctgcgaacgggccgaatgattggaattgacaccgccgccaaaacgcgggggagacgaactcgcggacgaattcgaagacatagcaaaaaaaaaaaaaa

SEQ ID NO: 16103 - DNA, 3637 bp, Heterodera glycines
  misc_feature (2408)..(2408): n is a, c, g, or t
  misc_feature (2446)..(2446): n is a, c, g, or t
acttaattattgagacggacaccgaccgatttttctataaacggtattcaaaattattttttgaattggctgaatgaatccctccccctctctccccatccatgtattttttgctttaatgatttaccaataaattctttgtcctcacaaatgtttcttttctctcagccctccgttccgcggctgcccaggcccggctgccgtacgatcgtgatgaccaaaaaggagttggagctgttcccggagatgagccgagcccaggcttcggtggcactgttcctttacattcgcaatcgaacggtggctggcactttttctgaatgatttcttccgtcggattattagtacaatattccccacttttttccttggctttttgcccttttctgacgacatcccataaactgcttaatggtcaaactttttcttaattccgagcccattaaattgagttatttgctaattcagtcttgaaaaaggcaactaaaaatgaacaaattgaaaaatcaacaataattatgtgcgttttgatcatattattaacactcactttttgctcttttagtaaaatttcgcttcccttttcagttggtcctttggcaactcgaccctttggttgagctgaccgtcgaatacattctcaccgaacttccggcaccctttgacagttcgattttccctcttttgagtcgttttatccgtcccttctttaggtgacgttgagttggtcaccggcattcatgcgtatttgcagcgctacggcttcatcaattttggccttttccaccaactaacgggtttgttttgttttgtttgtcatatctgaatgacaatgaattcggcaaaaggcacgccctttacggttttcaaaatggtcctttttaaaatgaaatttagcgcgtcgtttggaccgcccgaagactgtcattgtcatcggtgccggcccggccgggctcgccgctgcgcgtcagctcaaattcttcggcttttccgtcattttgctggaagggcgggtgggaaaggggcgcggtaaggcaaataaatgccatcaatgttctcccttttcaggctcgtccgggtggacgtgtccaaaccatcaatcgcacccattccgcggaccttggggcgatgattgtcatgggcattagtgcgtttcactctgtttttcattccgttgcttttactttggccactatttgctaatttcagtgggaaatccgttggtcactttgatccaacaggcaccggtgaccgttttccgtgccagcaatcgctgtcccatttatgacaaccaggcaagttcgtttgtttgttagacaatttccaactttgcatcgtttgtttttcactcacaattattgaaatttgtgggttttagggcaaattggtggacagtcgcaaggatgatatgattgagcgttcgttcaaccgcattttgggcacaatttcctatctttcgcacgccgaaggcgtcaccgagacgaaactgcccggggaaacggcggggcggaaaatcagcctgggcaaggcgttcgaactgatcctcaggtcactccctcttattcgcttataaaacaaatgcaaatttcaatgatttcaaaatgcggtccctgggaaagggaggggcaaacggctaattgtaaagggttcattttgacatgacttatgatttgacaatggacacttttcttccttttcagccaacaggaattgcgcgtcaaaaacaaatggctcaatttttggcagaaatactactacttgttgaaaaagttggaaatcgaaaaactcagagtgaggcgaaggcaaaaaaactaaaaaaatagcggggcctaattcattaaattaattaattagtcgtttccaaactattgggttagttgcttttgttttcaattcctcaggtcgattctctccacgctcagcttgccgattgtatgcagagactgcgcgaaaacggaattgcgaatccggcggaagcgaccgcggaaacggtggggtttttatttattttttttaaaaaatatttttgagccatgtatttgcaaatccaacaattttggaatcaccccctcgccccaatttttcgtaaaccatttcgggactcaaattatgctgcatttctcagattgccgtcaattttgaagaatcggccgaaaaagttgaacagcaaatgattgtgcgggctttgcgtaaaatcacggagatcactttggaagtgggctatttttttggcttctgtttattggcataaatttccaataaattttttttctatcctttcaagaagtatgacgaggccgagcgcgaacggaacaacaccgaaaacgtattgaaggacttcaaacagatggaaccgaggtgaggaaaagcctttgaattttgatattttgaaaagaataaaatggttnggaatgaaaatgtaaatccgagccaacagacgcaaatntaaataagtgtaccaaatagtttcaattttttaaaattaattttaatacgattttcctccccttgagtgtcgtttacatgaacaacacggacaaacgcattttggacttccatttggccaatttggagtacgccattggggcgccgctggacaaagtggcgatgaaggactgggaccaggacgacccgtacggatttaccggctcgcacatgaccggttaggaaaaaactaaaacagaaggcattcctcccatcccgaaatccttagacaatctcgtagaacttgaaaagcctcctcccctgtaggagtcgatggaatacaaggaaagtgtttattttatgggatgagatctttttcatttaagacactttgtaggcacggattttgcccttaaatcgtcactttttttaatgccccgaatcctttcagtgaaagagggactcggctttttgattggacgactatgcaaaaaggaattaaatgtgcgttataatcatgcggtggaccgaatcgaatacaatgaaaacggtaaaaacggagggaattaaaaagaaattcattgacattgtccatggataaggcagaggcctaattggccaattatttaggcgtttcggttcaatgttcgctgcagcccgaggcgcagcagcagaaaagcagcagtaacaagcccgagactgtctgctttgaggtgcttttgttcatttaccctttcgttgttggcattttttgtgtgcgttagacccaaagtcatgggtcaaaactctccaatttatttggggagcgtctccttgaggagtgacggcttttttaaaaacgtcatttgcgatgcgcacgtcttttacaacttttaatcaagccatttttgtctaattaggccgatgccgttctctgcaccgtgccattgggtgtgctgcagcgatgcgacgtgcaatttgagccgccgttgccccgctggaaaagggaggccatctccaacatgggattcggcgtgcttaacaaagtgagccaattataagtagtgatcaattaattatcccatttttgaaagatcattctcttcttcgacaagcccttttgggacacgaaacggtcctcattcggacgactcaacgacacttcgtaatgcctaataattagttggccttgccattttcctctcatcagtgagtcccgtggcgagctgttcat

SEQ ID NO: 16104 - DNA, 2874 bp, Heterodera glycines
gcaaccgacccaaaattcgacaaccatccaatcattccacctcaaataaatgcccagcaaacagctctaacgggcctcgaatgcgtttaattctggacaaattgccggacattaagggcaatgaaggaaatgacagcattaaatcttttttcaaaaaattttcacagtataccagcgattggccgaataaaaagcgcattgattccttggaatcgaaactcagtgggcgcgcagagcgagcatttaattcggctttggccaatgaaccgtttatatttgaaaacataaaaagacacattctccaacaacttgaggcgacggattgtcatgaaatggcagcatttgatgaattaatgcaaggcattcgccgaaagccaagagaagggctggatgatttggccgaccgaattgtgagcctggtgcgaagggcttatccgggactgacgcgaaatttggcggacgagtattcgattaaacacctaatccgcagtttcgataatgccgaacttgccttgagtttggagctaaatcgtcggccaggaatgagttttgatgagtttgtagctctagctgctcgtgccgaaacgacccaaaatgcggcgagaagggccaattcggacagaacgcaacaaaattttggccgtagcaagccacacagacaatatgatagaccgatggccaaacaaagcaaaaacgcatttgagccgaacaaattccagcgattcaatgaaaatcgaatcacgtgccaaagttgtggaagagagggacatgtggcgagaaattgttttaagcgttttgcagatcaggatcagcgtcgatattttagccaaaatcaaaatgcgaccggtgccaatagagcacaaatgccgacacattcaaatccgaatgtcagccaaaaatccgaacaaaatcagtttggacagcgccagcaacaccagcaatcacgaaattttctaaaacaaaatttcctggtcgaacagaacggaaagcaagttgagtcttccaatgttcagtgtgccggtgttatcagcaatacacctgaaatgttggattttttccgaaaattttggacaaaatgcgatgaaacggtggatgacggacaaaaataagcatttccaatcggcaaaataatggcaataaaggtcaaaatctacgaccaatcagcagattcaatgatggatagcggggcccaaatttcgcttgtacaggcgagttttgtcaaacacctcctagagaactcaacactgcaagtcgaaaatctcaaaattttctccaaaacgcgaaatgtcgtggacatcaatgggaaaatcgttgagtgctatggcataatcatcctcccaatcactaggaaaggatgtgaagcagttgaagtcccacttcacataactgatgcaccgattggcctgccaatactttttggtaccaatgccatgggactgttgggctttaaactttttgactcacaaaatggtgagctgatcgaatttgaatgcgccgataataaatcggattatgtacgcattgtctacagtacactgatcgaacctcactcaacaaaatttgttgaactttctgtttcaccaaaatttagcggcaaagactttatcctttctccaaacgatgaaagaaacgacttaagggtcgaaccatcgctaaacaaagagaggcgcggaaaaacaattgcagccataacaaatttttctcaaaatgcgttgacattaaaggagaatgaagaggttgcggttgtggaagcaattgaagatgttgctgatgtggaaaactgcttgggggaatcatggcttttctcagaacccagtgaggttaaaatggagaaaccaaagcccgaaaatgaggaggcaaatgcaaaatttggccttttgagcaaagagaattcggaaattcttgaaaatttgctaaataatttttcgagaatttttgcatttcatgactatgaattgacgcaaacagagatggtaaaacaccagattgacaccggtgaagcaataccggtcaaacaaaggatgaggccagtcccatatgcctatagagaaaaggttgccgcaatgatccaagactatttgggaagaggaatcattcgacactcaatttcgccatgggcttgccccattgtaattgtgcccaaaaaagacggatctttgcgcttttgtgttgattacagagggctaaatgcaatcacaagaaaggattgttttcctctcccaaatatagaacgtactcttctaatgctaggaggaccaaagttcttctcaactttggactttctctctggctattggcaaattaaaatggccaaaaattcaattgaaaaaacggcattttcaccgaatttggcttacatgaatttactgtaatgccttttggtctatgcaacgcagtcgcaacgtttcaacgcttcatgtcacaattgtttggaagtaaattaaatgattttgtgtttgtgtacatcgatgatgtactagtggcttctgaatcttttgaacagcatttgatacatcttaaatttgtctttaacaaatccaggaggctggattaaaaatcaaaatttcaaagtgtcagttttgcgctgaagaactcaaatttttgggacatattttgacgcgaaatggcataaaaatggacgcggaaaaacgaagccaattttggaattgccggtgccgaaatcgaagaaagatcttcattctttccttggatttatgacatattatagaaaattcatatattcatttggttctgttgctgccccattgttcaaactcctaaaaaaggatgtgaaattccaatgggagaggcagaaattcaggcagtttctacattgaaggaaaaaatttgtcagaagtcgcgtcctttatttcc

SEQ ID NO: 16105 - DNA, 1525 bp, Heterodera glycines
gatgtttaaaagcaaaagtgaaaccagaaacgcacgtgtcgataaatggattagggattgagtgcacgtttattttggaaattgagtataattcaggaaaggcaaacataattgcggatgtgctttcacgttctggcgcactgaagccacgtgaatgggcggagaaaatttttagagttgagcaagtcgatggaaatataagtgcttctgtgccaaaaatggaaatgattgagtgggtcaacgcaattaaggaaagtgagctcggaaacctttaccaattcctggaaaaaaggaaattgcctgaagataagcgggaatgtcagcgactttttgacaccattcataaattcacactgataaatgcgccagaattaagaccagtgattacggcggaaccttttgagctaatatgcatggacattttatcaattggaatgtcagacggggaaatcgatatgttttagtaatggtggaccattttacaaaatatttgatcactgcagcaattcccgataagagcgttgaatcagtcgcaaaggcttttgtcgaacaattggtgcttgtatttggcaagccaaaacgtattcattccgacaagggcgctgaatttgtgaataaaacaatggaagaaatcagccaaattcttggagttgaaaagagtacaacggcagggtacgacccaaatgccaacggacaagcagaacgggccaatcaaactattttaaatatgcttaaaagttcaactgattcaaattggtcctgggatgaccggctgccttttgtcacatttgcttttaacattactccctctgaaaccaccggattttcgccttacaatttactttttggccggccagtaaattttccgtcgtctgataatgttaattttactgtaaatccttcatacacaatcgatgaagaaagttatctgcagctctttcgtgaaaatttgttaaaaattttggaaaatgcaaaaaataattcggacaaatcaagagaacgaatggagaaatggtttaattcgcagccaaaagtgattttgcataagtaccaaaaaggcgaacgcgttatggttatttttccgggagctaacaaacgcttaacacataagaaattaaagtggaatatcttcggccctaccaaatcctcgaaatttccaaatcctcggcaaaagtaacgcctgctgataagaaaaatgctgatccgatttgcgtcccattagaacgtctgatcagagcaccagatggacttcctaatatttcaacaactccgcgcggcaaaaatgcttataaaaatgtgttaaatgtgatgacttttttgatttttgaagaaaaaagcatggaatttgaacaggaaaattttttgggaaaaacaaaaacttcatcagggacgatgaatttttcagaggaggaggaaaaaatggacattgccgaagcggagattaagtggacgatgacatgtgaaggcggcggacatgtgtttacaaagaattgttggccggcgatctcgaccccgtgctcagcaa

SEQ ID NO: 16106 - DNA, 443 bp, Heterodera glycines
ccattggatttgatggattagggctcatcgggttaggcaccattggatttgggaacatcggattcggcattattggatttgatggatttgggaacatcggattcggcatcattggatttgatgaatttgggaacatcggattcggcaccattggatttgatggatttggaaacatcgggttcggcaccattggatttgatggattagggctcatcgggttaggcacaattggatttgggaacatcggattcggcaccattggatttgacggatttggaatcattggattcggctccattgcatttgatagattcgggatcatcgggtttggtaacattggatttgacggatttggaatcattggattcggctccattgcatttgatagattcgggatcatcgggtttggtaacattggatttgatggcttcggaaacattgca

SEQ ID NO: 16107 - DNA, 1110 bp, Heterodera glycines
gaaaaatatttccaaaaatccctatttcttttttctatccttgtggactgagtcggcccttgaaattatatagcagtgaacccaatactttcttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatcccattttcttttttctatccttgtggactgattcggcccttgaaattatatagcagtgaacccaatactttcttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatcccattttcttttttctatccttgtggactgattcggcccttgaaattatatatcagggaacccaatactttcttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatcccattttcttttttctatccttgtggactgagtcggcccttgaaattatatagcagtgaacccaatactttcttggaattttccagtacgggtttgtccgtgaaaatttgaaaaatatttccaaaatccctatttcttttttctatccttgtggactgagtcggcccttgaattatatatcagggaaccca

SEQ ID NO: 16108 - DNA, 964 bp, Heterodera glycines
aggctatagggaagctattccggaaggattcggtctccccataaatctgggcgcatcggttcggggggactgctccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcagggggactgccccgaaaacaaaaaaaacaattttttcaaaagtccgtttggggtactcaaacaaatatgggggagaaaaa

SEQ ID NO: 16109 - DNA, 3669 bp, Heterodera glycines
  misc_feature (74)..(75): n is a, c, g, or t
  misc_feature (3605)..(3605): n is a, c, g, or t
  misc_feature (3620)..(3620): n is a, c, g, or t
  misc_feature (3643)..(3644): n is a, c, g, or t
  misc_feature (3654)..(3654): n is a, c, g, or t
agcattgactgtttgctgtgtgaacagcgggacaagtgttttttgcgggtattacataatcccattaattaatnntgttggggtaacaaaaaaattgtttaattgattttttaattgtttcttgtgccttttgtatcaatttagctaatgatccctgattaggggggatgacaaaaatctccgccgctcaaaaaatccgggaagaccaaaaataaattctttttatccctcatatgttttttttttattcctattcaccaatgactactcttaacactaaaaatgatttgaagcatgccccaataccaagccttcagacggacacaaaaagctacctaaaattagggacaccctcgtttcgtcggcaatatcatcattggaacaggacgaatcaagctcaagcaaccgtccaacatctctttcgtgctaatggtcaacaacgatgaatcgccacaaaggagtaaagcggctcagaggcagaaaaacattcaacaaaaagaaaaggacgaactgagacggcatcaacgcaacaaactcttgtctagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacaccaacaaggaagagttcatcagttgccaagcgaccagcattttcttccagcaaacaaccaaaaggaaaagcagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcccaaacatgagctcggcaacaatcagtaagacaccatgccaacagcactcgtccgagaagacgttaaactaagctacccacacaacaatcgtccgcaatgacgttaaactagcctaagccatcaacaactgtccgaaacgctaatcacccggctgccacgagtccggaatgacgttaaactagcaaagcatcggccaacccacacaacaatcgtccgcaatgacattaaactaaagaaccaaccaaacaacaaatgtccgcaaaaacgttaaactagcaaagcatcaattgtccgcaatgacgttaaactagcaaagcaccggccaccaaacaaccattgtccgaaaagacgctaaactagcaagcaatccatccgacggtcagggtccgaaatgacgtcaaacaagcaacgacaattggtcataaggacgttaaactacgtcaccaattcaagcaaaagcactcgagcatgcagctgacagcacgtttccggaagcaaattcacatgtcctcaacaattgaggaggttcagcagcgaaagaaccacaacaggccgcaaccgcggaggtcacaacaaaggggcctaaggccaactcaagcgcctaaaatatgccaatccgggatggcacagtacaagcagggtcgagggatccgccttcaccctgcgtcttctgcaatggcactcactggaccacgacgacgactcagcgaacaacccttgcaacgagagcaaggacacgaatccagtacgtcaccaggacgagaacgcagaccacgaaagagccaacgacacgccccagatcgcgtaagcacgatttggaaactcaagagcacggaaaattcacctttttgccgtcccccgccatcactcactgctcaatggctcaacctggcaattgagctcttcgcaaaaaatcatcaagcccgagcagatcacctttgcatggcattgctctgtaaaacgcaccacggagcgttattacactaatcttttggccgataagttcgtcaccatcgagaaggaatttccaccggtcaacaagcggatctgcaaacaaatggccattcaccaggaatgcccattcgccaagtctgaaatgacgaatcacgaagcacaattgtggtcaacgaatgacgaattggaagtcaacttccctggaccaatcgccggacttttcaactgctttgctcaaccagcaacacttttcgtaaaacggcacaatctgcagatgttttcgccagtccaccaagttcagaactgtcaatacgcaaccgaattctgccaactgcccgacaactcaaccctgatttggaaatcaacctgcaatggcaacgaatgtcaaacatgcgactacgagaaggcggaagtcatcaacggaaaattcactgcggcctacggagaatcaatggccacttggatctccgaagatcaccaaaaggcattaactttcgccaaaaatgcgccagaactcatcacctgcgatggcacacgcatcgtcatgtccgaacagaacttcggaattgccaaggagcaatacgacgacattgtcagcaccacgacaagatggaagaggcatccgaccagaacagctcgcatcacagctctcggcatcccaagtggcaacaagcgttgcgttaaatcagctctacacgagggaatgtcagcgaaacacgagggcagccaacccgactcttcaggccagacgcttactacggcaaccaaacatccaagctcgttggatcggcgaaacgacaatggaagtgtttccatgtgtcaacatttcgctacaggacatctcatacaggccaatgaatgactgtcgcctctacattcccgtgactgcgcactttcccgaccgagctatcgcagctttcttggatccggaacttcgcatcatctcgctgacagcacaacaggcaagctgtaatagctaccggttccatcatcttcaactgcgaagcaatcccaacatctggttatggattgactctcgaaccggcacagcacgacgaatgccgaaagactacgtccacgaattgtacgaaacaacgatcaaccaaacgaacagcaatttggaacttcatccattgatcttccacgcatggcaactcgacaatgagtctgacgcgacacgcttcccgcacatcaacgaattcaacaactcggagcagttcaaggacaagctggaacagcacattacagcaaggactgaagctttgggcgcgttgaagggcggaatagaaggattcactatgcgctggctaaaaagcctgatcgacgaagcaatcacgtggtggattcgagtcgcctgcgtttattcaaccttcctcatgctgcgcgacattgttctcccatgcactttggcgtatttgctcaatcccatccgagtgactcttctcagcctcgttggagtacgtccgcacccgacattccgacccaccgtttctaaaccactcgggatcgaagagggaatgccgctgcgtgaagtgccacgaacccccaaaccaccagcgcgcagggcagagcaccgatccatgtcaccaatcaaattggacatgattgccagaacggctcggtaccaacaaccacgaacacagagccatctcgacctcacagaagactcgccctttgngaggccgagacgaanagaattctgacgggccccatccnntttcgcgccngaatgtcggaatttt

SEQ ID NO: 16110 - DNA, 1045 bp, Heterodera glycines
attaagagaaaacagctgtcaaaagtcagtcacagatccatttatttttagttgaaagtccataattatcgactaccttttttctattttaagcggttgtccgagcggaaaacatcgcgaaacaggcggatgtaattgcggcactgactttggacgtgttgaaaggcacaacgagggcattcgacgcaagtgggcattttaaaaataaaattagatattttctggaattgatcattccccaaagatgttcatcgcgttcggccccaccatgggcaaaatttggttgccggtcggctgcgagctttgctccactcggacttgaaccgatccgagattgccgaatcgcaccggcactgcggcaaggtgcaggacgcgtacacgttgcgctgcgtgccccaggcaaggaaaagaaagaaaaataaatatttaactctcgagacataaaaagtcagtcattatcaataacagtctcttgtttaccaattaacacaaaatagtttaaaagcaagtattttaaaattaaatgaattaaagcgaataattaaaaaatatatttttgtaaaaaggaaaattttatactaataattatctcatgctgagacgaaataagaaaaatgcaaatgataaaattaaaagcaaaataattatttttatttttatttaataaaatagatattatttaaaattagggttcggaccccgcccccgccccgcccccggggacgggacaggttttttggcctcacccccgcccccgcgaccttcgccccgcgggggcacgggggtgaaaaacacacccctaagaatggcatattcgtgaaattaaaggcaaaaatttatacaattttgaattttttaacctcttttacaaatttttatgaaataaagtaaatttgcttgtggttttatagaatatttgtggtttagtggttagtgcttcaacattaacaatacttgtgatgagttcgacaccggttgacggtttcgtctgattttatttttttttccatagaatacagctgtctttctatggtgttattgctaa

SEQ ID NO: 16111 - DNA, 3437 bp, Heterodera glycines
tttttttttttttttttttttattattttttttttttttttttttggggggttttttttttttttggagtaaaaaaaaaaaaaaaaaaagggtttttgttggggggcacaaaaaaaaaaattttttttttttttttttatttggggaggaaaattgggggttttttttttttttttaaaaaaaaaaaaaaaaaaaaaatccccccggggggggcccaaaaaaaaaaaacaaaaaaaatttttaaaaaaaattttttataaaaaaagggggttttctttttttttgaggacgcttttttttaaaaaaaattttcaagcaagggttgatttttttaaaaaaaaaaggaaaaaaccattggggaatttttgggttggatttggtaagccttttatttttttttaaaaaaataaatatttttagcaattcttaaggaatcaaaacattctgtcccggtttttttgatgttttccattacgcttttgttacatttgtggcatgtttttgaaactttttaataattacgaacataaaaatcggttatcaattttaattaatttattattaatgtatttatttattttccatttttagctcattgcacaacgcttgtcacattctgatcgctttgcaacgcttgtccagcattttcggcttttttgagcttttcctccctctctctgtgcttttgtggccctcctccgaccagcgaagcttcttctccaattccacatgtttttgcttccaatccgttctgtttgcctttctcgtaaacatcttcactttgatgtttgccattggctttgatcgtttgctttgcgttttctttcccatttggtcagtttttaaactgataataataattgttttaattgtcataataaagaaatattaattatcttatttacttaatttgttttaggtatagaaaaagaaatgccaaattttattctgccgttctcttgattctttctgtgctttatccgttatacacaatctatttgttgtacacaaatctactggcgcaaccaaacgagtaattacctaattaattaatttcttaattaattaacaatattaaatttattttcaactttttaatgcaatattaaaaatcattgattattttatttcatttctttcatttttagtaaaacaatgtgtacgatgggttcttcgttgggccatgacggtgttataattgcaacatttgctaatatttgtattatttactcttccgtcatttgctatttgattctttacgccaaattaaaatgggacgaacgaaaagcgaatggaataagtgaaatttaaaacaaattaaattaaattaaattaaaagcattcattttaatttatatttttaaatacatttgaatgttcaacccttctccatttttagctgttgtcgcctcacaacccttcattttcaagtcaatttcgctcattcttttgctccaagtcgtcggttggtccggcggaattatcgcattttttgtcgtttcaattcattttggggatgacgacttaaacctccaaaaatttctggccaacagtgtgattaattgcttcgtttgtgtgtgtgggacttttgaaacgcctgtcctattttttcacaggtaaaaacaagcaaaacattaaatcatcgtcacaaatgccatctctagcttaaaatggtggcaagattttcaaaaatggtggcaaaacagtggtcaaatggggtttttgttggatggttctgtctgtgacaaaaagacatccgttcgttaattaacccaacaaaataataaatataaatattaaatacataaatatttcagcagcgaacaccaaaaagcgatgcgaaaagaatggagaaacattgtacaattggtgaagaagtgttctccgacgacatttgggcgtaataacaaaactggcaccgccgttgttttggtggtcagtcggccaggcaaaccgacggcgaaaatacggggcgaattcggaccgttcaacccccgcattgtttcggcagcaccgaaattggcagaccaaacaacggcacactgacaaatgagtgccgtcggatcaatgcaaggtcagttcagcccccgggcactgtcagcagcagcagaaggcacggacaaaatcgatcagatcctgacggattcaactttccgtaatcaaccgattcgaaattgtttatttgctacgctcatacagaatgttcaatgataattcaataaaatgaaattttccaaaataaaaatgaacaaattgagaaattatcaaacaaaaagtgggaaagtctaaatggatgaatgcatatgctaatgaatttgttaattttcatttttaaatattctttaattgtccatttccttcttcacaacttttaacttttcgagtggcaaaattttttgccgcatttctcgaggcatttatcactgacacagccgcacctgcaacgccaacattgggccatattggcactaaaattggtgtaaattttagatggataaaataaattgaaatttactccgactcaatgttcatttggatgcaattctctgcgtttctcgcaaaacgatttctaaaaattttaaattcatcaattggttcataagaaggatagatagaatcgcataaaattagacttatttgccttggtttccccctttatcccccatcccggccccgataaatgtttgatggcgccgtgattaatattaattaataattcgttaattaatgaattataattaataattttaacatacattgaatttgggacgacagcacattcggctaaattttgtataaaaattgttgaacaaagaaacattgagacaaaaaagacaccaccaaaataaaagcaatggaaattcatttgaatgttaattaaagaatttttgtttctttgttaattaatgagttcactttcatttcattcgttcgttttatgtgtgaaaattgatcagactcattaagtggaaaaggtcaattctctgaagaaagggcataaacaacgcaacgaccgactgatcattcattgttttgtctattctttgcttggttaattaatgcgcattgtgttgttataatatttagttaatttgattataccaacaaagtgcaattaattaattgattgaccggccttaattggactaagagagagagagagcgagagagagagagactcaatttttgaaacaaattaaatattcatcaaattaacaatttgaaaattaacaaatttaagaataaagtagaaattattaattaataaacttatttcacaaaaaaataaagcgaaaatttgaggtgaatttgggtgcgttttgttcagcaacctgtttattgttagtccccccgattagtgtgtttattgatcaatcgtttatgcatctcatctcaatagtaatcatcatcatcttatcatattattagttaattaa

SEQ ID NO: 16112 - DNA, 2241 bp, Heterodera glycines
  misc_feature (78)..(78): n is a, c, g, or t
  misc_feature (105)..(105): n is a, c, g, or t
  misc_feature (128)..(128): n is a, c, g, or t
  misc_feature (2105)..(2105): n is a, c, g, or t
  misc_feature (2160)..(2160): n is a, c, g, or t
  misc_feature (2173)..(2173): n is a, c, g, or t
  misc_feature (2181)..(2181): n is a, c, g, or t
aaattttcatttccttcacaccccgccccgacttcttttcaaattcacaaaaaaaaaaaaatagttaattctccgacnacatctgttcatcttttaattgctcgnatcgcagaagtggcgagcaaagnccgaaaagcggctgacggcaaacgataaaggcgcctattgttggccgaaggggctgcttggataaaccaatgacaaaaatgttgatgttgaaagtgaaaatgaaagaatgaaagaaatcacgagaaattccgatagaaaattgagctcaattgaataaataattaacggccaaaagtaattaacgaaaacttaaaggaacagaagcaaaaaagcaaaggccaattgttgaacaaaaataaagataatgaaaattggcaaatgttgccaaaaataagatgatcggaaagaaattaattggcaattacgagagtcagcagttgatggaacaaaaaagtcatttggaaaatcctaggcattttgcttaaaacaatagcgatcggacagcatccttacctttttgttattcatttttttttctctcgagcaattaccaacggcttttagtttttcttatcaaaagggatttttccatttaagccaaataattttaaaactactaaaccaaaacaccgaagttgtcaaatcatcaatttttgatcgaacggaacatcacacagtcgaaagtgggcgagatcggtactgatcagtgatcacagcggaacatttgcggtgcggacgtgacttttcgaagaaggcaattacggacggcgtgttcaactacgaagtggaccaaattgaagcagtctctcgaacggacaaaaaggtgaattcagtttttgaaaaaaggagtgattaccgtaggccaatcagagaaaattgccaacaaaaccgaaattatgcgagaggtggatataatggtggattcgcaccaagaaatcctaactttatcccgcttggtcaaaggagaatgtggaatggaaataattcaaattctaacagatttaacaataatgagccaaggggaagaggattcggtaacaggggcaattttcagaataatcgtggtaatttccaaggaaatggtaatgaaaaacagagataccgaataaatatggtgggagatgaacaaacacagtcaagttcatcgagacgttctccgactccgacttttacatttttaacaatttcgatggttttgtctattttgtttggtacttttagtctgtcaaatgcacaatatcaaatttgttctgaacgagttcagactaccccaattctgttaccaaatatcacgaattgctctataccaaaataccaaaaggcggctgaaaacaaaataaccttgtttttaccagtgcgcttacctaaacaatttgtcgtttataaatgctatcaaaaattaaccaaaatatgcaccggaaactttttgtttttatggaaaggagtaaatagtcaggagacaacggtgaggggagtgtctcacgaaacttgtcaaaaatttaaacataaaatgggcggctcaatgaatcgacttagtgagaatctttgggccacggaaaatcctgaaaagttgacatatgcctggactggcgaaaaatgcgagacaacagtaaatgactttttggaagaaggaaaagggggaattttggactttttcctggtcacttcttttgggcataatttaaacccgtataaaaactgggaagaactgccaagaaagacattcatttgggaaatccctgagccaaatgagaaatattgggctacacatttttcggttggcgaattcaaggccgaaataacagaaaatgcagtggtaattgaaagtgagcaaagtgtattttatttcgaaaaggaggcgactgacgaaagggagggcataatcggtgttcccgaaaatgcctataaaatgtcaaacgatgcttttattgtcttaagcaaaacggaaatacgggaaaaacgagaaacacctaaaattgagccaaaaagaaaggaaaggccggtaaaacaggaagttcaactgaaaagtgaaattggtaaaaaggaaaacgttttgaaaacaaaggaacaaaatgctacagtatatgttttaccanagagtactgtaaagctggtcaaggacagtcaacaaaaaatgccaaatccaattanaatcttacctcanagtactcnaagtacagtaaccacaacttctaaacctcaagtcaaaatctccacaacagtaatgcctgt

SEQ ID NO: 16113 - DNA, 2204 bp, Heterodera glycines
  misc_feature (49)..(50): n is a, c, g, or t
  misc_feature (54)..(54): n is a, c, g, or t
  misc_feature (57)..(57): n is a, c, g, or t
aaggggacggtgaaaatctctcccttcttggtgccctaaaggtcttcgnngggnagntgaagcggacgttgttgtccggctgtcccagcttgttctgcaccatgtccttcatcttctcgaaggtgatgcgctcgcaggcatccgagtcgagcgtgatgccgcgcaccttcagcttgtactcgtcctccccgttgcgttgttgcgcagccacaatccgtacgccttgggtccggctaaacaaacattccatttattttgtttaatttttaatcaatcttaccacaaataaactccataatcgtgtggttcgggtactcgtcagcgagttccccgagctgctcaccacccggaaggatttttgaatttttcttttgcagctaaaattaaacgatagtaatgtgttttactggtcccgaaatttttaaaacgtttcaaggcgcgttttggagtgctgaataagaagtaggctttctttttctgccaattccgaaccccgcatccgaacatattttcaaaaaaattattcttaccaaaatcatgaaagcgtatttcgaatggttttcagggtagctgatcatgaattcgggcaattctggaaaactcacacatttattgacattttttccaattttttggcaactattttggcatttttctgcattttagcaaatttttctgcctttttatcaactctttaggtatatatatttctcgatttttagcacataaaaatccatccctatcattggaatatgttgctttatgaaaccaaaatacttacaaaacataaaaaaatataaaatttaagcaccaagaaaattttgtgccctccaagactctcttctcatcctgctgatttccttcctttcccttttcaattcttcacgaaatgtttacgctattcacacgtaaaatcaattgccaaggtgactttgtcctcgtctttgttgtacaaccctttgcttgggtccattaattccttaatttaccattacaatattaaaatgtaaattaactaattaatttccactcaccgcaaaagaaatgaaatagtgccaacccaaactcagcagcgttgcattgttaaaaactttttcattgtattctctcttaaaatcctccacaccgctcttttgagagacaattcgaagtgttgccgaacattttctcttatataatttgataagcaaaccttttttacaagcatcgcaccaaagataaaagcccaaccatttctcagtgctttcatttttcattttgatatatgccaatattttccatggcattccctttatgtacacagcagtttcacttatacggtcactttcttcgatttctcgtgcaaattccgatagcttttcaatttccatcgaaagtgtgccgttggatttgtttggatcggaaataattttctcagtttttggctcatccacaatgacatcaatggccaatgtgactttgtcctcatctttgtcgtaaaatcctttgcccggatccaacaattccttaattttgatgattttatttggagatgcatgaaaatcagcaatgtttccgattataactttaattttaaatcaattatgtaatataaaatcatggtgagccaaagttacaaaagtgtcaatgatagaaacatttaaatttattaatagttttaattttattgctaataagaaaccataacttagcttaaatttagttcaattaataaaattggtattaaacgatgcattacatatcctatcaaatcctatcttatttaattttttaaaatctagaaaaaatttacaaagagttataaccaaaaaatttcaaaaatttctattcatttttttgtcactttcttttttaaaattttaaaaattttaatttcaaaataggaagtttattaaatttatttgaatcccactcaccgcaaaactaatgaaataaggaaatccaggattatttaattccttattaaaaatgcgatcaccaattcttccaattaaatcctccgtgccattcttttgtgacacaattcgaagtgttgccgaacttttacaagaccaattttctgcacaataaataaatatttaataaaattaccattttatttaaatacgatacttatttaagttgaaagagtacttttcacctacattttcaatttccattattcttgcattcttttattgtttacacggtacttttccattatg

SEQ ID NO: 16114 - DNA, 3480 bp, Heterodera glycines
acttaccaatggagcaaaaaagacgacggctgcagttcgtatttaatcgaaaccccgcaaagtacggtgttcacgatgacaccattttaaacaacgcaggaaacccaataactgacagtagtgtcgcccaagctctcgactatattatagaacgcagagcgggacgaattccacagtttagacagcccccaggaacaaaagttattcgagatcgcattaaccgtgacctaattttgcgaacatggacggctccaccagtaccaccaagggcacccaaacggaaaatgccacaagaagaccaagcgccggaattaaatcaaaaatcccaaaagctcagaggaatgaggcaggcgagaggcagggaacaagaaggattgacacttccgtttccaacgaggggagtcaagcggaagtcgacggctctgtcagcagtagaaacggaaattccaaccaaaagccaacgtctccgaccaaagaaatggacaaatcaatagaaaaggtgttagaacggctctacaatgacccaaaatcccctgctgcgtttgccggtgtcgaccgattgtggttggaagccaaaaaggaacttggaaataaaattcgtaaaaatgatgtaaaacattatctggagggacatcgcacctacacattgatgcgtccaagacgcatcaattttccgcgcgctagaacaacggctgccggttttatgaccgactgtcaggtcgatttggctgactttcaaaccctttctcgacacaacaggggaaatcggtatttaatggtggtaattgatgttctttcaaagcggatttttgtgacacctcttcgtaccaagaaggctgatgacatggtagacggctttaaagaagtgttttcaacgatgccaatgaaaccacacagaattttctccgacaagggtacagaattcagaaatcagcagctgaaaaaacttttcgatgaagaggaagttgagaaatatgagagcacacattctgagaagaaagcagcattagccgagcgcgcaatacgacaaatcaaaaatcgggtgtatcgctactttgcccaaacaaaaaccctaaattgggtggatgtaattgatcaaattgttaatggtattaataaatcaccgagccgggtgcatggaatgcgacctattgacgtgaactttaaaaattcacaacaaatatgggaaaaaatgtttggagatgatcagcatatggctctttttggaaagcccagaaaacgagccagatttgtccctggtcagacggtaagaatgagcatagcaaaaggtcaattcgagaaaggttatatacccaattacggcgacgaaattctcgaagttgatgccgtcaaacgccacatgaaaccaatgagatataagctacgtgattcaaagggggagaaatttaaaggatttttctacccggaagaattggcacccgtacgtaaggatgccgagacgacgtacagaattgagagagtttttcggaaacggaaaatgcctgacggaacgacagaagtactagtaaaatttattggataccctgaaagggaatggattcatgagacccaacttgtataaatacttgtaaacttagcattatatcactattttttttgttgcataaatgtctaacacattctttgtgcatttacccagtaatagcccagactacactgagaatacaccaaataagtttagagttcgtttaccaaaacctatttatttcaatggctcttgggtatgcggattacacagcattaattatgcctattcttggccatcaacgattggaaccttagatgatcagtggatcaacatacattttacggatggtttagataatgaaaggcttaggattgttcgagtacccgtcccgaaagcttcaaacacaacaattgaaaatttaagaaattttcttatttcaaccctaaagaaccatgctgagtctcttgaaaagattataaaagatggttcacagaggtcaataaaaagaaaacgggccgcttctcagccaaaatcacctcctagtgcaattgtaccaaagtcacaacctaatgttactcccaatgtaacgctaaatgttaaagtaccaacatctccaccacgagttggacagcagccacaagctaaatccgagggcatttctgattcgattttaaatgtaacaaagccatctgaaaagcaaccgaaaattgaaaaagagtcagaaattgtaaagcacgaaacagaaaaaataaaccagaagcccacacaaaatatttcactacctacaaatcagacgaaaaatgtgaatagtgaaggtgtttcacaaaatatcattcctccaccacctgttacaagtccgtcgatacatgcgaataagcaaaatcaagaacccaaaaagaacgacgaatcaccacctcaagtcgggaagcctaagcatcaattaccagtgtagacccaagatatagtgtcacaagctcagaaaaaaataactgctaaccctgctcaaaggaatgaccccaatcaacaaacgttgattaatgtggggaaacagaaggaaattggtccatcaccaaagcagaggaccgaaaaaagtgcaattgaaatagccccaccaccacatcgatctacacccacttcaccaatacgcccaaatgttactgagaaaaaacccacgtccccaccaaagacaatttcaattgataccattggaccgccacccaaacagagaaatgaaaaaagtctaaatattaatcagggtcaaactcagttagtcactgaaataacacctgaaaatagtaaaaagacaacaataacaacaactactactacgacaattaccgaaccgccgaaagaaacaatcgatgatttggtagggcaaatgaagaaccaacggaaagaaaccgtgtggaggagttgctttccggcttgtttggagatgagaaatggaaacaaataaacttacggatggttagacaaatcattgaaggagtggagttacaatatcacccaaatcttgagcggtttaaagcggtttttacacacccgagaattgaatttatctctttttctcctcaacttaattatgtattaggttttgaaaacgcgcagcacgtaagaaacaatgagattgccaattatggaagtgatttacgtggtggttttgcaagctttgccgtctacgcaaaaaggttgactgaaaacatgattgttggaaattcactgagttctcttctccgtgttgtctcagtgtcaggagcaacgccgggagaatacactgaaaaaatttacgactcccccctatacgcacgtgttttaccaaaagaagtgtcagaaattcaaattgaattaagaacaatgaccgatggaagattagtaccattttcctatggaacagtgctaattgtactgatatttaagaaggtgataaatttttgaattcactcattattgtataatttaacataatcgattaaataaaatggttcacattc

SEQ ID NO: 16115 - DNA, 2302 bp, Heterodera glycines
  misc_feature (11)..(11): n is a, c, g, or t
ggttgcatttntgctttaaaacacaaaaatcaaaaacatttgttagatgatctgtatctaaaagtccaccttttacttctaccgcatttattaagtcagtttttgttgaaaggattaaatctaggaaggattgctccctagttggttcattaatgcaagatgtcaaattatatttattaaagaaatcacaaaataaattaccaaaattacttaaagggaaaggttttttattttttatagttaaatctttagttccaaggttaaaatccccaagtatacagcagttttctgaaatgtaaaggtcaagaaatttgaaaagatttttggtattttttaaattagtagatggagggcgataaataagaatcaaattattttgacactgggtaaattcgacactttcctcaaaaattttgttattttatacccctaaattgaaactttaacacctattttgaggtttttagaaccgaaaatctaaatattttggtatttttgaatattggcaattttcgtaacaaagtgcacttaaatttaaattttcaattttttcaaaaaaaattttcacttgggaaaagtcccggttggtcccggtcccgggttttttcgctgtcccggtcccggtcaaaaaagtttgtcccggtcccgacttttctggtcccggtcctggtttttgtcaaatttcccggtcccgaccaactctagttataccaacctaaccttttaaaaagtacgaattagaaaatgaaataggaaaatttatcatacctaatactaacaccaaaatttcttattaatttttaaaaattctcaatagtgtcgaatttactcactgtcgaaatggtccagtgtcgaaaatgctggaaaacagtgaaagtttttgaatagttcagtgtcgaaatttctctatttcggttttcgggccctggaagccctacaaagcgcttttgaaatcaattgaaaattcgggaaaaaaattctcgatccaatttggaatccggagaccggataaagctggtaaaatagacaacattctattttaaaaatttttacttagagtaatgaaaaagtattaatggtcattgttttatttggttagttggagatgcgcaagttcggatgatcagaacaaccaatgcaaaaaattgcaatgatcagtgatcactgactgatcaggtttttttgaattatcgccccaaaatatcgctatttggcattatgagtcattgtctaacactgacactgggtttgacgttttactcagttataccaacctaaccttttaaaaagtacgaattagaaaatgaaataggaaactttatcatacctaatactaacaccaaaatttcttattaatttttaaaaattctcaatagtgtcgaatttactcattgtcgaaatggtccagtgtcgaaaatgctggaaaacagtgaaagtttttgaaatagttcagtgtcgaaatttctctatgtcgaaaacgtagtgtcgaaattacatagcgccggtcccaacgctaaatagcggaattggcgtaattttttgcgcgttaattcaaaatttacactggtaaatgcctttttgaatttttttaattttggtctgccataactcgcttcattctgaactaaacttgacaaatttagtatctaaaaaaagttttgaaatgaagaatcttttcttagcgaatgctaagcaatttcacatctcacaaaaagttgtgagcctttcaagaaataaactggatataatattcatgaacatgttttagttctttattttgatgtttagaattctttaaacgaggagaaacgcaaacagcgtggttcacgtgtgatctctgttcctatttcaagtggaattcgctctgcttctgtgctattggctcccgttttggcatggatcgtcattctctcgaccaagtttattctgcaatcatccaaaaagctttggaccttcgggttgagagtctttcgatgcctctgcttggtacagttttattgtcatactttttatattctttaaatttaggaactttattttcctcgcttgataccgcatcaaattatttgtgggcttgccttcagcagttttcttcatttggtcgtttaaaggtaaatggaaattattttcatttagccaactccacattttagaaaattcaaatcgtggacaccaatgatttccatatgcgatctcttcacaaattcatcattgccaaattgcgtgctcagtcacaactccaaaatggttcatctgcttcaagtaactcggaaaacaatcaatcggacgacagtcggctgac

SEQ ID NO: 16116 - DNA, 1685 bp, Heterodera glycines
ttttccgtgcccccctccccgcgtttttttattttggcaattttccgcttttttgggattttttccccccttaacccccccgggccgtaattattcatatcattaatgctctttggtttgttcccattcatttttttctatttttattttctctttttttgcaaaaacaaaggcccgattttgatggatttgcataattttttggctttttgctctttgaagaaaaaagagatcgaaaatagcggcaacatgtgaagccaacttttgcatattaatgttttggcgtcgttgggatttggccaaattaaaattaattaatttattgtttctaattttctatttttgctcatttggcccaattaattaattaaacactgacaaaaaaaagtaaccaaaactgctgaaatgtgcttaataaaagtaagcaaacatttaacaaaaatactttgatgttccaaaccttctgactagaataaatttggttaaactgataagattttttaaaatatttttgatgattttgtgtaaataaaatggtcaaagattgatgcccaattgaatttgcttcgtgcggaaaaactgtgttaataaaagtgattagtgaaggtcacaaatcggaaacgcatgtgatcatttgcaaattatttgggtaattaaatggcatttgacttttatcggcccacaaattacggtaattgtgctaaaaggccaaagattccattcaaatgattgattatttgtgctgattaagcgaattttctccgtaaaaaagccctttaaaaggcatgccaaaaatggaaattcattcttcggccaattctgaaccccggacgcgaattcgaacaaaaagctgcaagtctaaattttcgaattaagcattttttgttcaaaaacggcataaatgatcatctcctattgcaggattgatgtatttcagtttgtttctgtgtatttaaaccgatttgaagaaaaacactaatttcgaaaattttgactttcgattttttgttcgagtttgggtccggggttcgcaattgagaatgattttcttatagaagtttacttctatattacaatactaatgccatagaattttattttaaaatatttgcatcactgacgcattttccactgacgcattttccactgaccgattttccggtcacgggtggcacgagtatcaagaaaaaataaattttaagagattgaatgaaaaattccagttctaggggttaatcaaaaaaaaaaattcagtttctgaaatgcctttcgaccaattctaaaccagggacccgatttctaagcaaaagtcgaaaattaaatttttcaccaaaattcacgtttattgcattaaattattaattaaaatatatttattatctatttctttctctctctctctaggcaaatttactttttaactatttaaaaaacattaaggtaaccaatattcctgaggttacaaattttccgtacccccctccccgacttttttattttgccaattttgcccctattttgggacttttcgcccctaaacaccaccgggccctaattattcatatcattaatgctctttcgtttcgttccattcttttttttctatttttattttctctttttttgcaaaaacaaaggcccgattttgatggatttgcataattttttggctttttgctctttga

SEQ ID NO: 16117 - DNA, 1485 bp, Heterodera glycines
tttcaatgctttcatccgcttcttcttcttccgctggcagcgacaatggcctaaaattatttatgttttttcgacaatcaaaaattgcttttgctgctcacccaatgcaactatttccaccccacaactcaaatcggatattattcaaattggcacccgaataattggcatgccgtagagcaaatctgatatagttagaattggcacccgaattttcgcggttttcccacttaactggcgccgtcgccgtctctccaattgggtagcgttgcaacagcaaattatacaggcaattatagcctaattcttcgctatgtttcaatgtcagcttttctttcgtccgttcattcaccaattcaaattgttcaattgacgttggttccacatgaaaaaacagttgaattgtgtaactgacagaagtggtggcacgacggaatgcctaaacacaaaaattggtaaaacgaaaacaaattgacgaaaatatggcgagacacacctctttgaagctgttgacccattcgaaatttggtggacccaacaaattatagcgatacaatcgcttcggttggccatttttgctcggagtgtgaagccatttggtcaacgcttggccagcagttgcatttggtccatcgtcagaaattccatcgggtaaaagaccaacagaatcgattgaattcaattgatcaagatcagtgagaatcgttggtgaaatcagacgacgcaaattgtccaaagcatcgccactggtaaagctcaaatggcgaatgtttgtcgcaaaaagtggccaaatttgacggtccaaaacatcccaaattcgctggtcacaatattcaatatacacttccaatttggtgccacttctgtcccaaatttgcttgttggaacggagaaattcaatgacggaatggtcgatgtaactgaagaaatataaaaattgctttaatatatacaaaagtataaaattgctttatccgaagctccttaaagcgaattttgatgggcagcgaatggtccggcatcggaaaatccacccttttgccatcgatccattcagacagtttcgcatttcgtcctttgtccttgcgaatttcgattgctttccaaattgtcaattcgctttttccatcaaaatgcgtgtcaaccaaaacatcgaaacggtcggaaagcaatgccattttgagtccgagttgagcacggtcaaaagatggcagaatgtccatccaaacatccgcacaaatccaactgaaacatgaaaaaaaattgggtaaaacgaaattgtaatttttcaaaagaaattgcttaccgtctgttcattttttcgctattatgcatccaaaaagtcttttcgacctctttatatacctaccaaaataaaagtgagagatttgaaaacggatgaacggatggggggagattaaaatgatttgttggccaaaaataatgtgcatttgtctattggaaatggccagcaaatttgggatg

SEQ ID NO: 16118 - DNA, 2510 bp, Heterodera glycines
gtccctgtgttcgaacacgtatcgcttgtgctgtttgtcaaatggcacaggtgtctcacagtcgaacagtatggcaaatgtatgaaatgtggccaaacagtcggcaagtgcaaacgaaaacaggcccatggcttggcaattccctaaacaaaatcaacaaattagcataagccaaaatggaaaaattaaaaaatttaaataattcaaaacaaaaccactccttgtgacagacgatccaacatctcaagcagcaccggtgcttcatcttccacaaactcattgcgctcttgtgccagcgggtacggtccatcgagtacaggtggctgcgagttttcgtcacggttttggctcatgatttgtttttgtgtctaaaattttaaaaattaattctttaaatttgaacaaatatttattttgttgaaaaaacacaaaatggtaaaaattgggacaataaaaaaaattttttaacaaaatttggagtgatagatgcaaaataattcgtaataaatggacaaataataaataaattttggcgaaattattatcagactggtgtcaaattacataaatgaatggcacagcggtgtggcgcaagacaaattccagacaatctttttaatttttaacgaaaagataaaagaaacggtgtcaaattacacaaatgagcaggtgtgagggaggggcaacgtaaagatgtgaaattaaaaattattggtcaaataaacaaacgcccaacacctgaaagggtgctgtaattatttttgaggagataaaaaattaacagacaaatcaataattaaacttaaatgtatttgttaattcactgaaaaatatttatattattttagaagtaataaaaaatttattttaggaataataattaattaattaaccttttaattattttaatttctaaattatattttattatacggtcccccatttctttttgcttttaaaagagaaaattgtgaattcaataattgatttgtttatttgaccccctcccccttctcgccgcctgctctcgcccccctcccgccactggtgacgtcaaattttccctttatgagagcaaattaatgtttattatccattgccaatgtggccgagtggttagtgcgtcagtctggccgcccccctggggttcggatccgcttggtgcggggaatttttgatgaattttaaatgaatttaaattcaacggctttgacctttaagacgtttaaaattaatttaaaattaaattaatttaattaaaataatttgcataaagtcgcgcagtcaaaaaagtcgcgcacccctgcaataggtttgggtttccaagaaaaagtcgcgcaataggtttgggtttgcaaaaaaaagtcgcgcaataggttttggcttcagtactgaaaagtctggcgctcaaatggcccgcgctcacttggcggcgctcaaatggctggcgctcagttggccatgcacccctcccacacctatggggggctaccgtaatccggtgaaatctacaagggtaactactaatcttttaaataagagcaattttaaaaaatttagaatttaaaaatgatatttttttattgtaaatagttatatatttattatttataataattttggttgagtttcaataaatattatcttgttaaaaagggtattagtgccgccatgtcggtaatgataaaatttaaaagaataaagtttttttattaataaactgttttttatgttttttcgaattttctttcatctatgctgttgtttgtggagaaataaagtttaaatagttgtaaataaagagatttcttggaacaaggagacggagtaaccctgatttggtgaataaaaatgcttttttctgctaaatccattaaccattaattcgtctggaaaagataaattaatataatttaatttcaaaattacaaacacaaaaattttataatttataagctttgtttttaggatttttattttcgcaaaaagtttttaagttaatgatttttgttattctgttaattttttgatttctgctatatttttaattaagcttttctgaactatttaattgcttgtttttgtataaatattaattattaattcattttccgttaatggatttaagttgttgtataaaatttattcaatatttttaattctcatgtcctttgctccacgatctgtaaaaagaaaatttgaattaattataaactcaataaaaattatattaatttattattttctttaatttcatggattttgcttaaaaaaattattcatttgttgcaaaaatattaatttactttcaaaatgtatgacattttattttatttagatggtatttacttaaagtttatatttatttttacacatatagaattatttagtatattgaaaataaatagtgaattatttttctatagttcaacataataatgagaagttatcgctgtttgcatttgaaatttgtatacaataacttttttcatcatttattttttgctcct

SEQ ID NO: 16119 - DNA, 2980 bp, Heterodera glycines
aaactttggccttttctcttccgtggggatcgttttctttgttgacattgatcgactggtttctgtccttttcccattaaagtaacgtgtgggaaaaagcctgctgatgtttatagattatattaatggaatttaaaaaattttaatcatagaatatttcagtagaaataattagattttagaaataaaatataaatagtaagataaacaatcacaaaagctataaagaaaaattcacaaaatattttctctaaggttagtaagtcataactgtttttatctctctacttacataaatgttaaaataatatcatgttttaaattattaatctgttgtttatcaatgaatgagattcattcacagttatttgggagattatttgaaaaatagaaaattttcaatacgcaaaactcccttcagatatggtctttgcgaggagcatcttttcatttatattttaccaatgcttacggttacatttggatacagtttctatgtgcttggcgaagctgcacaatgggcactttttgtctaccccgactggtaaattaagctaattttttaatttaaaaatatattcgttttttcaatttttaatttaattttaggccagttttgtgcacaaattctgacatgttcagttttggaatgtccacaatgctgctgagaaacggtctggtgatcaatgggctgtcattgatctgttatttatttgttggtttgtcactgttttgggcttggcagaaaagttagttggactaaaattcaattattttatataacttgcatcttaaaaattaaatttgcattcatattttgcaattaaattagcatttagtaattgaattaataatggaaaaacattgaccatttttatttaattatttttacttaattgtttttttcacataagtgaatttattcattagacgaaattttcgttgctttttgtatatttgattaaaattaatttccattctttccgcacttgctttcatttatttttataataatttatttaaaaaatttataaatattcactttttcttaaaatttttaccgttaaattgacgcgatttttacgggacacaaaaaaaaattttgtagcaaatcagctaggtgtaaaaaatttggtattcatttttctgatttaaaaattttttaaaaattacgtttgccattcatcatatttttaccactgatcctttatgcaaaaaaagaataatataaaacaatagtaccaaattggaacgtagtcttttaaagaatccttaaatatttgtcaatataaatattttttgctaatttttccatttaagacccgagttcagtgataaaacatcgcatcttcaaatccctggcttcgataatgactttggtggttggcacttattttgccatttgcttcatccgattgctgctcgcttccgtcagggacccaattttcattttgcacatttcgccttccattagcgcactgcttacggtcacagcggcgagcagtaatgcgcccgttctgtttgcatttaggtgaaatttgataagttaaaatccaaaccaaaatttccattgtctgtctcttttttcaaataattgatcgattgggattaatattttaatttttaataggttaacaaaaattgcccatagatacaaaaagaaatttctaatttgtgctgggtgttttgcatataaaacgtatttcctcgattataagccccctctcgattagaagcgcctccctcgaatatagccccctttgaagggggtttcaacaatagagcccgggggcttatatcgagaaaatacggtatctatttgttttctcagtaattagttgaaaaacacccatagcaattttttcttatacaaattcttttgtttttcatcaaatattcaatcgaatttctaactttttagcactgaatatcgacaagcgttccgcaaacatctcagaaaattgccattggccggcatttgtttaatgcgaattggacaacagcagcaacaattgccaaatgctgtctccatggttgccgttttcaacaatgcaattcctcaaccgagcagtgttggtcgagttcggcacatcacaacaattgggggcggtggcggcaccgcggtgccaaaaacaatggcacccattgactcataaacattgttttggcgaattgtacgctaattataaacccggcgggattattttatcaaccttttcagaaagggaggttatttgattttaccccaaaatggcaaaaatgtgtttggagcaagaacgttacaaattacaaattttttcgcccgagcgctggaaatgtcgactttttgggggcatttttttcgagggttcaaagccatttttggcagtttttgaatcatattttcgtgcatatttgggcattttcggttttttctttctgttttttaatggtgtcatataattttctgaataaaaattcatttatcccccgggatgataaatggagacggggggattatttttcaacctcctcagaaatggggtgggggattattagagaatatatgttaagcgtttcaatttttacaaccattaaaggcgacaaaattcattattttggtatgcttttattggtttaataaatattaaatgaagatattgcaaacaaggcgagaaaaaaaatcacttgatccattttttaaaattccgtaatcgcttatgcatttaagcttttcctttctgtccaacagaaaagcttttcttaacatatatcattcattttgtaattttaattatgaaaattattttttttataattatctctgataatgaagtttttataaccagacaaaatattttaaaggtataaactgatcaatcactcatttccgatcaatctccatcggtcgtattttcaatcgttttgctctctgatcactttttccaaatctccgcatcatttgatgtcgctgttctcaaccaaaattgctctgtgcgtt

SEQ ID NO: 16120 - DNA, 2213 bp, Heterodera glycines
  misc_feature (1649)..(1649): n is a, c, g, or t
atgcgatagcatatagcgcaaaaaaatatgtgaaaactacccccccgttccctgatgataacttgaaaattttaaatttttaaataataaataaataattaattaaattctattcacatttatttaaaggtattctattaaaatggcacattaggaaatgcaccagcacgtttcgcatcaaatggaatttcggacggaattattccgacttcattttttgccttttgcattcatttaacaaaagtgttgcatattttaagaataaatataaaaattaccattctcatattcagaatttagttcggacaattacaattcaaattagcgccaaatattgataatagtccccccaaatacaaaaggcggtaatttatatgaaataattctttttttagtgccttaagcatcaaatagagaagatagtttaaacaagttttaataccaaatatatccccggtatttagtaatttgactagtcttatttttggatgtgttataaaatttggaattattcgttcataacttaattaaacttgcttttctgcaatgtttccttttgtttattaggataaattattttattattttcaatttgtttgactttgaattttgcattttctgtaattttattattaaataatgcttttttctgcaaatccgttatgtgattgttaataaaaatttattttagtttcacaatttattagatatacaaattaatttttccatttaaatttatccaacgatctgagagattggtcattagttcttattattatgtgctgctaattgttttattttacattgtttttgttcagttttgcgttataaatatgatttgtttttctttattaataattatttcgttaattattatattttaaatttttcacttgcttttctctttttttcaattcacgataggctagcactctaccattcgcatcttcgtaggggtgattgaataatttgtaaatttataatgcgttttatgtaataatcttttcaaattattaagatactatatttctaatttatcgtatttgaatattaaataatatatgtatatattttatatttatttctatgacattttttcaaataaaaatttttaatcagataaattattatacatttatttaatgtttttgaattattatttttcgctttttcggttttcctttttccgttattattgtattatttgtctttctgtctatcaattcgcattaacactgactctttcattgttttgggtttacatttttaaatgatcaattatttactaaaaataataacccaaattttcattaattttttataataaattttttgcatgtttaaaaaattaattctatattatcatcatatttgttctgtttttgtgatcttctgacttttaaaatgtaaaaagttttttatgttgctttttaaatttgaaaaggtaattttaaaaatttaggccttttctggtcttgtgggttttgagaaatttgaattattaattaatacactataatcagtttataatccataaaaaacaaataaaataaatatttaattaaaataagaacaattaaaagattatttaactaatttatatgtgccgaactttatgtaaattaaaatttaatttcatttttttctcngtattaaatgatattttttggcatatttacaattattagctgttaaattttattatacattagttttttccattttgattataataaatttaattgtttttctttgaattttattataatctttttgttaaattaataattttattattatttttcattaaaatattatctttcaactattatataatatattctgtttagttgataatatttctttttcttttttttggtgtttctatggtttttctgtgttaattgagccatttttaatatttatatttaatttaatttttatttgctttaaaataatgtatcgtttgttgttcatgttgtttaatattttttatgtttatttgtttaatttttgcatttttaatggtttctttttttcattattttttttatttccttgcaatttaaaatttttcttcatctgttctattattctaatgctattattcattttatgttaaaataatatatatttttcctcattaacttttttccttcatttttttcaaaattctcgcccgttctcccatttgcgttcgggaatggatgtat

SEQ ID NO: 16121 - DNA, 3125 bp, Heterodera glycines
  misc_feature (940)..(940): n is a, c, g, or t
  misc_feature (3121)..(3121): n is a, c, g, or t
tttctcttttcttagtagattatatttattgaattttgattgattcatgaaaatatataagtaaatttctctttatatattttttaaattatatttattttaacttatataggatttatttaattgtatcttttaattctcgtccactcatctgtttttgctgatattttttatcttttcttaatagattataattactaaatttgatttgattcattaaataaaaaaatattatttttaaatttcttatcgattatacattttgggtctgattattttcttatcaaaaattaacaattttcaatcttaaatttttttggggacaaattttgagaaaatttttcatttcttattaccgtatatgctctaattaaaacaacctgtgtcaaggaacatcattcgaagaatggcggctacactattcatggacactgacattaaggtgagaaaacttgtattatgctattaaattaaaatttggttaaggcatcagttggatggctgcaattcaaaagaagtgatcatcaaatcatttgagggtcagttgcaaaaagaaaaataacagaatttttagtctgtgggttgacaacgccattggatggaacgggagacgaaaaaatagcttgcttaagccgaaaggggcaattggaccgataaggatcaaacttttgcgcgagtttagggcaactgaaacggtgaaagatgggcgaaatgatcacgaagaagacggcctctctgatgtgatggtgatgtagagttggatcaagtcggagatgaggatgaaatacttatttgttagcgtgttttactgttattttttttgaaaaaatttgatacaattttccaaaaaaaaaattcctttttatccccccggggggataaaaggagacgggggattattgttcaccctctcagaaggggggggggggataataggagnacagtgagattaaaggagacagggggataattagagcatatacggtatattttattgcttgaagaaagtgtcatcaaatgctgaaaaatccggtctctattgattatatatatatattttcatttcatcgtttgcttatagtttcatagtttttcatttattttttaaatttatttttattatcatttgcaaagcgattacttttcttaattaacataattaattttttcgatgtcttaataaaaattgtactaatcaatctatcattatttgttgtattaattattttctattatttgccaatttattttgtctgttttgaattttatataaattttctcgtttagtatctgtgcttctctgatgtacatttcaccatataatatttcctcatttttgtaatttatttattattttttgctattttaaaagactatttaatttttctgttaattggtccattttttgaatggtctttttttgtattccatttttttgtaaagctaaatttaattagttgcgtttatagtagtgattttctattaagtaggataaatgaatgatcttactatatttaattattgtattcgaatatttaataataatattaattccatttctttgaatacatttaattactaatttaaatctcaaaattcgttttgtattatcctatttaaattttcaattatttgttttatttttctccattatcttaaggattacttcgttatgaattttagaatatttttggaactcaggtctttttataattatttttgcaattaatttttctttttctcaattaattcattttctatgattaatgttttgaattttatattcgagttttaaaaatgaataaaaatattttaattcttttaaaattatgcttttttaagctgtttaagttgtagtggaaaatgttcagattattttttatattaattatttttttgtttatattttatccaactgttatagaatcttcttgcttctttatttaagggatttttggattttaatatatttagaaaatacccatgctaaatgtagcaaatataattctaggatctgtttgctttttgtattcaattttaataatcctttctcaatttttcaatttaaatctttatttttagatatagtattttgattttgatttttaatttttcatcattttaaattattctaatttggttggatagttttcaattaaactaatcgttatacatttttttgttaaattatgaacatatattgaactttttatataaataaaaaaccatttttgattattttggtcttttttagttttttaacaattcattgctttttaaaaataatattttgctttttcatttcatcttttattttcaaatatattaattttatcattcttttaaataactttctcgttattttgccttttttctatttttgaatcgcaaatgttacgatggattaattttttattagtttttctttttgtttttaaatttttgtttcatttgagaatttttataaataaatatgcttgataaaaaatttttttttctcactaaaactataaaataattaacaattttttattttttagcttcatttttccgaaaattttttatttaattaaatgattaataccttaggatttaaaaaattatttttaatattaaattaacttagcttaatgagattgtttttgttgttaattttaaaatatttcaataattataattgatatcatcatgttatttagtttttttaattttttaatttctttttcttttttcaaattctcgtagatacgtcttttttatgttcgggaagatgtagaaaaagatgtttttatcttttctagttttttttataattactgaattttattttcgacccttagggtgggggtgaaaaaaggaaattcgataattcatttttcgttggattttattgtcatttaaattggttatcatttgtaatattttatttttgtttttaatttttttttgaactcattaatttagctcgtatttttgttttatttttaatgtttattttttctccttcttactaatacaaatatccagcttttttaaaaatttctaaaatcaacaaattacaaaaaatttaaatttttcgattttcaagcgtatatttttaaattattttttaaattcccanaaaa

SEQ ID NO: 16122 - DNA, 2048 bp, Heterodera glycines
ccccccccccccccaattaggccgagtacgaaatgatcacgaaggggcccaagtcgcgtgccttttaccgcgtccaggcgacgcgtcgcctcgtcggcggtggcgacatcgtgcgcaaaaggttggagcgcgagcacgacaaggcgggcgatgtgacagtgcaggaacaggagagacaggcacgacgacacacgtgccgcattttcttcgacccggcacattacacagtgctagagagtgtgggcgtattcgacgtgatggtcggaagggacggcgggccggacggactgacggtgatggcggattattacacggaggacggcacggcgaatgctgggtcggactatcagccggtcaaaggcacgctgacattccacccggaggacaaacaccaggcgagaatggcaaaagatgggccaaaccatttgccaagggatgaccaaatgattggcaaaagatggagcaattagttaattggtcaatcatttgtcataatctttggcaactgattttgccaattgcttgtttttgatctctttgttgcccttttcagaagattagcatcgaaattgttgatgatgatgtgtgagtgtcgcttcgtccctttgtcttttcaatttccgtccgttttttcagatttgaggaggacgaacacttttacttgcatttgaccaaccttcgggtccgaactcgggacggactcattttggacccctcgcgaatcggaggagtgccggtggccatgttcgacttggtaatgaggcatcatttcacggcatataaatgcctctgcaatcctctgtaatttattaatcgctcccttcccaaatcagccgaccaccgcgaccataatgatccttggtccgtttgcctaattgaccacttattatgctcatttgtttgcagatgatgaccatgccggagtgttctctttcgagcacgaccattacgtaactgtggagaactgtggtcacgtcactctgcgagtgcagcggacgagcggatgccgtggccaagttgtgttgccgtacaggtggcaaagccgggggaggggaaagtgccaaaacaatgcgaattgacacgaaaggaccatcgacggcacggcatccggcggaaagcatttcgaggtcaaagagggcgaagtggttttcgagaacaatcaaacggagtaagtgaaaggaaaggccgaattggaaagtgccacaatttagggcattcatcgacattggcatcatggacacggaacagtacgaggtgagtgattggtgagtgatcgctctgatcactccagtgcctttacaatgtttgccgtccattcattcctttaattcattcttttaagcgttccgactttttctccatggaattgaaagatccaatttggacaaagaaaatgtcaggtcagtgagtcgtgttgtgttgtgctttttctgctgagttcttgcgaatcgaatgccgaaattaatgtttcggcttaaattcggcatttgtttggctttgcttctttaactttgtgcagttacagtaatcattgctttgtttgtgctgtgtagcgattaatttccattagtgtttcgattcttgaacattccaatattaattggaataaacaaatgcaacagacgaataattggacgacatgctgatcagcaagtgattgataagcttaccaccaatcgactgattctcccattccttcgatgggtcccttttatgggatggcttttgtttgactgaaaacgaaagataggtttacggtaggcagtggttacggtccttctacagtcgaaggaccgccccttttgtccgaagtgtgccgacagatcagcacttccactttgtcttgctttcaatgactatctttccctccctcccttctgtcgttgatcgcttatcttctgtttaccttccccaatctctcactttttcttttgcttccctcgctttgcactatttcctttgctttttttctcaatcacgtgctatttccgccttcgctgaccatctgagtgccctctccgcctgaagtgctctattcccattgcttc

SEQ ID NO: 16123 - DNA, 2341 bp, Heterodera glycines
  misc_feature (791)..(791): n is a, c, g, or t
  misc_feature (809)..(809): n is a, c, g, or t
  misc_feature (875)..(875): n is a, c, g, or t
tctcgtttattaccgtattcgcttcctctccctacagtacccgtcttcgtgcagttccgtttgtgctgtccttcggaggtccttcccgtgcctttgtcgtgtttctgtccgcttcgtccctttttagccccccaattttccgtccctatttttcgttttccttttttcaatttattcccttcaacagatgaaaatccgctcaatttgacgcctgatcagcttcaaattgccgaattgggaaagccgcggctgggcgaatttcgcaagtgccaaataaccatcaaagagagcaaagattttcaggcaagttcaaagaagggaaagtttgttgtgcaatatttatcacttggtcaattagctattattgattggttatcgatcggtcattgcttttttataatttcgtcctataatcggtcattgatcgggcttcgtcgtgtcccccttctgctgcaaccgctcatttatggccatatccaccgtgatggccgtgctctcctccaccatatccaccgtatccgtgctgtcctccatggttaccgtagtccccgtctccgtggtgtgatccatggcttccccaaccactaaagcatttgttacattttgtccaactccacccccccccccccctcctcggcttgttacttgtcgtgtccgtccccatggccagtggcgtagtcgtgtccgtcgtcatgtccgtctttccatgcgctgttgtaccccttggcgtacgagtcgccctgggctttgtttccctgtcctccgtattggtaactgctccagtccgactngtcgcctttggcatagcncgcggcgtgtccatcatctgtggcatagtccgccgttgccaatgttcgcttcgtcccatttcttancatggtgtctccatgtttgtacccgtggtcccatccgtctttcttgtggttgtcgtggccccagtcccgtttgtgtccgtatttcccgtgggttgttgtcgtggtcgtggtgcccgtggtcgccatgccatcctccgtgctcacttccgtgccaatacggtgtgccatgctctgagcgttcacgaaagaagtaaaaaccaaaaaatgggggaaggcaaacccgaggcatttgaaagtgccaaaaagacagtggcaaggagcaaagacagaaagagaagacgacaagcagaaggggagcagcagaaagaagccatttgatgccgagttgttctgttgagcttgttggatgtgagtgtttcgaatggttttcttctgcgattttcggcgcttaaatacgcgcaattggcgcccatcgctggccattcattggcccaatcttttcgttgactattggcataattgcccaaacgcaaattgcacctggcacataatcacggcttatgatcatataatgccattagcgaacgattgtccggcagcaaaagcaaattctccgtcattaaatcatattgtggcatcgcaaaggacgaaaagcgtcaattattgacggggggggaggggaattgcccgaaaaacgaacgaatggacggacaaataaatgattgattatgcaatgcgacgatcgtcggcagcctttggggagggactgactgtccggttggaagcaaagaaaagcaaaaagaaaagaaatgaacagagagagaaaacaccaaaaggtgccgctgtgaatttgtgttgttaagccaattaaacgaccgatcgatcagagttagccaatctctgatcagttgaccagcagataaccgatcgatcaccatgtttagaccacttgatcagattactatccaagcaaaccatactatcggatcagtcgcttttaagggcgttgtggaccgaatgctgaaaacggccaatgcttctttcatgctgggcacctcctcctggcgcgaacagttcatcgacgctctgacggtgtccgccggcgacggcgacgacgaagagacggaagagggcgagccgagtgaggccgacggattggcgaagcagctgacggagccggcacagccttccaaatctgactatttcgtgcgcatgtcccaatgtccgctgacataagcttcttccccttcagatgcattttctgtccgtcccttggaaattgctcttcgccacaatccctccgaccggtgaatttttgcatttttggcattgtgtccccaaaatccgccgtttattttgccatattttacgctttttcagattattggggcggttgggcctgttttacggtgtccattttaatggtaacaattgctatttccccaattttggccttcttttcctaagattggcctgctaactgcggtcattggcgacttggcctcacaatttgtatgccaattaat

SEQ ID NO: 16124 - DNA, 1012 bp, Heterodera glycines
aggcattcctttggcttttagacactttcgccagcaaagtgtcagctgttcaagacaaatacgccgacaattccattggcaacgtggtaaaaaggagcggctaattgttgtaaaatgactttgttgtccaaaagactgggtccaacgcggtcaacgttttcctcggcattggcatcgcgtggacattggccgccgtttaccattggttccagggctccgtgttccgcgtcgacccggggtgccttcgtccgactgtacctgtctttgcctaattacccccccccccccctcattaggaccctcgccttttcggtgaccattttttgcatcgaggccgtcatttgcataattgtgattgtggctcggagacataagtctgtttagctttttgtttcattttgaatttgtcccattttaaagggccattggcggcgaattgggcggtccgcgcaacttccaaatggccaccagtgcgttcttcgcctgtctgtgggccttttacattggcatctccgccctcgagtcgtactgtgtcatcgccggcttttgaaccactcaattggcactctctcactctgtccgtccgttttaaatcgttggcactctgccaacccctctccgccgatcgctttatcccaagggcacattcgcttacctttttcatttgatcgtccctttgctttttctcccccccccccctcaaatgctcattttttgtcaaaatgaaagtgcctcactttcctttatttcccacaaaatgcaaatgatcaatttgctgactttcttctgatcagcagcgattgctcatttgccttattctttggttgactcctcttctgccccccccccaaattaggcaatttctccccgcgagttcttttttctagtcgaattgtacggttactgtaactcttcgctgctgtgttactgtggcgttgattgtactcttttctcttcttagtttaatgttcgttttttttctctgtttctgttgtttgtatctgaaaactca

SEQ ID NO: 16125 - DNA, 3684 bp, Heterodera glycines
catttatggaggtcaaaatttacaaatctcaatgcttttcatccatttttacttacatttttcaaaattagccaaaatgcgatgccaaagggcaatttgaaaaggagcaaaaggacggcgaatttactttttgtgtggacgaaaaaggaaacgaattggcaggtgaaggcgaaggcatggccaaaacattcacattcctttggcatttgttaaggaagtcgtcgtcactctgatcggttcgtcggatgcgaccaaaaaaaacgctgtccgtccgtccaatgccaactcaaatgcccatttgggtgcgtttctcttctttttctctgcttgactttcgcagtttccaattcgattccgtcggctgtgccctgtgccaatgccgtgtttcgtcttgcgatggcatcgcatgtcccgagggaatgatctgccgattggtcccccacttttgttcatccgttggccattcgaattcgtcttgcaatgttcccgaatgtcattattttctttcgcgtttttcctaatctttagttttaggtcttccaaatgtttgcctaaaaggagagcctttggaagacgcgcgaaacggccgattgattcaatgcgatgaaacggacggcggcgaatgcccccaggggtggcactgtcgccaaattggcaccggacccaagggattttgctgctcgggaatgcgttcgcaaattcttttgaattccatcacagattcgagtttcagtgcttcaagccgagcttttgccgccttcaaatcgatgtccagcagtgccaaatttaagttacaaatggccccggcctggccaatctgtcgggtgccggctgaacggagaatgccacaacggagagtcgtgttgttttgacggggtttcaacgcagtgtttggcactttccgaggcggaatattctcctgaaataagcacaaaaaggggtgtctctgatgagattgtgatgcgacagaccaaacaactgatgccgcaagggttgtcccaatcagtgagtcatttggccaattgtccgctccgtctgccaaacgcatcctccgccgactgcgcttcgaattgtgcttctgacgcggactgtgcccggcggagtgcctttctccgctgctgtccttttgggtgcggaatgcaatgccaatttggtgacagactgacgccatgcgttcacctgttggcctcaaatctgcgcgaagttgacaagttggccgaagtgccaataagtgttggaagaccgacggtgcaatgcacggaagaaggacagttcgaaaaagtgcaattcgacccatcaaatgggtaggaaagggaaaacaggtcgaagaagtacaactcgaaagagcaatccgaaaagtggcattccatggaacattccctccttcgcttcagtcaattttggtgcgtcgatcctttgtccggcattgaaagcgtcggctcgcgcgtttccgcctcccctctcgcgccggtcagtccgccggactgcagcgtccgccacttttgcaagttcaattgttcaacgacggcttccaatcgctgtccgcacggacttcggatggaccaccgcggctgtccgttggacgaacggtgcgaatgccgaaacccttgcgaagtgccgtttcatcactgaactcgcggcaattcctccgtttaggacttcaaatgctctcttacggacagtgaaatttgtctcctcaaatcggtccaatgcgtcgacgactctttctgtccaccgatcccaatttgtctttcgcttttcgcctgcttcttctgctccctcttaattgcctttttaggtgttgagaatgtttgcgatcgcttcggtgctcaatccgtcggtctttccttctgttcgtttgcctccgattgccaaaaacaattgccaaattccgatcgaatcttcgactgcaaattcatttcatcgcatttgcccttcgatcgaattggaatttgctgtggttggtcgatcacttccaattgtccgattgttccttttcttccctttcagcctttccctccgcccatttgttcaaagaacagtcgacgaacgccgaaggcgaaattttcaatggccaaacgaaattcgaaggcgaagcgaagcagcagagggagaagcaaagggagaaggaaaagccaaaggaaaagcagggactgtgcccggcagaagcgaacggcggaggaacggatgaaagtgccaaaggttttaacggaaattacacaataagaaatacaacggtaaggtgagaagtaaaaagccgaatttgctgcaggtgattgtcccggtttgtgttcctccgattcggattgtgccggcatccaaaagtgttgcccgaacagagtcgacggatgcctccaatgtgttcagccaattctgacaacaagtgggaaagcggatgaatgacgtcatccttcgcttttcctcagattgtctgaatttgctgtcggccgttctttcgctcgattcgtctcacgtcgaacactccgtcccgaagccgaactgtgaccctaacacaggtgagtttgtgcttccgtttggcttttcccttggcattgtcccttaggcgccttttcgcgtgtccaatgcgatcactttggcttttgttggtgcgttcgttccgcttcttctgcttctccgctcctcggcacgcgtcagtttcagcccaccggaggagaaagcttttgtgagagtgcgtatcttttggggtgtgtcgttccatttcgattttgctttagccccaaaagtgtgccctttccgccaatgttccgccactgtttgccccttcggcgtcgaattcgacttggacggatgcccactctcttctgagtgccgttgtcgcaacccctgtgacggaattcaatgtccgattggtcaaatttgtctgcttcgggcgagagattgtctggaaatcgaacagtttccgcccgattctgtcgcccaatttggcacttcttgtcttcctgtgccaatttgtaagttttgcggcctcattgtgcttttgtttgtgagggttggcctaaaatgagctttttgtctctgttttgctcaccattcattgcggctctcaaaaggcgaaccgtctccctgcggcaatgttttaaagcctttgttaaattcggcacttttgatgccccaaaaatgccaattgaattccgacaatcggccaatttctctcccccaatgccccgccgcatttcaatgcatccgcccgacggaatattctccatcggccgaaacgacgcccgagggcatttgctgcccacgggtgggaaatgatggcaacggagcagtggaaaatgcgatcggagaacagcaaatcgacgaaaatgagagagaaaaaggcaataatgataatggagggggggggggagatgagaaaatgtttttgcgcttttcttttagccattttctgtcttttgcccgtccatcagggaaatgccgtggaaaagtgcggagaaaaccgttcggagcttcgatatttttacgattcgcagaaagacaaatgcgaagtgcgaaattttaaaaaattaaagcgaaccaaaacaatggcactgattttgttcattttccctaaggcctttctgtttgccggctgtggaggaaatgcgaataattttaaattgaaaagcgaatgcgaaaagaaatgggaaacgatggaaaatcggcggaagggaaaagcgacgg

SEQ ID NO: 16126 - DNA, 3430 bp, Heterodera glycines
  misc_feature (98)..(98): n is a, c, g, or t
ttgacgtcctcgtaaacgcgcaatggccagcgtagtcaagtggtgaagacggacagatttttggcgtctaaagacgtcgagtgccttgttcaccaccnggggccatgtatttgaacatcacctaaaaattagctaggttatattttttaaattaaaaaaacgaatgttccaaccggagcaatgcttagggaaacgcgttgatcaaagtcaccctctagcggatttgttttaaatttcaagatcagccatgaccggtcagtcctcgtcatgtgcagcatggactcggtgccagcatgcatttcaagtgacttgacggcggaagtgaagctaaataggcgaataaccagaaaacttagaaggactaacaataagaagtatttaaaaggtaattaattagctttggaacctaaaaaagacataaaagtggcaaatgttgttttaccgcattgcactcgcagccgatctctgctccaatttagcggacagttgagaaaaacgcagttccatcacattgtccaacttcagctttagcgttttcaggtgcactttgaagacgttgtccacaaaatgttttgggtagttcatcggtggcacattttcctgcccaatttttgttattgtaaacatttgaatttcctttttcattctcacttggtagtcaatggatttataaaggcgacttttttccattggggtcgattccttctcgaatttttcgaaaatttgtgcgtcttccaccgcttcttttccctttggcgaaccgccgaaccaccaatttttggcccaaccaacccatccctcctgcggttggtcctcgacacggacgaggtcagtctgtttgtcgatttcgaactcggcttgttgtcgcgcgatgttcaagttgaacacgtccagcgcatcctcagcctcctgtgaacagagtaagtgcttttcagagtaaaaaggcaataataatatgcgattaaatttaaattttaattgaacaatttgaagagaaatcagctgcactctctctacctcaattgtgtccatcaccgcttttctgggcgttttgtgagttctgaagtgaatccacgcctctcggtagtccctcaccatttgccgatgctttttcattctgtcccacgaccaattgtttcggcgccgcaagacttgctcattgagaatgcaattgtatgcaaaatgccaccggaaattggcaaaataataaatttagtttaaaatttaaatacacatgacagaaatgcttaccattctgtgtagtgctgacgatagtgtgtcagattgggccgatatttgaggaatttctcggccaaagtgaagcgctcttgggcctccagaaacagaagcatgtcctggtactggtacttgccgatggacagtcccaatttgtccaattgcattgacaaatcaattttgggagtggtccaatttgagccgtcactctccggcttctggttcagcttaagctgtgcagcaatggtcaacggttccaacactgtggaaaaaagggcaacaatttcttgtttttggaattgccaattcagtacccaccgtatttgtacccggcgggcttcctcccgtggactgcgattgtccgttgcaaagcgctgattatcttctctttgcttttgaggtcggagatgaatttggagttggcgtttgaataaatgcttaaactgctcatggacaccaatctaaaacaaaattaatgaacaaacaacacataatgatgatagtaaaacgatgcactcacttgtaaaagattttgacagtttctttttgcactatcagtttgaaattctcatccgtagtctaaaaagcgatgtaataaattaggaaaataattcttccattgtttcccccacctgaaaattcaacgagtccaaagtaattcccgtggcaaatgggcgttcgcggttcgagaatttgtcctcgtaacgaatatggacccgtttaatatgcacttggagatttttgataatttgtgctattaatttctcggtaaaagtgtcatccgatgacatagttggctctaaattctaaattggttaacaattgacacatttgtccgactttggcgacttcgtctgttctgttccaattgtaataactgtttctgcttggcttcccgctcagttttacgcgctttttctgcgctgtaaacaatgccctggttcggcataatgataagatgaattccacttaaattttaaaaatttaatggttcattggtttttacgtattacagcgcacctaatctccacgattgtcggctcgacgtacaaatttttccatggtattttaagcaccaaactttgaatatatccaaaactcagcttcaccggcaagtccaagccatcaagcgctgtgtccttgatcttcaagtgattaagctttacatcgcctccccaaatgccaatgttcagctgggacgcatttaaattgtccacataagcgcccaaaaatcgattaagaagatccgtgacaactgattcaaataccatttcaaatttttctaaaaagttttcatcataaaaaggcgtatgtgtgaaacaaaatgataaatgaaagaaatgtttttttttattaacattagcatatagtctctaatttgtaggcaaagagagtgtaaattgtttaacattttaaagcgggaccccatggattttcaaaaatctgttgtttgaaaaataattttcggggttattgatcaggagtctaacatgacattttatcaatcccgaacctgaactcgaaaaaaagtgaaaaaaggtgggggaaaccaaagtgagaggcagtgccttagaatcttggaaacgggaaagttcagattactgacaattttgatcttgcacatggattttatatcattcgactcctcttgtagcgagaagcacaatagtgaaattttagggcgcggtaacgcttttaacaagacccggagcgaccgattggcaaaaaagttatgtcttagaaacgggccattgattgaacgcttaaacttcagcagagtccaaatgtttaagcagcggggtgagaaattatgtaaacggggaataaggaaatttgcaaaataaaatttttgtcatagtaaaacacaatgtaaaaagattacggaaattcctcagagttaacatggatgaaatggatatcagaatcggattctccaaccctggaaaccccaaaaaataatttatctcgaaaatttttattttatttttataaaaagaggtcctaccatcgacagtattactttgaaagatctgacatacgtggggaagttatgccgttgattacgaagattcgaccagattttgctttggacatcgttatggctttaggagcgggggaggggagggggtcaggtccggttcggacccattttgccggaatagaagactcgggtctaataatcgaaaaaatacgg

SEQ ID NO: 16127 - DNA, 3009 bp, Heterodera glycines
aggagcaccagtgggggtccgcatgaatagcgaacatcccttcacccgtagaaggggtgattatttggtgtgggtgcaattttgggtctttcagaccagctggagccctgcgctcattcaacaaagtcatgcgaaagaagcgaagctcttccggagtttgttgttggagaagctcagtgagctgctcacgcgcctgcttatatgcctgggcagcaggatgatgcacttggatcatttgttctaagatctcaagagtctgctcatttagctggtgaccctgcacaaactcatcttcgtttgtgattttctccccagtaaacctggggttgtttcgacgctgttccatagcctcgactgggtccagaatgtacaactggccaaagccaggaatctgagttgtaccagcctgcatgctgcttatgcggcgatggaattctccgttaagaataacggccatcggaccgccagcagggcttggtttgttgccagcggaaacgctcgcaaattggaacaggttgttataacgcgacatgtgtcgcacaaattctttcccttcacgggattgcttattccccacaatcagctctttgagctcatcaggatgcgggttaagcattggcagcacaactcttcccttccggcagcaaatgttactgtcttcatgtgagaagagatgtgcaccgcaatcggcgcattttttgtcaccgagtttcccggagtcacaatattccgggaaatgtttggctgctgctgcagcgcattgccaccccttgtgaaatgcagagcaacgccgtgtgatcggcgttgccattcccagcgaatttgctggcgggggtcgttttggcgccggtgaaggcgaacggctaacagaagctgaaagccttttttgcacgcgcagtgatcgccttggtggcgtcttaggtctgacgaagattacatcatcagcctgcgcgattggttcttgctggacaattgtgtccgcaacaacaccgtgggtgtcagcttgattttcgccgatcactggtgcttgcgcaagaacagcagtttcttccgaggaaggaagtactgctgaatcatccacttcaattggcactatgtccttggaggaagtttgcgctacatccccattgtgatgagacacaacagcgaaagatgttgaaacaccttcccttggatgaaacggcacaatatctgagccataaagctcatttatgtgccataaaatgcgcttcttctcataattgatgttcaaatccggcagaacaaatgtacggttgttcatcagccaggattcagcatacaggcacacgaagtacccgcagctgttaccatcattttgctttgtcaattgctgcacgtattcaacagcgaatgacgcattcccgggcactatctcagcaattattgactggatgagtgccattctctcatcactcaagctgctcatatgcagcgagtcaaggaagtatgcaccatgtgcaacatcgtagacgatgagagtccaatgatttgggaagtgaagcggcataagcacaacttcaggaacagcattcggatcatagccgaaagtgtaattcttcacgttggaaaatcgagaaacatcagttctcgatgccaaagaatccacaactactgtttttcgttgtgaaatgcttgcaatgtaagctaaataggcaacaataaagcgtgggccaagtgctgtttcgccatcacgctcataaaggccaattgctgcccatctccaaattttacaggcaaaatttcgcgatgtggcgaaattaattggcacagtgctgaagtcaattttttcagacacaatgtgcgaggttgccggaattggggcattttcaagattgttatccatttcagagcttttgctcatggaatcactgagtctgcctcggcctgggcctccaatttttttggcaggtcgccctccacgactttgagtcgaaacaggtgttaaagcaatagcttcattggcaaacatgggttggtcacactcggcgaccttttccctttttttgcacggcgaatcctggtcattttgagtgaccacagttcgatgtatgtcaatgagagacacactttcttgcgtagccaagtttggcttcgctccggctttcgagggcctgcctctttttttacttccaatagaagacgccggcgtgcttatttgcaaagcacttaagcttggggtggtggtgccccggagagatgccgatgcctctccattcccatctgcactcccgtctgagacgggtgagttatcccgactgacagatcgctctgcctgtcgccgatacacatcttgcttcttctttttcaaattttgttgtttagaaggcatctaaaacaacaaatcagaaagtattacaaatgcggcaaaaatatgaggtaattaaccataaatgtacacatatgttaaaaatttattaacaaaaaatgcacaaataaaggtcaaagacatcattttcgctgtggagtgtagtcgtcctgtgctgaaatccatcagtcagggctcacacatcccattaagaatgcagatgcaaaaatgtccggtccataacccaaaagggcaggaccagccacaatttttggtgcgaaccacaatcccccttaaggataggtccagcgacgacttttggtgctaaccacaatcccccgaagggttaggtccagcaaccatttttggtgcgacaaatgcatcagagcgccagacagcaaaccacattgcgacgacaatgcctcgaagggtcagacaacgaaccactggagcgacacattccccgaagggactgtcaacaaaccacattggtgcgacaatgacccgaagggcctgtctgctaaccacattggtgcgacacaatccccacagggccagacatcgaaccttcttggttcgacacatgccccacaagggccagtcagcgaacagctttggggcgacacatgcccgaaaggatcgtcaaagaacaccattgttgcgacaatgccccaaaggcctgt

SEQ ID NO: 16128 - DNA, 3011 bp, Heterodera glycines
ttctgcaaattcacttttttaagtcaaattttaaaaaggcgtaaattaaattttacaataattaatacttgcttaaattacatcaagttaaattttctaattcattttaaacccatattttatatttaaaattctcccacctaataattgttgttgaaaaaggtccataaaatgttgcttaagcccatactgggcataatttgcatgcatttcgccaagatgtacacatgcatcgtacattttatcctcatccattttgtattcattgatcagtttatcgaaaaacttaaaaattgcctgactgaaaattaaataaatatataatttataataaacttttatatttttaaattattatcatttaaaatattttagaatttttggcattttcaatttgattttcataataaataaatttaactcattaagaaaatatggtatgaaatttgggtataacttattaaattgtatatgtttagaacgcaacaattttgtataaggtcatatatatcgaaaaaggcaagaaaaaatatagaaaataaagtttactcgctccgatgggactcgaacccacggcgcccttccataccgtggaatgctctatccgactgcgctacgggcaactcctttaaggggtcctcccatgtcctttatccgactttctcccacactcaaattttttctttcaccacatcaaaagaaacatttttttaaaattgatttttattaaccaaattctgttaagttttggccattttgtcaggtctctatagcaatagtggccgcacgcgataatttcgttcatctttgggctcgcatgaatgcaataatgcattgccttgtggaacagatcgcttcgacttgtcacaatgttattgtgccaacacaaataaattctgaaaaaaaataaaaacaatattatattgatgtaaatatttttttctaaaaattaatgagccaaaaattcttcaatgccatgattaattaataataaataatcaaatatatttttcttattatttgttaaactaataaattgacgtacaattctcggtcttttggcgacaaaaaattagtgtccaccctcgttcaggcaaaacaattgcagtttctgtccttggtttactgagcatttttgtcagcgttcgtttgttctttaattgtcgtttgatgaggatcgttgtattaactaaaagataattaattcattttaattaattctttattttatttttattactcggccgacgcaaaattgcgacaaaatcattggacggcggcgaaattgtttgtcctcttgttgaatcagaaattaagcatgaattgcccattttattttaaagatttgtttaaagctaaattataagaaaaaaatttatgccgattgatcaattcaattagtaacaatgtgattaaactcacaaaaattttaactgtttaaatcaaggttgtgcaaaattattgtcatcttttcgagactcgacctatgagagtcgaaaccgagactacaaaaaatgccaacaaatttctgttgtttcgagtgtagttgggaacaaaaataagtttttaaaagtgtccaaaaaaagattttggttcacattcaaagaaataaaaaattttgtcatcgcggtagtggcgagtaatcccaataaattctgagcaaattgttaccaaaattaacactaacttttaacaaatacaaattttccaaaaacttctccccccactcgctcactgcttatgatgggcctaggggttaagcctgagactattgcatttcaattaatgcttcaattctcatgtgttttaaataatctgaaattataaaatagagggttggcaattataatttattcccaaaaaatgaaaaaaaaatttttccttttattttaatggttaaactcagaagatgggaaaactgaattcaatattttgtacttaatgggaaaagcaattaacagtaaattatttcattcatttatgtatgggaaataattgttagcgaaaaatttatgaaaagtcacatttgtttaaagaatagcgcctttaaatgtgggaaatcagtgtgaaatttgataaatggggaaagtgaccgaaattaaaaaatgaaattaattttaataatgacaattctatttgataaatgcaggttaacatcagaaccaaaggtagatgaccaaatcaaattattaattattcttgaaagattgtgtaaataacctaaatttacatcaattatgtatagatgagagaattattgtttaaaaaaaataaataaaattgttaaacggaatttttaactcaattgcactgaatcaaaaaagttaacgctaaattcatttattaaaattaatttttagctaaatttgggtttttggaagagggtttgttgaatcaaaaaaggatttgaaaaagttagcccttttttttgctccgggttcggaattgtccaaattaaaccaaatattcatgataatgtattatggtactccggggaacgtgtatttgtgaaatattatgtttaattgtcatattactttatttaatttaaagataaaattaaaatcaaatatttaatagtcataatatttatttaaaattaattatagattagagtttttttaatttaaaaagaaaaatatttttataaaatattaaattccattataaaaataaatgattgtaatttttgtataaaatatttgagagtcatataatttatttatattaaagataaattagagtgtttttttaaatattaaattccaattacaaaaatataatttgtattatttaacaaggctttagcaatatttgtgttattcataataaattttataatgaaatttttcatttctgttcacttttttatatacgggcaattagaagcacgtccaccaccaacgtaaaattacgtaattcaactaagaaattcccatatcatttcaaaaaattatttttagtaaatcaaaaataattttaatgtaaaagttgtgagaaaattgatttaa

SEQ ID NO: 16129 - DNA, 1606 bp, Heterodera glycines
ttccttccattaacccttaatttaattgcttaattgtatttcattttagattcatttcattatgatcttaattgtagcaatttagtgcaattaattattcgttctttcgttcctttgccatatccccagaggcactttcttaactgtcggtaatttcctcgcctcaattggccttatccaatcaatggtcgttgcgcgtcggggattggttgcaccgcagaacacttttttggaggcggtcgtgcgacgctgcaacaacaccggtgaagcacattaatgataatgagatcattttcaaaattgtattaactgacgaattgtttgatctgctcagattcaagcttcattttggccaacgctcaaattatcgattttccaattgtttactgtaacgaaggcttctccaaaatgatcggttattcgagggccgaaattatgcaaaaaaatgcctcgtagggaaatacaaaaagcaaaaaaatgaattattaaattaatttttcagattgtcttttatgtacggagaacacaccgaccaagtgaaacggaagtaaaatgaaaaattggaaaaaaaaacattttaagatggccatccaaaagattcaaaatgccatggagacagaaaagacggagcaagtcgaaatcgaactgtgcaagaaaaacagtcggaagcactcactcccccaattgcttatctttaaaataattgtgctaattgtcagagtccgtcctgtggctgctgatgaacatttcgccaatcaaaaacgatgccaaccgcgtggttttgtatttgtgccaattcaaagacatcactccgctcaaagagccctttgagggggaaaacaacaaaagtgggcgggggagggggggggatgagataaaaaatgagaaacgaaatcttgaaactgtgccggctcacgccgggacttaaaagcattgcacagcggaattaaaagctaaaataattttcgcatatttttcacaatttatttcaaaaagccaaaaaggccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattaaattttgaaacgaaatagtgcacaaaagggagggatggttagacgaaaagaggaatttttagaaaagagcgcaccccatctgatattcccatttttccgttccacaactggccaaaggcgactgtgctaattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtgcgaaaccaattttaaaaactataatagtgcacataaggcgaggcgtcgcacgacggagcttaaaagcatcgtacagcataattaaaactgaatataattttcgaatatttttcacaatctatttcaaaagacaaaaaaaatgattcaatttt

SEQ ID NO: 16130 - DNA, 1677 bp, Heterodera glycines
  misc_feature (1650)..(1650): n is a, c, g, or t
  misc_feature (1669)..(1670): n is a, c, g, or t
gattggtccattttggcattgactttctacacggctttcatggtgcctttcaacatcgcctttcgtccccgtgacccccttcccttaggttattaatattcattaattaacttttaaaaataatttcaattcttttcaggtattgactacgttgttctgcttgattcggtcgtcgatgtgatttttttcgccgacattctcctcaatttccacaccacttttgttggcccggtcggcgaagttcgtttggcttttttgaattttgttaattaacaatttattttcacaggtcgtaattgaccctaatgcgataagaaaaagtgagtcggcattcattggacatttgtgatcagaaattttttcaatactcactttcccaagattacttcaagtcttggttcctcatcgacctcctttcctgcctgccttatgacattttctatatgtttaaacaggacgacgaagtaattaggggccattaactggaattatttatttaattatcttatcttttaattttaaatatttcgccattatttcgttgacagagaatagcttcgctgttttctgcactaaaagttgtccgactgctcagacttggtcagcaattcccgaattttgttaattgctttttcataatctgtcaggaagagtggccagaaaattggacaattatttggagtacggtgcggcaactcttctgcttttgctgtgtgcctatgttttggtggcccattggatggcatgcatttggtgggttccatttgcaattttgccatcctcggattgccatttcctgccataattagtcaaaggacatgggtttgtcctgctgcggtttcggcttcggaattctttcgcattgttttatctttggccgtccaaaatttcagttccgaagccggggctgctcagcacggacgaacgctttccttctcatttctccgcttcatttaaaaattattccattttcggtacgtaattggcgagtacgaagcacggcataaggtcgaaactgaaaaataaataaatttcgattgcttttcaattttagttttattacgccgaccaaccgttgcccgaggggtaatttgaatagctattagcagtgagtgggctaattagttgtgtaaacacattgaagatggctgattcggttgtcgtacgatctcaaaatgcctttcaacattacttcttccaatttgaatcgcctcgtcgggggccccgaccgcacacaatgttatgtttccggttggggacagaattaatttaaagcaatttgctcatttcgcatttcagcactttatttcacaatgtcctgcatgtcgaccgtcggatttgggaacatcgccagcacgacaatgaacgagaaaatattcggcatgtgagcagaggaatcaattattttgtctatttagtgcggattaattaactaattaattgactgattaatggactgattttgtgcagttgtatgatgatgttctcttcaatttcgtacgccgccattttcggtcatatgaccacaataattcagcaaatgacttcgtccactcagaggtccgtccgtccaatttgtcaatggttttctcattttctgctttcaattaattgaaggtatcaccgaaatgatcagcgaatgttcgcgangttcatcaaattgcgaccnntgcaggc

SEQ ID NO: 16131 - DNA, 3456 bp, Heterodera glycines
cttacaaagtgtacggccaagagaaagtgccagcgggcggcgttgtcgccggcattggcccaatctgtggccgattgtgtgtcattgtggcaaacgacgcgaccgtaaaagtgagaaaaaaacgtacgaatttcgatgtttttttaataaaattccgtttccccggtttagggtggcacttattatccgattacggtgaagaagcatttgcgggcccaggaaattgcccttgaaaattggtcggtttttgttcccattttttggggtttccgtttttaatttccatcgttttgcccttttaattgcattaattattaattttctgctcagtttgccctgcgtttacctcgtcgactcgggcggtgccaatctgtcgcgccaagcggagattttcgcggacaaagacaaattcggccgaatctttttcaaccaggcacaaatgtccgccaaaggcattccgcagattgccgttgtgatggggtgggctaacaatgggaggggtattaattttcatggcatttttacgatttttcttgtattaattaacacattttcaacaaaattgtatcaaaaactctctctcattttagttcgtgtacggctggcggtgcctatggtgcgttttcgttttactttaaatttttgttgggattttggagaacctttttttgaaatggtcaaaaatggggccttcctaaccttcgctcaacaaaagtgaagtgcccgcaatggctgaccaggcagtgattgtccacggcaccggcaccgttttcctcggcggccctccgttggtcaaagcggcgacgggcgaagaagtacagccacaataagttttaaatttgttcgtccgacaatttggcaaagtccaaaaaaggggggaatttaacgaaccaaaaatcgatttgaaattgaaaagtgatcagattggccactgattgtgaactgttcaggtgagtgccgaagatttgggtggtgccacgcttcactgcggccgcagcggagtctccgattatttcgcctccgacgaccgccacgcgttggccatcgctcgtcgcatcgtcgccggccttcccgcccaacggtcttttcccccttcggtgcgttttgattgcctctaattgatttgtttgtctctctcattagtctaattgattggtgtatttctctcattggcatgccatttggttttgatgagttttaaaattgtttacttcaattggtcagcaaaacgatccttttccgtcttcggcatttgtggaggagcccatttaccctgctgaacaactctacggcatcgtcggcggcccgaaacagcgaaaggcgtacgacgtcagagaagtgatcgcccgcgtggtggacgggtcgcgctttgacgagttcaaaagggtgcgccttaattagcatttaattgccttgcttatactatttactgctaattgtaagcaattgatcggtgtgtccatttggttgataattttccctcttttttcagatgtacggcgaaactttggtcaccggatttgcccatatttttggccaaattgttggcattgtcggcgagtgcttttcaattcaaataaaaaaaacaaatttttccacccctccctctttcattataggaaataatggcattttgttcagcgaatcggccatgaaaggtgcgcatttcattgagttgtgctgtcagcgccaaattccgctcattttccttcaggtggacaatcattttgctaaaattgtcaaaataataaattactttaatttgttgccaattttatccatccgttgcgatttcaaaaatatttcttcccttttaatcatttgttttttttcaaatatttctctgatttctgttcaattaattcgcctttttgtcttgaattgttttgtttcgtaaatttttgcctttttcttgtgcagaatatcaccggttttatggtgggtcccgacgcggaggcgggcggaattgcgaagcacggggccaaattggtgaccgccgtttcgtgtgcagcggtgcccaaactgacggtgctcatcggcgggtcgtacggggcggggaactacggaatgtgcggaagagcgtactcaccgcggtcagaaaaaggcgattaaataaaatggaaaagcaatatttttggccaaaagtaataaaatcagggaccaaagttcggtttcaagtggaggaaagtgtggcaaatttctcattcgtcaggtttctgttcatgtggccaaatgcgcgtgtttctgtgatgggcggtgggcaggcggccaatgttttggcccaagtgcagcgcgaacggcgcttgcgcgagggcggccaatggtcggaggaggacgagcagcagctgaagcagcacattgaacaacgcttcgagcgcgaggcgtcgccccttttcgcatcggcgcgcctttgggacgacggtgggcaaaagggcgacgcatttttgaaaaagcgtggacatgcatttaatcatgatgcccgaccgatccaactggatcgacattttcgggacaaaacccccaagaaaattattttgtatggttttccagattttaaaaaccgccgaaaaagacccaggcttggatccatcggtccagcagaatcttcacgttggacatttgtgatggaaataggaaaatgccccgggggaaacagtcgacgaaactccgtttttaaaacggcggaaaagaggagaaattaagcatttttcacggagtaaccccctcatttgtcaggtgtgattgatcccgtggacactcgccgtgtgcttggcctcgcccttcaggcgacactttccgcacaaaaaagggaaggaaaggcggcggaaacgaaattcggcgttttccgaatgtaaaaagcggcacaaaaattgtgattttatccttgtccaacaacttaagtgtctttttctttttgtgtgaataattttaattttgcaaataaactaagaatttcatgaaatacattttaaatgaattaaaaataatatataaaaaccgtgcgattgtttcgctcgcttttcactgtcttcggttgcttactgtaactcccccgccccgcggcgcggccaattgcttattggaggacattggttaaatggtcgaaagggagggaatttgctattggaagcgactaaaaacctcaaaatgtgatcaaaaattaaaattatacgaattttgccaaatattggaagctcattcgatgccaaaataattttatttaataggtaccggtgaaaaattgcgggagtcaaaagttttccgggacccccgtaaaaatcccgtcatttcttacgggcgggagtaattcaaaaatttaatcaaataaatacacaaaatatatttaatactcaaatttactttttaggaaaaaatcgaatgattgaaaacattaaacactaattatatctaatttaaaatatttctttagttttacaaaacgaaactagcagggac

SEQ ID NO: 16132 - DNA, 3461 bp, Heterodera glycines
  misc_feature (3345)..(3345): n is a, c, g, or t
  misc_feature (3414)..(3414): n is a, c, g, or t
atgcacaatttataaaaaaaaagaaaaaactaagtcacaaagatatgcatttatattgcaaatcggtcaaatataaaattgaattaacaagaaaaaattaatacaggaaagtttatcgaatatgttgacaaagaacccaacgagaattcaaattgaatcactcctaacaagagagggaataaacaggataaatttttaaataagtaaacttggaatttaatcgaataaacaatgtaccaccaaataatacaaataatgaaaaaaaggttaatagaaaaattaaatatttaaattaaaaatatataacaaaataaaacttaagataattttaataaatcttattcaattaaagtaattgtctgttataaatggaaagaagagatatataaaaaatacgagaaatatatataattaataaaataatttcgtgtttcatggaattattattttcttattgaaaatcctaaaaaaaatccatttttaattatttaaacaattaaaattggcgaagaaaaaataaattgaaaaaacaaaaataataattgaaataagatataaaaaaatttatattattttaagaacaatgcagattttagcatttgatgaattatttatattttataattttattaaataaaaaataaaaataattattatttaatattcatagtttatcgatggcaatgggacgcacgtctcttcatgaatatcgagaataattaaattatataacgataaaaaagcttttgagaaaaatgtacatttaacaatgtaaatgaaactaaaataaatggaaaaacaataattttcctttaatttatataaaatctaaattgatataattggcaaaagactaatataatttttaatacaaaaaataatttgcaaaagaaataattttgcaaattttcatatcatattctctattcattgaaaatataaaaagtaaaattcacatataaattaaaaaattgcaatcataaacattttctcgtcaaaaaatcatctagaattcaataaattaattaaatctttggtacaagtaaatgaaaccggtaaaataaagaattaactatttataaactcatcggcataaataccttaaaatggagttaattgttattctaattttgtttaaagtcatataattttatatttaaaaattattacccataaactaaaccgacagaacacacaaatattatatttgaaaaatttaatttctgcaaacggaaatgaactgagaaattctaaaatataaaataaaagaaaaaaaagtttaaaaaaagtttggttttttggtcttttaattcttttttttattaatattaatctccttttattaaatatattagcacttgaatgttaattaaatatattatttaaaattttataatattccaagataaaaatgaacttttttatatatatttaaaaaatataatcggcaatgatttgcaattaagcagctcacccactctggtcaagttccgaaatataaatacaatacattttatacataataataatattcatgtagaaaacaaatatataagcttaaaaagtatttaaagaatatttagaattaattcatcagtctttgcaaaataaaaaatatataaataattttaactttaaaaagctggaaaaatcaattataatgaaacaacaaattttaaatttaataaatatttacatttactcataaataataatccaaattatattattattacatatttgcggaaaataaaattcagatacaaataatagaaaacaaaaatgcaaaatattttaaaatgccattcattacatcaactaatgtcaatttgtttattttttcacagtttaattatatatattaattttaagcaatgcttcgaaagaattacaaatataaccacataaaaacaaatgatttaaaaaataaatataaattttagttattgacaaaaaaatggtggctaatttaaaataaatagggatgcgatttttaagcaaatgcctattttttcatgagctccctgtggcctgaaatgcacgaattattttaagtccaataaaaataaatatctaaagataattttaaaattattgatttaaaattaaaaatctagtgaatattttaaataattttataattttattacttgtgtaccaggggtgtgacttgtctcagaaattggagctttctaaaaatagagaagacattaactaggagagaaagagatttatgattttcgcgtaaatttgaaaatttttctgactgctcaaaagttcaatctttaggggcgtattttcaactctcgcctctcgtcccaaaaaaacgagaggcgagagtaccaaaaatggcgagagttggcgagagacgagaggcgagagttgtcccacccctgttgtgtacctacctattttggaattttttagagcctaaaaatccaatatacgcggacccggttattgtacaaatagccgggcctaacctaccctaaaactaaaatagttcaattgcttaaataaatgaaattcttaagaaaacgtggaaataagaaaaaaaatatacaaaaaataaatgaaaatatatttttatacaaagtaattaattaaaattaaagaaattataatctgtctacaataaataattagtagtataaagcgtataaattcaaaaattttaattggattttttaaaaatgatcaattaatctaaaaaataaaagtaataataattattatcttatgcgaatgaatcgccgctagagataacttaaacgatatagttaaaaagtaaattacctacttaatatgctgattgcacgcattgaactctttttcctaatggaaaaatgagaaaactagaaatattcgaaactataaaaaattttctgatcaaaaatgttacacatattttagctcttttataaattttttaaatttataaaaaatttaatgaaaatccatttgatcaaataattaaaaaaaatacaaaaaaacaaatagttaactttacccttataaaaaataaagacaactatatttaactttgaatcaaacagttgtaagaagtaagttaacttattgggtatttatttattatcaacagccaaatatgaagaaacaaaaattttttgaatgaaacaaaaataggaatcaaaatgatgtaaagcttcattttataaaaaaatattatatattttccgattggggttgtatcttgaagcaataaataaaaatatcatttaaaatttgcttggaattaataatgagttgcttaattttaaaaagttacctgttttcagcctcagttaaattctattaaaaatatcaattcaaaatttgtatatntgaaatagataacagataatattaaaagatatattaattggaacaccattaaaaaaataatattcattnttttgcactaaattttatggtgacatacgtaaggaaatggtgcacta

SEQ ID NO: 16133 - DNA, 1395 bp, Heterodera glycines
  misc_feature (1259)..(1259): n is a, c, g, or t
ggtttagctaatagtgcttcgtcttcccgcccctccgcttcggcttctcttcgctcgtccccctctttgacccttcctcggacaccgccgccgctttcaccgctgtcgtcgccgccgctgcttttgcctcccctcaacaaattgctgctgctgctgctgctagcgctaacggcgtggtgctgctgttgaagtagcaatttgtggatgagaaaatttcgctgctgctgcccaatactggtgctgctcaaagtggccgtcgtcggcgtcctcctcgtcctctttgttgtcgttgtcctcgacttttggttggtcatcgtcgtcttcgccggcttactgctgctgctactgctgctattggtccgataacaacggctaagcttttgatgatggggatgattgggattgggatggggaagatggttgttgtttttcagtccccgccgcggccgccgctgctgcgggtcccggaggagaagtgcaaacggaggcggtggaggaggagaagccgaatctgctgaggatgagtcgaattggtgcgccaatgaggatgatgatgatgagtgtttttgtcctcgcgacggtcgatcatccgcactattagccgccacttcatcatccccatcatcacaatctgctgctgctgcccatgctcgtccaacattctcctcccctttcaccgctttgacggctattagccgtcctccacatcgccgcttttcctcctcctcctccgctctctcctcgccaatgcttttcctcatcaacgtaatcattgcttcaccctttttcaacggcttccccctcccccgccccgcattgctgccccgcttcatcctcatccgtcgccgatttgaagtgctgttgctgcttttgctttcgcgctgctgacaatgagcagcgccaccgctgcggttcgccgctgcacattcctccgtccgcggtgggccaggacgatgatgagcagccgttgctgccaaagccaaatactccgcgtagctgggtggtcccgcggttgctaagccgccattgatggccgtttgaccatcatcattattattgctggccaaattgacggagagtcccccattttgaacaccaccattgttcaaagccttttctgtaggtgaagaagcataacaaaacggtggtggtggaggaggaggaaaatgatgatgttgaagcagtagagcatcaccggaagcaacagcataagagccattgtccagcgccggcggtggcgcaggtactgctccaatggngtcgggttgaaggaggatgagaaggacgggagccgcaggaaacgaacaatggacgaagctgcggctgatcattgtgggtggtgaagataatagtcctgctgttggatcacctcatgaccgctatcattagcgctgc

SEQ ID NO: 16134 - DNA, 1360 bp, Heterodera glycines
aagccgccgattgaaattgctgctggtggaaagcccctctatcattctgctggcgttggtgatggaagaacggcattgcggatggtgatgatggcaatgccaacatgggacagaagcgttgctcgggcacagtgacgcagcacattttgcgcccaaatggctcaaaatcggtgcccatttggtacatggggttacggtatgggtgtaatacggtattacagagtacagtacaaatcaaaaaattgcttaataaaaaatagtaaagttcgatgaaaaacaaaatttgagttcatgccaaaaaaagccctaattcttttcaaaaaacttgtcttcatttaacaattccatctgtaaaaaaaagaccaaaaaaatgattgattgggatagaaaaatgcataaaaggaagggcatggaaatccgtttcccgcttcttctttttttggtggccttggaatttcgattaacgaaatttttgaggattaaataattctcggaattccgacttccaacaattctttagagcatgtaaactaaagctcagaaatttttttgtttttatcccaatttttgattcttgaaatccttaaaataaaattgattgaaatggagaaagtgatgaacaaaaatagtgccttcacgctgattaagcatcagaagaaagacaagcagaaagtgtgaaatggatttgtgaaattttggggttagggtgggaaaagctgctggcggcggcttttcgtctgtcgctgtccaccggcggacagagtcagcggcgcctccgacaaatttcgccgagtttatggcggcgccgaataatggggggagaggagatgaatgtcttattgttgaacgaagagtggtggagggtgggtttcccatttccaatctccgcttcaactcgctccattacacattttacaacaatttaattatctccgtcacccgtcggtccggggagggggggatgtagccagaaaaggccgacaaagggcgtaaaacttttttaggccttaccgcgccgacaactttggcaccgccgatggcaccgggacaattagcaattcacgacaaaatgccaagaattcgcgaaatccaaggagaaccgccaaaggcagaaacaattcacaaaaaaggcacaacaacaacaacgacaaaatgccctgctggggaaaaacttaatggcacaacaaaaaacgacaatgtgatgacaaaaaggccacagaaagcagccgtaattcaccgaaaaaaaagtggcggcacgcggcgaaagacggcacggagaaaaacgacggcacaaatgacgacaacgacgagaacgacgacgacgaaggcacatccgccggtggtggcacaaccgatgccc

SEQ ID NO: 16135 - DNA, 1027 bp, Heterodera glycines
cgaaggggacgggcccggcctgaaacagttggtggagcaggtggtgcgcaccaccggcatcaacgaggtggcggacacaggtgggcattcgtcagtcctacctctaattagttcgttctagcactaatttagtcagtcctgccgctaattagtcagtccattactccttaaaagtcatcccatattactgcctaaaaaatcatcccccctcattatcccctaaaaatgccattcctaattgtccccccccccccctctttccaatcacacagaaacgatgcgtgtcgtcaagggcgagacgtcctcccgccagtcgtaccaacggtcggccaagggcaatgtgtccattttggagacgtcgccggagggcaaatacgtggtgttggagaacacacaccgatcaaaggaggagaccattggagagtggaagctgaagcgtcgcattgatggcaagcgcgaaattgtgtacacattgcccgccaactttgtgctccgcccgatggcccgtctgaaggtgcgttttcgtttttggcgtagagcgcagttagcccgctgatcgctgatcagagcattatcgattggtcagagtgaaaggaagaaaaacacagtgagcggtttaacccaggggtgcgatcggttcttatttgtaagaaatgttctgattttgggctattgttcttattggcaatttttagacaaaatctgttaacaaatcgaattaaaaattacaaaaaatttttcccggcggcgcctatcggcgccaccggacgcccctgttcaacccccaaaattttttgtaaaaatgtcgcaaaaaaaagcattgaatgtaaaaaaggtcgccaatatgaaataattagaggcgaaaaatacaatacaacaaaagttgatgctatattaattgtataaagtgttatatacaagcgatttaagcaatttttgttaatgttcttatttttgaccctaaaatcttattttttggctttgatgttcttattttgaaaatttttcgatcgcacccctggtttaa

SEQ ID NO: 16136 - DNA, 1261 bp, Heterodera glycines
  misc_feature (115)..(115): n is a, c, g, or t
taccaatttcccaaatgtgccacctggcttgatcacaaaagtgccgtgccatcgaaattattaccattttttgccaggtgtgggcccgtaaccagggcggcctgcacgccccgcncggattcactgatcttcgatggcgaagaatcgttcggcgtcggctcaaacgtgcaaaccattctctataatgcgcaaggagaagtgagttggtggcaaacaaatttaaaaaagcaaaaaaaaaaaaaatgatggcattatgccaaagcggcgaaatgccaaaatttgaatttaatgaatccattcccacacaggaacgtgccacgcacatccaacgttcaagccagacagctgcctgaagaggaagagagagataatgctgataagagtgatcactgggggacggaattttaaattttttaattatttttcgaaaaatcgaaaaatgtcccccccccccctcctaagaattgattttcttttttaattttcaaaaaattccccttatataaaattgattttttcaatgtccaaccgacatttaaccattaaattttaccaaattggggataaagtgacaaataatcgataaatttctgttgataaattttaaatttcctaaatttggcgtttttatcacttaaaaatccctgccttaatgtcatgaatagggttataagttgtatgcactaaaaaatgccaaatatgccctaaaaacccgagaaatgcccaaatatgcactaaaatatgccttaaaaactgccaaaaatggtttttaaccctcaaaaaaatgccaaaattgtgtaaaaatacagaattgacttaaagaacatcaaaacaatagctaaggagtatttttagagaattgcaaaaattttgattttctaaatttatatatgcaacttcgaatttttaaaatttttatcatatgctaaaacaaaattacattttcttatatcaacaatttttttaaaggttcttacaaaaaatttaaaatttttcgatttttaagggtatattttttaattcccaaaaaagtcgatcattaagggtgtatttttcatttttattgcatttttcttatgcaaatttgccaaaaaatgactgaaatatgctctaaaaatgcaaaaatggcaaaatatgcatttattctcgaaaactcccaaaatatgcttttatatgcactaaaaacattaaccaaatcaaaaaatttaacgcagaaatgctatttttgagcccccttcttcataacatatgcgtagaaaaa

SEQ ID NO: 16137 - DNA, 1035 bp, Heterodera glycines
  misc_feature (879)..(879): n is a, c, g, or t
tttggcgacggtattggcatttgaaatttgggcaagaaaatatccttgtagatgagcccagcggctgaaggttgctgaaagcgcctggggcgacagggggcgatataggggggatccggtttttcctgtattgtggtgggcagacgcactctcactgattggtggttggttggttggttggtcagcggcggctgaccatcggcgccggcggggcggctggcagcaaatcgcagccgtccgccgctctcaccccgcggcactgacgaaacaaattttttccgcgcgcgcgagcgacaccgcgacacgcaaagcacaaaaccaaacgacgtatattttacgtcagcagctcaaccccctccccggctatgaacccagccaaatagtttgaatgggtgggcaggcgatttggggaagtgatttgttgggatttgtgtttggaagcaaatccgcgcgcgccccggcgctgcgccgcctgaggcgtcaaaggtgtccttgagaaaaagggtgggacatacacataacatagggcggtggatgagagaaagttttgagggtgagatggaagtacaaatggtggaggaggaggaagaggaggaggaggggaatgtgtcgcaagccaatttgactatttttcgcgcatttttcaaaattttattgccccgaaatttctaaaaatctgtgcctgcaaatcactccgacttaagaccaaccgcgaaaatgtcgcgcgtttctgcgtctccgcgcagttttaatgtcagcaggggattttaatgatgccgctaggtcctaattagtgcaataaagtgccaaataggtatattttttttatttgtacccgctcaaattcaaaaaatttaggcgaaagaaaaaatatatatnttcgacctgccaccaccgtaatgcattttccgcaaagaaaaaacggtaaaaaaaaccctaaaagccccagccctactgatgatgagacgtagggaaagaaaaacaataatattagactctcaatgccaaaaatttaccaaattttaaataataaaa

SEQ ID NO: 16138 - DNA, 3482 bp, Heterodera glycines
ctatgagcttcaatccagctacctaatttatgtttttcttattttgagctgtttccagtttagtgcatataattttaaactttagaatgcaattaaataaatgtttttattttcaaatttattcaaaaaaaatgaaaaaattatttataaattgagattaattagaagtttaaaaaagaaagccaaacatttaagctggaaagagagaagtaaatattttgttaatttgcattagcatttgcatggatttattaatgggtggggtgactgaattaacactttcgtaacacccaaagtgccacggtatttctgtctccagcggtcacagcaaaattcatccaatttggcagattcaaaggactcatttcgagcggataaattctcaatctgtcgctgcggcttttgccattttcattatgtgaaccgacctttaattagctttagccaccaaataattatctctcattccattttttgttatgatttatccataaaaatgaattaattaataaaaatgcaaaaaaaaaaaacaaaaaaaactttggcattgatttttttgtaatgagtcggaaatgttttctccgaggattatctttcagcagattaattttcgtacgagaaactgtgacccaattatggccagctgagttttgtcgaacagagcaaaagctgcgaaagtgcccgacgaggaaacccaattaaaaggatcgtacacttaaattattaaattacattaaaaataaataaataaactcaatttattatttacgcctcattggcttcattaattcgcgagtcgaggagaatcctttttttggctttcaaatattaaatctcttttcaaaataacattttgtttttcgacctctgttagcagaaagaaagggggggggggcgatcaattggctcccggacaatccgtcaatggacaattcgtcatgaaattttgtttttgtgcacaaaattgttatttatttttttcatttaacttcattttacataaatttttcgttttaaaaataaattttgctagtggattattcattgacggattgtccaggtatcattatctccccccccccaggggcctattagaattaacatcacatcctgatgtgatgatatgataaatcatatgcatgttataattagtgtcatttcgtcacatcgctgatctgatagtcagatcacatgtggggcgatcatatgatgctctgaatatgatgagcaatcatatgcaacgatcatatgatggaaaagctgttagaattatttttgtctgatatgatgcatcagttcgtcatatgatgatgtaaaataatgtttcaccattagggatttgttttcaggcacaaaaaatcgcaaaataggcacaaaaacccacaaataggcaaataaaattttaaaaaaacgctttttaggtgtaaaacacgtaaaacttaatcaaaacacttatcttttgatttttttatgaaagttaattattttctcgttgaaataatacatattttgggtaggtttgttaaaaaattcatataaaattaactattggtcagaaaaaataaaattatggttcattagaaagccaaaggttcaaagaacaacctattaaaattttaaattatttcattgaactctaaattttttacgattttttgtttaaggctcatacgtggttcggaggggtgatttttggcacagtgaaactctcgtcatatgacgagcatcatatgatttgaaaaaaataattcaaacacgcgtatgactgactaatcgtacgatttgtcatacgccgcctacgatgtgatcgtctgatatgacgatcatatccctggtgtgattatatgatatattctaacgcgcaatgacaatatgatgtgataaatcagacacgggggctgattaatcatatgatttaattctaacaggggtcctacgtctgataagtcatatcatcacatcagtgatgtgatgttaattctaataggccccaggggtaggggtcactcccttccgccggttgttagccaacctttgtccctttgtccctttttcccttttcccttttccctttccctttttctccgttttcctcttttttccctttgacttttcattttttgcccactttcgaatttgaatttgcttcttcgtttgccctctttctcttctgtttcttttctcttccgaatttgcattttttcccttccgctctttcccaaacttttttggccttttatttgtggtgacaactctttcttcgacccttttttacctcattcatcggtccaatttccctttttgacctttcttcgctttgttttgcctcatttcctttctttttgtccgtttaattcctcggcacaaaatttcattaattaatcgctgacgactgataaatttatgttttattaaacttaaatttaaaaaattattttacattgtctttattctgtcagatcgaaatgcttctccctcccactctgtctctctccccgtctctcctctcccttccattctctctcctctctctctctctctcctttctctctcccctctctctcttcctctctctctctctctccccctcatctctctctctctcactccccgtctctcctctctctctctctctctctccccatctctcctctctctctttctctctctctatcctcttctctccgctccctctctatcctctcccttctctctttcccctttttctccaattgactcctccgtttctgtcacttgcacattttaactcattctttttcttttatgtctgtttttgtttttctttcattttgtgccgatttatcggattgttgttctgcggttttttagtccctccaaaatctgttttttttttgatttgagtatttttttaaaaaattttctccttttttctcttttcttctcttttttccaaagtgtgatcttttacgctcttttccgtcctttctcttcaatttgtcaattattttccattttttttttttgccattccttcgccaccaattcaatatgaacaattgttatttatttctgttttttttcattttagcagttttttctatttaacaaaagccccacccaccgaaatcagaagacgaaaatgaacggataattgggagatttatccgattagcagtgatttgttagtcgtaattactctaaaacaaactcaaaggaatttgttacataaaaattatgcatttaaacggtttaatcgcctaacaaataagggttaaatgatcggtcgttgaaaattgcttattttaatcgacggtttctgatcaccaataattgaattatattaattggattcacattggacggacagagaacaaaaagcaaagcgataaaaggacaatggacgacggtaattaattttaggacaattaatggctggtagaaataaatgattgatgggggagggatgagagggatatggctaatgagtcaggccccccccc

SEQ ID NO: 16139 - DNA, 2928 bp, Heterodera glycines
aatttataggtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatctctgctacaaagtagggtgtttttgtcgctttgcccctattttttattcattttaactttttaaaaattcttaataatattgaaatactatataaaccaaccataatgattattgatgcaattttattctctaaaaaacgacaaaaaaggtaggttttatgtctaaaaaaccaaaaatagtcactaaaaatggaaaataggcactaaaaaaatgcgtaaaattttacccataaagcaacaaaatgaagccaaatcagaattgggacacatattttttaaactttaaactccttgtcaagaaaaataaatagattaatttttgagaaaatttttaatttattaggtgtgtgttttttgaaatttttgggtcgattttttagaggcgtatctttcttttttattgtatttttgctaataaattttccaaaaaatgttaaaataagttttttcaaaattactttttgacaaaattaattttttttaacctattttgacgcaaaatcttttacaaattgcacttaaatcttcaaaattttcctctacggcgtctatacgcaccttcggtcacgccaaatctttttaatatgcttttaaattgcttataaaattattgaatttttaaaataaaaatttgaaaattattttaaaaaaataaaattttgaaaattacggattacgggttacggattacggaaaattacggggttttttgacccccgtcatgatggattacggaattccgtaattgagaaaatcgccgtaattacggatttccgtcaatccagttacgcccagccctgttatcgtctccacttttcaaaatgttgatgaattcgatgagatttttgaaacattttatagagtgaaaatagttaggacatgagaaactcaaaaaccaagtttttttaacatttttggtcataactttttgaaacataataatattttttgaaatttttgcaggataatagaaaacactttggctatcgaatgctatcaagaattaaaaatttggttcctacttattttagcggtttttaaagcctaaaattggagctctagttgtaacgtgggctcacttaaaatgccatttttccccacttttaataaatttgtaaaaaaaacattttatgaaaatgccaaaaatcaatttgatcaaagcccgctcattgttcggacagtcggacagacaaagcgcacaaaaattctttgctgataattggcataaactgttcatggttagcattgaaaaagcggccgtgtgagtatttcggaaatcggaatttgggggatcaaaaatttaaggaaaccccaaaaaattttcggacatcggaagtcaggaatcggaattccgtgccatctctgccccatacgagtgaggccgggaagcggctgaatgagtaccttaagcgcgggaaaacttaaggcccgtgcgaacgccacgctagtgttcaaagcggcccggcactttcacagggcactggttgactagtaaattaaaaaatcggggagatttccgttctccatttattaattgtttaagaaactgataactaaacagtcaacaaatttattcataccatcactaattgatttcataatggaaaaacgcgtgactaattgaccccactaattgaccacggcaataagctttgtatcgccagtcactcatcaagcattaaaaatgagagaattgtaaaaaaaacaacttttaatgaaaatgagatttttgaaacattttactgactttatgacctcccgccgtctgctcattttggggttggagccgcgccggcttttggcgtggcgaccggcgcattgacagcgacggcagcgccagcggcctctgctggcgcgccgttgtcgccgtagcggtcgctgcgccgggcgttggcgactggcgatagaagccgccggcggcggacggcaagcgctgagcggtgctgcagccgctgccgctgacgccgcccatcgtcgaccaattttccatcgaccgacttttttgagtaggcggcgcccgcgtcgcccaggcggcaggcgcgccggaaacgcaatttgtcaacattcaaatgcaaaaaataattctaaaaatgggaaaataaaatgtaataaatcatttaaaaactattttaaaatattaaaaaattaaatatttgaaaattaaatcactttcaaattgtcgagtccgaagcgttcaatcagaaggaaacggtcgatcagtggaatttcaacacaattgatcagatgcgtttcgcagcgcgacttcaacacggccacctgaaaacagagcaattagtgtccctaataattaccctaatgaatttaaaaatagtaaaaattaattttttattgaaaattatgggtaaactctctttgataaaggatattcaaatttaagtatcatttttttgaaaatcaagtgctcacggaataaaatttaatgtaatgtctaatattccatctgtaagggcacccacctggaagtagtcggccaatttgagcagcatcagcacatttttggctaaaattggaaatccatttaaaaaaaaaataaaaaatcatattttcaacccctcacgatatatattagaataaatcattatcatgaattacggttgggcagaaaaggtccgttcagataattgatggcctctagaaactgcttgaattgctcccatgtacccgcccatttcctccaaagcgatcattccctgctgcttctccttcatctacaatgtgagcatgcgacagatcccgcaggaaacggacatca

SEQ ID NO: 16140 - DNA, 3645 bp, Heterodera glycines
  misc_feature (41)..(41): n is a, c, g, or t
  misc_feature (3620)..(3620): n is a, c, g, or t
caaataaagttgcatcgagctgaaataaaaaaacaaaaatntaaaattgacaatttgtttggcatactgtgtcggaaatctccaaacaaaaagtttttgtcaccgagcagcctaaaccgcaaaatgaattgatggattatgtaaaatatgatgattgtttgtttatttgatcacgttgatagtgctatcaggtcctttttcgcgatttcttccacctccgtctcggaatggcgtccatagccttgtgccatcaaaacgcttttgtactaaaacgcatattgcatcatattttttaaaatttgttttcttttttacaaataattcaataaaaataaaggacacctaaataaggaaaacataatttaaaaataaattaaatttatttgctttgctttgctttgaaaaagaaattatttaattaaaacactcacaaatccttggaactttttgagtttgatcttctgaaacagaaacttttggaatccgctcatgtgaacggcccaaccattttcggtggccaaccacccaaagtcaatgctatggtcgtactgaaggcacctaaaaaattatttagcagttcatcctcattagtgttcagcgattggcatttgtcaatgactcaggactgaattgggcctcgtaaaacaacaaaaggtcctcccctccccttcgtgccctcctcgcaaaaaaggggggaatttgatcggctcgagatcgtcgagagtgccatgcatttttttttttggtcccttcgctttggtaattccaatttcggcactttcgtttatcagtttgggcaattggcgtaccgaaaaagcgattcttcgatcagaatagtgaatgcgcgacccaacgcgcgttcgtgcgtgctgaggcgcgaatcgatggaaactttgaaatggttgcgcaaatgatcaatgatcagattggagtcggcaaattggcgcccgttcagctcaatgaacggaatttgacctttggccgacgcctttgtgaattcgttgttcacattctgaaaagaacactaacagttttgaacaatatttttcatttaaacgagtcaatggcaaaaaaataaactcggattttacaaaataaagcttatgcctaagcctaggcctggcctaaagcttaggcctaagcctaagcctaggcctaacgtaaaaagttgcccgatttgcctttgtacaacagtgtacgagttgccttttgtacgagttgctcccatttaaacagtcaaaatgccaatttaatttattgtattttttaagactaaatataaaattttgcctaatttttaacattcctttttcaattaattattatttttatttaatgcatttaatattatgagtgtaaattacgcggtatttaagcccattgatgcgaagccatgtctccaatttgagtgcaaatggggatggactgagcacattatgggtgcgtgggaattggaccaaataaaccacgtcgggtttccaatcacgaacgatcagaccgcgcgacgctttcattctctaattaaattcagatagattaaataaaattagaattgaaattaaaatggggaaatggctggtgttatgtcgttatttaaaaatccatcaatatgatttgatgaaaaattatttataacttagctcaaaagcaaccaaatttttaattcttgatatcattcgatagccctaagtgttctctattcagtatacaaaatttcaaaaagatttgttaggtttcaaaaaagttttggctagaggaactcaaaaaaaccttgtttttcgagcatctttggccctaacttttttgaaacttaacgaaattttttgaaattttgtagactgatagagaacggttagggctttcgaatgatataagaattaaaaatttggttggttttgagctaagatataaataaattttcatcaaataatattgatggttttttaaataacgactccgccccaaatgtctgatttaaataaatgccaaaattattttatttaaaaatttaaatgtttcgttgtatttaaaaggattgttccccgccttttctcatcatttggccaacaatttggacaaagtaaaacagacaattggccaaattaaccaaattttgttttattttcacaattgtttgaggtgattgtggcggagactgaaaagattgttgaggtattaaaaacacactgaatgggaaattggaggggaaaaacaggtttttaatttcatttttacgtttttcaattccattaaaatttttattgtcccaaaatcccatcaaaatgagggccaattgcgcaatgattggagaaaacagaggcggagtgggggggggggggaagaacgaatgaatgaacggaagaatgaatcagcactcgccaagcagaagaacacaaacaatggcagcctagtaaaataaaaaatatataaaatggaaaaaatgtaaaatgtaaaatttaaaatggaaaaatttaaaaggaaaaaaatgaaaaatataaaatggaaataaatgtcaaaatataaaatgggaaaaaatgtaaaaatttaaattggaaaaaatgtaaaaatttaaattgtatcagagaaattgcaaaatgaatgaaatatttaaaaaaaatgaaaaataaattgagccgaattataaatcattaaatttactgccttttgttggcaccaattttctccttttatcccactgacaatgcgtgactgacaaatcagtgaattcatttatctttttgcctattgtctccggcactttcttggatttggctcggaggggaaccttcatggcttttcatgggtaccacactggccaattggtcgaaagacaattcggacgacaaatggcaaatttggcatttgtctccgaattgtggttacggcaaaaaattatgtcgtttgtcgtttcataaataggaatacgatttttaggcttaaaaaactgccaaaatacgtaggctttaggtcctaaaaaaccctcaaaataggcactaaaaaccctcaaatttaggggggtgtaaaagggaaaaatttattcaaaaaaataaaaaaaaacaatttttttaagccatatcggtattgagctaaataatttttaaatcaaaaattcttgtcaaaaaataaataaattttgagacgaagttttctcaaaattttttaggctttttcggctctaaaaataaaacctagaaaattagctctaataactcgaaaagtagcttaacaaccaccaaaaaaaaaacaacttatttttcgtcgtgcgtttcaggccactgcgagttcaggaaataaataggctgaaccctaaaaatcgtttcctctctattcatacctcgtcggataccgatcagggttaggcttaactgtgcattctaattacagaccatccgtaattacacccaaccctggcaccgacaaatgcaactaaagaaaaatgccgatacttttttgaaacgtcgataaaaacatgacatgtagttgatctactttattttttttaattccccatcaaagtggcacttacgccagaggaagggcatttccgaatgatcagctgatttgctgtcacatcagtgggggcggcattgggcttattaaaaaaaatttacaaggcaaantatatttttatctaacgcgactcta

SEQ ID NO: 16141 - DNA, 2618 bp, Heterodera glycines
  misc_feature (2586)..(2586): n is a, c, g, or t
tactattttcatgtctctaacacatgtaaaaagatcggtttcgtaaattcgaatagtttttgttataagggtacaaaatcacctcaacatttagaatcaatagaaaaattattagttttcgcattttagttaaaaacagcagtttatagacttaagttataacttgataaaatgaaagtatcacaacttttttctgagatgtcaaactgctgagcattcacttagaaaaagattctccttttcaaaaatttttttcagatatcaaatttgttcggtttggttgggaattaagcgagttatggctgatcaaattaaaaaatacaaaaaaggcatgtaaattaaaaattagcgcgcaaaaattcacgacaattacgctctttggcgttatgaacaattttgtctgacactgggcttgaccaaaacacattctttaaaacaattttgtcaaagaacatttacagtcaattggacccatcacaacggaagggactcgacattgatggtcactcatacggagttcatttttactcggtttggattgttttttgatttaacttattgttgtaaatcattctttgaattcagctgcccggaatgtcgtctttgacctccttcgactggcacccgaccatcagtgatcggttggcacttttacctgtccaagaaaagccaatggcttttgcacattcgattgcctccacgaaacgaattgccataattaaagtatgtcttgcttcttatttttttcactagttttctgttgtgtttagcttcgtgatgacgtcaattccgtcatcggtccttccggtgacttttgcatttcggcggggccgcagctgaactttgaaaacggcgagaaattgttggccaaacccaactgcacttctgacattgacactgaaacactgttcaaacgacgggtgctcgtcggctacggctacggaaattcactgaacgcattggcaagtgagtgaaaggcattcattcagtcggaaggattcaattatttgttctaaaaaagcactgctcgaatattcgaagaaggccattgagagagatcaattcgcttcggatgacttacgcttttgctgggattggctttggatgcaattccaatcggcagatgctaacgaagtgcagaagaattacgggaccatgtgcgaagcattgtttggatgtcctcaattaatttactttcattttaaggttcgctggcattaaacacattttgaagggcacaaagtccagttcgaccatcaaacaggacgaaattacttacagaaaccgagtgagtggaccaacgagattttttggttacgtaaatatttattttcttttcggatttttgtcaacgaaaaacgactcaaaattttgcgtatgtgcaattggcccaactgcgccgtgagggacgagtgcaaggcgcggtttgacgaaatcgcggctcaaaacggagtcttcggtatcactcgcgcggcggcgttggcacttttttcagtgcagggaatgctcagcaaagaggtggccacagtcgagaaaggctttctgacaatgagcagaatcccccccccccctccccccttaaaagcaatttcttatttaatgccatttgttttaatttctgttttccgctccaactttttctattcgggccctcttttagtatttgactcatttgagcgagttcactcattcgcgcgaatttgccgaaacatggtgccgttccccctcctttgtgaccaattatcaacgaatggccgatacggtgctgaacattttgcagaagtacgacggagttcgggtaccgaactatgaaagtgtgtgcgagggactgacaggggacgattatttgctggcaattgttaaggtataatggtgaaacatttaaaactgtttctgtttctccatttatcatattcgttcagttcctcgccagacgtgacaaaatttacaatcggatttacaacgaaatcttcgaaagtgtgagtgaatcgctcaaagttttcactattttcgattcagaaaatggcccttaaagacaaattggcatttgctgccattcacatggacgacgattttctcggcactgccctcgaaaggctcgtcgaacggctcactttggaatttccactgaccactttatttgtcaatggcctcgacgaccaaacggaaagtcatcaattgttacaccggtcagcaaaaacaatcatttgcaaattgaatgcccaatgggttctcctcatttggcattttaagttacctcgacctcaccggtgacctccaaacggtgtctcttcttctcgtcattggcaattgttttcgcggctgcgctgtgtttcgggaagaaacgcccaattcgcccgttggcggcgttaaggcggcggaacttttggagtgcgcaatgtaagcggagaataaaatgcacaaagataaagcaactaactttagtgaagctgaacctcgcgggagtttaaggaggaaaagtttgcattgtttccgcgattatttggaattgctcaaccggtggaaattttggtaaaacaaagttgaaaatattgaaaaaattggtggttttattctgaaatattntaggtagtaaaactttcatctgttcttttttg

SEQ ID NO: 16142 - DNA, 1205 bp, Heterodera glycines
  misc_feature (1129)..(1129): n is a, c, g, or t
tcaaccgtagatagtaatgcgatttggctgaaacccaaatgtcaaatgatgtagaaaaaagggatagccattttctgagaatacctattcttacctacaatgcaaaatttcaaaccgaccatttgtagggctaaaccgtagatagtaatgcgatttggctgaaacccaaatgtcaaatgatgtagaaaaaagggatagccattttctgagaatacctattcttacctacaatgcaaatttcaaaccgaccatttgtagggctcagccgtagatagtaatgcgatttggctgaaacccaaatgtctaatgatgtagaaaaaagggatagccattttctgagaatacctattcttacctacaatgcaaatttcaaaccgaccatttgtagggctcagccgtagatagtaatgcgatttggctgaaacccaaatgtcaaatgatgtagaaaaaagggatagccattttctgagaatgcctattcttacctacaatgcaaatttcaaaccgaccatttgtagggctcagccgtagatagtaatgcgatttggctgaaacccaaatgtcaaatgatgtagaaaaaagggatagccattttctgagaatacctattcttacctacaatgcaaatttcaaaccgaccatttgtagggctcaaccgtagatagtaatgcgatttggctgaaacccaaatgtcaaatgatgtagaaaaaagggatagccattttctgagaatacctattcttacctacaatgcaaatttcaaaccgaccatttgtagggctcagccgtagatagtaatgcgatttggctgaaacccaaatgtcaaatgatgtagaaaaaagggatagccattttctgagaatacctattcttacctacaatgcaaatttcaaaccgaccatttgtagggctcagccgtagatagtaatgcgatttggctgaaacccaaatgtcaaatgatgtagaaaaaagggatagccattttctgagaatgcctattcttaactacaatgcaaatttcaaaccgaccatttgtagggctcaaccgtagatagtaatgcgatttggctgaaacccaaatgtcaaatgatgtagaaaaaaaggatagccatttttctgagaatacctnattcttaactaccatgcaaatttcaaaaccgatcattttgtagggctcaacccgtagatagtaatgcgatttggct

SEQ ID NO: 16143 - DNA, 1686 bp, Heterodera glycines
aattagggagggattggggtcaaaaaatgtctccatctgagtcccacgttatcagcttatcactgacacgcatgcaggacagggcagggtttactttttactttatttctttaaattcttcgaaacgccttttgtccaccaggaagcggacgcgtgtgcggacgcgcacgtagcggaggaatggttccacggcaaagttggccgggacgaggcaaaggcacgccttctgcaggcggcacggcacaacagcaacggcggaggcggaagcagtggcaccaccgacggactattcttggttcgcgagtcgaccaccttcatcggcgattttacgctgtcctttttgcactccggctgtgtgcaccattgtcgcatcaaaggtggcacaattggaggaggggcggagaaagtgccgaaggaattggaaaagggggtggaaaagtgccgaagaaattaggtggggatgggtagaaatgccaaaaaaattgggcggggagtgcctaaataattcgggagcgggtcgtttcctccccccccccgatcataagaatttttttatgaaaactgctaggtttgaaaaaaaaatttcattttttcgggggggggaaacgacgggggggggaatgaagtgcacccaaataattggtgggagggggtgcaaaatgccaaggaattgagggagggtggaggaaaagtgcctttggttcaagcttttaagattggttttaaaattggagacgagcacccgggaaagtccaaagcagtgcttgttcagatccaaaagaaagatttggaaaagatgctttcatccctattttaagcatccatttcgacgggaggtgagcgaaagtatcatttgttggattcggtgaagcgggacacactgtacgagctgatcagcttctacacacacaacgcattggacacgcccaactttaaggtgaacaaacacacggagcagcagaagagacaatggtagcatagtctgatcagcagtgtgcctaatcacttttgtggcgttcggtttttatgccaacgatcgatttattaattaatttatttgatcaatgtttgtcttttttggccttatttctgatcagtgccatcatcagtttggcatttgaccaatcacttctttaatgctttagctgatcaaatgaaatgatcaggaatcgcttaatttatttttggctaaatgattaggttaaacgatcagtaagccttgtctctgatcagtcctaatgcgaaaatcagcagtcctttggcctttgatcaatttctctcctctttcctttcctaaatagtctctgaattgccagacttttctgcaaacgccgtgcccccaaccccaacctcaccttgacaagccgtggttcagcgccaacgcggacaccgaacaggcggaaaagctgctcaacgcggtgcccatggacggtgccttcatggtgcgctacagtagcacggacaagacggtgtttgtggtgtcattacggtattcaattttttggtgggtttcagcttcaaaaatggctttccattcccacagaattgacaacaatctgtgccactttcgcctgaaacgagaaggccgtctgtttatggtcgctcagcgaaccttcgaaacgctgtgccatttggtggacttttacgcgtccactccgttcgtccgcggcgtttccctaaaatttc

SEQ ID NO: 16144 - DNA, 2383 bp, Heterodera glycines
  misc_feature (2377)..(2377): n is a, c, g, or t
gatggcatcgtcgacgatggccaaatgttgaaaaatgatcacctgaaagtgtttcctccgctcagttttcctatcggtacccaaatcactttgctgtcgatggaccaaaatgatcacaatattgttggtgatgaacaacaacacatttgggttggccgttacaacgaaaaagtgagggcaaaagcgaatttggaaaatgtccttttttgatgccggaaaaattccgtgaatttttaaataaatttagaccggatggttcccagcgaaatgcgtgcgaaaattgactgctacaagcggtggaacaacggatggtaacaacatgctcaattatggcacaattgagctaagcgggacaacgtttaaacaggtgcaagcaaacaatggcattttcaaacttggaatttggcgcaaaattttgttatttcaaacaactgttttttaaattgcattgatcgaatccttctcgatctgttgatcagtcgattatggctcccgtacaacatttatggaattgtttccgggatatctaaagataattggaacggagaaatgcaaatgccggaatttaggaggaaggcaaatgagaaatcgggatcctttttgggccgcctttcccgatcacttgtcttcacatattcttgcccgataacttttccactagtcttttccgatcacttatcccatattctattccgatcaccaatttatccccccccccattgggacagtgctcctccgattcctcggccgatcaccccgccgaggacgaccattcgcgccgcggtcgtcgtccgttcgccttccgcgtcactttggccccgtcccattgggacgtgtgcgactacgttttggcggcgaacagtcgcgaggagatggacgaatgggtgaacgcgtgccaacaagtggcggccgaggcgagcaacaaaatgcgacagttgcgcagtcgcgagaaacagtcgcgcatcgccagcgaactgtccagcctcgtggtagggcaatgacaattttaattttgatcaatcacatatattgaaaacaaaaaatgaccaacattggcagggcaatttcgcataaatgcggactgatcagatagagtttgagctgtgattgtcattttcaagattatcttctgattaagaataaaaagccaccttgacgtgtgacaaagtctctgaacaataaaaaattgatcaataagtcagtttgccattctctgattaaatttaaagctgatcagtcgatcagaagatttagtctgaatttcatcaaaaatggatctttgggtaatcaggcgtgatcggattcgatttttctgatattgagaattttcagctttggtgatcagaatttgttagatgcaaacatttgcttttcggacttcaataagctggtcaaattttgtcctttttaacagatttattgccaagcagttccgttccatgccgatttcgagttgcaagacccgcgcagctcattctacgaaatgtgttcctttaggtgcgtgccatttccgaccaatcttatcaaattttggttaattcaaatgcaaaaattgcatttttggcttttgtctgatctgcaatgatttaaaattagcccttttcgatcatttatccaattgtttagcctaaatttcggccattcgtccatttcagtgagtccaaacatgacaaattggtcgagcgtgggcttcagctgttcaacaagcgtcagctgtcgcgcgtgtacccgcaggcgagtcggttcacctccaccaatttcaacccggtgccaatgtggaacagcgggtgccatatggtggcgctgaacttccaaactggcgacaaatccatgcagctgaacacgggacggttcatggccaacggacggtgggacaacgggcacaaattggaaattagcactatctaatcgggccttaaaaattacaaagaattgaaaaaatcgtctaaaaattttaacagaattaggccgagagtaattttagttacaaaactcgagaatgattttaattagttcgagactgaactcgaacaatctcttatttgtagctgtggctatgtgctgaagccgctttatctgatggacgaaactttttccatcaatgctcgtgatcaccataaccacagccaacaacagcagcaccaccaccagcatcagttgcagcgtccggcgttgtcgagcagcacttttgagaatgtgccgtcgtcgccgtccaacgatggcacggcatttgacaaattgacggaggatcgggacgacgtgccgacgaagctcatcggggacgatggacagaaacaacggcaaaaaatgagcaccggcaatggcactttttccgcagcggcaatgccgtccgacgcatttcatcaccaaaatcatncagcaa

SEQ ID NO: 16145 - DNA, 1469 bp, Heterodera glycines
gttggaatggtcattgctctgacaagactgcccaaaaatagaaaattggccccaaattttagaacatatgcatggcttatgaattaataaaattctaaaaattttacggcctgtaggctctcatttcgactccccttccctaccttccacgagctggacgttttgtcgaaggagacaatgtcatcctggttgagacggcggcgcttcaccccacggcggacggtggtcagactttcgctctgagtaaccggcgtcgccaaacgcgggctgaccggacgtggcgtggaaatgaccatgttaggcgtgctgatgttctgcccgacaaccgacgtgttcggactggtcgacggcgtaatgtgcaatctgtggagagaaattttgattaaaaattgaaacacaaagcaaatgaatccaaaaaaataaacgggacagttacaaattcaaccccccccccaattccgctctcttctccccatcaatgccaacctggtctcctcctgctccaacatcttctggtacgcctgcaattcggtgtccaactgcactttgacatccaacaagtcctggtagtcactgatcatcaacgcaatttccttctgcagttgctcaatctgttcgtcgcgctgttgaatgcgaatgtcggcgtcctcgtgcgcgcggcgcaacgccgcctccaagtccttaaaaatgtgagcaaatcataatcagttggtcagggcttttgctcttcgtgtcaaaaatccaaaaaaaaaaaaattctccgaatattttacacttttctaacagggagaaaatttcagaattcatagctttttagacattttggggtcaaaactcaacgaattgggtttcgcgagaaaaaaacaaaccttaacacgacggttcagcgactcgacgatgccctgatggtctttgctggagttctccaagtcctgaacacggacgcgccacattgccgcttcctcgcgcgccttggccgccaagtcacggtttctgttcgcgttttcagccgcctcgcccagcttgttgcggtacagctcatcgacctgaaaccaaaccaaatttctggtaccatccctgacattggtcttgtttttcgctttaagaaaattgccccggcttgctgattcaccctggacacatacctcggcacggttctgcgcaatgcgattgtcaaagtcgtcccgcatggcctgcagctgttcctgcagcttggcctggtaacggtgctccacttcgtcgctgaacgatgtcatttccacttggcgcttgcgccgtatctcctcaatttggttgctgtgactgcgacgcgcaaaatccaagtcgtctttggcggtgtgcagacgattctccagctcagtgcgcagcagcacctcgtcctccaactgacgacgcaacatatccaccatattttccgagttgttgaactcgtttcgaagttgctgaaaataaaaaaaattttaaaaaaa

SEQ ID NO: 16146 - DNA, 1801 bp, Heterodera glycines
attaaaatcgaaatccagacaaaatcgcattattaatccatcccccccctccgcctacttggccttttcacgcgtgaagaactccaactgcttgcgcagttcgtcgattttgatctcgtagcgggccgacaaattttccttctccttgcgctccacaacctcaacctcgcgcacttggatctgtagacgcgcattctccgtctcgagactgcgcacgcgctgaaggaaaacatttatttgtaaatcttaattactggtatttatttttatccattggtgggtttccattgaggttcttaaggctgaaaaactactaatataatcactttttggcgggattcccatccatccctgaaatagcaatggctgttgtgcatcaaaaattacaaacaatgagaaagttagatgaattcaaatgaaatttcgaggcatcaacggaccaccgaaaatttaaaactcaatttctactctataaaaaagcgaaacctcaatgtagccagcaagacggtcgttaagattgcacaggtggttcttctcgtcctgacgcgacgacagatgacccgatgaactgttaattgttgagccattactgctgaaaaaagggaagcgaaaaattagcatttgattttccaaaaagcataaatgctaacaaaaaaatttttttgcatgttggaaatttattgaaatcgaagccatcactgaaaacagttttttaacttaacctgctttcgatggtctcatccgcacttgcatcaatgtgaatggcagcttcgcgctgtgatcgagtcgttcgtttacttttcgaagccattacaatttaggtttaatgacagaagaataatctgttgggaaaatgaaaattttatatcgtttagggtagaccaatttgcttacattttatgcttttcgcgttttgcaacacttagattttatagataaattcaggaggaagcaaaactcgaaagtaacgggaaaaatatataatgtttaaaaccccgtatgtccccttaacaacatttgagatccaattttctgtttaattggaggcaatttaaaatggaaaccaatcgatgtaaccaaccactaaacacatagagacacagcgcgaaagagaaacgcgggattatctaacagcgaatagtgcccagagaattccaagcactctcgccaaaattaaaacaaacaaataaattttgttgtatgcatgttataaacgtaactgtgtgtatatatgcatatgatgttgagggatgggtgagtcacgcaaaaagaaacggaattttcaaattcaaaaactgaagggggggggggggagaacaaatggagcggaaatagccatcatttaacacagaagagagagaagaaattggaagcgaaagcctcttccatcgcaatttttcaaccaaaccaccggcggaggaagggggacagcaaaatgaatgaaaagggaaagagagagagaggacggatgaggaaaaggacaagcgaaacaacaaatcgatggatgatcaaaaggaatgttggggaaggcacatccaaaacaacgggggaatgaggtgggaaacgcgggccatcgaaatgacgaaaagctgttgaaggaactgagtgaccgaaacaaaccattggccgttttatgggcgtattgcaaaagaaaaggacgcatttattcatatttggtaaagtttgaaaacaacatttcgccatatattttcttttttttgcgttaaattataatttaaatattttttttttataacaaaatctagaaaaggatgacatgaatgaagtttgtgcggaccgg

SEQ ID NO: 16147 - DNA, 2225 bp, Heterodera glycines
  misc_feature (2216)..(2216): n is a, c, g, or t
ttgatcaacctttgctttctccgattttcatccgatttcttttgcttcacattttctttgtgctttaataaaaggggctattaaaaagccaactcggactcaataggcgggatcgcgcctagcccctgacttcggtcaggggtaggcccaacgatcccacggacacgcctaatatggtccagctggacggatctcatcttcttttcctacccccccccccccccccttacccgtacaatttacattattcgacggatctcatcttcttttcctacccccctttttttccccacaattttcattatttacacatttcaaatattaaataataaaatttttgctcaaaatattaattaattaattagattttcattgttttttcctttttattatcaacataatattttgttcgggccattatttttcccattttggccattttcctttttttccattccttaattggccattacttttgcatatacactttccatttggccatttttccccttcccatatccatttctttgcattaaaatttcaatttccaatttttctgtttttattacctcgtctcccctaccgttttaacaattttaatttttgaccaacacctttcgcatttatttgccatttcctctattttcactctcttttccccctcccttctcaaattctttgcagtttaacaattaaagttttattcagttaaaaatcaaatgtaaaaaaaaaaaaaaatttaacaaatcctgagagtgtcattaacaccaataacccccgccgtaacagttcactgatttcaattggcggagaatcggcggcattgactgcaaaagcccaaaccgcttgtgcccatctgacgacgacgacgcaggagaagcgcagccaaagtcacagactgaatgccgacaaggaaaaggagcacggccattgccgaaacgattaatggggtgacaaaagggtcccagcgtgatgagtcgacacaggaagttgggccaacagagcaaattacagggctcgcccattcgttaatcccaaagcacatttaagtgcagttgtatcccgcgcaggggatcctccagaattccagacgatccaatgctgaataataatgttttgcgcattaacaccatatgcgattaacttaaaattttattttattttttttcctttttttctctctctctctctctcttttcttttttttctcttttcctttccacaatttacttttggccggcagaaggaaatttggtctgtcgtttgcctactgtcgctaccgtatgcccgcatcaccagtcccatccctccctcccttgttttcccatctcgccattctgtgaatttgttgcctattgcctaacagctgtctcaattcccttccccctcctacgaccaggcagggccccatccctggacgtttggagtttttgatcagagctcattaattaattaatcacaggggaaaaagggttggggaaaagaaatttcagctaacaaatgccagtcccgggacaagacaaaaataaacacaaatggcaaatcacgagaaaagactaacaattaacgaaacaaaaatgcgaaaacgaattcgaagaaacaaaatgaggcaacaactgacgggaaaaatgaagaaaaattgggaaaaacagagaaaatggacaattaattaattgccttcgtagggcacgaaaatggacacaaaaatgcacatcaaagagggacggtagacgatcacattgcgatcacattggcaatcatcatccaatcaacgacgaccaattgtttcattatttttattacaccaatcgacgaacaattctttaattacttcatcacttcattttccaatcaacaattactggagttcaacaaatcttttatttttctgagacacttcgacgacatatttctttaaattttaaatttctcgactacaatcaacaaaattctggatttattttctaaattctggtgttaatcggcgaaacatattctaacaattccatcaaaaacggccgacacgcggagaagatcgaatcctttagaggaagaaggactaaacgaagaacaaaccgaaagggataaaaggctttggctcatccatcaaaaaaggcagttgcgtaatatggatttagacgccctgcggcgtcgaattatgactctcgagcaagagatgcgtgaaaatggtggaactcgctctgggctcccgatgnccgaccaca

SEQ ID NO: 16148 - DNA, 3021 bp, Heterodera glycines
  misc_feature (171)..(171): n is a, c, g, or t
  misc_feature (186)..(186): n is a, c, g, or t
  misc_feature (241)..(241): n is a, c, g, or t
tttgggatccctttggttgccacaaatttattttgattttagtgaatggtttttgcctgttagtgaaacccacaaaatgttcttttaatcagcgctttttggtgcttttgggccgcacttttcaaatggtaaaaatttatatgctgaatggatgcacgaaaaaaaatctantttccatgtgaattntaattggaccattatacctacggtagattgtccaaattttcgatcggtttacctnaattaatgactgacccaaccatacctaagtgaaaaattgaaactaatgccaaaaatttaaatcaaaaacgcagcgttaaaattaaacagttggcacgaaacgcatacaaattgaagaatttcggaccaataattagcacttgggtattaaagaaaacacagcagagagagagagagagagagagaggcacataaacattattatgacggaaataacacaatagagatcttgacaatcacactttgtcattcgcgagttttgagcattcgacgtggaacgttttcccatgaaagttgaacttggaacactccaattccgcggccattctgcccgaaatggactttttgcacgctaaaacaagttgtgtaagtagccgaattgtttagtcgaaagtatgctttgctaccgttgcagtggggtagccacgcgctctccgtgatttcgaacaagtacatctggtcgccttttgcttgctgaaataggcaattcacatgcatgggaaattgaccgacttttttaccgccacacagttgcaacagttgcgctgttcgcagccttcgtcgtagtcgtcgccggcaattaaacgtattaggagataaggcgtgttaagaatcatgaaatgaaaaagcattttctgaagggaaggaaaatgttcacactgaaagattaacggaatccaaatccccctccttcgtctccgcttgagcctgcaaatcacagacgcaaaagtccgttccgtgaatttgtcgtccgtgaaaaaaagacacacaaatgcgtaaaaagaatgagctgtttcgcacctgcacattgcattatataggtagttgttcccttctcgttggtaattagttagaaatttttaagaaaaattcgttctttgaacacttgaaaagtttataaaaagggtcgaattttggatccatcatcactttgcctaactattccctattactgtcctatggaaataatcaaatcgctagcagaacgcactctacaggtgtaaaaattttttttcctttgtaaatttttttaaacaaactttttttgttcaggcatgcatgggggcatcagcaacaaaatgcgaagtttaagcggccttcgttttaatcagaaattaatgtttccccatttgcagttcatcccatccggatttgagccaatgttcaaccaacgactcatcaccgttttctctgcacccgcctacacaggccaaacaaacacgggcgcggtactggaagtgaagacgtcgagccactttaccactcactttttcccgccccaatcccagtgattgattgtactttgttgtattgttgttgttgttgttgtgtttataataaatgctcttttgtgcttcaattgagatggttttgtagggaagagggtggcgagggcggtaaaattttgcgtctgtttggtcggagggttagctctcgaagaactcggtctgcttaattctagtaaattcatgtcaaaattatgatggattttcacttttttaccgttgttcacccactaaaaaaactcatctaatatactgttttgtttataccttttatgtatgtacttgaatatgcataaaattaattgacaacataaaatttgtcgaaaatgttttcatgtgaaagttggatttttgacttgtgtcattcatctcgaacaactattccagctacatacatattgatggaatttatttttgtgaatgaataacagtaaaagtgaaaatccatcaaaaaatttttttgacgttatcacttgatgaaaaatcatagattagatgatttatatgataatctgatgtcagattcgtgatcagcgccatcgataacccccgagcacttcttagaatcgaaaaaacgaccttttttatgggaccaatgatgtgaacgattatgtcaataaaaatatttaaattgaattattttaaagctattttttaattgaatattaataataattttaaaattcgaggttcaacttttcttcaatgttttttaaatgctagcttcgtaccattaataaatgcagaataattttgagtggaaaaagaatagggatgatggaaaatttatggggaaaatgcatgaaatttatggggaaacgaatgaagaacttaaatttacgaaaatattgggtgaaatttcagtagaaaattagtagatttgtcttttttctaaaattgaaaaatccactagtaagcttacttgcaaatcaatttgatgggttcatgatttgaaatttaaatttttcgtttccatgtaatttttttttggtcggagatggaatgcttttatctcttttttattttattttttttaaataatcgtctaattaatttattatttttgacaccgatttgaattgtataattaaaattaaatatttttcatttttggcacatattttagccttttttgagttttagcacatattttggggatttttggcgcatatatatgtacagatttggcgttttttagcacatataaatccgttccctgctaattagataatttttatggcattttgtgcctttttcaagaaaataaccattttaaaaatttatttacatatttttgtacatatttttggcagccctactaatatgaatgatgctttttggcaaaagatcagtccgcggaagagtgtgtccaagtgtggcacccgtgcgaccgactggtggaacgacattcagtgtgaccgtgccaacctcgccggcgttgtgtgccaaaagaatgccgtctaaagttttcagcagaaaaacagaagaaatcact

SEQ ID NO: 16149 - DNA, 2452 bp, Heterodera glycines
  misc_feature (2340)..(2340): n is a, c, g, or t
cccccccccccttcagattttctccacctttctgatccccggtgctccgctgcaattgtcaaacattgcgcagcgcgacattcagtccattgacaaagtgttgcgcgcaattggccaccaccagccaatggcacctccgctggacactgcggctgatcagttgcgcaaactattcatttcgacgcgcactcgcgcagtcagtcaaatcaacgaacagttggccgactttcgtcggcggggccaaccctttggtaagcgattggcagggctttacactattgaatcataaagctgaaattatatacatattttgccattcttttagagttttaatgggttcaatggataaacactccaacatcaaagagttttgacattcatttttttgaatttgcattagtaaatttggcggttctgccaaaactgttcccaatgctttacttttgctgattattttttattttgctttcatttggggtttggcttctcccttctactcccaaatcccttctctttcccagacccggcggatggcgttgacgcggctctgctcgactcgctgacttcgcgcgcggaccgcggtgccgaattgcgcttggccagtcgactgttgttcaaggccctacaaagcttgaccaaatcagcgactaccattggtgaggcattatccataaaatatattgaattgcttttcaaattttcagctggcggaatccccgactttgagaacatcgaccgccgcacactttcactaatcacttccatcgcgacactaattaaggcattttaacactttttgataattaacaaatctttttgattgtcttccacaggtcgttttctgtttgcgcactaccaattcagccctggaggcaagtcacttttttatgagctgatggttatttgggcaattaatttgtgtgtgatcgtggataattaccgttgttaatttcctatccatggcttaatgctcccataattaaatgagatggttggacaattattccatctctttcattttgatttgttgtttttttatttgccactttcttttataatttattttcttttactcgccctttctgactttgtttttttcctctttttttattacttattttctgtttctctctctcacttttacacactctctcactcacttatctctcatccctcctccgattttgatttttaaattcaaattttcccatacagaagctattagacaagtgcccaacttttttgatgccgacctcaaagcattccggcaccggcacttcaatgttcaaaatgttggcatcgtcggccgccaagcaaaagtttcagctcaaagaccatcaagtgattttaatgaccaattaattaacaatcatttcttttttattatgaattttgtatttcttcagtttctgcttcaacccgttctgctcactgtccactgttaccaatggtccgatttttaaaatgatttattaaaatttcataaatttaattgttattattttgattcagtcgtgaagtcgtttggggcgtcaaccctcaagcgtatttctgccaaagtgagtggagcagttgcagcagtgatttttggccaaatttgcattcattaggccaaaatcctgaaaaaatataagcaatttaaaagccattccacaaattgccccggggatgacattttattttggcacatttctttaatcaatcagagccaattagtctaagagaagaaaggttgcttttttcataaaaatgaattttatttgaaaataaattcaaattttattgaaaaaacattgcaagaggaaaaaaaagaagaaaaaattgcccattttcgccttgtgcgatttttgacggcacttttttggggatgacagaattcccgtgggcattttacccccggctttggactttgaattttgagaccattcccaaggccaaaaacccatccatcacttttttgtcggtcgaacaccccccgggggcggtcgaattgcatttttgtgccgcgggggtgccaaaagtcgggaacaatcgacgccaaattttgtgctttttttccacaacaccactacaatatttttaccacagattgtgacgtggtggtgcacaaaaattgtacttcacagctggtgagttgtgccaataccaacggaacgccaaaaacaaatttttgaatttcaattagagcccgtgaatttaattaaatattcataaaaacatatttaatgattgggttttgaaggtcaatcttttaatgatgaaaaactgacaaaataatttgtaagcagaaaaattgaattacagtttttctttcagtaggtttggtgtgattttgggttnaattttgaaaaatttatttgaattttaagttgcagcggtgccgatagataccgccgaaaaataaaatgttcaggaatttgaatcatttattgacagattttcaatcacaaat

SEQ ID NO: 16150 - DNA, 1792 bp, Heterodera glycines
gtagaccgtcgtgccgagggcgtggcatatttcccaattctttttcagcaattgcttttgctcacttctctgtcagaatgttgctgggaactttgttaataatggcgtttttctttatagaaagcaagctccaaggagggatcaagcattgacaagcatggaaatgatctgatcccgccctacgaacatgaactaatgatcgatgccgatcaccagcacctccaacaacggcagcgccacccgcaagtgatcggcaacagcagcagtgccgccatttcacccgccaaactgcaccatcttaaaatggaaagtttggactccagctcatcgcctccgtcgtcggtacgccttttggtggtattaccggccaattaaggcatcaattagggtaattgatccggtggcattgattgacccagtagttttgttgtctctccatttgtttatttcttagtttagttgcaaagatgaatttatcgatcgaagttttcagtttccttttttttaggccgctatgttgccaccacccgtgttcagcacccgttttgaacgcattgcgccaccacgaagtgccatcgtcctgcacagcgacagctgttgagactatacaaccggtggcagtaaaagcggacgggaaagtaggcgcaaatcgtaggctttttaaaaatacgcatcattagcccaacggaaaggccccaccaaaattggcacaaccgatcacttcgatggactcgggcatttgtacccaggcaagcagccatagtgccgcaactgcggcggctatggcagcaacgccacccgctgcagcggtggcatcgccggcggcgtcggcgacgacggcaccgccgacgcggtcgcaaagcataaaaaaagtggtcgaatttcttggattttaattcatttttcaatccaatttgaattgttcccaaaaagactgaacatggcagttcgttgaagcggggccccggcggaagtttgggcgcggcggacagcagcggggcaatttcgcaactcgccattccgacggtgggggcgctgaaggccagctcagccggagacatcgcgcaacagcaggtggccattttgaattttgaaatttaatttcaaaaataaaatgaatcgacaaatggcattttgatttgtcttttccaattcacttcttcctttttgctcagtctccccactcttgcttggctggaaccagctcgacctcatgtgttgagctgaacgcggaggcggaggagcgacgcctggtcgagctggtggagaagttcgacatggactggggcagcgatttggaggtgaacagggaaaagcgacgggcgcggggcgtacaatccattaatagaccgggagaactgagctttctttcgtcgtttctccaaactttttactgccaattcaaaaaattattttaatttagattttttaaaattatatttagtccattttaaatttatttattctcttaaatttaatttttcttttccatgcgaaggttgacactgaaattccgagtctcgagtcgctggtcagttgggaaattctcaagcatctgaagccaaaagagaagaagcgccaggaagtggtcaacgaactgtaccaaaccggtaaagagcttcgtattactggcaaatgagttagataaggcaggcggtgatcagggctgtgcgaaaatcacaaaaaaactttttcgtatacgaaaacgaaacgaaaaagtgcattcgatacgaaaacgaaacacgaaacgaaaaaagatatttgaaaaccgaaaacgaaacacgaaacgaaa

SEQ ID NO: 16151 - DNA, 428 bp, Heterodera glycines
caatcagcagtacccgtatgcataaagatcaggatcggatcctcggatcttgatccacgaatcactgattcgaggatcgaaaaatccgtggatcaaaatccgtatgcataaagatcggattgggtgatccatggatcatccgtggattgtattccttttaatcgtaacttagcttaaacttaatcaaattaatgaatttttgtatgagcaacagctccaagtatccgctactacttatgtaattttaaaaaaattactaaaaatttacaaaaagttgtgacaaaaaacttccaaaaaatttagactcaacaatttataccctaactttttttgaaattcaataaaattttttgaaataaactgaataatagagaaatctttgggctatctaattattttaaaattaaaattggttctttctgaaaaaa

SEQ ID NO: 16152 - DNA, 2614 bp, Heterodera glycines
  misc_feature (926)..(926): n is a, c, g, or t
caaaatgagcaaaatgataactctacagcagttgatcaaatgggtgaagaaatgggaattgacccaaatgatcaacaaaaaagagaaataattaaaaaatttgatgcaattaaagaaaaaattagagaaaagggaaaacttgaaataaaaaataaaaataaaatcgaatgtaaaattggaaaattattaggcacaagtcgccataaaatatacaaatggaaaaaagaattaaatttaaataaaaataaaatgatgaaaaagagtttttatgaacagaaaaagaaagaattcattgaacgaattgatgaatttaagagtttatatagccaaggcaaacagaaagaatttgtgaatgaattgggaattgatgaaaagacatttataaaatggaaaaaggaattaatgccaaaatactataaaaagtatgagaattgatgtatttaaattttaaatattttatgcattaagtaattattccaatgaggacaaattaaaaatgatgaagcaatattccgaaattaaagaaataaatccaaaaatcaaggacgaatttattgctaaggaattgggaattaaatataatacaatgagaaagtggaaaaaacaattttcttccacttaatccagtgtttctatcgaaaatttatcaaaatcagaataccgggcttcaaaaatcagattttggggtcgaaaattagaacattttgcgaaactgcttcaaaacagttgtttttacattgtatttaatcaaaaacgtattaaatattatattttcacctcccataatgatttgaatagtatggaggagtaaattagcaacccgtaatttcattgtaatgggaattaaaaaatcagattttaacaatttttttgcggcgcattacaacaaaaaaaattttcaggaacgggggggggggagtggggtnccggcgggtgccgataggcgccgccggggaaaaatttttgaaaattgagtgcaatttgttaacagattttgtcgaaaaattgtcaaattttgtgatttttgagctattttttatgaaaataatggatttttagggtccgacggtgccaataggctgccgccgaaatttttttgaaattttggcaagtttttaacggatttttgtcaaaaaatgagcaaaatttgcgtctaactttaaaatttctagtaaagtaatgaatgacattatgccataaaatttcaaaattttttgtttttttaagaaatcagaacaaattttgttcgctacaccgaaatcagaacatttctgacaaatcagaacagatagaaaccctgacttaatcagcgatttcgcattattattataaaaagaactaaatcagtgacaaacatttgcttaaaaaattggaaaatggaagtaaaacaatgcacaaagtttgattttgcgtttatgtcatgccttttctaataaaatttaaactttttcacttatccccctttttaacactctttgttttaaaagtttgattttttgtaactataaaaccgaacgccggacccgaattcgaacaaaatgtcgaaattcaatttttcggatttcgcatttttcgtctaaaaacgggttaaatgttatttaatcgcaaaattaaaggctttcagcagtttgtgtccgtgtatttcaactgattttgaattaaaaattccaatttcgaaaatttggaatttggactttttgttcgaatttaggttcggggttcggaattcagaacattgttcttatagaatttacttttatactacaatacttaatgctacagaattttattttaaaatatttgtatcactgacgctttttccggtcacgaattaaataagaatgtttcaaaattccaaaattcattcaaatccaagtttttctcaaatattttcaattttgaaatataagtttcaaattatagattaaataattgagtttattatggctatagagtgatacaagtttgtaggattgggtaaatataaagtaaaaggttttatgatgctctaaactaggcctgtgacagaattggcgggagtgaattggcccactccggtataccgtaatcgcaaaatttacatatatacagtatacaattaaaatggcataaattgcaaaaataagaatatttattttggatgcttatgtaattgagcatttaagtcaatcttacagccatcaacaccgtttaggattgcagagcaaacacacaatgcacataatataatgggggggggggggaagaagcatttcgcggttgacggaaggcttacgccagccgatgccggaccagctgaggcccataagacagagtcccccattagagaatttacccaaaactaggcggttggcccaatgacacaaaattcgaatccgaaattagattctttaaaaaagcttagttcaggatccgaaaaagatttcaggatctgaaaaagaccggaattctagaatcaaatgttacagaattttggtgatctatctaatgcaatggatttaattttataattaaaattgtttaataaaaaaatcaaaaaattcctatgctaaatgtaaattcatagaaatacaaaagtcaaccatcagtttttgcattttggattatacgattt

SEQ ID NO: 16153 - DNA, 942 bp, Heterodera glycines
  misc_feature (868)..(868): n is a, c, g, or t
  misc_feature (909)..(909): n is a, c, g, or t
atttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagattaatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggagtagctttcctatagcctgtactttaattctgcgttggatttttgctccccataattttatttacatgttagtttaggcactctgatgctttttctatcaaagcctaaactttttggcctgtttaaaaaggaattaaaaattttaaaaattttattcatctccctttttaactttttagtgaaaattcaatcactcatttttcgagtagtgatcagaagcgcaccagattttgcaggggcctaaaaaggtcaaggaaaggcgtctctgcgttgatttagcagtagtacctatgaatttagattntctatgaatttttaagttttttgaaatttttttagtgcaanagtggtggtgtctgcaaaaaattttcaccgggt

SEQ ID NO: 16154 - DNA, 2229 bp, Heterodera glycines
atgcccgtcacaatgttcaaaggcgggagaaggcgttgatcagtcccttcttctccagcgtttccatcacgcgcctttcatatttctaaagccgatcaaatggagaagctccaacaaaaggaggaaacaccattcgacctgcttaaatgtgtacggctcgcgagcaatgacaaacagcggaaaattgcaattgatgcccaaaatggcgtactcatagcgacgcccccggcgaaatgccgaagagggaatgccatcgccgtaagccgcgtcaatgacgcgcactgaaacggacttacggaatgagccgcaacggcagcctttttccattttattctgcacttctttcccaaccattgacttcctccggcgtgtttgaacgtctgaacacaatttgtccgggccgtggcataagggcatagcccgaactcagcagaggctgttgctgcattggcattggcattgtgccaatgctttcgtgccaattggcaaatccgtcgcgtggcgttgtccgatttccttttggactcgtaaattggagggtttgaaagacggaaccgacgccttcggtggaggaagaacggctgagcatttcgtaggagaacattgtacacatggaagaggacatcaacggactgtgcatcaccttaacggcacttttgcccgattaatttggtgtgacatttctttggcccacttcaaaccattgacccatcagagagtccaattcgaagttgtccatcgtttccccaacagaacaaagcggagccaatggcgagttgaggaacttttgtatgcgcgtgtaagtgctctcttcgccgtaggatttcttctcttgcttaaccgttagcgaggggataattttagaatggcactgcttccatccatggacattcgacccttccgctggtatttaggctttccaaagtcacctttgtgacatgtcgtgaagaatggtccatgatccattcggtaagcacctgatccaattcggagcttgcctttgggttgttgatgcccataaactgcaacaaactgctgaccaccccttgctgatagcttgacttgtctccatactgtttatgcttcattatttccaacttaacttgcatcccccacttggaagtactgcttcgtcggcttggccatccgtccgtcgccctccgccaatgatttcccatgcaaaacggcgccctttgcttttgggcgatttccaaagcttttcacggattttgtcattccgtcgattttcttttccacctttttagcattcagttcaagcagttttgacactatttctgttggttggtcttcctgcggtacgatgaaatccatggggacttttgggatgaatggaatttgctttggaatgccgctaatggacgaggagaaagacggcactgaattctcttcaagttcgactaattcctcgccagagccttccatgaactcgtcgtgctcctcctcctgaaacagcagctaatttggtgagttgtatagctagcggatgcttctttgaattcaataaaattggaccgttttattgtgtgctgcttgtgccattccgatgccatccgtttttgtgttctgctgctgttgcatttgcttctccttctccgttaggtacggtattcgctccattgcacggtagcgaccgtcgagaaaattgtccaaactccgttcaaagtactgtactaatttgtcttttgacgtcgttggacgggtgaaagtcggcgcgtttgtcgtgtccatgaatttgtcaaaaggcgggccgaggagagagtgcaaatcgacgccgatgatttctttgatcactttttcgggcggcaaatccaacgaaaagtaattgcggattgcctatagttgtttcgatgattagtttctcttttcttttcctttttttccttttcctttttttgcctgagggatttccgtccttcccatcaattccatgctttgtgcgtctttttgtttcagttggttcagctgttcctgccatatgctttgtgggtcgggtggcttagcgaattgaactccttgaaaaacgtatcgatgcgatggtcggacatttttccgaccgtcgttcggtgctgtgtaagaaacactccacgcttttggaaaggtttttattattaaaatttccaaaatttaccaggtgaatgttcctcttggatgaaagaatggtgggggcctaaatttgaaggaaacggtgggactccgaatcagcgagaa

SEQ ID NO: 16155 - DNA, 1539 bp, Heterodera glycines
tgcaaatcaacatttctttgataataaggatacagcaaattttaatgttacatatataatgtaatgttatagagacaatggtcacataatcatcgcgagactaatattttaatcatctcctcaatttcctctgtttgcctttggtaaagcgaccgttaatatggcacatgtccaatcccctcatggtgcggatgtgatcaatatgcataagaatagtttagtagttgttcactcattgctccaaattggtgagagcctcacacaaatttttgcactgcatctcgcgagaacatttgtcatatcaaatcgtccggatgttattaatctgcagctccaacttgtcaagactattgcattaggtaccaaagtgtcaattgctgtatacatactgttacgggttttgtatgtctgactgatataaggcatgaaaagatatcagcataaaagtgagccacagattgtaagtaaaaagtatgaggagggggagggggacgcaagaagaatcttccgtctatgttgttgttgacgtttgggtattgaaataaaagtcggaaggaagacggacggaagggaagaaaaggaccgaccgattgaatgccccgggggatggatcaccgaatgataagtgataaacaaattatcccattccttcaattctcactacgaatcggtataaggaaggtcaacttttggtgatcatttcaccacatgcaggtgcttcgcttgtcaaagaattaacaaatattaattgggcaattattaaatggacaattattatccaactctaaaaggactcatcgctttcaactcattctccaccagaaaaaactagagtgccacgggaccgggaattttgggcaaacccgggaccgggaccttttcgggttgaaaaaccgggaatttttggctggaaaaccgggaaaaaaccgggactagtcccggtcccggtcaaaaccgggaccttggtactcagttgtactcagttgtctgctaccaggtcccgtggcactctagaaaaagcaaagcaaaagcgattggcaagaaattagaaaaaaaaacaattggtttaaatttttattgttctaaaaatttttgtgaatgtaatgtgaaagagtcgtggattaatccgatgacgagttttgccaacgccaattgcctttgccaatgccaacgatgcctttgccaatgccaatgatggctttttcccatttgctgtgccttcctttccccaattcattcttttcttggcattcgatgttttctctctcgtgccgttccccctttctcctctctctctttccgctgctctttttttccgttctgtccctctctcaccgccatagaaaaagccatggcatttccaccgaatcagtcgacgacgaaacggacacttttccgatcagtcgccaatggttgcgaaactcggcaaacaaaacgaatcgaaaagacaatgagcaaagggtgaggaaaattttaaggtaaaatcggggggggggggcaaaagcggaacaaatcacttctgggtttagtggcggagaa

SEQ ID NO: 16156 - DNA, 722 bp, Heterodera glycines
agtctgaggcaagtttagaccaccataacttttttctttgttgaccaaatccaacaatgttggtatcattcgaaagcgcttaacaagctctatcggctatccaaaaatcacaaagacatactgacatataaaaaagttataaattaaaatatgcaaaaattctgactttttggtagtgttcatgttgcagcttttttataagtttttcaatcgcttagcaatatcttatcaaaagcttcttcaaaaattatcatttaaaaatctaaatttctctctgaatcctaaaaataagactaaaataaggacaaagagcttaaataaggacaaatcttacaaataaggacaaagggtaaccctgctctaagtggctgactatggtattaaaaaaccggtacttgtgcggtttacatgatacttttaacatacattttcagattcctataaatgtgttttagaaattaatgaaaataaggggtttttagagtcgctgatcacgaatacagcacccatttttgccaatttcgaactcctgaaccgaactcgaacaaaaataaaattagaaaatttgtaaggatgatatcttggcatcttgcccatgagggtaacattggtacaggaagcctatcaattctttttccctgtacagctcatgtagtgaatggtagcgctgatctgagcccggattcgtgatcagcgacctcgagaaccccttattacttatt

SEQ ID NO: 16157 - DNA, 2064 bp, Heterodera glycines
  misc_feature (31)..(31): n is a, c, g, or t
  misc_feature (122)..(122): n is a, c, g, or t
  misc_feature (132)..(132): n is a, c, g, or t
  misc_feature (1937)..(1937): n is a, c, g, or t
  misc_feature (1939)..(1939): n is a, c, g, or t
  misc_feature (2052)..(2052): n is a, c, g, or t
ttttgcatattttacagaattttaacaattntaagaaaatccaaattaaaaaaaatgcaaatgtcaaaaaaaatttagctaatggtagccgtttgaatagagtgtaagcgactaacaatttntaattttatntaataaaattcggttacatttgaatcagaaaatgacatttttagaaatagtattattttatttgttggaatacatttaaaaatgggtgggtgtgggcttcttcttttcctcccccttcgtcgtcatgtttcgtaattgttgccgggcacagtccgaaggcaataagttatgcccagcgagtcgagcatttgtgccatgcgctccctggacgccttcagacgcttcatttcggtgccaaattcggcgaacaaacggtcctggaaaaggggccaaacacatggatcgagttgattccagaaaaacacacacacacggctatttgaatcccgaaacccgaacaaacatagattcaattgaaagagcccggtctcgaaaaagttcaaaattattggacactaaaattcgaggggccagtgattaggaatttgtcagtaatgaatgccaaagtgtgggtcagtcagaacgttttcaaaatgcaaaattcgttgaataaattttcaaatgtaaaatgtaatgtaatgagagagcgtagcattttcgaaatccgatcatgggatgcgatttcaaaagccaaaatggaagcatgtcatttttctggggactgcccagtctggtacttttcaaaaattaaaaaaaaaaataggtcaattttaatttaaaaaagggacaaaataggggaaaataagtcaaatgggggtgagaaatcctcaaaaaagcaaactccaaaattgaaaaaacgcacaattagcacagggttcagtgacaacagttcgttgtacagtttgctgttctcggcactgcgcagccaattgaggaagcatttggtcaactaaaaattgagggaaaaatgtcaattattaaatgagataaattatggttcattaagcccgaaaaaaaacgtggacatgggagtcctattcagaatttaaaaattcatattcgagtgatgtggaaaatcctttttttagatatttttggatgaaaaatttttttttttcgttttccccacaaataaccaaagtaggccaattttgaaaatttaaaaggagaatttagattttaaaattccatgagtgattattccttcacctccgcctccccaccatccgtcgttgccgtcgcgtccacggcagccccccgctgttgctgctgtccgtgccgttgtttgtccattgttggcgccgccatttgtccggcaccgttttctttggcattgttggcaaatccatcgccgccaccgtcatcgttttgcttggcataattctctgtcgtctccgtctcggcatttttgttggccaaccgcaacatttggccaattttctgcttggtcctccgttcccgttgccgttcagccgccccatttttgtcgccgccgccgtcgtccgttgccaatgcgcgccgcactttccgcgggattggcgtgtcgcttgaaatcactggaaaccaattaaaaattttttttagggagagggtaggcctacaaacgaaaactaaaaaaataattggaaaatccaatttctcccaattttctaacaattttttagataattgtttaaaaaaatctttgaaaattttaaagtttttaaaaaatttcggtggagaaaacgaagaaatgaagtatatcccaatttctgatagaaatttaaagtgattttcgaaaaattacaaaattttccaaatatttcaaaaaattttcgatttttatggaatttatacttttttataaaaaaaaattgtataaatgccaatggctcttaggaattctaaaaaaattgtagcacattttttaaattttgctaaacctngngtgtgttgcctcataaattcggttcaaaagtcggatagccgcacgttttcccatcggaccatggccatatttggcaagttcggccttaaattgacaaataatattaaagttgngtaattagaatt

SEQ ID NO: 16158 - DNA, 2190 bp, Heterodera glycines
  misc_feature (148)..(148): n is a, c, g, or t
ttttgtgtgcttttctcccccttttaacgctaaaattcgctttttcgtccattctctgctgccggacaatttatgacagccgatgaatcgaaacgaaaaatgataaaagggacgacggaaattgaggggggggggggggagacgaacnaaacggtgaaatgccggaaagaataaattatccgaaataaattaataaaatttataataaaaatatttatatatcatttaattaattgagcaaccgattcgaaataacaaaaaatgagcaattcttcaaatgtatttgagcacttcgtaataaatggccagaatcagtgcccctgaagtgcacctcagcgaattgctcagcgcgcctttgtacagtgacagtacgccttcagtacggcatacggtagaaaagcattgccattgagtactgtactgcttgaattcactgcccgcttccaacattaaccgacggcggacagtatccagcggatagcaaaccaaactggacacaattatggaaaactgtggagggaggggggggggggcaattaaaatgggcaaatggtgccacaaaagcaaacccaaaaggccgtctcacctgagctaatgaccaaattgccgcgaaagacagcgcttgtcgccgttcctccgctaaggtcagccgaatggagtcgaaaatgccgaaaaaaacggcacgggagagaaaggtgaagttaagagaagcgagaaagccgcggtaaagcccagcagtgccttcgcgggagcgtatcaccgaaaagcagtgaaacaagccgcggtgcacacctccgtcaacggcaagtcgggtgcgcgcgaggtccaacgggtaacagaagacgagggtcaaagcggcacccgcaccgcccgcagcgacattgcctgagggcagagtcaatgactgccgacaaaaggcaaataaatgaatgcctgccacaaagcgaatgggccttttgcgacattcgatgccatccaaaaaggcgacacggaaccaatcgcggaaggccaaattgagcgcattgtgcggaaagcagcgaataacactgctgaatttcctcgccacagcgaacggatgccttcgtcggcgcacaaacgccgcaaacaatcgacgatgccgcggtaagggagcgaatgggcggaggggaggcgaacaacgggcatatggggggtgggaacagcggcattttgcaactgaatgggcgaaagagtaagcaaaagcagacgagggggggggggggtaattagggataatgacatggggtaaggtaactgaggatggtgacttcattagggtaattatatcaaaattggaaagaacggaggcaattgcgctatgcatttagcggcccatttccaatcggtttttgctcaattttttcttgcctgaaggcacaatttgactctgtccatcggtgccactgttgttttggaaatggcagccgcaaatgcgccagcggccattcccttcagggcatgctgattgaaatcgcttagctgagtgccaatgaccgatgaggtggaagggactgtactcatgcccaaaaatttgtacaaaaaatgcacgaaatgcccttgaaaatacaccaaaaaaaagaattttaatagaaaaatgaaataaaataaaaatcgaccagagagcaaaagaagaacggaaaacaaacaaaagttaattttgggataaaaacggaaaaggctctttggcctaattaaaatggacgctcagcagcccatcccttcctccgttagcaccatctcttgcagcggcggtctttcccggtgaattgttgagcactgctccccgcgtttattgatcaatgtcggtctctgaaacgacgacgaagggacctccccccccccaactttcgaagccaaccccacccccaagaaaaggcaatgagtgaaatgagctaaagaagcaaaaaggaagcgcaaaaagcagcaaaagccaatcagtcaaaacgattaggcaaatgaagtcgaaatatttgtggtcattcggtcggttttatttaatcattttggtgccattgtcgtgtttcacttcttcaaatacattaattttaagttatattttttggaaataagtaaaccctctcagttttcaaagcggcgatgccaatcttccaagaacataaattttatgagctttgcctaggctctgattaaaaaagcatacctatgcatttt

SEQ ID NO: 16159 - DNA, 839 bp, Heterodera glycines
ttagggtaataaatcaaaattgaaaaaacggaggcaatttcgttaatgcattaagcggcccatttcaatcggttttgctcaattttttttgcctgaggcacaattgactccgtccatcgggtgccactgttgtttggaaaatggcagccgcaaatgcgccagcggccattcccttcagggcatgctgattgaaatcgcttagctgagtgccaatgaccgatgaggtggaagggactgtactcatgcccaaaaatttgtacaaaaaatgcacgaaatgcccttgaaaatacaccaaaaaaaaaagaattttaatagaaaaatgaaataaaataaaaggcgaccaaagagagcaaaagaagaacggaaaacaaacaaaagttaattttgggataaaaacggaaaaggctctttggcctaattataatgaataaatcattaaaaaatattagaaatgctcattcccaacaaatggacgctcagcagcccatcccttcctccgttagcaccatctcttgcagcggcggtctttcccggtgaattgttgagcactgctccccgcgtttattgatcaatgtcggtctctgaaacgacgacgaagggacctccccccaactttcgaagccaaccccccccccttccctagtacacacatactaaccaattttgatgatgatggaaaggaagtgataatcatgtgaaattggaatggaaagattgcataaatggaaaaaaaggttcaaaaaagaaaagaaaaggcaatgagtggtcccagtgattgaaatgcaggagaacagagtcccagtgattgaaatctggtgggttgagtcccgacgattgga

SEQ ID NO: 16160 - DNA, 970 bp, Heterodera glycines
gcgaagcggccgagtgagtaccttcggtgcaggaaaatattaaggaagagagttcattatttatttgttttttgcaaaattaattcataaatattttttcagaaagtgctctgaaacacacaaaattttatttacaggttagtttaggcactcagatgctttcactatcaaaaagggagatgaataaaaatctaaaaatttttaattgctttttaaacgagcgaaaaactttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaacatcgatataatctctccaaattattgcaggccttctccattgtaaaggactaacttaacctgaaa

SEQ ID NO: 16161 - DNA, 3252 bp, Heterodera glycines
gccgataggcgccgccgccccccccaagaattttgagtgtaatatattaacagaacttgtcccccaatgatcaaagttttggttaaatttgcagttttaggctgtttaaaaaaaagaaaaaataataatttttaaattgaaatattttttattaattaaaatttcaattgaaaaattatttaaagaaattatttaaaaaattctgtaccgttggggaattgaaccgaagagaaaaataatgaaaggcagaaggtttagccagcagaccatatttgaattagagctatccaaaaatagagaaaacattaaggaaggaaagaaagagatttaagattttttttcgcgtaaatttgaaaatttttctggctgctcaaaagttcaatctttaggggtgtattttcaactctcgcctctcgtcccaaaaaacgagaggcgagagacgagaggcgagagttgtcccacccctgctctacacttaccttttcaagtgttggcataatttccttcagaaactcaatgtccccagtggcaccgaaataatcgtaaaccaaactaataaaaataaaaattttaattaagtaaaaatgtaataaataaatggtccaaaaatagacacactaagtgaggaatggcggctgcgatcgtttgctgtaataaatgcgtccaccggcgggcacataaccaaaacggttgaccaattccgcaaagtttttgcacatatttttaacggatttttccattcctaatatgtaatttaaaattaattttttaaatagtcaaaaatataaataaaaattttacaaaaaagtttaatttataatttagatttttaaataaattttcatttttctgatcactttccacctgatgcgagcagcccccgcgcaatccaaaaggaatcccaatagcgaaactcgcgaaatcgccctccgggcacgaaaaaaggatcggatagataaatcagtgaatgcctttgattgtccttgttgttcatcttttaaatttttaatttattatgcgcattaattaattggattttttacatcgtttggcatttttttgctcaattccttccacattttgttcaattcaatggcccattgcttcaaattcttgtctttgatgttctttagattttggggattttcgacccaatcttccggcaaatgccttaattttgtaacatttatttatcggtttactcttaaattgggttttttcggtacaaaaaatattcgaggcatttttaaaattatattcccaatatttaataaatattattaaaatatttttaaatttaaattgccaattcaaaattcactccgttaatgcgctgtcggccgtcccaaaattttgccgtataaatttggacaaattgtccacttgggtttcgttcattttcgacaccataaattgcttccattccgccacattgaacactgttttgaattgttcaaccaaattcttggcatcatttttcattggacggtcaacaaaatgtttggagtcgcgcaagaaaagcattcgttcgccccaatcattcactgcctgcacaacaaattacaaatttggatttaatttgtaaaaattaaaacaattaataaattttaaactttgataaaatatgcactttgtataaatagatatttttgggcacagttttcctaagcataatgcgacttttgcgccggacaacaaaaattgacacttgcgccggggatatttgcgccgcgacatggccacgcagtcaaaaattacatttttatataattttcactattattcaacaaattttattaaaattataatcgattgacaaaaataattaatttaaaaataagcaataccaattactcattcaaaacgatagacatttaaaaaaatttttgttttttgcttttattttttttgttaagacgtgtatatcagggatgggccgacgtttcgcttttcgcatttcgctttttggcgcgaaatgcgaaatttctacccctaagaatgaacatatttgaaaatttaaatttttaaaagaatgcttccgtttattattattttgggctgcaggattaataattaccttttttctaacttgctatggcctaatacgcacgaaaaacgagtttttaactggtttgaagcttatatcttgaactttttggtgcatttttttgccttttttttttgcgattttagtgccttatgccgggcatgtaattttgttgccttttttgacctttgtgcctttttcatgccttttttttactatttttttgaaaaaaatagtaaattttttgaaatttttgcaacttttcctatcatattttattacaatttccaaaaaatttccggcggcgcctgacgacaccgccggaccctcgttaccttgatttttggaattttaacctctatgattttactattggtaaaaaattttgaaaaaatttcgcttttcgcgtttcgcttttcgcaaatttcgcttttcgcgtttcgctttttatttttcaatttggcccatccctggtgtatatcaaacagcaatgaacagattcttttcttcttttggcatgggttaaaaagattaaccgcccccctattcacccagctttttgcaaagtaatgcttaatttccgaaaacaaaatctgtgctttaataatgatgttgggccattgctaattatgatcttaaatagattcattcaaacaaataaaaatgacgaagaataccaactaaattgattggggacccgactgaaattgatttacgcattttctgaccgcccacggctttaaaaaatagattaaaagttagaaattttgattttttgtttttttgcttgctggcgcaaaaatcgcggcacaaaagtcggcaaaccgttcataagtgtatctcttttatgctaatttagcatattctaacaaatttacctcgagaattttcccgtcgcaaatgatgggtgctggaaattatatgtgtaaaatttatggcatataataaggagggttcaattttatatatgctaaaaaccctcaaaatatgttaaaaagcgaaaaaaatccaaaaaatttctaaattaagtgctaaacactgttgaaaaaaaaaattaaaatttatttaaacaggctatttttctccaaaaacgctaaaaaagacataaaattattttacacatttctctctttagggttgctccccgacccctcggggggtaaaaagtcgggggccggggacctcggggggcggcatgtcggggc

SEQ ID NO: 16162 - DNA, 1949 bp, Heterodera glycines
atttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgttcaaggcttataactcgtcaggcgttgattttagcggaaatttgtcttagagcatttttgtagagaattttaagctctatctaatgtgctttatctcatgtttttaccatgagtttaaaaaaagttataaaattaattgttattttgaaactcaatttgagccacggaaaatccagtgaaatttcgaaaattcataaatctcttcgtttttggtcaaatttaatggaataaagctttaaaaatagagaaaaattgggagaattttatgagatttatttggaatttctatcttccaaaataaaaaagttattccagaatttctggtaaaattcgatttttcagaaaaaaattcagaactcccttctgaaaaagtattttataaaaataatatactcaaaaaaatccgcaattttttgctctattttataaattttattttagctttttatcacttttttgaaaaaagttatagaaataaaagtgattttgtaatttgggaccaaaggggtgtgtgtgaccatgatttctgagtgggaaatttttttcaccaaaaatcttccaaaaatatgatttttagggttatttgggccgctgatcacgaatatgtaatcagtttttactttagcatggttaagacctcagaatccctgtgtgatttgggattctgaggagtgggagcgcccgtcctgaggccgcgaagcggccgaatatcccccaaaaaattaaaaaacgggcgcgaagcgccagtctgaggccgcgaagcggccgaatgtccccaaaaaaattaaaaaacgggcgcgaagcgccagtctgaggccgcgaagcggccggatccctcctacaaaattaaaaaacgggcgcgaagcgcccgtcctgaggccgcgaagcggccgaatgtcacccaaaaaattacaaaacgggcgcgaagcgcccgtcctgaggccgcgaagcggccgaatatccccataaaatttaaaaacgggcgcgaagcgcccgtcctgaggccgcgaagcggccgtatccctcccacgaaattataaaactgtcccggaaaatttggagtgctgaagatctattactaattgatttaactattaatccttaaagtttgaagttttacctacccaaaaatcctgtacaatttgcaaatgcttaagaccataatttttcccatccatattaatttttgcgtccagcattaattttgttacttcatcaaatctaattcgcaattatttttcgaaattgattcattgaaattgtttcctcctcagttttattaattagttgataaaatctacttaaaaccaatgcataaaataagcctaaaaaattaaaaataccaaaaggaaaacaaatcgcagcgatagagagagagatatttatctagagagagtgatatttcatcacgagggagagatttgtggacatttaaaataatattggcaagcacatagctataaataaaacgattaattattctgctgtcgtggagcaatataaaaatctaatctgtggaagtttgtataaattaatatcctgtttgcctaaattatttgaaaatcaaaatttaataaataaaaatattaaaagatgctactcaagggttaaatattttccttaaaatttgaaaacctgtaattttacccataccaaaaaccaaactttgaccgatcccgtttaaaaattaattttt

SEQ ID NO: 16163 - DNA, 736 bp, Heterodera glycines
gggaagcgtggggggaagggtggggagccacgcatgttgtggtacacgcatcgattatggaagccgcgcatgcactagcaacgaagtcctttgcgcgaagcgctcatgtaatgcatattcttttcatctctcacaagtaaactgtctacaccgagcaattactgtgcaaagcatactgtctacaccgagcaatcactgtgcaaagcatactgtctacaccgagcaattgctgcgccacaacacgctagttatatactactaaagaaacaaggcaactcatttccaaaaacaaaatctccttacggggcgtcgggaggggttcgaaatttcgaccttggggacaactttttgaggcgcatctgggaaaactataggtttttcgctccgagggccaactgagcgccaacggcgctgaaacggctttttcaaaattttttttgaagttgctcggattcaaaatttttttaaaggcctaaatgaaaaatcggcctcgtaaaggagcttcgtatggatgtttggcacattttttgtttcttgaccgaacccctaggccttaccagtttttctggaaaactgcgcaaaaatgggtcacttttttgggccatttcagcgccggccgaataactcgccagatattgatgataggaggtcggtgtaagcggcttttttgtacagcttgacgagctctatccaaccatgtttttagatttcagataattttcagtaaattttcgag

SEQ ID NO: 16164 - DNA, 1271 bp, Heterodera glycines
attgaaagaatatatttatgattatttcttaatttttttcctttaactccaattttcatcactaacttttcactcacaaatcagacccccattcttaccagtgcttgtttttcccggttcccggttgccctaccgggaccgggaccgggacctgagcttttcaaaatccgggaccgggacctcgaatgaccgggaattcccggcccggtcccggtcccgctctactctaccttaaaggatgaattctgtatttttacacaattttggaatttttttagagttgaatgcatattttatgcgcatatttggaattttttagtgcatacaacttataaccctattaataacttatttcaaattaaaattaatttttcagaagagaaaaggcaaatggattttaccctgaatgtccttgatgagctcctgtttttcaaaaattcgacctaattaataacactttttcagtgatgagaatttgataatccttccgaattttaattttaaaatttataaacctgattccatttctgttttttctgctatttggtttgtgttatatcggcgttttaattgctctaagtcaaatttagttttctcaaaaatttcatcaaatttttgttcaaatttttgttttagcggcaccgattgatcccgtgccaaactgacaaaattcgacaactgttcttggatattcatttttgttgttgcatttttccattttttgcacatatagcaaatgtcttcaaattcattggcaatttgctccgaaagtttgacaaatgcttcgccgtaaatgcacgggtcagcaaaagcggctattttgtgccgaaattctgcttcaaaaatggccaatttaagctcaacaacaaatttctccgtggcctctccaatcattgaaattccctcatcctttttttccagtccatccttttcaagctgttcagcaaacgaaaggagacggtctcttgcagtttggaaacggtcaatgctacagtatgctgcgttcactaacaaatgttcaatgttggcacagtgtttcttgagcgataccaaactttgcggcattgccaacaggtctttagcctccaactgcacacgtaatgtgccaagttctgccggcagttctttaatagttaactttatccggatcaattggctgtccaacagttcgtccgttgcttttcgcttaaaatggtcatttccgttcagcaactgctcacagtaacgcatcgccattttggtcagtttaatcagtcgttggtgcaccattg

SEQ ID NO: 16165 - DNA, 2637 bp, Heterodera glycines
tgtatgcaaaattgaaatggatttaacggtcaggaaaaaaaagttaaacgtcaggaagtaaatcaattttgtgtctattaacagagataaagaaatagtacgccaaaatgtttctctgcactctctatttattggttcatctctcgttttttgaaacggtgtgtataaaggtgctgagacatttataaaagccaccaaaaagagcgttataaaaaaccatcaaatgaaaaattttcaacaaaaatttgctcataactttgccccaaagcaaagcaaatttttaaattcttgatatcattcgacagcccttagaaatctttactagcctgcaaaatttcaaaaaattttgctatgtttcaaattagaatacacttaggtctatcgatttctaataataaattttgtcattcactgtctaattagtgcccactgtcgaattgtccgggagcccaccattgagtcgccgttgctcatttcagattgccaattctctgccaattccttcaaatttgccaaattttccgccaattcaacaaatgtttgttgcgttggtacttctgcccggtctttaactaattaattggaagatattaaatagagctcgaaattaaaaaataacatattctcttgccctgtcttaagtaactttattttctggtcaaaaaaaggaattgttttttgaaaaatttttaaacgggtaaaaaaagactaactcgaattatatggtcaagatagagattgagacttattaaaatagtcataattagagcccggtaaaaaataatttccgggagcgggaatcccgtaaaactcccgctcccgtacaaatcccgtccatttttaacgggagtgccgggcgggagcgggagtaattcgaaaatttaattaaataatcacaaaaatatttttaatgcacaaatttgaaggacaatccttttattaaagaaaaaaaacttaaataaaaaaaatagattttagggtcgaaaatcagaaataaattttcaaaattgcttcaaataattttttaaatcaatttattcgaacaaaaaagtttaaactttttatttccgaatcctttattaattttaacaattttttgctccgtactttttgaaaaaaaaactttttggggtccagggaaaaggagggaggccggcggtgccgataggcgccgcagggaaaaaaattgaatatttgaatacaatagattgccagattatgcccaaaaatagccaatttttgaaaacttgaggcatttttttaagcaaattaaggattttaagactcccgcttccgtaaaaaatcccgttcaccgaaaaaagcgggagtcgggagcgggactcccgtaaacttcctccccgctcccgccgggccgtattatttaataataaaattaaatacttggcagaaagtgttcggtgagcatgaatcataagcaaaaattttttaatctgtttaattcgatgacatataattttttcataaataaatatatctttattatattacagatggcacggtttttttactgttcggtttttaattctaagctccttttattatttcaagaattaatttatattttaatttttctttttttttaagaaaatgctatgaaatttatcttttttataatctttacatttatttttcaatgttttttatttagaaaattgtgtttcattttgctatcttctcgcgaacatgattatttttataactattttttacctttctttctttaaaatattttgattcaattctctcttgtcaagagcttttaatttttcattcatccagttttattttatgacgaatatactcgatttcggcactcagctggttggacgcattcagcttcgattcacgagccaacatgaacaagattcgggcctcgatttcgttcatctttgccttcagctataaaaatatttctatttgtttcgttttaaataaatgtgtttttttaaaattaaataataatatttttcattatagtattttgaaaactgaattaatttttttttttaaaattgtcttttagttctttgaaattgcaccggagatatcaccccttgcaattgttcaatgcaatataccaaaatgaaaattggcaaaaacaagtacttgccttatatcctgcagaatacacccaataccaataaaatttagtgaatttgttatcccttcactttatctgtataaccactataattaataattttagaaggttacctcatttttttttacttttatttttaatttattttagaattatcgtgttttatccaatgtcattttttatcaaataaagttaaaaatatttttttccataaatgctattaactttttagaatttatttttgtaatttttctttattgaataaaatatctacttgttgatgttcattcaaatatttaaattcaattctcgttgcagtgttagcacctgcttcatttattcttaaaggagaaaagttgggtgaacccggaatcccttgagattcatcattttgatgcgttttttttctttgaatttttgtttaataaaatttgttgatagcagtttttgattgaatatttcatcggaagggtcgtgattttatgtgttcttgttttaaattagcctaaaagaat

SEQ ID NO: 16166 - DNA, 2892 bp, Heterodera glycines
  misc_feature (21)..(21): n is a, c, g, or t
  misc_feature (31)..(31): n is a, c, g, or t
ataagcagtctaggtaagagncctaatacgnaaagattttcacacacacacaaaattcgcataagatgtataataaataccattatatttatatgaaatgatataaaattacattagaatggataagaaaatggagggggaatatgaaaatacattaattataatatgaaattaattagaacattaataagaatggggggggggataaattatatttatacattaaattatatttatgaaaggggggatacatatgaaattacattagaaataatatgagaaaagtttgttgagaactcaaacagaatacagtgttttttaactctgcattctgtatgaggtgggaatacaaattagtgaaagggacaaggtcaagcgtgtgggcgtcgggattactagtcgataatgcgtctccgctgttagtgcaataatgtcagtagtgttctcgtgtgagttgaaccaatcgagaaactccgttagtttttccggcacttcttcgaaaggacatgcctcgtgcccgcacacttcgacgttaattcttcggataaaccggcgaccaatgggttagttgtccacataatatgtttgtgtaagtcgaccagcatctaaacaatgcatcatcatgaccttgcccactccataaaaattggaaacaagccccttgtaaaactttcaatgcgttcacggcgaccctgagattgtttcttcaattttttattataaatattttcccaatgacttagaaattcagcatgacctcaatttggcaaattccccggctgtcattttcgcaatatgccaaaaataatgctctaaatcttggtattttggatttcatagaccaattacaagtaaaatgcttttttaaacgtaaaaagctcgaacctgtagagttaattgttttgaatatgtgaagttagtatcatttatgaagccaaaataaagttggtcatttttgaagagggaaaaaagtaattaccaaaattttggcgccttgggaaaaacgggtaattttagccattttgattgggacccggcggtgccttcggcacctggcaaaattgatgctcagtctttgagtaaaatacagtaaccttgaaaaaatacccattttctgaaatttttttcatttcggggggggggggggggaattgccccgctggtttccgaaaaaattgctaatgtaaacttttttcaaaaaactttagggaaaaataccgagccagtgaattgcgatgcgattttcaacagatattccaaaaaatttaaaaagttgcaaaagttgaatatttccggagccgatacaaacgacaggctcggaaaaatttatgaaaattttgtagaatttgctaagaattgggccaaatttgaaatggactaaattttcaaaccatttttggaggggtaaaaatgtcatccctttagtttcagtgggcttggaaaaccctaccgatacccacctgttgcttgttgttgttgttattgttgttgtgccccttttagtgatgcgtttcatttgcgtgacgcgcccattctgtgccatcagtttggacaacagttgggtgagtcgtgcctcttcgtccaccaattgggccgggtaattggccacgggcaaacggagacaaaagcgatggaacggactgaaaattggggtagaaatcacacatgaagaaattattgtaaattcaattcaatattggatttttatttaatggggtatggctatcacaaaaacggtggttccaatgattttttaaaaaagacacaaattatggaaagttttgctggaaaattttttacaatggtcaagcattctaaagtctaaaaaaatgggacataatttccaaaaacaaattgtccattttcctcaaaattctacggattggaggcattagggaagcagggattttcacaaaaaaaaattaataaatttcaaaaaatcaacgataggaatacggacccaaaacaggcattgaatgcggtacacagtgtgccgtagtcgtttgtcggttggtcccctgaggcggcgacactttcgtcggtggtggtggtgccgtatttgcgcgcgtattggccaattgtggcgaacagtgcgcggacggtggccaatcggagacggcatttgtcttcatcagtgttggtggcatcggcatcagcattctcttctccatccaaaatgcaacccttttccgcctccaaatcgccaatgtttgggtggaaaatttgtccaagtaacaaattgccaaaagtgccggtttttgatgttgttgttgactccttaataaacgatgaaccatgaaaaggaaacaaaaaaaatagttttgaatgccaagaaaaaaaaaatttttttagagaaagccttgaatttcaataggcaatttttaagttgaaaatcactgtcagcataaaattggtcaccgccagaaaagaacccaatgtgtttcaatagaaaaaattcaatttttcatggcattaaaaataaataaatttggtatttgcacaccaaaatttcccagaggaattccgtctctaaaacttcgagttgctattaaaaacggcaaaaaatgctattaaaaacggcaaaaaataccatggatggatttcggacagcacaaaataaccaacctttggcgagacaaaaagcatttggcgatggggcagcgaaattgggaaattcatcgacggaaatggcacttctttcgcctcatttttgcacagctgaagagcgcccaacaaaaatgccaatacttcgcggaagaaacgaggcctataaattttcgaaaatttggaaaaaatgacgaaaatggcggaaggcacagaccgatggcaattaacgggaatcccgctcaaggaatggaaaaaaaattttttttttactaaaatttgggtaaa

SEQ ID NO: 16167 - DNA, 1095 bp, Heterodera glycines
agatagaaaattgtcctaaaaagagatagccattttctgagaataattcacaatttccgcagctctggcggtaatggaaaaattttgaagaggctctgcggaacggattagcatcggggttacgagatagaaatttgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaa

SEQ ID NO: 16168 - DNA, 4273 bp, Heterodera glycines
  misc_feature (37)..(37): n is a, c, g, or t
  misc_feature (4204)..(4204): n is a, c, g, or t
  misc_feature (4248)..(4248): n is a, c, g, or t
agaaaaaccaaaaatcgtcaaaacaaagaaaagcacngagcagagcgaccgacccctcttcggcacggtcatcccacgagttgggcaccggacgaagagaatcggcaaatattcggggacacttcgactggcaaaagcatttgacagcagcgacagaattggcattttgtgcccagaggaaggctttggtttgcgcatcggtgttgaaagagttcatcaacagaagcggaacgggggagcgcaagtcggcgcagttcaacagaatgcggtgctgctgcagggcgaagtccaaaaaggtgagtccgtcacgcagttggaccagcgatttgggcccggaacagcccattgtagtgcctgccaaagccatcaatgtccgaacacttccttgtcatcctttgattttccctttttcgatcacttttcccacttttctctgtccatttactcattctgctgatcattctcccccctccccgccctttgcttttcatccgatcattcgcttctccttttgtcccccttcgcttacccaatcctccgttcagttttatcaccgcaattcgttccaaaattgcccttctctcctccgatccctccaccttcggcaaatgttcgtatggcatttgcttttcctttgccattggttgtatttcctgccaattcactttgtgcggatcctccaaaaattggcggaaaagttgccgaaacaatgccaaatccttctcactttggcactgattaatttagatcaattcaacaattgctaagctttttgaagaaaacctcggaaggattgaccagcgaagggatgacactgtccaattggtccattaaatgcgcaccttgactttcattttccatcgttggcactgatcggtcagtggtgatcaatccgacggaggaaaaatgagtggagactttatttattggtgaacgaagaggccaaaaagacagacagacaacaccacaaatggagttaattcctgatcagagtttgtcccgcccactttctccatctcccctctcgctctctctctatcttttcactctctctcttttctctctctctctcttctcttttatctctttctttccttttctcccactctctttgttttccctccacaattgcccaatatttctgtccttccgatcaaggtcatctcccttcttctcacgcgccttttccctctaatgaatgaatgaatctgtgatgaatggattgaatggatgaccttttctcgtcatcgcaatattggcttatttttgtttgttgctgcggttcatacgcaattaaaagttgaaaattaaaaaatatatgcctattttaaaataaaaaaagaagaagatgatttaaagggggtaaagaaagaaaatctgaataataaaataaatacactgctgggcagggttgttccgggttacccgatacccgaaacccgaaacccggcctttttctcgacccgaaacccgacccgatgattttgggtcgggtttcgggtcgaaataagcactggtaagaaaggggtctgggtgaaaattaggtggataaggaaattgagaattttttttgaaacgattgtgttcaatggaatcgaaaattttgtatttgtttttgttcattattagggctgccaaaagtatgcaaatgcatatttttttcctggcttctccatgctctaaatagtacgaaaaacactttcttttttgtgtttgcgtataaaaatcgggacttttatttacatatttttgcatattttgggcctttatgcatattttgccatttttcttcaaatattttccgattttggtgcatatttggtgcatatttcacgactttatttgcatatttatgcgcatattttggccacttttcgtgcatatttttggcagccctattcattattatcctttttctaaagatattttgtatgaatttcttgaatttaagcaaagcaaatggctgaaaaacctgattccatttggttttatttccatcgtctactgatttaagaaatcggttaagtgcagaaaatttggagaagcttctttttttgcatcggaatttaccaatttataatttttcttattgatttttaaacaaattaaaaatttgtcaattgacccgatacccgaaacccggcctttttctcgacccgaaacccgaaacccgacccgatgatttttcggccgacccgacccgaaacccgacccgatgatttttctcgacccggaacaaccctggtgctaaatagtgaaatgaggtgaaaaccaatatgcgacaggtgaaatgtccttcgataattggtaaaagaggtgaaaaacaataggaaataggtgaaatgtcctggtgaaaagagcgaaacacaataggaaacaggttgaaatgtcctgtgataagtggtgaaaagaggtgaaaaacaataggaaacaggtgaaatgtcctgtgataagtggtgaaaagaggtgcaaaaacaataggaaataggtgaaatttttaagctatagatggtgaaaagaggtgaaaaataataggcgacaagtgaaatttactgtgataagtggttaaatgaggtgaaaaacaataggaaatagatgaaatgtcctgtgataagtggtgaaaaaaggtgaaaaacaaaaggaaataggtgaaaggacctatgataagtggtgaaagaagtgaaaaactataggcgacaggtgaaattttcagttctaggtggtgaaaagatgttgaaaattctaagaacattgatgaaattctaaagaagggatgaaaagaggtgaaaactaaaaacggaaataagtgaaatgtttcaaaaacagatgaaatgacaacgaacgacggtgagatcttcgtgagtgacgataggcaaaacaaaacaataattgagatagaagctattttaaactggtgaaaaggcaaagaaataatggaatatgtagaaaaataataaaaaaatttaagagatttaccttaacaatggcaaaattaattgctgttaactgtgcaaaaggaaagttttgtgacgggtattgttatcacaaacacaaaaagacaaaaaataaaatttggtggaagtgtgaactttatcaacacggatgcaaaggttggggttatgagagtaacggtgagtttttcggcactcgaatgcataaccatcctccatgaccaaattctacttcaaattgagggagaacaatagatttgaatatgttaaacatataaatcagattttacattggaatttcaaaaatatcacgtgaaattatttttcctctcagcgtgcgtgattttgggtaactcaaaacttgaaaaaaaagtttgatatttccctactctgagcttttgaatgagcttaatttttgttcataccggttcaatttcagggattgaataaatgacaattaaaaattgcggctaacaggtgcttacctacactttaggtcgttcccaattgatggtccaccagaaagttggcaccgggtgtttggaaatcaggaagtttgggcatcagaaatttaatcaattagtacagctaattagacatagggtaggttaagcgtctacttttttccgccttagaccatggaaacgctggagactgcttggctttcaaatcacaatgccgtcggtcggacatcgtcgtcttccccagccgtcggtgtcagctcaaaaagttgagccattctcgtcaccacatgctaatcactaattttatttctactaattagaaaatttttcacccacaaatggttgacaaatagactgaactgcgttttattttgcagtagtaaggcctaattttgaaaaataacagaaattttttggcagagtaaaaaaatagattaaatgaattgccatttaattgaacaaaaataaaataaatttcgagacgacaaaaatgaaattattccctttattatgtttaattatatttttaataattgtcaaaattggatcagaaaagaaaaaacttcagcagaaatcatttgatgcaatatttggagaaaattgggaagaaaaagaagaagaaaggcgaaatgaactcaaaaaaagagaaataattggaaaatattataaaattaaagaaaaaataaagcaaaaaggaagaaaatattcagcaaaagaatggaataaaattgaacaaaaaatagcgaaaaaattggggacaaacaattgttatattaaaaaatggattanagaatttggtcttcaaaaacaaatacagaaaagctacaaattanaaactgatgaagaaaatttagaaat

SEQ ID NO: 16169 - DNA, 1272 bp, Heterodera glycines
  misc_feature (8)..(8): n is a, c, g, or t
ttaaatantcttttttataaaaataataaaaaacatcctcctaaaaatttaactttttataaaacaattttaaaagactaaaaatattttaaagttagtaattcaaatagaaattaaaactaaataataatatttctattctatttaatattccctttcggaaacaaataattaataatttcataaaatttagtcaaaaataaaattaaattcccttaaaagggttagtataaaagaaaaaaaatcaaagtcttatttacggttgaacaaagacatattaataatgcaaaattgatatgaggtaattttttcattaaaaagatggggtaaaaatagattcaaaaccatataaaattttttatcttaaaaccaaattaaattaaattttatggtttagaatatccattataagttttttttattactaaaagatacctacaataggaccagataattaaagattttattgaaatttataaaatgtaaataaattttaaaataaattaatcattactataaattaaaaaaactaattaatagctttgaaataaattatttattaaattaataattatatctgcttctgaatttacacaatgttcttggaaagcagaaagaaaatttagtcttgtggaataatgaaatgaaaattaaaaaattatgaacaaagcggcgaggatgaccaagagatctatgaggttgaggccatcttggacatgtcggtgctcacaacgagcgagcggttatactactttacgtggaaagaaaaatttgattttcattgagttcaataatttgacgtcaaaacttaaaaaaatcaatataatcaaaataaaacctaataaaaattaaaaatatatacgcacggaaaattaaatataattaatttttaaattatcatatataatgttattgaaatgaaaattatataaatttaagaaagcgtatgataatatttgtaaattcgaaaatttataagaaatatattttaaaaaataatattgttattctgaaaataaaactgcaatatatgtataattgagctaattttgcatgatgaataaaaaggtggctaaaattaaaataatggaaataagaaagttttcttttatttaatataaaagataaaatgaatcaatttaaaacacacacaaaaattatattttatatttagaggctttcttttacaggatttcatcctaagaatgaatttcaaaatatggacgtgacacagacaagaaattataaataatttatttttataataattaa

SEQ ID NO: 16170 - DNA, 1935 bp, Heterodera glycines
tgatttaagaaaatatagagaattcgagtctcgtcgcctcaaaaaaaacacgcacttcagaacaatttgaaaataaataaatcttttcagtttttcataatcaaaaatgattttaaatttttttcaattaataattcggtcaattaattaaatcaaaattaaactaataaaaacatatttattttgcaaggttaaagaaaaaaatccgttaaatattattatacaaaaagttgttccgcaaaaaaaacaagtaaagtaagaattttgactgcttttatttcttttaaaattcttgaaatagtagtctgtataatatactcctttcaaatttaaaaatgctcgtgtctaaaacaaaaatggtcgaagatatgtagattatttattaaaatataattttaatgcaaatctcattaaagacatactgccttcaactaagtttaatttaaaaaattttcttttaaacaattatattttttaaattcagaattaaccattttattttttctttctcttaatatggccaaattcatttgttttaaacaaatattaaaaaaaaataaaattaaaacaaccgttaaataactgctgcaatacagttttttttgttgacaaaacaaaaattaattttttttaaacaaaaataaaaattattttttatatttcattaattttttagatttaaataatttgaaacatgcgttattttcttaaaaaagagaaattttatatttaaaatttaatatgtattcatcaaatttaataattttacaaaaagtcatttgtataatgaatttattttgtaagatgcaattaatcgatgtaaaatacgcttgttaggccttaagataagccgtatagacaatgatttattcaattctataatttccttgttcaagaataagtaaataaaaatttagtcttttttaaaaaatttaaataataatttatgaaaaaatacttccatataatttatattatattaaatataaatttaatgaatagaataattaaatttaattattttatcatcactgagtttttttgcatcgcccaaactgagtattttttcgcatcgtctcagcacgttttattcattactcaatttcttgaatttttttctgtaaacattttttttattacttatccattctgtataatttaaatgattatatttttatatattaattcgagtgccacgggaccgggaattttgggcaaatccaggaccgggacattttcgggttgaaaaaccaggatttttgctaggaaaaccggggaaaaacaatggactagtcccggtcaaaactgcgaccttggtactcagttgtaccgcttttttcagtacctgtaccggtaccgctctactctagtttgtagtatcgaaataaaatcttgttccaaatcgctggttatcacgttcttttgcgcgactgaagaagcatgtttttttataagtaaaattctgtttaattaatcttattattaaaatgatttttttatattaattttttataaggttaacataaaattgcatttttttatttatttattttttttaaacgaacgaattatttttaaaattaattttgtttttatcaattctttttgatgtcttttatttatgatgctacattcttcgcgccacgggttgatcgttcattctcgttttcattatatcttttcagatataataaccgaaaaataaatttcatttatattaattttatttttttggtcgcataaggtgcactattcataattgctttatattttattttatatactaatgtagaatatactttttcaattcattaaatatcaaaaaaaaaattttgttaaatttatgacttttaacttaccggcttctatattttatttgattatataaaagtgttgttttttattttaattttatgagtttttagtcatcatgca

SEQ ID NO: 16171 - DNA, 3651 bp, Heterodera glycines
aagtgccatttaaagtccgcgtaagagaattttgattattttgttgaggtggtggggctgaagtgttgttattcatctgctgattgcaattcactgctggagactctgatgagaaactaatgaaagagctgcttgaagaaggcacgacctaaaggagagaaaccaaaaattaatcaatcaatcggtgaccataaataaaacaagcatatgattatttcgttaatacaaaatgccaaaaataaaaataggatttcctgttagaataattttcaaaacaatttcgacatgtgattaaaaaaaatcccaagaaacttggccatggctagttgcatcttgcgtcatataaaaaactattttttgttttctttttttaaaagaaaatttattaatttaatttaaaaaaatagttctttctaaagataagaaataaatttttagcaaatgcagaagtgtcagaagaataataataatccgtcgtgtcaatccaactgttgttgggtactataataaagcacattcacacatttataaaagggatgaacaatcgattattcagctcagtcagtcatcgtcatcttaaacatctaactaaaactaatgtcaaaggcatttgaatccatcgccacaaaaaggaattttcgaagcacaaaaacaccccaaagaccgacgaacggtggagagaagagatgggagaacaaaaggagaagaaacatttggacgaagtctgtgcccaccttttgcttctctccgtttgcggcgttcattttcagtgcgttttcctccgtccgccgttcttcggaagatgacccccccggcgcactgctgcgatcgtcaaaatcaagcaaaagcaccggactgttgttctccttgtcctcactgcaattcggtggtcttttgccttcgttttccgttcctttgcatggcgtttcctttctctgcatttgttcgtcgtccctttgctcctccatttttgcttctttgtcattatttgttgtttctatccccgccaatgccttcaattccatcgccgccttttcccttttgctgcgttcttcttcatcttcggattgttcattatctgtgacaacatttagcaaattgcgtgaagtcgagtttttccgagtgcctggcaatgaacgcgccgaatgaatcacttttttgccctcattagtggaggtcagccaacattcttgcgaggtcacgatgttgctgttcttttctcttaattaacaaaaactatttttaaaataaatctgaaaacttacgcataggccaacagatgaaatgccaattgttcagctgctttcagtgtctgtgcaatggcatatgtccgatcactgctgatgtaatcgatgtgctcaatgtccagggtttctgtcacgtgatcacttcgtccaacccattcgcgtggaaaatacaaacttaaagaatcagcaaaatattatggtaaatgcgcaaatgagttgagctttttccgctcacatcggtttgaccattcggacgcaatcgatacggaatttgttgagggtggggcgaatgagcagacgaggcaatcgcaaattgttgccagcccttatgagcaagtcgtcgagtgtcacttttgaaaaattgaagtcgaagaacaaaaagccaaattcattagcctgaaaactctaaaacattcttatttgatcgaagtttgcagaaggagagtgaggagggataataataaaaaatttatacattacaaatttaaatttcgagaaaacaaggaataaaacaaaaaatttttgtacctttttcagtgtgtcggcgatataatcaaaggcgggtaaataagagtccatgtaccagcgacaaatttgatcaaattttcggccaacttcagcaacgcactgctcgacaaaattgacaaagtcagtctcgcgtttttccgcccattcgaagtccattttgttctgcaagtcatccaaaaaggcaagcaattgcgttctgccaattaatgccttccattttcaacattttgtttggttttcttacttttccggcattggatattgcaatggaatctcccaataccacgagtccacaacttcgattatgtactcgtagagcttgcggaaatcgcggctcaatgagtttcgtcctctgcgtttgtcacgttcatcgcccagctgttgtatcaactgatgcccaaaattcgcataaacttgcccagctgacgttaatttgacggaataaccctcaagacgagccaatttctcaagcgtatattcaatgtcacttacaattaaatagagaacaacttagaatttaaccgattcgttttgacttacgggctgtcgtttgaaaatcggttgttctccaagtcggcacttccaaatccgacggtggcatcgcaacaattggctccttcttggtcggaaattcttaaattcccataataaaaaacaatggaagaaatgcaaatgctaaactcacaattcaatatgactgttatcaaagaaacaagttgaacgtagcatatgaatggcaagcgcttctgtgatgccaaacccatcagaacataaaccaatttttggggccatcagcaaaaaacaaatgttaacaagacaaccttctcttaagacttcactcttaaggctcaaataatttaaattttgcgagaaattccaaaaataaaattgaattatatctaatacaaaaaagtcccagagtcaaggtaatacaaagtccaagaaggaatttttttaaaaaaaacaaaaattttttcaataaaaattttaaaacaggaaaaaaaaattcccccccctttccctggcttggaatttttcgaaaaaacaaaattttttaaaggggaacctcccttgtatagggcaagttttaaattttaaaaaaaaaaaaaaaaaaaaaaaaaaaaaaaaaaaattttccccaaaaaccgtcccccggccccaaaaccccccccttggggggacctttattttttccaaaaaaaaattttgggccccaaaaaaaaaaaggggggcccccccgcccgcccacacccccccccaaaaattttttttctttttttaaaaaaaaaaaaaaaaaaatccccccctctcgggaaagaaccaccccccccccccccccccctcttttggtgggtggttttaaaaaaaaaaaagaaaaaaaaataatatttttttttttttttcgggggggagagaaagaaaaactctcccccccgccccccccccccctctttttttttttttttttttttttttttttttttttcaaaaaaaaaaaaaaaaaaaaaaaaaaaaaaaaaaattttttttttttttttttttttttttttttttttttttttgggggggggcaaaaaaaaaaaaaaaatttttttttttgggggggggggggaaaaaaaaaaaaccccccccccgggggggggggaaaaaaaaaaaaaaaaaaaaatagggggggggcggggggcggggggggggggccccccccccccccccccacccaacaaaaaaaaaaataaaaaaaaaaaaaaagaaggggtggggggggggggggggggggggggttaataaaaaaaaaaaacaaaaaaaaaggggggggggggggggggggggggggggggaatttttttttttttttaaaaaaaaaaaaggggggggg

SEQ ID NO: 16172 - DNA, 995 bp, Heterodera glycines
  misc_feature (13)..(13): n is a, c, g, or t
tatgatgacttancaggcaaaaacaaaagctgttttttaaatgtaaataaaaattgagtttcaaaaaatgtgaaattaaatctctgctcaaagctcaattcaataacagaaaaaaatgaatgaaaatcccataaatataataaaaccaaaatacacaattcaacccaacacgtcagtttcataccggggccatttcgtaccagaaaaaacttctctaaaatgatttaccccataactttttcttgatcaactaaataaacaatctatggtttcattcgatggctttatactgttagtgaccgctttttaaacggccactaccgtatcagcctcataaattgccaagaccagtttttatgatgaaaatttgtaagcatttaatttttgcattgttttcggcaaatacttaaacttattttggggaaaaatttttctgatatggatggaactggcgcggtacggaaccggctgataccaatggcaattctttccgcaaataaatgccatttcattcagaatttggcgcctctttcgccatttcctcagcaaatgaatttttcttttcctctaacatttccaaaatattgttgaccatttcctttgctttttctatttgttgtttcgtttccatctccatttttccaatttcattttgtttttgcttttcttccgctttttccaatgcaaattttagtttttcacattttttgaccaatccttttaaatccaattctccttttaggctcacttttaatgcctctatttggggaaataattccccaaatattttctttaaaaattcatttatcctgtacatttccatttccattccaaattctttatcatttatctcattagaaaaaattttggtccaataaatcaaaaaatcttccaatctctcatggatatcttaaataattatttattggtttttcatttcatttatttttattttacctttcgatgcattgaattcgaaattcattgccaattca

SEQ ID NO: 16173 - DNA, 2884 bp, Heterodera glycines
  misc_feature (2412)..(2412): n is a, c, g, or t
  misc_feature (2420)..(2420): n is a, c, g, or t
  misc_feature (2868)..(2868): n is a, c, g, or t
tttgtttatttttccagcgattaaattcagttttttgttaataaaattaaataaaaaatcaacgggacgcggatttttttggaagccccgtgaacacggctcacggattaccgtgattggaaatgcaatcacggccagctctgtccgcaacccccgccccctgcgaactccgcccccgcgggggtgcgggggtgaaattacacacctaaggattcggattttcgtagatgagtgagatgtagttggctgtttatataaaaattttatgctcacaaatgctttaaaattatagtattattactaataaatatttttggaattttttcaaaatttttctctatcataaaaaatcaaatttaattcaaagaatttttttgaatttacattaattcgttttcccactcggccattggaaagcattttaaaacagcaaaaaatgcacgaattttgtcctttgaattttccccgaattcttctacaataattattccttcttcgtttttgccatgaacaagtgcctcaagtcgaacagcaaatgaaaaaagcaaattgaacaaaagtgtgtcaatttcccatttcattttttgttcgattgttttgtgcatttctttatttttaattgctgctaatttgacataattttgctcattattaattgagttaattagttgctttatttggccggctttttctctgcttaatattacactaattgccttttcgaaattgacatttttcaataacactttctttgcccggcatttaaattgtttttgtttttgtgggttttcgtcgaccattaaaatttcttttgttgaaaaattaaataatttttcaagaaaatcatttacaattttaaaggtaaaaaaaggtctatcttcaggattatccataattatttccacaatatcggccattttcttagaaatttccttttttctatataaaagatccgctctgtatggaatttcaatttcgtacttatttatttctttttcacatttgcctattatcattggccgattttttgcataattttttcaacatttaaccccatcacctaattttccccggttcttcaaaattaacaaattacataaaaattttaaattaatttattccccattggacccttcatttttaaaaaaggggtttttttcctttaaatgggtttgggtttccaaaaggaaataaattccctttgggtttttaacccccccaaaaagggaaattttttatttttaaaaaatcccggccccccccaaatccaatctaaactttttttttggatttttttaaaaaaaaattaaatttttttttttttaaaaaaaaaattggaaaaaatttttaaacttattttttttttttagggattttgggggggggaaaaaaaaaaaaatttttttttggcgccctttttttaaaattttttttggggggaaaacccccccccctcccaattttttttaaaaaaaaaaaaaaaaaaaaaaccctctccccaaaaggggcccccacaaattcaaaaattcctctggggaaaaaaaggggggaaaaaaaaaaaaaaaaatttttttcccccccccttttttccggggttttgcccgaattttttttttttttttttttttttttttttttttttttccccccccccctccctttccccccaaaccccaaaaaaaaaaaaaaccccctcttttttttttttttttttttttttttttttttttttttttttttttttttttggttggttatttttgccggcgggggggggggggaaaaaaaaaaaaaaaaaaaatattttttttcttgttttttttttttttttttttttttttgtcaaaaaaaaaaaaaaagggagaggagaagagaaaaacaaaaaaaaaaataaaataaaaaaaaaaacaaccccccctcccccccacaaaagggggggggggttttttttgtgtttttttataaaatggggggtatattttttttttttcccaatatttttttctcaaaaattttttttttttttggggggggagtttcaaaaaaaaattggtggaaattttttttgggaagaagaaaaaaacccccgggggggagaggaaaaagggggcaaaaattttggtgggtttcttttttttttcaaaaagttttttttcccgttttttttttttttttggtttttttttaaaattttcacggggaggccaaaggttaatggcaaaaaatggtaacaaaaatggggatcaaaaagtgggggatcaatggggttcattgggggatccgggggttgattaaattaatttggggatcgggggatcattggttgctttgcttggggctgttttttgtgccttattttagtgattgcaatttgctaattgcttctttcttctcatgttttttctctttttnccttttcnttgtttctttttctcagcttttcttattcctttctgcaatgtcttctcttctcccctatctttatgctttttttcttttttctttgcttctttcccctgcgtttcctttttttcctttcctcttccttcttctcttcttccttttcctcttcctcttctcttcttcttcctccttttcctcaaattttcttcctcctcctcttccctcctcttctctctctcccatttttgttttgttccgcatttttcacctttaattatgctgctgctctgctgttgatgacgatcatttgcttgcgcaacagatggataataattaaccaattaatttgtcatggaattgctgcattttttcccccctccgttcgtccgtcctttccttcgttcgttcgtcaaattccccccctccccccaatgccttaggcagtctttgctcattccctcccanaaatgacgcaattaat

SEQ ID NO: 16174 - DNA, 3110 bp, Heterodera glycines
  misc_feature (29)..(29): n is a, c, g, or t
  misc_feature (36)..(36): n is a, c, g, or t
  misc_feature (191)..(191): n is a, c, g, or t
  misc_feature (2904)..(2904): n is a, c, g, or t
cgtcgtattgcatcagatatttctgctcncaaaccntagggaattggaataaaataaattatctttttttttttgctttttttggtcaaaccccagaaaaaaaaaattattttaaaaatgtcgaattatagccggagtcgtcaaactaatttttcttaagcctattacaaattgaaaaacataaaaaagtntaatataagtgtgaaaacactgaaattaattagaattttgggtataaatgaatgcaaaaaaaatgaaaattcatcgacttgattatgtacaaattgagactacctcccagggtttttttttatggaccgtgattcttttttgtcaaataaagtccatgcccttagttagtccccaggtcaaggataagacaaggaattttttttcaagctgtcgagccccctaagaaaaaatatttattcaaaaaatccgtaccatttggatggcaacaatgatttgcgccatgacaatcagcagatcgccagtgatcactccgttgatgtcatcttttgggttgtcgtcaaacattctatgcaaaagggaaaaaaacagtcaacaaaagcaacacgtctataaaatgccgagattttgcagacaaaatgagcgggtaaatcccaaatgaatatttattgaaaaaccgaggcctgaatttttttcaaaaaaggggacgagatttacaagggatgcacaatatttcttcccacccaccccccaaaaaatttttttttcggattttattataaaaattcgagttttcagcaatttgttggaaaagttttcgaaatcttatgtggcactcactactctattagaatgtcaaaaatgcattcgccaagaaaatttgatgaaaatttccgaatttttgacccaaatttccgaatctttactctgccgcaacgcaaattcaatcaaaatttggggggtgagaaatttggtcgatgcattattattcacatgtccgtgacgccaacaatcacaaggccgaacgcgacaaggcccatgccgagccatttgaagccgcgcagttgggcacgcaaaaatgagacggacaacagaccggtgaaaatgatcacagcgcctgtggggcaaaggggggggggtggttaaatttaaaaattttcaaaaaaaaacccgaaaaaatctgacgaatgttaacccaaaaaacctacacaaacttaacattgttggggcaaaagacagagtttattaaatgggctaaaaacacgccacattctttccaacggcgataatttcatatttttcagttttttttgctaaatgagggctttacccataaaaaataattgcttaaaaaacctctgagcatttgaaagctggacgctgtcgtcaggtttagaccaacgtacatctgcacaaaaaaaacatggaattatttaaatgcatttaaaaacgggaaagaatggaaatttgtcaaaatttgtcttaatcccaaccaaaaaattgtcattccaatccatgaccaactaaatttcaattgtaatatttgctaactgtgcttgtgcccaacacatcgcaacaggcgggcggcaagaaaacgaacgggttaaagcgcgggagggtcggctcctcatcggtgccaatttcgatgatggcacccccgtcgccgtattgactggagaaatttttagcaatttttttttttgaaatatgagagggttcgaatcatcatcaattccaaagtctggcatttccttcccaatgccgaaagaataaataacattttgtgagaaaattttcgattttccttattggtattccctccaagtcatccctcacccaaattttacaaaaaatttcacgaattggaaccgtccctgtcacatattttccttccattccctgaaattcacgctcatccccccaccttcctttccattacatttcgattgaaaaaaattggttttttttgtcttgaatctccaccaactttcggttcttccatcgccgctttttgaccaaataggcgacaacaaacacaaccaagcagctgaactcgccgatgaacatgcaaaacgcttggaaatagggatggtcaaagaggactccgtccaccacaatgctgtccgcccatctgcacacaaaatatgaaaagtgcatattttttaaaatctcgaatggttttccgtatttgtgccttttcgatttgaaaaaactgtcggaaaattccaaatttagaataaaaataattttgacaaaaaagaggtactacataccaactacaccacgaatgtgtgccgatgccctcaaaaaattttggcaatcggcattccgacggcccaaagaaattttggaattcatgtccccaaaatgttggaaggaaaccagcaatcggaaattggcattccaacacatcgctggtcttttcacaacttcttaacccagtctgttttttcatttttagcatttgtgaatccggggaagcatggttgtctcaacccaaacacttacttcgctgccaatgtgttaacgctgccttaaaaaaattcttgatttttacagtcctaaaaataaatgacggacccgtaatgaccatcatcaccgaaataatgatggaaattagccgttcggtgtgttcttcgtcaatttccataatttcaagggtcaatatttagcttaaaaggagcagttgcatttgcggaataaaaaaagcaaagccaagccattgatggaaaaaaagtgagacactttttttgaatgaattcataaaaaatcagtggcattttatcaattgtaaacatttaaaatacatataatacagtaggaaagatattttagaccggaatacctaaatctggcttgaacgaggcgaatgaagtgtgtgatggttggcattaatgcaattttagccccactttttttggtcaaaaatttttntttggtactttcctgttatgcgactacaagccaaaattcgggcatttaatgcatataatggcctgtgtattgacacttggctagacccttcaagacttcacctgggcccgtagaaaaagaacgaggtaagggtaaggttaccctcagctgcgagtaaccttatccgttacccgtagcaaaagagcaaccccgagttgggggtaagg

SEQ ID NO: 16175 - DNA, 1041 bp, Heterodera glycines
tcctatattcttcacaaatcattggaggcttaaaaactttgtggtgctcaacccgtgccaaatcctgctcttgaactcagtgccgtcgtgcccattagaaggcgggcggcacaaatgcttctcccgctaccgcactttttgtgctttcctcgagagtcccgaggcgccaaaaacgctctcgaaaccggcaaattaaaaaaaatcccgccttttcgcgaagaaatgggcacagaatgccaagaactgatccatttctatatataagtatttttcacttcggatgcggaagagcctaccgtataaatatttaaaaaaggggaaaagcaaaagcacatttttgtcgggcaattacactaatacacccttttaagtggaaatcgtaatttttttcctatgtcatttttacgagagatttgttttttttttaaattttgaggggttttttttgaatttttgtcattttgtttaattaatttaattcaaaaattctttagggataaaattttgtgtttttgtatcagaaggatcttacgtaattataaatgcatatcaatgacggaaacataagctataatctcattttttaattatttagggtggaacataatttttgatacccaaattttttttattaaaaatttttttttgaatttcaacaaaacacaatcatgattcaaaatacccgccattattatcaataatatgttgccattattctggcaagagatcaataccaatggaaaagtatttagggagttagagttaataagtaaaaatggtcattttagaggtaggtatttttgatggctgatttaaagaaaaataaaagagatacagagccagagaaatagtgattaaatagagcaaagttaggactataagaacacaaaaatataaaattttaattactaaaattgaattatgggagagccgagactgaaagtggtctccaaaacggcatttttcaagaccaccaaggaacataatgttttaaaagtggttttggaaattctgaatttgattaaaacaggtaaatcgggt

SEQ ID NO: 16176 - DNA, 2345 bp, Heterodera glycines
ccttcacgacaaaatttcgaattttcccatttttaaaaataaatataattaaagttttcttttaaaaatttagatcattgcgaattgtcgctgtgctgtgcctgcaacacgcccattcacgaccaatttctttataaggtgagaaaaaaatttgcaaaaaaaaaattttttgttttttcattcgattgttaccccccaaaaaattcaaaaattttcataaatctcaccaaagcacccattaattttttgtttcttttaaaccatagaaaattttttggcaaaatcattagctcaacccgcaatgttaaattttcaaaaatcaaaaagccccccgacaaataaccgaaatttttcaaattttcatttgtaaaatttcaaaaaccaattcctctccctgaagagccaggcagccagccctaaaattttcatcccacctctcgctgtgccaaagaataaatttttccaattttcatcccgtctcccacccgtggttaaaatcttccctccctctcccccccccctaaaaaatcccaaaatttttcctctcccttcatgttgttcaaaacaaaatttttgtaacccccccccctcgatattccaaagttttgtaaaacttccctccctcccctccatgtctacctccacccccctaaaaattccataatttttggaaaattcacccatcccacccatttcccgaaaaaaaaaacctcaaaatttttttttgtaaatcctccctccccacgtgccgtgcccaaggtgctggacgaccagtgctaccacgagaagtgcctgcgctgttcccaatgtggtgacccgttccggacacggacctgcttcacccggcatcggctgctgttctgccagcagcactttttgcagacgttcggcccgcggtgtgcccattgcgcggcaccaattgttgaacaaaccattgtccagcgtgttggcccacaacaccatttaccatctggagtgcttccagtgcctggtgtgcaaagtgagttttttttttgaagcgagcgagccatcgggaatcgatctgatcattctggtctgatcaatggtctgatcaataaacgacaaatcagtttgatcaatttggcacctaaacgggcaacgatcactctgatcatttttgatcaatcgggaaacattgattattctgatctgatcgataggcaacaaattattctggtcactttgatcaaatgggtaaccgtcactctgatcaccttgataaatcgggcaatctgatcattcattgcccattgctcactgatcgatcatttgatcactttgactgatgccaactttgacaaatttcaaacatggaatctttgaaaaaacaactgctcttgcagagagagctgagccggggtgaccaattctatatgaatccgattgacggaaaattggtgtgtcggcacgattatgaggccggaggaaagggtgagtattataatattaaaaaaaaattttggcaatttttccgtaatttttgaaaaatcggataaatttttcaattttttaaattttaataagttactttgtattttgacttttgtgagagcttattcaattcactttcttgtttattcattttgatttatatttgtcagtttccatttggtgccgccaaatttatcaaaaattcctgtgaaagtgccataatttttcaaatttatcaaaaattcctgtgaaagtgccataatttttcaaatttatcaaaaatttgtgcgaaaatactacatttttcaaaattgtcgtaaatttaagcgaaaaggccacagtttttcaaaatgtaccgaaaatttaagcgaaaatgccacaatttttcaaattttcgaaaattcatgcgaaaatgccacaatttttcaaattttcgaaaattcatgcgaaaatgccataattttttttctcgcgtaaatctgtgccaaattttgtgaaatttcgctgcaaatttatctcaaaattttttgtttcatatcataattttacgaaactttgctgcttgttttttcgaaaaattcttggcataattttttgcaaaaaaattggtgccgcttaaaatttaattttttttttttgaaataaaattttttatttttttaattccttattaatccgcttcaccgcttttccattaaatcattttcccggaatttgcacacaaatttaaagctgctaggccatcaaattgctgctgctttaatccaccggatatgttaaaccatttttggcaacatattcttcaatctttgacagctaaaaattaattttggattttctttaaaattaattttgctttttcttagaaaattaattttggattttctctaaaa

SEQ ID NO: 16177 - DNA, 1109 bp, Heterodera glycines
gcaattagtgaaaattcccccaccaatgagccacgataccaatacacggtaatccgtgccgagactctcgaataggggagggggggggggaggattcgggatcgggattagcacggttttttcttcctgaggcctgggtttccgatctttcccattttttatatgggaatcagcgcctagacgctcgaatagggggtcgacgggaccataattagtcctggttttttttttttagagagacaagtcccaaggcctggatccccgatttttttttctattttttcttatttaaaatttgcaggcaaaccctcaaaattgttgacagatgaaagcgattttgaattctctggcgccaaaccccgcaaaatttcgttgcttttttttgtgggcctttaaaaaaaatttccctcaaaaaatgtgaacaccaccagcagcaaggagcagctgcctttttcatccaaatgctttgatttttatacgatgtatccactcaaaaaacgagcattttgttgtgtaaaaaatgggggaaaaaattggatgagggaaaaggacgacaaaacggacggacgaatgattggggggggggggcatttaattgtatgaggaggaggggaagaggaggaggaaatggaggaggacaacccatccatctcaacctccacttatcccatccgatgatcccatctcaatggatgaatgagtggataaatgtgttcgttcttccgtctttgttgttgaagaggaggaggaagagaagggagcagcccccgggggacgcggaagaacgacgcgaaaacattggcggggaaagaggaggaaaaatggggacacggaaaacggaggacagacgacgaggggggaagggatttgttggacatttaaagaagagaaagaagcatgacagatggacgatggattggatttaagtgaaatgtggttttgtgttaggcacattatgtaagcgggcatttttctttttccctaagggtggttaggggtgtggatttttttaaatttttctttttaacctaaggtgggttaggggtggggattttttttaaatttttttttttttacctaagggtgggttaagggggggggattttttt

SEQ ID NO: 16178 - DNA, 2528 bp, Heterodera glycines
ttttttaaatttttcttttttccttagggttggtagggtggggatttttttaattttcttttttacctaaggtggttagggtgtggatttttttaatttttctttttacctaaggttggttagggtgtgattttttttaattttcttttttacctaaggttggttagggtgtggattttttaaatttttcttttttccctaaggttggttagggtgtggatttttttaaatttttcttttttacctaaggttggttagggtgtggatttttttaaatttttcttttttacctaaggttggttagggtgtggatttttttaaatttttcttttttccctaaggttggttagggtgtggatttttttaaatttttcttttttacctaaggttggttagggtgtggatttttttaaatttttcttttttacctaaggttggttagggtgtggatttttttaaatttttcttttttacctaaggttggttagggtgtggatttttttaaatttttcttttttacctaaggttggttagggtgtggatttttttaaatttttcttttttacctaaggttggttagggtgtggatttttttaaatttttcttttttacctaaggttggttagggtgtggatttttttaaatttttcttttttatgacaaggcggtaccagggggagggaaggcgggttaggtgctaggggtgtaactgggtcccgcgaaatttcgggacttttggggccagaattatctcgatattttgatgcaataaatttcaaggagatttctaaattttgttttgggggcctatagattacagccctccgaaaaaagtgaaaatttctcaatgaaaattttttcagtagaacccaaacccaaaaatttttccattgtggtactcggtggattaatccaaaatcctgggatttcgatagaaaattggatatgtccctgacatttttcgttataagtgatcacccactccctgatcacattctaaaattggaaggatccaattgaaattgggatttttcggcattttagtggggatttttcccttgaaacatgggactgactgacacaattttcaaggaaaaatcattttgattttatagtcaatgaaatttgataaaattctttataagcctccacaatattctcggcggaatatttgtgtaaataaaagattttttgtaaatttttcatttccatccgtggaagagatttaaaaatggaggaaaaagatgatgactcatcactcccgggagatttatttgtgtctcgagaataggacggacgagagtgaaagggcacacacaaccaatgaatggatggataaatgaatggtccgaggacgacacacaagcaaaacaaaccgaggctttttggggggatgggacggacaaaagaaattggggggcccattttggagagaagggcacattgtgccgatgccgaaattggtggcaattgcgaccaataaacaaaccagcaaaatgccacaaattatatgggggaggggggagggatgtgctccgttttgtgggtggaagaactgtctcgaggataggagattagaatcttgaattttggctgggcccctgactcgagaattatccttttatcgacaaaatgccgaaattcagcccagactcgagaatgccttttcgagaaatgccggccttttttgtggggatcttaaactattttggattgaatgaataccaatttcttcagagtgctcatgccagaaaacatattttttggctcaataaatgctacttggggagcaattaatatatctaatgacccatgagtaatttgttcatcttcaatcattgttaatagtcgagagtctcgggaaaagaggggctcggaaataattcaaccgaattttcaaaaattttaatcacggaaattgtgaaaattctcagtctcgcgactcgagataatttgaaatattatagaattcagcagatggaaaacaaattgtcgagagaggaacatttatctgtcccaattttgtgatcgggagggcggggattttggaaagtgatttctgtctgatgctgctgttgttgttcaatcggtaaaattttgatcggaatttaaaggcgacaaattgtaaaatgaggtgtcagtttaaatgcgataaatggatgatgaaagtgtatttgtgtgatcagatcagtgacgccttccttatcagtagcgatcagagcaggagcaggtcgagacttgactgaccaccaccattttacctctcccaatgttgatcagataaataaatatataatatttatatatcccgcgattggcgggaggagtgatcggacggaatgtgtcattcatttaattcatccctttcccctggggggagggggtccgatcggactctctgtgctgatcaattaattgactaatgagatgatgtttgatccgacccagcgattattacacaaaagcgccggttttggaaatgtgtaagcagattaaaatttggcacagttttcccattttgtagtaat

SEQ ID NO: 16179 - DNA, 2935 bp, Heterodera glycines
tttttgagaattttaaaccaattaatattttcataagataatttttttttgaaattagccttatatttaaaaaaattatgtctcagtgacgaactgaacggtgacgaaacgatcagtgacgaaatgataggtaaccgttttttctcaatttaatttttgaatttattttcttttccctaagcgtccaattccgtcccaacatttttccgtccattcgaatggttacggcgccatcgccgccgatgcgacgcggccatcggtcagcggttcgtccaattcgtcgtccgatggctttcattgtcacgcggacggcgaccgacggccaacggacgcgcaaaacggcgcaagtgatcagaggagggcacggacagtgctgtggatgtccgtgggggtgtgctttgtgtttatgatttgcgaagtgatcggcggagtgttggccaattctttggcggtcggttggattcattagtcaaaggttcaattagtgaatacttcagattataacggacgccgcacatttggtaattggcaattagcagtggccatacggaaaatgaaacatttatttgaaagtttttgaaaccatttaaatgctatatttaaatattttaacaaattattctgcttcgtccgataaataaaaacaacacagctgaccgacttggccagcatgctcatttcgctgttttcgctttacattgcctctcggcccgcttcccagcgcatgagtttcgggtggcatcgcgcgggtgcgttaaaagcccccgcccccgctaattaatgctaatgctaatatttcctgcatttcatttaataatgatgcaattccatttcccttttagaggttgtcggcgcttttatttccgttgtgatgatttgggtgctgactggaattttaagtgctttcaattgacaatttggcctttccacgactttccggtcgctttagtgtatttggcgttggagcgaatgatcacttccgactacgacatccaagcggggattatggcgatcactgcagcgatcggagtcggcgcaacttgatgtgtgttttttgggtcgaaatgagaaaaatactcgacacgaatgtttcctatttgagcatgggcctcttactgtaccttggcggacattcgcacagccattcccaccatgggcatggcacacattcgcaacggcaaaccgaccgtacgaactttgcagagcacgagtggggtacggtagacggacggccgggccaaaacggtggcaatcgccagacgcacggcacgcggagacagacgaacatcaacgtcagggcagcatttgtccatgtgctcggtatttgttgagaaaggcaaataaacaaacttcgaattttgaggtgatctgatccaaagtgtcggggttttgttcgccggattgctaatttattggaaagtaatttcgaattttatttggggcaattaactaattaatggtcagccgaattggcacattctcgacccaatttgcacgttgcttttctccgcaattgttctcagcaccaccatttatatcatccgcgatgcgctcgttgtccttttggaaggtccgctttttatatcttcttttatttatttcaacttttttaggtcgtccgtcgaccatcgattttcgccatgtttttggtaatccaaattttttgcttacaattaacacttttaatgagtttcagacgcacttgagcacattgaaggggtaagttactaattgttccttcccctttgacagcaaaattaagcattcgatttttcctaagatttccgcttactcgtggacaaaaaaataataaaataatccacaaaggaagcaaatggataataaataacacaaataaagagaagaacaattaatagaatctcaaaatataaatattatatctatatttttaaaaaaaatgcaattttaagaaatatataaacttcgaatatgcaccaaatatccaataaaaaatttttggaaattataataattaattaacaaataattggttttcgcacttttttcggtcagaatagaccgatcctttcattaatcgttcaggtcaaaaaagtgcatgaccttcgaatttgggctctcactatggacaaaggttgtttttttgtgaaaaaagaaatttttaaattttaattaaattatttttcttatttttacataaataaatgtgaaaatgacttgaatcgtttctttggcagttgcaatttcggtccatttggaggtcgaatcggctgcggactcccaacaaattctgagggccaccactttgatgcttcgacgcgacttcaacgtgcacgagtcgaccattcaaattgagggctatcagcccgaaacggccaattgtggccaatgtgtggtgccgacaaagtgaaaaagggcaaaacggaagggaaaggagaagagagagaagcagttaaaccaagcataaaatgaagaaaaaacaactcgagtttttgttgactctttgaaaatgttgaataaattaaaggcactaattaattaattggcgagggaggtaatgatttatctattttctaccattaatattaaccattaattcactgttttctctacaaaaagtgatcgatcgttcgattagcttttccctctttttcgctcttcaactgttcgttttgctcagctcttcccgtccgtccgcttctcatttcctttcttttttatctccagagggattactctcgaattttgcgatgaaattttgaatattttcgccgacaatccttcgccgtttgcgtccttttccgaaaagttccgtgccaattgcttcatttcttcacatggttggcacatgcaattggccttcgacttcgttctgatcagtgccatgaggtcgattttgatctgctccttcactaccgtgttgaattccccaaattgtttggtttggctttttctg

SEQ ID NO: 16180 - DNA, 2062 bp, Heterodera glycines
  misc_feature (1839)..(1839): n is a, c, g, or t
cctcatcttcacgcttagtgtcagctgtactcctactgttactgccactgctccactgctgatgcgtcacataacatttgtcgttgtcgccggtgttgttggcatttttcaaattcttaaaaatttaaattcatttattttccatttttatcagagaatttccaaattattatataaataaaatcatccatttttgaattaaacataaaacacataaatggcctaattctgatcaattgaccacaagaaaaacttaaggctcttaaaattaatcagataaattcaataggcaatgcgtttattaagatagaaatagtgccatccctcgatgacacaattagacatttatacaatgtaccaaacacattcccatattggtaaacattcaaattgttcatattgcaactcgagagtcaaaattttgatggactcgagaactgacaaggagcccgtgaattgaatctgagacaaaaaaaaaccgcttctttagaacgagaacctaaaacagccctataaaccattataccgtacaatcggtttacttccattatttttcaagactttttccttcccaaaatgtttgatgggcacaagcatttttgtacatcatcatcatcatcatcatcactcatcacccattttggtcatcattacttcacacaacacgagggaggaatgaactgattttgcgagcgcgacgacggcggtaacataaaaggggacggaaagacggacggatgtgagcactaatcagaagccgaagaagaagcgaacgagaaaaaatcgaagcggcgagagagtacacatacaaggaagtaaaggtcatcaaatcacatcacatcaaatcaaatcgtgccaatgttgagttgtgagatgattactcattcattccatttccgtcgtccacccgcccgaatttgcgggacgagtgaactttttgcgtgtacaaaacagcacagaaaaccaatgattagcaaataattcgcaccataaaaaaccaataaaaagttgccgttgaatgcaaaaaatttgcgaatttgtgaattggtggtgctatttatttgtttaattgatgatgatgacgacgacagcgataatgatggatgaacgagacgcgcattttttgatcacaaaatcagattcaaataatcaaatcagagagaaatggagcaaaatggtaattggaatgattttttatgagtaactaatcatattagaataaacgattgattaacagactgatcagagacaaaaatgcgtcgtgaattgccgaacaaaaaacccaagcgattagaaagcactactcattctgatcacttaccattgatatttggtatagcaacaataagaataccagaaggaaagaaatggaaaacaattaaataaattagatcaaattaaaatggcatttaaactgtttatcaaaaaaagcatttaaacaattaacgacttttgttttgggtaaacgaaccgaaatgatatgctcaatgtaagctttggtcgacgcctggacagaaatacgcaaagggtggaaaatggaatcgaaatgaattttggcggtttgttgttgtttggccttttgtcagggtgaatcaaaaataataatttaaataaaatgggagaagagagagtcgcgaaatttttttatattattactgattaaatctgaaaattgctaaaaaaattaatggcaaatttgggaaaacggaggcaaatggaataggaaaaaacatttatttgatcatgaaataatcacattgtgcaaaatataaatttaaaaaatcgtcgtgttttcaggatcattatcaaaaatagtgataaatttggttgcccgattanaaacagcacaccacacacagagagatagacgacggacccatcatgatatgcatagacaaacacagactctctgctttcgcttattaccccacgggttatgccgtcgtcgcccgctccgcataccgacgaagaggggggggggggggggggggggggagggaaaaaagaaaaagtattagggaaaaaagcaaaaaaaaaaagaggggggaaaaggggggggggg

SEQ ID NO: 16181 - DNA, 857 bp, Heterodera glycines
gtttataaacaccacagcatcatcaacatcatcatcatccgatcgtttttaataagttttgcaaaatgaaattaatgtcgcgcgttgtaaaaaaaaataaaaaagaatgcccgccggggatgaaacagttctcactcagttcatcataactacatgaaatgtaatctcaacagctagcctcaaggggtgattggagcgagtgagtgagtaataaataataaggaatgaatggggtggactgatcagtcagaagtgcagtggagtgactgagggggggggggggggggaatgagtggcggtcggtggtgagtgatctgactgaactgatctctctgctccgctactctgctggggaatgtgcgctgggggataaatgggggatgaatgtgtgaggggggcgaataaatacactttttcggataaaaaaaatgtcatcgatttgatcgctggctgctgctgcactgcttcaaaatgtgtgcttttcacacacaaagaacaaaagggcggagtaaaaatgggtgaagaggggagggggagggtgcaaatgaatgatcaatgggcgtctcgacgccttccgcccctcacggcgctctttgttcttcatttttctgaaggatggcagcagcattttttggcaaaatgtaaatggcgtgaaacaaaatggtagccaaaatatggaatggcactcaagtttcgaagcataagacatttcgtaatttgaatgagtaaaagagagagagacagagagagagagagagacacagagagagagcaagagagagagagagagcgagagagtgagagatagagggtgagagagagagagagagcagagagagaaagagagagagagagag

SEQ ID NO: 16182 - DNA, 1139 bp, Heterodera glycines
gcgggggtcagagtcacccggcctggggtgagccccaaaaacctgtcccgcccccgggggcggggtccaaaccctacttttttgtataaattcaaaattgattttttttttgttgtatttaattgttaagtaagcaaggacagcaggaaggaaagcattaaaatttggattccgatccatacttttgttaagtaaaaaatgacatgagctcatgcgattttgagttgtcttctgttggtgatcatgaaagtgacaccaaatttgtaatgtgatttcatccgatcgttgatttaatgtctacatatcattaaattttgaatttttttgtttaaatgcattttttgtcatttttttgggcctaaaaattgaatgtaatatctgttagcccactatttcaaaagatcaacaaactgtcgatggatgttaaaccaatttaaaatgaaaactgttgacaaatcacaatttgagaaacgaaatcctaaagaatgcacgcctttttcattctccgccggcgattgtttccatcgctttcgcgccaacgtaaattttgacatgtaaaagaggccacgctccagcggcggtgccaacagagtgtccaggtggacatccgtctccgacagcaattggtccgcctcgtcaagttggtcgttggacaactatggcagggggagagagttgagaacggcacttttaattgttggggttggaaaatgtggacaaaggcacatggaaacaaccaaatttaaatgggggaacgaattcaaccccaaacccccctcccctcgccgacggaccttcaaatcggccaattttctgctctcaatggcctcaagcgttgcagaagtgggcataacacaaaatataggaagaatttgtccgtccgagaaaaattataaaacaattagacacattgtgaaaaaagattgtgacaccaaaacaaatatgtcggggcaaaaaaacaattccgtcacacaattttattcagtaaaaaagtgtcgcacacacaaaaaaaagtgaaacatttcatgtttataaacacgtggttgaaaagctaagactttgatgtcttcacactgattatatttaaaaaagaaaaaaaaaaagaaacaattgtcgaactatttttatagaggcatttt

SEQ ID NO: 16183 - DNA, 1706 bp, Heterodera glycines
  misc_feature (1560)..(1560): n is a, c, g, or t
gcattttacgggtccaatcaaaagtttgcgcgtccaatccaaaagtttatgtgtccaatcaattattagaaattatttaattatttaaaattattggcaataaatgcttaaaggtcaaaaatgaagactttgattaatacaacgaaaagatgattagacagggtattgaatacgtatttcttcgagaatttgctgaaaaattttttcgttagatgcgacgcagtgttttcaattgtgtggccaaattgttaataaaaaatcacaaaaaattttgatatcagaggttatcgaaaccaaaataagcacgcacaaattagtctctctattattaaattttataacaattgattgaatgcgtatatacctatcgatactttgataataagtgatcaatgacggatttaaattttattaaaaactagcggggaaagcgccttcggcgcatcccccgctaggtagtacgatgtattattgagctatgaataataaaaccgaaaatggctcggccgcttcgcggcctgggactcaattcttcggcattccaatcacttggaatcactcaatccacctgcattccaatcaccaacaataaatctcgccgattcttctgcataccaatcgctgggactcagttctacgacctttcaatcaccgttactcaatccatcagcactcgaaacacctggactcaatctcaccaattctacataggcaaaacattttaacattctactggcctttttgattcttgtcatttcttaaacaaccctcggcatttcaatcatcggaactctatctcaccaattctccggcattccagtcactgggaccaacccaccagcattccagtcactgggactcattctcctgcatttcaatcaccgggactcaaccctccagcatttcaatcactgggactcaatcctccggcatttcaatcactgggagtcaaatctacggcattccgaacactgggactcaattctccagcatttcaatcactgggactcaattctcctgcatttcaatcaacgggactcaaccctccagcatttcaatcactgggactcaattctccagcatttcgatcactgggactcaatcctccagcattccagtcactgggactcaattctcatgcatttcaatcactgggagttaaccctccagcattccagtcactgggactcaattctccggcatttcaatcactgggactcaatcctccagcattccagtcactgggactcaattctcatgcatttcaatcactgggagtcaaccctcatttcaatcactgggactcaatcctccagcattccagtcactgggactcaattctcatgcatttcaatcactgggagttaaccctccagcatttcaatcactgggactcaattctccagcattccagtcactggtactcaattctccagcattccagtcgccgggactcaattctccagcattccagtcgccgggactcaaccctccagcatttcaatcaccgggactcaacccaccagcattccagtcgccgggactcaaccctccagcatnttcatcactgggactctatcctccagcattccagtcactgggactcaattctccggcatttcaatcaccggcactcaattctccagcattccagtcgccgggactcaattctccagcattcagtcgccgggactcaacctccagca

SEQ ID NO: 16184 - DNA, 1174 bp, Heterodera glycines
  misc_feature (16)..(16): n is a, c, g, or t
ttgaaaagcgaacctntaaaacagacgatcccaatgagtttttgaaaaacgacctttctgacccaaaacacctcaaaccctagagaagtgtcgttcaaactctgccatttttgctatttgtgcacttttttgcggaaaacagacgatcccaatgagttttttgaaaagcgaacccttcgacccaaaacacctcaaaccctagagaagtgtcgttcaaactctgccatttttgctattgtgcactcttttgccgaaaacagacgatcccaatgagttttttgaaaagcaaaccttctgacccaaaacacctcaaaccctagagaagtgtcgttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgagttttttgaaaagcaaaccttctgacccaaaacacctcaaaccctagagaagtgtcgttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgatttttttgaaaagcaaaccttctgacccaaaacacctcaaaccctagagaagtgtcgttcaaactctgccatttttgctattgtgcactcttttgccgaaaacagacgatcccaatgagttttttgaaaagcaaaccttctgacccaaaacacctcaaaccctagagaagtgtcgttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatccaaatgagttttttgaaaagcaaaccttctgactcaaacatctcaaaccctagagaagtgtctgtcaaactctgccattttt

SEQ ID NO: 16185 - DNA, 998 bp, Heterodera glycines
  misc_feature (953)..(953): n is a, c, g, or t
  misc_feature (980)..(980): n is a, c, g, or t
cgaaatcagagaaacagacgatcccaatgattttttgaaaagcgaacctcttctgactgatttttgaaaagcttctgacccaaaacacctcaaaccctagagaagtgtcgttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgatttttttgaaaagcaaaccttctgacccaaaacacctcaaaccctagagaagtgtcgttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgagttttttgaaaagcaaaccttctgactcaaaacacctcaaaccctagagaagtgtcgttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgatttttttgaaaagcaaaccttctgacccaaaacacctcaaaccctagagaagtgtcgttcaaactctgccattnttgctattgtgcactctttttgcgaanacagacgatcccaatgag

SEQ ID NO: 16186 - DNA, 2819 bp, Heterodera glycines
  misc_feature (59)..(60): n is a, c, g, or t
  misc_feature (63)..(63): n is a, c, g, or t
  misc_feature (67)..(67): n is a, c, g, or t
  misc_feature (87)..(87): n is a, c, g, or t
agcctttgcgtacaaacaaaaaggcatcgttctccctttctagggagcatccctcgganngancggncccgggcccggctcacgtgncaaaaaactttttcatctccttatttttcttcagttcctctttcacgtcacactcgtaaaacgaaaaattaaaaaatttctaaatttatatttacccaaacttctccgattgaaaagtttttacactgttcggtccacacaatgggtgctaagccaatgtttagtgtccaacaaatataaatatttattttgggtgcagacaatacaatttatttagaagaaaataaatgaagagaaattggggaagaacaataatgtcaattgcacaaaaagtgaactgaatagggaagagtgaacatgaatgagggaaagggtgaatttaaataacaaacgaacagaggggaagggaatatcgattgggtcaaagggcattgcgtgtggcgttatgttgaccacactcgaaagccgaagggcgctgcccctaacacctccccttttaagaagtgccgcttccgcttaatgagggctgtagcggtccggtggtcgtcgattccgtcgagggtatactcggggagtgatcggcctttcctcattcggctgttcctcctgttcgatccgtccatcattctgttcttcgactgcccggccgatttcatcctcatcggcttcacttcgaacggcttcgtcttgaggctgtacatcttccggttcggctcttacctgcggtggaaggccgaagacatcattgaaaatgttcaattggtccatcgttttgtcctcaatttgccgtgggcgtatttgattggcgtgaaaccgattggtcgtgccatccatgaatttaacgtcgtaaattacgccggtctttttgacgacgtttcctggacgccaattctgcgaaattcggtgacgggcgaagattttgtcgccttggccaaactctcttggtttggcgccaaatcttttgttgaaacgccgctccatcagttcatcacgctccattggctgaaactgcggcgggcgcaacaaatctaatatgtgaatccgttgccatggtttgctcgccttcggccatgaatgcagctccgctttgatggacgatttggccgcgagctggcaaggctcacaatttctgacgaaatcctcgatttccgcgtccagttttggccaatacacgtggttccgtgccagttgcttcatccgctttattcctggatggcctttgtggagcattcgtaggactttcgctcgaaattttggcgggatgacgactcgttctccgtacatcagacattcttttgtgatggagaggtcatcttttcgacgaaagaacaattttatttcttccgtttccgaagcaattgctttatcattgggtcatccatctttgacaaatttcttaacctttttgatggtttcgtcttcgttccctgctgaaattatgtccttcgatgagagtgacattgtttccaaagtgttgatgaagaaattttcggcttccttctcaaattccatggacgcgatgactcggtcttcttcaggactggtgctttttgcaatcagccttgagagcgcatccgcttgtccaaattctgtggtgttcacatactcaatctcgaagtcatacgccaacagcataagtgaccatcgtaaaagacggttagcactcatttggcggattccctttttgttgccgaaaatggcgaggagtggcttgtgatcagtttgaagaacaaattttcttccgtagatcattttgtgaaattttcgcactgcgaaaatcaaagccaatccctctttttcaatttgggaataatttctttcagcgggtgtcaaagatgatgaggcgtgttcgatggccttaattgctccgtttggaaatcggtgggaaatgactgcgccaattccatgttctgaggcgtcagcggccacgatgatttccaattttgggtcatagtgcgtcaggagcaaatccgaggacaaaatttccttgattttaatgaatgctccttggcattctttgccccagtcccagtctttgtccttcttcagtagttcatccattggttatcggatgaatcgcatttcttcacaaattgttggtaatggtttaccattccaaggaacgtgcgaagtgacgggacgtcttttggtgctggcatattcgttattgccgcgattttgccttggtcgggtcgtcttccatcttagtcgatgatttggccaagatacttgatttgttcttggaaaaacgaacatttgtccattttgacccgaaatccccagctttggattcgttcgaacactttccagattttgaaagtgctcttctttcgatttgctgacaattatgatgtcatcaaggtacgccgtcgcaaactcgagtccggccaggagcttatccataacggattgaaaaattcctggtgccgtcttcacaccgaatggcaatctgttgaatttgtagtagccacggtgggttgcgaccgtgcatagctttttcgcttcagcagtcagctcaatttgcaggtaggcatcttttaagtccacctgagagaagacttttccaccattcaacgtcgcaaaaatgtcatttggcaacggaagtgggtgctgatggtccaatagagcgttgttgaggcccgtcgagtagtcgatgcacatacgggctgttccgtcggcattcttcacgattagaatcggtgccgcccaatccaagtgctcaccttttgtgatgattcctaggctctccccccaaacgagctctttctcgacaacttaccgtgagtgtgagg

SEQ ID NO: 16187 - DNA, 2051 bp, Heterodera glycines
ctgcacttatatttgaagaaaggctcaatctctttttactactttatttttttgatttggatttatttatttcgtttttttatagttttagagaattttagttatggttctaattagtctttaccgttggcagggccctcgttttttattattatttttttcagatggatccaaaaaatgtttagacaattgactatttttaagttaaaattgactaaaaaaatatcccttttttagcaatgttaaaatttggaaaagtacagtggaaaagaaattttggggtaaagatcaaaaaaatacttcggattctcctctgattttttcagcttaagcgattttttctcgccatacacgtcctcgtatttcatcattctccatgaattctgtatgatcagtagaaattgagtttgatctgacccctgagttagcaaatttagttaaaattttcattgtaaaatattaatatcaacgtaaaataaaacattaaaaaatacttttaatcaataatttttaataattattttttatattatttataaaaacttttaattattgttttattgtttttttaaagtcaatcagaatgttaactttttttaggataaaaccatttttttggggaaagtttatatatgtgaggaaatgaaagaaatattaatctttatatatatatctcaatcaggccgaaaatttagtcatatatgaataaaatcattttcaaattaaattttaaggttaaacacattcattttaaaaagattcggttgaaattctttactcattctggtttaccaccctttttccagaaattcataaccaatatgaaattatgtaaaaaaatttccctgattttattgatggttttaaaaaaaaagaagaaatatataaattccaacaaataaaattattttcttatattagttataattaaagacagatttttggtgttaaaagtagtgaaaatgtactaaaatatgtgataaaaaagtacaaaatatgaactaaccccgtttttaaggtgttaaaaaattcgctcaaattagagaaaatgtgttttcgttgttctctcgtcaaatactatccgtaaaaatatgttaaaaactaaaaaatcaggactctaattttaatgaggttaaaaccgtaagctaaattgtagtgaaaaaaagtttatgtgcatttttttgcgctaattcaaaaatacactgataattgtcttttttgcacaatttattttattcctaacctgaccgaataaatttagtatataaaaaggttttgaaatggagaattttttctcttcaaaaaaagtaagcaatttaactcatatgaaaaatattatgaaaattttaaaatttaagttataattcacctcctaaactgctgattccaaccaaaatgctaaaactaatcattttatattgattctaaatgtctaaactgattagtacctttatagacttataacaaaattataagaattagctaatttgatgttttttagtatattaaagatgtgtaaatagtacgacaaaaccagagaaaaaaaggtcattaataacagacttatacttttatttaatgttttaaaataattttagttatataaaaggtttttagtaaaatcgttttgcaccagtgatttctaaaccttaaatttagtaaaacatttttgcatcaaaaaacattatttgatagaaataaataatttaataaattttaattaaaaatcataaaaccaaacctaaaataatttgttattaatattcatttttattatttgttcacaaagttagtgatttaagatctacaactcaaaaatttttttcagaggtaaaatttaatttatgatcagtgataggcaattcccaataactttgaatttttttgagaatgaaagtaaaaatatatttttaaaattaaactttaaaataaatcaattgaaattatttaattttctcttttgatgtacaagaacgtgttggttttttcaaaatttcgaaaataagtttaaagggaggttgacaaaattttattatctatgtacagaaaat

SEQ ID NO: 16188 - DNA, 1520 bp, Heterodera glycines
  misc_feature (1476)..(1476): n is a, c, g, or t
  misc_feature (1480)..(1480): n is a, c, g, or t
ttttaatgactaccaaactcgtccaatcacaaaatcagacgtcaccgattaccaattccctattctgctctaccaccatgacaaacattttgatggcatcaaaactttgtcaaaattttggaacaaacgttactattgcctctcctgtgaatcagcattcagcaataaaccacaacattcaatgaactgcacatcactctgtcacggctgccgagaggtgggcgtcgactacccctgcgaagcccaacaaggatacttcaaaaaatgtttgcattgtaacaacaccttctacaacaaagactgctatgaacgccacctacacaaggatttatgcactaaatttcaacgatgcgaagagtgtggggtagtttacaacataaaagttcatgggagtgttgggcataaatgcggagaaaaattttgtcgtctgtgtaaacagtttcacatcaaagaaaacgaccaaatgaatgcttgcatgagctgtttcattcaacctatgaagcaacaacgaattaagccgtatagaatcatagcatacgactttgaggcgacacaggacaagaaggtggagaaccgtttcgaacacgaggtaaactttgcagcggctaccatcatctgcaccgactgcattatcaacggcgactggaacaaatcacttcagggaaaaaactgccaaatttgcggtcctcaccgctcaattaccttttcaccatttgactacacggagacaacagttgaccaaaaaatcgtcacgcaagaaccgctacgcaaattcgttgaatggctcctttttgaccacaacaaaaagtttccaacagttgcctttgcacactttggtggccgttatgacataacgttatttatcatggaaattattaaccaaggtaatgaattcaattttaaacatttttaaatatttcttaaggaatacacacaccacaaataatcaaacaaggaaatcgtatctatgagctcaaaatcaacgacaatggacactgccccctcacaatcctacgcgacagctacaatctaatgcccatcaaattatcaggactcatcaaatcgtttgggcttaaaattcaagtgaaaaaataatactaatagtaaatacaatttaatttaaaataatttttctgttttccaaaaaaatttttttgactattcttgttttttattgtcgatttttctgggagtaatctacaattttatgtgatcttattagtttttttaaaagatttattaattcttaggactaaaaaaaacatataagaattagagaaaacatgtaatttgtgagagaaaaaattaacactatttctaaaataaatatttatcaaaataattaagctcttttttgtaaaatcaaacaaataattttcttaaggataaacagtacttccctcatttatttaacaaatcatcaaactacgataaggtcctccagcaccttcctccacgtgaagactactggtctanccanaagaagaaggccgatctgcagaaatttgacgactggtaca

SEQ ID NO: 16189 - DNA, 1320 bp, Heterodera glycines
acgccgggaattcaaacaaaatacacaacggaatggtaaacatggaggaatcgacattctttgcaaagcaatgaccatagccagcgcctgtgtcaaaaattatgcactcaaccatttgaaaccgaactctcttgccatcgtcccggaaaaaggttacactcctcaacaaaaccaaagtgcactgtccatcaaatttcttgactggtactcgcacatcaataacgtcaacattcaaactgcacactcccgttacggtgaatatgtgtttaagcgtgaagggcaggtataccaagtggacggctacatcaaaggcacaaatgggaagcgggacaaaataatagaagtgaatgggtgtctgtggcacggctgcgaggagtgtttttgtaatattgacgaagaaacaaaaatgccaaacggaaagacgctgcgggagattagggaaagggaagagaagaaacatgaaatattaagcaggtacgtcgacttggaggttgtttgggagcacgagatcaaccagaagctgaagaagaacaagcagatgagggagttttttgataactggagggaccgctcgccaatcaaaatcagagacgcatttcatggaggacggactggaccgatgaagctactccacacagctaagcctggccaaaaaatcagctacaaggacttcacaagtctctacccgtggaccaactttacgacggactacccacttggtcacccaaaaatcatcagtgttccaccaaatgagcagacggttaactggcgcaccccaacagacaacccctacaaaggtctactcaaagtgctgcttctacctccaaacaacaacatcagcgtcaatgttatgcctgtaaaaataaatgatcgccttctttttccaacttgtgaaaaatgcgccaaatattttactaaaaaacaccctaacggcctcaaagacaacgactattcctgtccccacttcaaccctaacgaccgcgccttcgtgtccacttgcacccatcttgagttaaacgcagcattggaggccggctacacagtccgcaaagtcttccacgtcctccaatacgaccaatggagcgacaacgttttcaagtcgtacgtaagcgaaatgatggccctaaaaatccacgccaccggcttcccgtcatggtgtggcagtgagagggaaaaggacaaatacattgaggagtgttggcgaaaatttggaattcatctggagaaggaaaagatgaaaccagagcccgggaagcgctacatcgccaaactctgcctcaactcgctttggggccgcttctccatgaggaatctcctttc

SEQ ID NO: 16190 - DNA, 3282 bp, Heterodera glycines
  misc_feature (10)..(11): n is a, c, g, or t
  misc_feature (3208)..(3208): n is a, c, g, or t
tgcaggtctnnttcgacaaacatttgagaaaaaagtgacaaaaggccacctctaagcaaacgaatgaattgggggggggggagagggcaaccttcattcattcgttaagggatagaatgccaaaatcatgcccaaaaatatacacactaaaaccgttgaattatctaattagtcggattgcttttcgtgactttaaattcaaatttgcacaaaagtaatgctaacttgtcatttatcaagctccttaaaatgcttaaaaaatggcattatttggctttcaaatcctttttgttaatattttcgatgtcaactcctcgtttaaaatcattttgttttttcttataaaatgcatttcaatattttaattaaaacaatttaaacatcatataaaaaatgcttaattattaatgaaatgatgttgctcattatttttctgtcatattcattgattttttagctccgttaatttggtaatggagttggcacatcatttctgaaaaataagaaaaatattatataattttaattaaaaacaaaatgccttggaaaggaagaaggagttagtgggatttcaatgttgatgaagctttttcttctctgctggtccaccactgtgtttgtgcttctatccgaatgcaaataattcctcacaaaaaaatcttttattttcagcttgggtccctgaaaagttaaattttaaacaaattattttaaactcggattttggcattccattcattttttgcattttaaatttcaattaatcatttttactgattcaccaaagtccggcgattgtccgcagcagcgggtgccctttggccccaactttgtgccaattgcatatggtaaatttgcgcattgttcgacactaccaaattttgtcctaatgcgtttctgatttgtattccgtggcgctcatttgctaccgtaatgttcgggtgtactgtggccactgaactcggagagccgaaaacaaatttcctgcagaacaaaattgatacagtaaaatagccaaaaaagtctgtttcaattcagacaaaataaattcggaaatcaaaaaaaattagaaaataaataaaatttgtttagaatttttggaaaaaaaatttttttgaaaacacacttttagagctatttttaaaatataaatgtgactttttatttttacagcattttaagattttcaaaaataacgaggctgttttaatgacgacgcacataaactgttttctgataagtcgctgtgcgtaaaaatcagcggcacaatgaacagcagagagtagagcgctaccgtaatgtcataggcatggttacagtacaaatggacgtagtaaagacactcgggaaccacgattttcaagattacgatcagcaaagtcatggtgataaaattgcgaagggtggtcagtgcggccagaaaaaggaaggtacgcagcacgcggattttgacagtgatctgaagcggaaggaataatccaaaacaaatataccgtatttcctgattaatagacccccttcaattgtaagaactcgtactggtatccccggcatggaaacaacacttttattattatttgatcgaattaaattttcgtttcgtccatagtttggcaatttattggctttcgaacattttcatttttttaattcatacaattattttgcccattcgttcattttgctataaatgttcttgaattgcttttcatcttttccttattttaattatttctttatataatatgaaatatttaaaaatgctcaaaatttgctattattttgatatatttggctttaattttccaattttacttgatatctttcatccaaactgatcgcacgcatcgttttgtattttttgcgattgtaaaagtacagtcgcaagaataccttaaatataaaacatatttattatacagtatacaatccaataattacaattttaaattatgcctttttctaaacaaaatttcatattcggaaagacactcctttcctcgaaaattttttcaagtgatataattttttactctgtctatttaaagggaaaaaaacattttttcttgattaaaaattgctctaaaatttgggataaaaattaccatccaactgataatgttaatcacttccagcacagcaaattggggcactgtttcaataatgcctgtggaacattttgtaaatcgttttaaataatatataattacttaccattttgttccaaccaatatataacaattgtagtagaccactaaattaccaaaaattaaacagtcaatatggtaattagtaagaaattgaccggccaaaaggtgttaattgcgctgagtgtaattgtggtcgatttcgttgggtttggccaaattgaatagacgaaaaattccattgtgatggccagagtgatcaaagtattgctaaaataacagaattaaattacacaattaagcaatgctttcacgcacacgtttatgctgacatcgtggaaaatttggacgggcgccacaaaagcggcgctgtaaagcgaattgatggaaatgtactgggggatgagcacgaaaagcctaaatatttcaaaacttaatttaaattcaaattcaaatgtccgaccgcgtggcggcgatgccaaaggcggcgaaaagcatgttgaggaaaagcactttcatagtgccggtgaacgaagtgatggcggagaccattttggcaaacggtgccgaggcgccgatcacgcaaacgttgacgaacatttcgaatatgcaaaggccgagccgagtcgagtccatttcgtacgcgtcgctgcaatttttggccgtgtgttccatcggttggattatgttgcccattttggacacacaaaatgatcacagttttggcaaaaatcttttattttggaaattgatacaattactttttaggttaattaaatctgatgaatcttaaattattaaacaaattaattttaattttttttaataaattttcttgaaatttaaaatgtgtcaaacggccaattgggtaaattctctgagaattatcaagtaattggcctttttaaagctaaaagttagatgcatagcacgaaacgcatttgtttctagtgaactttttttctgattttgcactaattacgatcgatttagcggaggcatatggtaacaattgcgtgttttgcctacaaaatatacacaattgcgcgtgcaattagcgngcttcacccgttggttgctttcagttcaattaataaaaataggtgttacgtcaaattgtcaaggaaaagcgggg

SEQ ID NO: 16191 - DNA, 1482 bp, Heterodera glycines
aattgttttaaaagttcttggggatgttttttattttcctaaaatgacacccccaatgtccgggatttataaaattttattttcctaggaatattgggcatttggtcattttattgtttaattttggactttttattggaattccaatatatttataaatagggatgccatattcatatgaatccatggtcagcaatagggctggaagtttaagtcagaggactttttttgtggactttaaatggcttaaaaagtgtttgtaatacacttggttggaagctgctaacatgcatttttttagactttttttctacttttgggataggttatcttttgcacttttatgacaatggttttattatgaaaattggaaatgtaccttttagcaattgtattgaaaattaattgtttttataaaatattcttctaaaattattaaaaatggatattcttttttaactttggctaatttttcaagactatttttgaattttttcgtgactttttggcgattgtttatgactaaggctaatattttaagggttttacggttttacctatttttcctgagcttcccgtggcctgaaacgcacgaaaaacaagttttttgggggtttgttaagctacttttcgagttattagagcctattttctaggtttttatttttaaaacctaaaaagcctaaaattaaaaaaaaaaattattttcacctattctgccgttttgcccaaaattataaagaaaaatgcaaaaaaacgaaaatacatccctaataaattaaaaattttctcaaaaattcatcttttaaattatttatttattttattgacaagaatttttattttaagtattatttaactcaatactgatttggattaattttgtttcttttttgaataaaatctcattttacaccccttaaatttgaggtttttagtgcctattttggcagtttttagagcctaaaaatataagccctacttatgactttttgtagtcaactttttggagatttttcttacttaaatgcccagccctaatgatcagtgtgactcattgtcactgagtccgaaataataataaaatgaaaaagggggcggcggggaaaagacgaaaagttcgaggcgttggctcgaactcctcgaaaaaattgtgaatgattgcagttaatcctcgcgatggaaaaagaaaaatggcatagagaaattatgaaaaaggtgggatttagttgggatcaatgggatgacgggacattagtattattattttgagagatgacggatgatgacggacgacggctggaaaagcccatcagtgatcagaaaaagcggagaatggccggggatggggaaggggcagtcccccgaaaagccattggctaatgccatcgccctttggccaagaattgttggtaatgagagagcgagagagagagagagcgatcgcgtgagccagtggaaagacaagagagggggagagag

SEQ ID NO: 16192 - DNA, 1755 bp, Heterodera glycines
tttataaacacagctcccataaagtgccatcactttttttgtttccaaatggttaaaggcgctgaaaagttgttggaattggtcggcccggtcggtcggtgtccatccaaccgacccatccgtccccgttaaattgacaccccggggcatgcaaaagcggcacaactgacaaatcccctgtggcatttgcccccggcgggcgtcaaaaacattcggcgccgccaaaagtggacggacaagcacacaaaaagctcatccattttttgtttgaaaccggtcagaagaagcgatattaacacagctaaacacagccgagaaaagaggggggaaagtgtaataagagtaatttaaaaatggaaagctacatttaaattggatttcaggactaggaaaagtggataaccgaaagggataccggagataacaaaaactaatttttgatcgaaaaaccggcaaatccggcctaattgaaagctgaaaaccacgtcctaaaacaaaagagttaagtaaaaatgtcaaattgagaaaaatgccaaaaacattgaaagaaggcggaaagtcggaaaagaataattattaatggattttcattgaaaaagtcacgagcagcagaaaatggcggcactatcaaaagttggggaggaaagaaaatgaatggcaatgaataaaaaaggagggggaatagggaaaatggggaaagaaaagcaaaatggaaaaaagaaaaacaatgcaattttaatgtgaattaaagcattaaacagctagttgaatttaagaccatttaaattttattttcattttcatgccatttttctaaataattccaagagaattttaattaattttaatccggaaattcgaattgcgacactttcgccttttgctgaagaattcattttgtgcacattaatttcctgctgagcgccataaaatgaggaaattgaaatttgaggagagaaagtgaaaaaggcaccgaaaaggaatttaaaaaataatttaatttataaaaaaaacttattatataatagattaaaatgatttgtatattgacaaagctaaaaatatttttacaaagtaaagaaaatgccattatccaatggattggctattttaaatgtgcgcaagcaatgccaatggtaagaaaagggcactaaataaaagcatatattttgtgccagaaaaacgaaagcgaatgaatggggcgttgtgccaatgtgtcgcggtcgcttcccccccccccctcccccaccgctcatcatttgttttggctcggtatttccgcttcacgaattttaaaggtgcaagtgcaaattgtggaaaaaatgaccaagggatggcctttttaaaagcaatttaaataattattgattgaaataaatatcattttatgttttttctggtataatggcactgaatgccaacgattttaaacccaaaaaaacgaattaacgatatgaaataacaattgttatacaaaaaacaatttcgatggaaaagacataaaaactgataaataaattctgtaaaaaaaataataattaaaaattttctttcattactttaagttttggcccttaaaatggtcaatggatgtctgctatatccgctaagattttgttaatatttcctttttgaatggttaagcataattcagaagcataattctgcttttttaaatccgtaaaaaaatctcaattatgacagaaattatttctcactccaacattaatacataataataataaattacataat

SEQ ID NO: 16193 - DNA, 1808 bp, Heterodera glycines
  misc_feature (1796)..(1796): n is a, c, g, or t
atttaacataattagtaggaagttttaagatgccttttgtgaagctgtccaccctccgccccatcttcaaccaccctcattatgaaagtgaagaagtccggtactgtcactgtttttaacaaaaaccaacagtttgcttcaggaatagaactttgctggtttattcgctttacagtaggaaatccctcaccgaagtaatgtaaaaaattatcgtgcaaaattccacttttatttctttgaaggtgtaccattcgctgcgttcttcgaacattcatttttacgtgtttcagccgcaacaatgcatagagaaacacccaaagtgagttcataaatttgcttatgcatttttacccgtttgaatacggtagaaacggatgttcgtatttggaaatgtgggatgagcatgacgcgtccaacaaaggtcgaccatcattatgccatcacatttggaaggcgggaaagaatggtcaacaaatggcaccgtttcggcctgtctattggtcgtcaacttacgttgtgttggctctgtgattcgccagtgtttccgagggtggacgaacattttgactcaattttcatttgcctttttttaccatttactgcgtgtgagaccattactttaattttattctataattctcatttttaattataacaataaattttgattaaaactattcccaagttctaacaaatatccaaatttattttgaccgcctttatttttggtccttctctacgcaatttcagttttgctccgccctcctccccccccccccccactttctctccttaaatctctcaacattcgctcccttgtcagcgctcttcttcaaattcactcaactcaaaacccaatcgtcctccttttccctttcctttgctttattcccctaaattttttctttgctttttccgattccaccgatgtctctcttctgttcgtcctttttgcttatgctgctcattacacaaatttgcggtaattatccttttttattcctcccatatgtccatagaaattcctccaatggataaaaacggacggagagagaaaaaatggggtggggataaaatttggattattcagctgataatactatatttactattgttttcaaccgtttattttattccaccgaatccttttttaatcgtcgtccaattcctccgcccctaagaccacttgagtttaatctgccggatgagatgaccaaattgggcacggcataagaataaacttttggcaaaagcagcccaccgacgatggcaattccaactgcgaattggacggaaacccccgggggatttgggcattttcgccatttatgcaaataatccaatttctgcaaaataaacacagcaggcgaaggaggaagaaaaaacaataaaagttgagggggattaataacaagaaataaataaatggaaatcaaaatcgactaaaatgtcataaattggcgggagggaattgataggacctggacgcgttggacgtccgaccggcttttaccgagcccgttaaatgaaaataccgggcccagtcgattgtcaaagaccggtggtttcgaaattccagtctttattattaattacctttttttattttgattgatggcaaataaaagagaaagattcattgtacaatatttgcgaccaaaataactgtaagtagtcaaaagaaacgcactttgcttcgttcactaacaaaaaaaaaaagttaatccaaatccaatcggacggagacgaaagagcagagaaaggaggaaaatgggggaaaatgagggcgggggggngggaggaggggt

SEQ ID NO: 16194 - DNA, 1196 bp, Heterodera glycines
  misc_feature (64)..(64): n is a, c, g, or t
  misc_feature (94)..(94): n is a, c, g, or t
  misc_feature (138)..(138): n is a, c, g, or t
  misc_feature (189)..(189): n is a, c, g, or t
ttatgcaaaatttctcaaaaacaaagaatcactatatgatattgaacaattttgagaaagaaanaacaaaatggtatgaaatacgttctgctanaatggaaaggatacagtattaaattcaatagctgggttccatgnagttctatctccgagaaaaatatataaaaactttattgcgctttatctttntaaaaaaatgccatccaattctttttacattgttcttccttcaaatacaaatgttgaaggtaacaagacaaattcattccgggttcgtttaccacgaaaactacaattcaactccgaatgggaagttggcctcgctgttattgtatatcctcatacttggccttcgattggtactgttgaacagcaatttgtagaagttgaatggcaaacaggaaatacggtgcgtatagaagtacccccatcgaatgtcacaaatccaatagactcgtgtatattggtctataggctagcgggggcacgcagtgatcccatagctaaaaaactgtaatcggaagggactttctctttctctcccattttccctcccgccccctccctccctctctctcccctgtcactctctctcctctctctctcctctgtcactctctctctctctctttttctctctctaactgttacagttacagtatgccgttttaaggttgcatggactcggcttcgtgacgatgctttgctcgcggtcggcaccagcacttttaccttggacccgcgttttcaggcatttattttgcgtttgagaaggcttgcttatccgttgttaaggtgtccaaaccacggcggaagaatgaatcggattgggtgttaattcttcggagaccctcgtgacttttaggggggaatttggagaataatgacgataattaaggcccactgatcagggctgttatctttgtggtaagaaaatggcaatgattggactaatccctcgccaatgtaaagaaatgaatacggagccaacgagctcaattgttccggtgtatctgaaggtgagcatagacagaaatgaagtgaggcgagaggaaagcgaagaaacggcggacgaaatgcgaagtgagtaaattaacagtcattaaaagtaataaaaaatgaattatccgcaaaaggggtgagggaataatgagaatacggaagggaaaatgatcggcgggtaaaagtcggataat

SEQ ID NO: 16195 - DNA, 2945 bp, Heterodera glycines
  misc_feature (59)..(59): n is a, c, g, or t
ttggattttgacccacaaaaattaaaaatttttcttaaaaatacatatttataaaattntaacgaaaatattgattaaatttaaattttcttaaaaattgtttaattattttaatagcatatttagcgatttagaaagttttattttgcgttaagcgaatttgaagaaaattttgaaaaattataccctcaatttggaaaaatttatgtcagactttttgcaactatgtgtccatatttcgagattttcgtatgtccatatttcgcgatttttatccatataattccgaaccctagacatcagaatccaaaatttttaatatagaaatgagttttttttgagctcctttcttcaaaaatttataattattaaaaattgtgaactgtttagcctacaatgatttcagccgcttttaccgcagcgactaagtcagagaatgctccgttccgattcaggttgttgaagatgagagtttcggcgattgttgacccttaaaggtttctatacaaaaacaaaaagattgatttaaaattaccaagaaaatatttcatgtaagccgttaattcatttttggtgtacagcttgcgataattgatccgcgtttcaccttgcgaaccctcggctggttcgatggtcatctgagttaaacaaaaacaatttaaaaattaaattttcttacaatgacaattttggtacaatgacgatctaaccaacacgcgacagcatggccagtctcatggaaactaggccgttgttcttccacagcaatggagttccattgcatcattgctgacacgaactttaaaatatttaataaaattaactgggtagagggaaaacttgtcaactatcgtattttttggtttaataataaatttttttaagcaattttttacagctgggagtttatggttgtgattttccatagttttgccagattggcaagaccagcttcggcaagtgagttaagtattagtatcgcttttattttttcaactcccacacccaaaagaagagcttaatttagtggtattgacctaacatagatggactttattttcaactctgtttttcaaattcgaaatgctctttttggaaaatttttgcaaaatttttaactgcttttgagcgattttgcaacacacggcggtttttgggggtcctgatcacgacatcttgttagcattttctacctcatacaatttattgtatttatttttcaggaaattttatttgtgtaccacgccaaagatttgtagggcccgatgcacttaccaaccatgtggattttttaataaactgaaaattaagaaagaaactaattcattactttttcagattttgtgacatttttttaatggtttataggatatattttggggggtttttcgcacatttaaatgcataattggcgttttttgtaattaaaaataaaaatcctagccctcgttaaagtagaaccctttttattctcaagcattcaaacaacagcatgcgattactcttattcttccaaataaaatttttaattcttgtttttgtgaaatttatggaccgaaattgtcatggaccagaaatgccgggacctggccgaaattttcaattcggaaagaaaatagcgaaaagtaggcaaaaatatttcaaaaattaattttaattattttttaatgtaaatataaaaatctttttaaaatataaaaaaaatcaaaaaatgcgttcttttaaaattttgcttaaaattattctcaattgtttttaatttgaaatagctaataaactaaagcgtatttgtatgcctttcctttttcgacaaggcgcttaaagcggcagctgctgatggtctacttacgggtgagtttcgtgcattcacatggcgaaacttggcaaggctgtcattaccataatggcacccttcgaatacagcacgatgatattcagtggctgatgctgtagaccagtagaaaaatagaactgccaaaacaataatgaatttatgaaccattttaactctgtcaaaaatgtaaaattaaaagactcaaatcacggttgaatactgttttctttctcggtctcgggttttttggctcggaagccgagaaatttttatgctattaagatggcctcatcaattaatttacgtaagacaatgtgcgagtcgcagccgggtgggatgcccagtcaaacagggagaaggacgaagacccaatcttggatccactaaatggggattagtaataggggcggggattcccgtacatagattgtaaactggcgaataatgatcttcctggataaagggcattcaaaatacaaaaatattttattaatattttccatttttctgcttacataaatacatttttcgcttctcgattcgatgaaaaaacatttagaatgattttatttcctttaacgggattgatatgccgatgatattgacggccaaagcagctcccccccctcgtcccttctccgagtgtttttccgcttcactatagcattgggtggtccttcgtcccgtcctagcgctctttctttgtttttctccatgtactttatttttcgtagccatggacaactaattttatttcgcggagcggaatgggtggtcctttctgcccccccccactcccgaatgctttctcttctcaatttacgtccacgtcagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagcgaaattttttctacaactttttaatagttaaaatcataaagcaaaaatcattatttaaaattttattccaaatttaaaaatcaataaaacgcttttttgaggcgcgctttttcactagaatttagtagggcgaaagctgat

SEQ ID NO: 16196 - DNA, 1990 bp, Heterodera glycines
attatttcatgactatcatcttgaaaatttggaattctcttccatagttttaaaaattcgataataaactaatacgtaactattaaataaaaatataaaaaataataattttctatatattttagaaaccccaaaaaaggaaaagcaccgtttttatgcccgattatataataaatttttgttacaaaataatcccattggaaaatggaggacaaaaattacattggacaaatatttgtacagcgaatgggcagaaaattattttaacaatgaactcaaaaaatcagatgaagctggtaagaaaaaccgaaaaaaaatttattatttttaaaatggcgaaaaataataaataaataaaaatatatttaaaaaagaaaataaataatttgtcacgaaataattaaagaccaaacaaacaaagtgagaaaaaggcaaattattgatgagctgaattcgatttggaaatgctttgaaaaatacttttggcttaatgaacgaaaaattcgtgaaaattttgaccaatttatgcgaaaaaatcgaggaaaattttccaaaatgaaagagccaattcaaatttgtatagaattcagtgaaatagagtcggtaagaatgcttaaaccattaaaaaatttcaacaaaatgccagaaatgtaaattattttatagtcacaaaaacataatcctgtctttagatttattaaaagcagggcggtcaagtttttattttcaaaataaggacagatgaggctaaaactaagattcggaccccaaaaataagattttttctaaaactgatagtagcgcgaaggaaacgcaataaaaagcatgaaaaaacgacttaaaacaacattttattagcgcaaaaacaattgaaagtgattatcaaaagtatttttcccatccgccgattttctccaacaatttgtgattggaaattagcatttggtacatttgtgggcaagaaagatcaaaattggctttcgtttggaccaacgccttgactgtttcgacttgcaacaaattccgcgtgtcagtccattgtgagccacaaagagaaaacactctctcgacaaatgcattagagaccggaatggaaagaacaatgctgaccagcttgagcagatgcggcaaatttgcttcaaatagcttattccacttctgttcgggggttaatttttgaaattcatcatttggaaaagaattcagtatttggttggcttcgctaacatcgtcaaacaaatcatttgttaactcgggcgcaatttgtcgagccagagccaatgcatcgtcgtggggaattttgcgggatgccagcgcaacccattgcaacttttccggaaatcggtcaatgcgatgccatttgtccaaatatgccaaaaccgaggtgtaaaaagactggaaaaattggaaatttaataaaaaaccgattaatttttacttgaaattgttcctccaacgcttcgcgtgtgcactccccgactttttccattgccaaatcggcaccataaaaccgttcttgttttcgtcgctcaattttcgctctaaatttgtccatttccagcaaaagttcgggcaaaatggctttttctttctaaatttatgaacagaattttcatttaaaattagtaaaacaacctgaaaaaagtcaattgtcttgttaaataggcctagcacgtggtgtaaaaaatgaatgatcgcaaatgattgttcagaaaaaacgaaaaaaaagtcgtaaagaagtgccggacatttgtcaggttttgaaaagtaggcgattaagacagattccatccgaataattttgcccaacacgctgttcattgatgtccatcttgtcggcccatgtcgattcaagcgttcaaattcaacctaaattaacagcttagaatttttcattacttaattccgcacctccaattcctcacaaaatcctttcagctcctcaattcatttggttgaatttttaaaatgtccggccatttaaaaatca

SEQ ID NO: 16197 - DNA, 1793 bp, Heterodera glycines
gcatagcatcactcagggcacttttcagtggatggacggaaggcgcgaattggtcagggtcattcattagcacagtcacacaaaaggcgggatgctttttttgtctgtctcggttagcagtctctaatgctgctaatatcctttgcccatgcccttagcatttatttttttgatctttccgctatggcaaattggaaaaaaaaactagaaattttggcaaatttggacccgttggttttcatgtgagtgccggcactgttaatttcatgatcaattgctactccgcatttcgattttgaactgatcactttcccaaaatttggtcatgataagtgttattcaagaaaacaaagtcagttttgcaatttcaccaattgtttatcagattatttggagatttgaatttcgaccagtgctgggatttcaaaaatgatagactcactgatttgtcggattgatttcactgattggttattcattgaccatattgattataaatattctttcattatttttcgatgtcttacatttctttggcactgatccactgatcaatgccctcctccaggatggttagggttgccaagcccgatatccctacaagcaattcaaattttgagagccgctgtcttttttttggctttttaactcattaaaaatttttacatttcaaaaaatgaattttccgcgtctttcttgcgcaaaccgcgtgctgcttctggtggccgtgacgatggcggccgtggtcaacgcgtgcacgccgaccgcgagcggaagcgatgaattcaccctgggcagcgaaacatcgccgcccgtcaagttggaggggggcaaaggtgcggtaaaaaaacgaccggattcaggaatgttgggatcagaccaattctcgatcacgagactcgagttttaatggtagttttatcacttttttaaaaccaaaattggggcccatttgtttgacaaaatatatttttttgttgatttattgttcttggcagtttcggattcgcttatcacgaatgttcgacaaatgccgaacctgctgaatttgaacaaaggatcggaaaataatttcttgaattttcaacttttatttcgaattcgtcttagggattggaaattgatcaaaatgattgccatattcaggatcatcagcaacatctaaaatccttccgaaacatattttcataacttttgaatattaaaaattaaatcaaatttttgacataaaagggagtataagctccattagtgccgactttgccaatcattatgagaccatttgtccctttttcaaagcagtgattgcttccggcgttctggcggactgtactcaatgtcaggtcaaaatgaaaaaaaaattatttaataaaaaatttatcgcttccggcattagtttaaatttttgaaattgaatgcccatcagtcaccactgcttcctctcccatccctttttaagcatccacttcccgtccgtcggctcgtaatcaattcacgggcgatcactcagacggcaaatgccggcggcggtgttggcacattgccaaacggtggcagtcgatgtgcgcccataaataattaggccaaatttgggacaaaatgccaacatcaaaatttggaacaccacgttttttttgtaggcatttcattggcactgcaatgtgtgggcaatggcacagaagcggcagtcattttgacggtatctgaaatttaaaataaaataaagcaattcaaaggggcgaaaattttgtcaatttttttggtaaatttaaaaaataatgattatggtaaat

SEQ ID NO: 16198 - DNA, 3093 bp, Heterodera glycines
caaaatcggagataagtccacgatcccctgtgtcctgcggtctttgtggctgttagagctgaaagattggcagaatttttgatttgagactattggaagaatgccatgcccggaaattttatttattttttctctcttattgaattatacgattgatgggttgtggtaaattaattattatggacgaacaaaataagaaatacgcgatacctgcgaaaaataggaggccaaattctgattgaaaaattactaaattttaaattaaaaatatttatggtgtaataaatgcggaggtgccgataggcgggtgctgggtcctccttactcatcaaaaaccttttataagcattatggtttttgaagaacgacatggggaggggaccgtggccattcattgtgccgtgccagaaacacaccccaaatgcaatgttggctttttgcttttcccaaattgcttttttgttggcttttgcttctaaacgcattgaaaggcgaagggcgggcgaatgaatgcgcgcgcatttgcccttctttttttcttgtgaaaaatgattttaaacactaaactgtgaaagtaataaaactgcttaaatatgtcacaataattgcagggattcgtttcgtcaaagaaaagcgaactacggtaaagggtacggtacgcgtcattgtgtttctgtgctatacatccattttcactttcattgtttgtggaattgcgaaactccaccgaggcctccgagataccatcgtttgaaatatggataatggtacctggcgggggaatacgttattggaatacggttaatcgtcaaatagtaaacatagacttgagcctgtcaaaaaacccggacccgaaccaggactcggatttccgagatggatctggccgggctttaccaaaaactgactaaaatggacggaaataatttaggagaaacaaagttattaaagagaattccgatttattggtattttattacgtaaatgggatatgtatttgtgctctgtttaaaattctctcatttgtcagacccaacccaccaatagtgataactgcaggacattggccaatagctgaaacattcaaatggacataattaatgcaagaaatccttgtcttttttaatttattaatttacacctataataagaatcgggtggcaaaaattggaaacggtcgaagcggcgattgtaccaattggtgtccaactaaagtggccgaaaacgaaaaagtcacaggacgaattgcaaaagcacaaccaaataactgcgataggaaggccaataagaacggaacaatgggtaaaagttgtaattggagacgatgttgcacaagttgctggtcatcggccagtaatagggcttgtttttgggccagtatctgaatgtttgtgttggtcaacagcggcagcagcgatcaagccaaattaattggccaatttttgctggcggcgacctcgtgggcgaattgatctccgcgtatcgctgtgcgacgtccgtcgtggaatggacccgcgtcatcttcggatacgggcggtcggcccaactttcgggcacatttgtggccgactgactgcggcacaagtgacttcggcaaatgccgccgattgaatcggtcatgggaaatgcttcggaaatgtttaatttggtgaaaatgcttttgttttgaggaaatcaaaaaataaattgattttaattagaggtaaaagaatatttgttcaatttcacaaaataatcaatttctgacggagtttttgatcaatcgcatgggaagggccaacaaacagttgcttcagcattttgagcctttctgcttttcctccttcgttaatgcattttcctttctctgatattttttcctctcgaattctcagaattctttgatttttctcctctttaaaacagctgattaaatcattacgcacttaattaaaaatcggggaaatttccgaaaaaaattcctagggttgagaaaaattttctgtacgttttgaatagactcattaatttttttctcttaatttagcaaggcccactttcttggtatcaaactaaggcttgggccacgaaattgagtttttacattcatttttcataaaatatgcaattttcccaaatttaattcaacgcctgccgacgacgacttcttcatccagaggatctcaattcgcttgaacattggacgaagttgttctacgcccactggcagcaactccgatcaattgacgtcgcccgttaccccgttcgcccgaagctgcaccttctcactgcccatgtcgtcccttttgcgcgctctcatctttggtgggggctgatcagtaagcagggaatggaacatacctatgcacagaatgtgcaacaatttggtttaatgaataatttttctcattaaaattataaatccgggttggtcgttttgctcatctcggcactccagagaaggttgttgagaagttggtgaaacatgtgacactgctaaatgcacttcatgatcgaggcgtcgacaacaaccaagagaatacaagcgattacccaaatttttgatcaaatttcattttttcaaacattttcaccatttcacattttccatatctgaatatttaagtgaacacattttttcggtttcaaatagcatttttaaataaagattttagtcatttgaataaagtttattaatgttaattggtctccaaaaaaggcagtgatcagcgtttcttttgaattaacgcgcaaaaatttacgccaaatacgctaatccaactttcttgatatcattcgagagcccttcggatgctctattagcctgcaaaatttcaaaaaattttattaagtttaaaaaaagtttgagccaaaaaagtttgaaaatctggttttttttgttggcaaagaaaaaagttatagccaaaaacttgcgctcgtactaaaacggcccgtactaaaccgaccccgacccgtctaacactggggccggaacaggaccggttcggtgccagcagtttcggtgccagcccaagttttggactacaacttttttcattgttgaccaaatctaaaatcttggtatcatgaggggacaccctcgtttcggcgccg

SEQ ID NO: 16199 - DNA, 1873 bp, Heterodera glycines
ttcaatcgccacaacaaagaattgaaacggttcaacctcccagagagttgctgagagtagcaccccaaagaccgagccactaacaacaacaagctggagcagtacaagaagaccaaggattagcaataattcgagcacaacaaacggcgccagttcaacatccccaacaacatgttggagcagtacgaggaagccaaacgctgccaaggatagcacagccggcacgacaaggacaaaatggaactgttcaatcgtcacaacttcagcgtggagctgttccattgccaagagtcccaactccacaaccgcagcaacaacaccaacaacaacaacagcgccaagttgtccgaacgccacaattgcagcaacaagttggagctgtgcaagggcaagtgccaagacaggcaccccagcaacagcacgaaaaacttgttggagctgttcagttaccaagaatgacatcgcaacaacaaccatctactgggacagtccaaggaagtcaaaccttgccgagaatggcaccgaaaaatcaacaacagccacaactacaacttggggccgtcccattgccaagaatggcatctccgcagttacaacaaaatcaacgggaacaacaacacgttggagctgtacaacaaccaaaaatggcaatggcggcacaacaacacatgccgcaacaagttggagctgttcaaggaaaccaacaggtgccaagaatgatggcaccacaacaacagcaacagtggcagcagcagcaagaaattggcgaattgggagcggaaaatggcacgaatcgttgggaagaatggcaagaatgctgcgtccagttgcccgcaggcaattcagtcctgggcaaatgcatggcgaaaatgataatctgggtttaattcataggaattttagcaattttgtccaaaaagtgctattgtaaatgcctcaagcaatttaaaaataggaaattatttgaatttggcactcatttttatggtaaaagcttaagacttggcattattccatcccatcagtgttttgaaatattggcattgcatcttggcaaaaagcataatgccaaaacaacgtttaaaatttcatacaaattttcattctatgacattccgtctctttagacttcgatgaggaggcgcccaacgccaccatggagaccaaagtggcgggcggcggcgcggcgccgaagcgcgttgggcgctggacgttgtcacagctgcgccagacggacggtatcatcccgtcccaggccggttggaacaagggagactcgcagaagttgatgaccaactttggtacgccgcgtaacaccaccaccaaagtgagtgatttgtgatgattgtctctgatcaatcaatcagttatcgattgattgttttttaaccggcacatactgtactctgccccgctatgactacagtactataccggatcaaaattgatcttgattatatctgatcaattatcgattacgataattgcttttgaccggcacatactgtagcttgtcttgccagagctacaatagtactctgtttgatcaacacaggtcaaagtggagaatctggccgagattccggaggacattttgctgaaaagccacggggaggtgcgtctgcagtccggtaccaaccggttcgcctcccagaagggctttgtttcgttcgggtaagtgatcagagaaattgatcaatcacaccgccgccatcagcagtcaatgatttaaaaaatatgtaaaagtcaatctatcccaaaatggtgccatgacactttttgttcgtgatcagatttttctgaaaatattgattagggcccagaaatgatcaaaatggatttgagagtttgtggcacaaaattcttatcaacg

SEQ ID NO: 16200 - DNA, 1871 bp, Heterodera glycines
  misc_feature (1725)..(1725): n is a, c, g, or t
ttcgcttttcaacatcccccaatattgtggtgttggtagtggaagataatcttttcatcaactaatccttctgtccgtgtcgggaagcttggacaaaaaaatgccaacaaaatttgccaacgaaaaatgtttgacgaaatgttttttttttttttgcttaaatcacaaacattttgtcactttagccgctgccggaggagaaaatccgcgccagtgacggcattgtgcgtctgcaagccggtacgaacaaattcgactcgcagaagggcatgaccctgttcgggtaagggtgtcgaaatgttttcaaaagaattattaatataaattatacactaattaaatgggatcagaattttaaagcagcactctcgtcttaaatcctcgggaaattaaacgaaaaaaaaacggatttatggaatttttaacaataattttgaaaatttgaggaaatttagatggtatgggtccgaaaatctaatgcaaaattttgaaatttatgaaaattttacgataaaaatgggtaaaattttcaaataatttatccaacactcgaaaatgaaataacttggaaattgagtcatttttaagaacaattataatggaaaaatttccactgaacactctctctcactacagtaacccatccactcccttccctaaccatacagtaccggacgtcgtgagaccaccagaatgaaggacagcaagcacccggagtactcgcacgagcgcgacattgacaacacggagattccacttcagatgggtgagtttcgcaggcttttaccgtatgtatatatttaaattggatactgtaaaaattgtcggactaccatattgtttatgtgccattgttgaacaggtacgaacaaattcgcctcgcagaagggcatgactggcttcggcacaaaccgtcgtgagaccaccaaaatgttggacacctcgcacccggtttgttgggagatgggactggattcaaattgattcatgggaatggtagaatggagccttgatcactgatcaaacaatctccaaatggatgattgattactgaccaaacaatgcccaagtgctttttggggattaatcataaaactttgtccatttgataatattctgatcagcaagaattattatcagacaaatgcccaaactatcttttgggcattaataagaggttttgtcaagattataatgtattctgatcaaaacaggttaatgatcaggcaaatgtccaaccctctcgaacattgatcatagaaatttgggctgggtctatacattgacccgttcttcaccatctttggtcatttaatccgatttatcaaaccacctaaatctgatcattctttccatcgagcctaattgaaaaaatgatcaattttgtcccgtccttttcaaggagtacagccacgagcagagcatcgaccagaccagcatcccctaccaaatggggtcagtttaaaattagccaataattgatattttgaaatttggcatcgggttgatcagcactcgttttttattgttccattcaaacattttacagatcgaacaaatacgcgtcgcagaagggcatgaccggctttggacagccacgttgggaggtgcttgacccgtccatttcgtaccagaaccgcaagtcgcaaggtaagcaagtgcacatgcgcaagtgtagaaaaggctatgggcgatcctcgagagtcttgaaatttgccaatttgngtttatcaccatatttcggatgtcatgcgagttgccttttgtacgagtgccattcactcacattcggctctttaaatgtgtgacaggcagcatttgtctttttcgatcactgcgctttctgatcagtgccaaacgaattttactct

SEQ ID NO: 16201 - DNA, 2682 bp, Heterodera glycines
  misc_feature (2674)..(2675): n is a, c, g, or t
ttcggtgcaaaaggcgcccctgggtgccatcgtcgccagtcggtgccgcaaaacactttctcacgtgcagcacgagaagtagtagcaccgcggaaggtttaccgcgtggacgacgaaatgggcgaaccgcaggcgatgttcatgcaaagtcgcaaggacgcgtgcgcaaaattgggcgcgccaaatgaatcgtatttgtgcagcaaatcgcaggtgagcgccaaatgagtgggagccacggccgaatgggcaaagtcggagtggaaaagtgccaaaattagtggcggatgccaaaaaattccatgccatttatatgccaaggcacttcccattaacaccttaatttaaatgggcagaatttgctctttttctgctgaagttgaccttcaccaacaaataccctttctacgtgaatatgccaacttcgtccaaacaaagcagaaaagtgtcacttctggcaaatgcaattcgcacagaaaattcattcattgccgcacttcgcaaggagcaaagttcaaaagaggacggaatattgtcattaattagctaattgcttttcctttgattagtgtccgaatggaaaaagaaaaaagaggagggaaaaacgacgcggggaaatgcgacgagcgaaacgaacggcgaaactccgaaaagggcggaggtgcgaacaaagagatgtgccttttggcatttcccaactgaaataaatttctcataggaaaagcctccttcgatggtgccgaattcggtttcttcgccttcgatttcgccaccgtatgccaatgtcacaccaacagacgatctccaatgtaccgtaccaatgccaattgcgagtactgtaccaacaaaatgtgaagaacaacaaacggcctcagaaacaatgacaactccagctgaacaaagtgctgaagaagcatccatagtggagaatgtcaaaccaactcttcctaccgtaatggtcagagcgaaaccgttgacaactacggtaggatggacggggcgacaaccgccacaaaaaacggccatttcgccattggcacccgtggaaacgacgacagtgccagtttgagacgaggacacagccttggcgatttgaatggccaacccatgggccataaacagtaactcatgacatcctatcgtatcgcattcatactgtattttctatgattttagtagagcaaataaatttctttatttatgaccttcttttttcaattgcgcgttttgctttcaatcatattttgacgtaataacaccagtttaaatcggaaatttcgaaaaaaaatcctatgggtaggcaaatttaaatttggcgttgcgatcttagaaagacttttcggcttttacttctttttgtcttcgtttccctttttttcttcctccgtcttggtatcgccaaattttttgaacttatctttatgtatttactttttatttgtttttcaaaggggctatcatgtttaagtttattcatatccccctttttgtcatttttttggcattcaaaagttgtgaacacatgtttccggcgggggttttccgggatttaaattagggaccacaattctttaccattgcccaaattcgaaacaaaagtcgtagttctatttttctattttatgttcgcgttcgggttaaaaatggtcttggttttaaaaaagtggacccaaacttaacctagtgccttaactattcagttgttttcgttcgttataaattcacaaataaatctccaaaatgctcctttcttccaactttgttggcgttggccgtgtcgcgtctcgtgccgttcaccgtttcttcctgtcgacttccgctgtgcgccttcagcaacaatacaaagtggcggtttcattttttatttatgaaatacgaaataatcgaaacaaagtttagcattgcaaacattttttttaggaagaagaaaatatggacattgaaaatctcttctcggaacagcaaaatctgccgcaatcgcagagcgaagaccaaccgcaggtgttcgatgcaccgaagcgtcgcttcaacaaagggtttgtcgaaacgatcaaaagcagcccatccccgggggaggggggaatagaggcactgcccatcaagcacaaattatattggtattgaattataatcatacttttcgccagaatcaaccgtgttgaattgttgggcggtgtcggcagtcagccattggtaaaacagaccgcgcaaggctccgcttttgcctctttcaacttgtacacaaatgtggagcgtcgacttggcgatggcaccacaacgaccaacacggaagtgcacagtgttgtcgcattcggctccatggccaaatacgtggagaaaaacgtggaacggggtgagagcgagccttttacactcagcttttcgtttctcacattcgaaattcatttcctctttaggcactcgtgtctatttgactggccgtcttcactacaccggcggtgcacttttccccgacgggacgcgctctccacgtatttgttcggtgaacttggaaagcatttacccgctctccaagcaaggtgagtgacccattgggtttgttttaaagattatccattttcatcttttcaggcgcaattttgcgttaatgcgagtgaggcaaagagaaaacgaattttggcgatgatggttgaattgacccaggacctgcagnngcatgca

SEQ ID NO: 16202 - DNA, 1857 bp, Heterodera glycines
cttctacatttggaagattgaaaagttcggcttgcacctcccaagacgataacttgcggattgccaaacaatcggcggagtgtttccaccatattttcgtaattttggccacctctgtagcctatcactgcacgagaggctttccctttaaggcatcccatcaaataattcattttgtcgattggctgcaggtgagcctgattgtggaccgcattctcgaaggattgccaaaatgtcggccactctaacggatcgccggagaatatcggcatccgtaattcaggaagtctgatccttggttgatgcaggacttctctgacgggtgattgcctttgtactcgaaaagggagttgcctttcctctcgagcaggtgattgccgttgcctttgggcattttctcgcacggcattgtccccgttttgggaaccatcgtattctgactctcctgcaagtgccactagtatttcatccatcgtagcatgtgcgtcggctagcaaattcgctacttctctttcgttgatgaatgtctcgagtcgttcacgctccgcgacaatgttattgaacttagcgaatgggacggggttttcgctcttggaatggacttgtgggatggacagcccctttagacttagttggactgtcctggtggacttcgggataatcgagcttagacaaatgcaaacacggaactctgagttccgggaatgtcgaaaccgtagagaacaaggaacaccttcggaacaaaaaacttcttagacaagaagtagtttatttgtcggaatagcgcacaatcaaaggatggaataatgatttttcgagagacattctaaagggaaatattcgggtttatatatgagatttggacagggagggaaaattctaaaacacacctgaaaggaaatgaaaaatggggaaacttcgggaatattaatcacaaagatcacaagggaacattcgagaatcttcttccgtcctccacaggacttcctcatttctttcctccgggcggtcctccaaacggtcctccgagcggtcctccgggctgtcctccgagcgatcctccgggctgtcccccaatttccacgcgttcagtcgccagcggcgacaacagatttcgacaaaccaagttttggcaaaattttgaaaatccagggaataggtggtcagaaggcgggaaaattttgaatggtataaaatgagaaaaaaaaatcatccagaaaatgtacatttttttcttcaaaaggtttcaaaatgagcattatgccaaaactacattttttaattttttctttaaaagcaattaaataaattccaaaaaagttaaaatcacttttgattcaatcaaaagcatcaaaattgcttatattttacttgaaataaaaacaaaatagtggtaaatttttattataaaatatgtaacttaaaaattgttgtgaaaatgagaaaaaatccgtcctgaaatttaacattttttcttcaaaatgtcatcaattgcttcttctccttcacagccatttgcacagatttgtctgctgaacacaaatcactaaatcaccacccgcccacgcctttaagctgaagcctaagcctaggcccaagcaagcctaagcctaggcctcgaccttcgctgttctcccaatccaattattgccataccacagatcaaattggacaatgttcaaattggcgtcccaattttcgtcattttcccattgattcatcgccgtttccctaataattagggctgggaatttaagtcaatgactttttttgctgactctaaatgaccgtataatggcttaaaaagtgttctaaactagagaccggcgcgggacgggatcccgcgtgggaatttgc

SEQ ID NO: 16203 - DNA, 1529 bp, Heterodera glycines
  misc_feature (1409)..(1409): n is a, c, g, or t
  misc_feature (1412)..(1412): n is a, c, g, or t
  misc_feature (1423)..(1423): n is a, c, g, or t
  misc_feature (1431)..(1431): n is a, c, g, or t
  misc_feature (1439)..(1439): n is a, c, g, or t
  misc_feature (1441)..(1442): n is a, c, g, or t
  misc_feature (1480)..(1481): n is a, c, g, or t
ttaattatttagatgactttccaagaaaaaatgcaatctgttccttatatggtgagattgataataatattatttacaaaaaaaatatttgattatttcaggatgaactttggcaatgcattttaaataaacaacacgattgggtactgattaatagggatgcaatttttaggttttagcctatttttagtgcctattttctatgtttttattttcagagcctaaaacctaaaaaaaatgtgaaaaacctattttggcaaatgcaataaacacgaaaaatacacccctaagggtcaagtttttgagaatttttaaaaaatacacccctcagaagcaactttttgagaattttgaaaacatacactcctaagaatctacccgaaatttttcaaaaatacaccccctaagaaatgaaaaatttcaaaaattaatctccaaaaaacaacgatttgatttcaaaaatcacttagctcaatactgattttgcttaattttgttacttttttgattaaaattttatcattttacacacctaaaaatgaagtttttagtgcctattttgggagtttttaggacctaaagcctacctattttggcagtttttagagcaaaaaaattgtatccctactgtttaataaatatttttcagtgtaaatcagggatgcgatcgaaaatttttcaaaatcagagcatcgggctcaaaaaaatcagattttgtgggcaaaaatcagaacattttgcaaaattgcttcaaaccttttatttttacaattaatttaatcaaaaaccattaaatattgtatttatcgcctcgattatcatctttaaaaattttggtgaggaaattaacaaagcgtaaatttcactgcactcgggatcaaaaaaatcagattttaaagaatttttttgccgcgcgtttttccaaaaaacttttgggaaatgggcgaggggagagtgttggctcggacggcaaaggggggcaatttggcaagggcaaaatgggagagagtgcgggaggaattaaggggggaataaattccgaataaataaaagaagtttatttaataaatataatataaagatgtgagtaagatgtgagaaaacgcggatgcttatatggagagagaaagcgtaggtggagcaattttagcagagcgacaaacaacaaaaaagagtgactaatactaagcacagaaatcacatattaaatatggaaatatcatagaaatataaaattaatcacaattattcaaaattatccaaattaactcaattaaattagtcttccacaatttccttccattctctctctctctctccctctttttccctcatttcccatcatttcttctttttctccactttcttagtcgctttggcgaccctccccgccgaagatggttcagctncgnttgtgccttcntcggccgnggctccgncnnagtttaaaggtcgggcggcgggtgccgtgctcggcgcnncgctctagcaagccaccgtctggcgatcgacttcagactgcaacagtg

SEQ ID NO: 16204 - DNA, 1208 bp, Heterodera glycines
  misc_feature (43)..(43): n is a, c, g, or t
  misc_feature (48)..(48): n is a, c, g, or t
  misc_feature (78)..(78): n is a, c, g, or t
  misc_feature (96)..(96): n is a, c, g, or t
tttgtccgaaagaattgtctaaattttgccaaaaatcttattntctgnataaaatagttacattatgccataaaattntaaaattatgagtttatntaaaaaatcagaacaaattttgctcgctactccaaaatcagaacatttctgacaaatcagaacatttttattttatcagatttggacccttcaaatcagaacatttctgacaaatcagaacagatcgcatccctggtgtaaatagatgcccaaatttgttgagaaaataatatggctaaataactttagaattctttcttaaactgcttaccaatttccgttgacagtgcttgtcgaagttctgtaagtgtttttgtctaattttgtataacttttcaaaatatttaaatccaggaacttagagacttctgctctgaaacttttgatttaatatactcggacaaagtgaaaaattgtgtacgcacttaatttaattaaaatgaatgaaatattaaaattacattcactttaacgacacaggcacgagccaaagaatgttttgtgcgtcaaaatacattagtaattttctattactgctactagaatttaggtcaattctaattaagaaaaatgtgcacctgtgttttaattatattacgttggatcacacctatggcgaaattgtcttcaatcaaacccgttgtgtaagtttagaaaattgtaataataattaaatgtgcaacaagtctaagtgaaatttaaaagagctaaacggacatacagggtggcccaaaagtttccgggcacttcatttgttcataactttatttataacagagttagagaaataaaacataaacaaaacaataagaacataatagggaaaacaataatcattggtttttaaagtccccgcagttttcgttaatacagagacgaaaagaaaaggcttgggaaaattttcgattggacccacgaaccaagaaaacgggatttttgcccgtgacgaattttcctacccaaagcataacagaaaacggattaaatggaggttttatcaagcgcagcggaaaaaagtatattttacttataatcttttattttcgtgattatgggcagttttaattgtcaaaattttcttagccgaaaaaggaactgaggacctgcggcatgcgtaaggaccagtgggaatcttttgactctggcacgcttcacctattctcttagaaatt

SEQ ID NO: 16205 - DNA, 1499 bp, Heterodera glycines
aaaaagctagttaaaataagtttctgaaaaagcgaaaaaagaaagctaaataaatttttgagcaaatttctataaaattaaattaacgaaataaatataaataaatacacaaaaaaattaaataaattaaattacattaaaaatttttgacatttttaaaatgtttaattctgatgaatcgcacaaatatttaaacacaaaaaacctctccaaataaaatcacccgcaaaatttgtgtgtaagggaaaattggatgattaagtgggggggggggggggggggaaagtccggttcttttctcgtcgataatcactgcgatcttgtgatgatcagcaggcgaacattttgaagagccgccccaaaaaattgcggaaaatttgtgaaaaaaatgggaaatgaaaggggggggagactttttttaatccatttccccgttatttttgggaaacggccaatttcgcaatgattaaattaaattcctttaatttgttttgacgaaaatattttcgcttgaaaattaagacgaataataaatagaaataaaacaaaataaagaaaaattaaatttgaaaaaggaaacaaataaaaaaaggacagacaaaaattaagaaataacagaagcaaagaatttattattcaccagccgtagcaaaatgcagcataggaaaaatgtgcaaaatggggaaatgtttggggggaatatattaaaaacgacaaaaagaaagccgaaaagggcacagatttcatttttaaacaaagattatcgaaaaatgttttaattgtcaagaagaggtaatgtaacaaaacaaaatattttctaaagtcgcattttattaatttgaaggcaaaattaaatttcagcggtattccgaattttttattttaggccgcataaaacgattaacaaattgggacaatttgtgtctaacgttgtaattgccaaccgaacaattatgacttgagtcatttcattaattcagtgaggaaattttttgagggaaaagggcgacgagaaaatgtttcaatgggagtaaaggcaaagggacggcggttaccttttatgttttttgcattttaattgatcattgatttttttatgcgatgtaaataggcgaatattttcgactgaaattttccaaatttgaggccaatcggacagaacaaatcataggaatcgaaatttgaaagtgcatttttgaatggccgttctttcatcgccgcttttcactgatcgacggttttcgtctttgatcagtcatttgtttattagctgtgggtttcggagagaaaattgctccgccccccgcggggacattttttggctgtgcttttgcactgatttcagctttgcagaagatcgctaatttcgtggataaataaccaattgggcgaacacacacatcaaaaacaaaagcaaagcatatggtccgccctctgggcaaaacaaaacaaaatattaataattaaacgcaattacggagtgaatttgcgcgcgtaac

SEQ ID NO: 16206 - DNA, 2558 bp, Heterodera glycines
  misc_feature (47)..(47): n is a, c, g, or t
  misc_feature (90)..(90): n is a, c, g, or t
aagagaagggacgacagatgggacacacagccccaccccccacctcncctcgggggaagtgtgtccgatcgttagttcacttgacggttntatggattatcagcaagcagcctttgaattggtcacaggcacagatgggcgtacaatgaataaccttacttttacttaagctcacaatcagcattatgaaaaaagaacctggcctgaattttctggacaaaaatcaaggaaaagcccaggttgccgccattgtctagatctgaatccaggaaccgtaattgtttcagtcagtcgaactcttcaacaacagcagcagcaactgttgtgactttcatccatttccgaataattaacttctcctttatttttgtttgcgcattttattatctttaacaagatatgttaataatctttcgttttttaatttatttttccaacaaacaaaacgatattacgatgatactctgaccactaaagggaaaatgccataaaaagaacaaagtaaatgataataatgttttgaaaataatgtgcaggtttcgatgaagaatttgtggggaaatgcgtgtccttacagtactcatctggcgagggcacaggcttaaagatttccgaacgctcgacaaagcgattcaaagttgagtttgtctcacaaccggtgatgtttctcgtcatttcctcgaagctgggcgaattgggaggccaataaaacgcctgaaaatgattgtgaatatcggacaacaaacagattttgaaagcacctttatatagtgctcgagattagtagcgttttgccacagctcaaacgtcacacaggcggaataatggggataactaaataataattggtaaaaccataatttattagaggaacgaggatccgacccgtcaacgtcaaaattcgttttgttgaagcccagggctgagaacagtgcggcaattgttgtgtcatgctaaatgacggactattaattatgctattaattagaaccgtctaaaagcaccgcggaatatgcgaaatatttcctggtacgaatccaatcgcaaagtggcgacccaattggcgatttcagaccttacaattagaattaagacacatagacataatcaatgtaggagagaaccaaaaccaacccgaaaaagactccgtcacattctcggacagacatttcaatttgttttgcatatttccaattaaaatccaaaggattggcccgccccttatccgtggcaattcgatgtcaaagtgcacaccgtcgaaagcggacaagccttaatagaagcaaagcaattcaaaaaagagcacaaaaacagtggttatcttgacatgcctctcccgttaatccattcttccaacaaaaaatccatctttgtgatcatttccctcagtgttcggttttgagtccattccggcatcggatgaggcaatttgtcgcggtattgatcctcaataatcaaattgttcaacaaacggacataattttataagcgaatgaacaaaacctcaatgaaaagtgtgtcagcgaccagcccaaagttaaaaatgtcaattttctcaccggtaaaagttgacaaatcggagaaaagttgctgaaaaggttctcgttaaaagcggaaaacccagttgttttaagcacaaaattggattcagaaaccaccaataactaatttttcgtaaaaaaatcagagctaggctagaaaaattactttattatcgtccatcaactgacgatattccggtgtgttctgcataatttcatgaattttgctttgtcttggacatgggacgtctggaatgtcggggataatgtgatcctcgtaggaagcgatcgtgtgaacagccactggggtgaaactaaaaaataaattacaatatgacacaatcaaattcaaattgtaggatgaaaaagcaaaaagacaaacaaataaagttcgcgtttcatcactgacccctagaagtatgtttaaattgctgacccatgaggccaccattgcgactcgcgttcactcggataatccgtccccggcatccctttgctgtaaaatccgaccatgtttgaaatggcacttgtcagcgttctgtttatatcggtgcttcgaatgtaaatttccttgtttaaatagcgttcactgacaaaatgcagctggtcaatgtatcgtgccttcagcttcctgccaagaatgacgtgttgggccattcctttctgtaacatttattgaaattaattctaaaacgaatgacaaatgaatgccaaccggagacaattgtccccagccctgaggccacacttcttcctggttcgggtcggttctgaacgttccggttggggaacgatctccatgacgccataactgcaaatcaaaaacagatgaaatggcaacaaggatgtattataagtaccgcttggacaaggattaattcatcattagtggcggcgacgaacaaatttaaaaaacaatttataaagaatagagattagaaatatgaattcatcgtaaaaaattaaataaatccatagaagggccacgtctcagtagatggggaactgcacataaat

SEQ ID NO: 16207 - DNA, 944 bp, Heterodera glycines
tcatcattttttcacttttcgcgcaacgacctagcaccacagagagccaagggcaaatttttggactcatttttggcataaatttctaattttttagataaaatatacaaaaaaattgcaaaatatgaaaagtgagggaagcaaacaaaaataataataatactaataataataatcatttgaacgctacctaacatcatgtaaatattagcgtcaacatttaaattttcccttttttatgaattactgaattaattgctttagtaaagtttataatttttagactaatatcaataaacatattttttaataattttcatcatttcctttcatttaactcattttagcaaaattttcaacaaaaaacaaacaaataataagcatatacatttacgtgtaaatattaacaaatcgattagctaagctagagaattgctttttaacattcaatgttcattttataataaaatattacatttatttttatacaatattataataatttaaaaaaagtaaatttgaaacatattaaatttgtgggataatttcttttttttgatgattattaatttcccatcaattgatctacctattcctaatagtttaatgattattaaaaatattttttcattagtctcagatgaaaatcagtgtaattataattggactgacaatttttgaaactttgtttggcacaatatttgctgggtttttcgattgcttttttggtcgtgacagtgatgagcgcaaaccatcgacgactaattacagaaagccggccccaattacgacatcaagccgatgggatatggacggtaaaatgcttaatctcatcattctttggtgattttcagaacacaatcaagatatcaagctgttcaaagaacattccaaaaaatattttgatgatttaaagaaaaaaagcagtcgtcaatatggcagcg

SEQ ID NO: 16208 - DNA, 1120 bp, Heterodera glycines
atagatgaaaaaactcccaaataggtaaggataagtatttaaaactgggtccagaagcagatcaaaactaaggtaaaaatggggtttttcttgcttagctacacgcattaagtgcgcaaaaatcgtaggtatttacctacaaattccattagtaattaatttcaaggtttgatcaaccaaggtaggggagctcagcatgcttttgatcaatcattgaaaagctccacaagaaaaagccccgagtaccaatcaattctagatgagtggaacaaaccaaagagcaacaacaatcataataataatgatattgcaaggcaaaaaacaaatgtatacaatcgtagaatttcaagaatagaccatggaaagagttcaaagcaattgggccaagtttatgctgaacagcgaacagcaacaagccgaaatcgtggcaaaaatgttcagggccaacgttcaaagccactgggccaaaattacactggaacaccaagacgaaatccgggaaaaaatgttcaaagtccaggtttattaacaaggctatttagtcgaatgtccaattagcttataagcaaaagttcaggcagcagccgtttaaaccgaagcaagtcgggccattatgccaaagagttagggcaagtgccaaaaccaaagacgcaaaaagtgattcgcattgatgcacatgaatatacaaaaaagcacatctatgggcaaaataagagtaaaattattgtttcaaatttaataacttaaattaattaatagttttattaattccaaaataaaggatgaatgaaataatattaatattaatttttatgtatgcattaataaaatattttagaagtcaaacctcaaaaggatgaatataatttgccatcgcatgcattggctggcaatggtaaatcatcacgtggaaaaagcaagaaacatagtcaaaaacaaaaaatcaaagaagagctttatgaattgagtgactattattaattgatattttttttaaattgttttattttcaaattttagtgaaatttcggaccgtctatgtcattttctttaaatttttggggaacgttttgtaaagttattatttattctaaataaattctgttacataatgcattat

SEQ ID NO: 16209 - DNA, 1098 bp, Heterodera glycines
ttatttgccaaagcggccaaattcaaagctaaatagaaaatgaaaatgaaaatgtatttatttaaaaaaattaattttatcaattaacagtaaaaattactcctaattattgtattttgcctacgcctttttgtccttaattaatttatgtttagtttttatttaccaattaattaattagttaattaattgattgattgattcatgctctcccgacatttacctttcaaattttcctcatttggcataacagttaaactatcagtcatgtattaatctctttcttccaaactcattactttttaaattattttattgtgtgcccttttccctcactaattaattacttaattggctaattaactaattaattcccccggccgtttgtttaccttccaacttttcttccgcatggatctttccgctgcttcggctgctttttccgctgctccctccgccgcttcttccgctttggctccccccaccgccccccttttttccgcttagcatccccaaaattcggcccaatcgcttcgccgcccttttctccattttctccctttttttcctttccttttctatttggaccaattgtccgtcaatttcgcccatttgtctgcccaattccgccgccaccaattggccataaattgtcatttgtccgaccgtttttttacgcgaaactgcgcggcgttcggccaattttgaccattgctccaaagtgtcggcactttgccgcaattggtcggcgaattcggcacatttcttttgtgtcgtcactttgccgccaaaaaatgcttaaaatttttataatttattttcgtattaacaaaagaattaaatgtctttattttttcgaattcgtaaatttaaatttttattttcgttttccttttcctttttccgttcgaaattgttttatttttccacttttaccttcggcactgtaaaattcggcactttcgttttgcgtttcgtcccttttcatttgaattggcattcgcttttcctcctttttctcctctttctcttcttcctttccctcttcaatttctctctctttttcctttgtctccgatgtctctccgcgttcgacaa

SEQ ID NO: 16210 - DNA, 3038 bp, Heterodera glycines
attaaatttgaagaatcggaaggcgaaaattggaggcgattggttgaagaaatcgctacaaaaataattttaattaaaatcagattattttaattaattaaatttatttgatttaatgccaaatttgtttcacttttgccgtacgacggtgaagaatcgtccaaaaacaaagtgccaacgatcgtttcgcacttttccacaattttttggatatctttgcgaatcgaacgcggcgaatattccacttttgggctccgtatgtccgaatcgtcctcctcaaaatggcccaataaagcgaatttcaattctaaaagagtttctttccattttattgcatttcaaaaaagaaatattttaattataattctcctcaaattatacaattttaaggcgggagtggtcattctcgacataatcgagcaattgggtcccattttcggatgaacttagagatatccccaaagaattgatcagtcctgatcagtaagacctatccgattgaagaattgtaaagtaaatgaatgaaagactgccgattatctaattggcacagttccattagcaaattgtctcattgatcaattgtctaattggccaattagctcattatcccattggccaatagtctactgctgaccaatttcccattgactgtttgtcccaatgaccgtttgtcccattagcaaatccttcccttgcccaattgtccctgtttcccattccctcaccgtccatttgttgcggccattccgtcttggtcaccaaatgcgccttttcacgtgccattcgttcatattcttcgtccggcaaaaggacttgttcaaattcgcgccaaatttgcacaatgttgtgaatgtgatggtaaaattgggtcttttttgctgcgcaattccctccggggccacaaaatttgtaaatttcgtacagagaattgatttcgctcatcagctgaaacgctcttttataaataaattcaaatggtttatctcttgaattcgagatcccattatcattttcatttctcctccaatttttggctttattccccggctttatccctgctcttccccattttttgtccttttcccggctttattcctcccgttccacatttttggccctatctcccggctttatacctcccttttcccatttttggctttatcccccggctttatcccttatctctccccattttttcgtacgtccgttgtcgcgtccattataaaagttaatcggctctgttggatgcccaatattctgctgattgcgcgcaaattttcacccactttttggcacttctctttccctttttcgccctttaaaatgccctcaaattttccccttaggcaatggtttttcgttcgttttttttgcccttccgtcgccctttgcttttgctcaatccgttcgatttgcttttcgatttgcccatttgtctgttgccggtcattttggtagcttctcgccgcactcaaaatgccgctcaactgaacgtagcactgctccaactctttgaggatttggttcgctaaatgcatgccatttggatttttaacggataccaaaacaattaattccccactaatttttaaaattgaaattttaaactttaatttcaattataatttaaaattgttctcacaatttcgctgttcattttcattttcatttgcttttgtccattcatttgccaacgaagcgcagaaaaacaaaatcaaaaacatctaaattattaaaaaaataacaaaaaaataaattattaaaccaaattttaaacgaaaaaaaaaataattcgaatgatgtcatttataaataaataaatccatcaaaaatcttctgaatgcaaattgtaattttgtgatggtgccgccctgccggtcacatcatttttttatttcttcttaagcattaattgctaccacgagaatgatgtcactttataaagtggctttttatttggttttaaaaattgtaaaataaaacaaaatataaaaataataattaaaaagaaaaattgtaaattattaaatttaaaaaaataaaaaacaattttttaagcaattatatttcctaatctgaaacttaattcttctgtctagagaatgaaaaattctgctaaaaaataaataaataattaattccaataaaaatgaaaatcgattagcaaatatttacacgtcccatcgctaaatgaattaattaatttttaatcttattttattttattttgggttttctgtccagcagattgatacatattgttgaaaatcgttttatgccaatcaatcgattgattatccggtcgatcgatagatcaatcactccgctcgcgcgcgtgcgggccggttttccgccccgctcatcccccgccgtcgcccgtctcttccgcgcgcgtgtgccgcgtccgtttgccattggcgcgccccccggcgacgcgtcgccctcgcggcgttcgctggcgagtggcggcgagcagaaattcctcctgcagcgctttattggtggacgaagttgaggagagagtgcgcttctcctgcagaacaccaaaatgaataatggcattcattaattgtgccttacctgctccgttttgacgctcagcaagtcgtcgtccgcccccaccaattcgtcgccgtcttcgacacctccgaaaatgccaaagtcatcctccccatccatcgcaatgccttcctcctcaaagtcggactcttcgcttccaacttcgtcgtgcactgaagcaaacaaaatattaaaaatcccttatgtttaaagttatgaataaagataatataaattaaatttcatggcattttcgaaatttaccctaggttttcaaatttacaggcaaattagaattagtgactatttttccaattcaatttcaatttgtccaccaccgattatgccaatgcgttgtcccaaccatcgcgccttctgcacaacgtcgtcctgcatcagtttgaagcacattgcgatcagtgccatgccgaacagcaaataaagggcacagaccttttttgtgggggggggggggg

SEQ ID NO: 16211 - DNA, 2610 bp, Heterodera glycines
  misc_feature (2390)..(2390): n is a, c, g, or t
  misc_feature (2416)..(2416): n is a, c, g, or t
  misc_feature (2431)..(2431): n is a, c, g, or t
  misc_feature (2447)..(2448): n is a, c, g, or t
cctggttctgttccatcccccccccccccccccccactctttcagtgcgcaatttgagcgaccaaacaattttttaaacagactgatcagcaacagagaacaatctgacttttgttgtgtgccgcactgatcggagaaacaaaactaagcgggggaaaggggggagggggcggaactttcactaaaaagtgaaagcgacaattcaaattgtttttttccatttaaattagtgttttatttaaataaatgcaaagcgaaaggactgatattactgtatgatagcacagataaataaataaacaataattgattgccaatcgtttgatcactcattgtcagttgatcgccttcggaatgattgtgatttttcttgagcgaatttgaccggccaacaacggatttaaagcggcgatccaatcgaacaacttaaaaatgcccaactatataaattatcctaattaatatggttcgtatttgacttcaggcagtgttgggccacccgaaaaaaagggaaccggcagaacccctggcattttttattacgtcgtctccgggcagtgcctgcatgaaaaatgcgcgatgggaagtgcacacggtaaaagtgttgggggcgttttcctgctgttcgtcgttgtactcaattttggcaattgccaagttgattatgccacgaattacctgtcaattaagggacagttccgatttttagcgatgccaatttccttccaaatgtttttaatttttaattgtgaaattttccttgccctataaatcagttatttttattttttttttaaattttcgtttttctctgtttctctctctctcgccctttctctcgcccctctctttctctgctctgaccaggtctttgtcgtctctgtacagcaaaatgtacggccttcgaatgaccacccatcgtcggaccctgtaaaaacagcacaacgtttggccaattgttgttctcccataccattcttgtcttgctccctccagaaagtgcatgtgtcccttcttggacaccaccaaaccgaccctttcttctgtgacctgtcaatttaccttaatttgataatttccataaaactcgcacctcgggaattgttgagggtgccgttgttttgaacatgtaatttccggaagtcgaacgggtcattgactcgttcatggcaccgtattcgatgttcaggtcgtcaaaagaccgcgacttggtgcgaatgtccgcggtcagagtgacactctttggcatggtctgactgaacaaattcgcatttccattggcttttcccaatttgccattggcttttcccttattttgccattttacccctcaatgcttccgccactttgtgatgaactgtcgctgcttagcatttccatctgtttatgtatttttccatttgcatttcgccttttatttcgaaatttcccacttttttgcccgtcggtgggtctttgttcactgggattttcagtcggatcaattccaacacttttgtggccaattttcgttcctttccactcattttcacagaattcggaatgggaaatttgggcgaacatggtgaaatcttccaaaaataataattaaatatttatttttcgacttttcccaccggtgtgtcgcctttgcccgttttgcgcgattttctcagctaaattaaaaatatttttccaaatgcgaagcactgaccataaggaacagtcgcattcgctccacttgctgaagtttgctcagcttctccaactccaattggtgctccaaaatgattgagtcccctcggggcctaaataattttaatttaattattatttttaattggaattttcgcttttcctccgccaacctccaagtgccaagattctcttcgcctcgcacatctgtggaaaatgaaagaatgaaccgatggctcttttttgttagctgtcttcccacatgttgacgatgtgtccaaaattcgccgctttctccgtgccgtgccgggactgttgttcgcctcactgtcctccattacggtgagaaggtaaacgccgggcacacggttcatttctgaaggcatcgaagtaggccaattgttgccatttttgtcgcccatttacccgcgctttttgagattccgccgatcagtgaccggcaaaatctgctggccgcactgatcttcgagtcccgtgcgtacacaatcagacccaaatctttggtgataattgccgactgcgcacaattttcaatttccatatacgcctaaacaattaataaaatgaataaattaattgaattattaaattgaattgaattcggtaccgaaattgtcatgtaaacgttttcgccgtagcccgagacgcggttgagaagcggcgaattgtgcagcgaagagtcccaagcggcctcnaattggaaagaaaccctgcgaaaganaaggaaattgtattnaattaccctatctatnntatatgattaaaatccacctgtcgtccatggagaattcgaggtaagtgcccggggaaaggcccaaactgagcacgtcctcgtccctcccaccccgacaatcgggaacactgcgggatccgccgactaacagctggaaacaataaatggcaaattgcaaggaa

SEQ ID NO: 16212 - DNA, 1015 bp, Heterodera glycines
  misc_feature (906)..(906): n is a, c, g, or t
  misc_feature (969)..(969): n is a, c, g, or t
  misc_feature (974)..(975): n is a, c, g, or t
ggggggggggggaaagaggagggggtaattaaaagtgtccctttttacctcttgacagtctctccagcgaatgtctcctgcaattaattatattatgtcttttttataatgctttttgcccaaaaaacaaaacctttttcgtggcaaattgtgattttaatgcgccgttggatgccctggtggagaaggaaaatgccatgggttggcagtccattggcatggtcaaccacctgcatttattttgggggaataacaacgattggttttctttgcaaaatcgaaccgctggatggtattctccgttgctggtgaattcgcaaatttcgaaccaaatcagcaagtcatactttgatttgaccgaatttgccctggaatttctctttatcgtcgattaattaattaattaggctttgcctcgggcagccgttgccgctgaccaccaatttgctcttcagcggagttgaaatgaccaacgacggctgcaagttgctcagattcttcgacattttgcacctgtcaaaaccagaaagtgccaccatttatgccatccttcgttacttttccgactgattgttcgccgtcgtcccactgaacatgctctgctcgtctactttagtcaaatggccgaacacttcgaaaatgatgggaaagtgctgcaggtaatggataaatgccgagttgaccaccgctttgaactcctcaaaagggcaattggaacaattaggcaatcattgcaaatggtccattgatagggcaatggcgtttgctaattatgccacctgcacataattatacggtaacgtgcgatgttcgcccttcgcaatccctttgactgggctctgttgaaaatgcttcgtcgtgccgatggagaaaactggagggaaataattataaaacgaagaatgngatgccattggcattcgcatttggcctacttgaaactgacaaacacgtccgtgtactccttgngaacnngtgagcattcgacgacagtcaaacggaaaatgaattcact

SEQ ID NO: 16213 - DNA, 1322 bp, Heterodera glycines
ttcaacccatttcgaacatttttacatcgattctgaacgtttttaagcatttttgagtttggggactatgatcaatatttaccaagccgataataattaacaaattcattttaattgtcatcaaattcctcttccgtttgcccattcttgaccattcattctttgttgtttttgcctttgttggccaatgcgcacttactaaacacatttttctggccaattggtgacaacgttcacctaaaaaaatcgttggaagtactgtaataaaaggagatagggagggtatacggtagcaaaacttagatcaaaaatgaaaagcgtagctgagtgaaactgaccgggaaggtgacggcacgacaaaacaaacgacggaatttggcacggccacgaacggcacttaccgtagtgcaaccgacagaagcagcgccaatggcattgacatttgacgtaaactgaacctgcgtcataatttattttagaggttcttttcggttttgtgaccccccccctgaaattttcaaataaaaagtcatttctagggtaatttggggcgctgatcacgaatatgacatttatttttcaaaattccgaatcccgaacccgaattcgaacaaaaattctaaattcataaattacaagggaaacatatttctaggggttttagaggtcgctgaaaacgattatgacatgcatttttgccaaattcgaaactcgaaccctgacttgaacaaaaaaccgagatttaatttactaaaaaatttaaaaggtaaaatatccatcataggtcccagactcaaaattgcataaaaatacttttataggttttcttaggtgctgaaaacgcctaaaccatcaaaaaaaaactgcgcggcaaagcgcaaaatttacacaaattttgtatcattcgaaagctcttgatgagctaagttaaaaaacaaggtatcgaaccgacgccatctgagcactgggacaactaagtcccagtgaaaatggacatttcagtgccgaaaaataataacgggaaataacaatttaaaagcaaaatttcgcaaaagggagcatgcgaagacggagcaagtagtgaggcgagacggagggcggaggaagacgtctgacgagcgccacaggcggtggcttgcgggtgcccgaagggcccccgccaatcggtcaaccgcctgcggatcacgcgcggacttcttccgtagtctcacccacctactggccgccgtagtcgagtgtgcggcggttttttagcgcaataagcaaattcaatcttttatatttgacgttcttttactaatttctgactatggtttaaaaat

SEQ ID NO: 16214 - DNA, 1523 bp, Heterodera glycines
  misc_feature (405)..(405): n is a, c, g, or t
  misc_feature (1500)..(1500): n is a, c, g, or t
tttttgatgcgaaaaaggtcgggcaaatccgaaggaagaggagtaaacaaatgggcgcaaaaaatgttaattaattaaaataataattttcgattttatttaatctaaaaattatttaaataataattaatttttatattgttccatattgcacctaatacgctcattactttttcttccattgattgcccttggggtgtgtgacctttgggctcctccattttccatctgcgcatttcgcatttactcactcttttttttgtgtccatctgctgctgttagcgctgaagaaggcatcattttgagcatagttttaccagttcacagaaaatgccatagttttaactgcttttggcatttttgttccaatttttttaagaaaaatgaattggacccagaaaattntctaatttttaagctattaaatagccgaatattggtttgaaacctattcaatttattttttagcatttaaaaatgggtcttaaactatttttgatactgaaaatgtcggacaatccgaaagaagaggagaaacaaatggacaaagaaatgtaatttaataaaaataataatttacgattttatttaatttaaaaattatttaaataataatttaacatatttatttaataaatttcaatttctgttccatttgtcctgctgattggcacgcggtgttcaatttgctgccgacttctcaactcggccttggcattgcgttggtcagctgtcgatttgacggacgagtggacgaacacttcgaaacacgcaaatggacgctctactatatggaaatttgctgcaaaattggcgagaatggggccaaggaaatggaaattaaaaagatggataaaagccctaattggggttggaaaatgttgccaattccgcagaagccattgccgaccaacgtcatcggatttccgcgcatccaaataaagtaatgaaaacaatgagtgttggtcgagaccggaaatttcatggcctcgacaccgagactcaacccaggggtttgagtattcaaaaaactcgagactttttctcggttgaggccgatattctaaggctcactgaaatgggaatggacagtttagcctttaaatttttattggtttacacataaaataggtgaattttcaaaaattagcccaatttatattaaacagtcagtttaattggcccaatttgtcttttggaaacaatttgtgacgaatttcactctgcccgaaaaattctttattttttgaaggttttcttaaatttaactcccatttatattgaaaaattctaagaatttttcaacgacccgtccaaaaaatgacaaaatttatcagattatacatcagttctcaattatttttcagttacattgaccacaatgtcgtcgtttttctgtgccgttttcttcccatttttgcttcctatggcacaaattttgccattcaaacggaaagtgaccgcgttttggcgttcgttgtgcgcaacgatttggccaantgttacgcagcgaaattcgcgcc

SEQ ID NO: 16215 - DNA, 3228 bp, Heterodera glycines
ccccccctggataaatagtttagagggaatttgccatttattagcagcaaattcactgcctacaataattaacaaattttcatttcttcagatttgcatcactcacaataagcctttacttatggaagaaaaaagcgcggtaagttttgtttcttgtctatcgcttagaatttggaccgtatttcggcactttaacgccctaatttcgtgccgtccatcaaaacggagagagtgaactgtgcagaagtttgatttatggggctgagatggtcggtcacggggctttttgcttggcggggaataagcccctcccttctcccccagtaacgagtcattgggggtcgagtgggcgccaaccaactgagcgcctgaccggtttttggggtataactcatttcatagttgcccgaattgagtgaatttaatatcattcgaaagctttaagtgtcctctattagcctgcaaaatttcgttaagtttcaataaagttctggccaaaaataaattcattcaattcgggcaactatggaatgccgggctggcgcccaggcgttaatttaacaaaaaaatttgctactttttgaaattttttttgactactgaaaatttttatgaagagcgaaatgacgcatgccaaaagcactcatttttagtaatgctgcatatttctgagccaaattggctgagtttttctttgtttcgccatgggagggcggggcgttctccgccactgacctcaacgccgtccatctccgcgtttagtttcaatcgactcattcatttatacattcccttttctttattagttttttatataataaaaactcatttttcatgaacaagaaatttttgcaagagttccctccataatggctgagtgtgccaaaaaatgcaaagttcaaattccgaccgaattggtcgctgaattggtcgatgttctccgttttgatgtccgttgggccatcgtccgcgtttcagcggcctttgacattttggtttttaaaaaacaaaatgcttttataattgccaaaacagttgcgcaattcatccctttaaaagtattttattttctctaattttagcagacggatctgaacagtgggaaaacggaactcattaaactcgtggccgggcacagtgacgaacattcgcttaaactacatttcaaaagtgagttcttttgactgcttttgcgcaacggcagccgaggatttttgaaaaacctttgtagttcaccataaaattttttgcaaaatttttttttgaatttctcaggggaggaggtgggtgggctgatacgaggggaaaaggctgtgtgtgagaaatgaagtgcacccgtcatgcgcggtcaaaattaatcatttaacaaatgcctaggccttcgcaatttcctcatgttgaatggcgttgctgtgagtcagtccgttggtgatttgttctccgtgccaactttcaaaaatgccgttgccgaaatgaccaaacaattgcctcacgatttgaagacacacaccggcatctgtgagtggtttttgggtcttattattgcaattgttaacatttaagttctgcaacatttcgtacaatcattaacaattgcacaaaaaaaatgcatctatgggtctaccggtacgatgaaaaaagactgatgaggaagctaattgtctaattattcgtttagtcttcattcattggatagcgtttaaagatgcaaattcccacgaagcattctttactcgccctggacagcccgctgatgtttgtgaatatttgggggaattctttactcgccctggacagcccgctgatggtcgtgaacatttggacggaaaaatgagaagcgccaagattaaactgtttaactatgcttacgtatttggcaatcctggtgctctacagtttcacattgaaagtgcgtaacttttgctttacttcccaaaaaactgatttcccagggttttttttttgtacaaacattactgttaagcactttggaagtgttttggtaaaggcgaaacagtgaagcgctcggacggtcttcagggcggatcaccaatgagctatcccatcttcatgaaggcgtttgagcaattaatcaccgacaaatgcacatcaaaagaaattgccgactcgttcgccagctgtaatttattatatgccaaaaacacccttaatcacatttagttgtggagtcattcattgattccttaatcgatcaaagtcgtttgttcaattcggtgtctgtgaatctatccgttgctggtaacgagggactgctcaccggtccgtcgtcatcgaattcgtccagcattgatgcacagcagaaggcatcgtccgttggtccgtcattcagttcgcccgttgttgatgaacaacagcagcagaaggactcgtctggtgtatcgtcggcacaacagcatggacaaagttggcaaatgcatcgaaatttccaatgattttcaacttttgttttcagagcgagccaacactactgatcagtgccagcatcctccgaagaaagaaagaggcggaaacaaataaagcggaaaggcggcaaatgaaggaaggaaattttgttggatttggagaaatttgtcattggaggcactttttgttgagttttaaatggacaacgaaacggcgtattttgttatttttggaaaatgttcagttatttatgttcttttaccaatatgcataaagacaatatttatgaagacatttgtaatcgcagattctcatgcaaaaaaaaacaaagtgcaaatgcccgctgcagtgggtgtggcgaggcgaaattggtcagtctcatcgattagcgcgctaattacccccatgaataagtgcactcagtcgcttgacagtgggcgtcagccgaggcggtccagaggggagggggggggggagtatttggatggcatttgaggggcatactgtagtcatgggctaattgtaagtttatcctttttttaattttaaatgttgtcctcttaaaatgaatgtgtacatttgcaggattttgtcggaatgcgttcaaacggtcaaatgctgaaggtgtgctgcagggagtgggaaaacattattaaaaattaaataattttggcacaccattccttccgatcactgtttttgttttatgtattgtcttattttggttgtacagagagtgagagaaaatgaagggagagatagagagagagagagtcaaggttaaaggagagacagtacgggaga

SEQ ID NO: 16216 - DNA, 3454 bp, Heterodera glycines
aaattatacattttaaatgcaattaaatattttcaattaaattattattttaattaaatttagttgaaccgtgagcctcgtcttgcgcagcccattcagctgttgacccgtctccatgttcatgtgttaaaccccgtggacgcaatgcgctcttttctggacgaaggtgacaaaacaaataaataaacaatttcactaatttattaattgaaaaatgttattaaatttttactaattaatttattaaattcaaaatatgatttttgcttttaatttataaaattattgaatttgaatttttgaattttatttttcacttacctaacgcttttaaattttattctttattatattttcaatattttaaactttctaacaaagttctttcattactatacatttgtatgcatttttctttatttaaaatattaattatgaagtattaaatttaaatttttaaattatttccggcgttttgtgttttccctacggcgctttgttggaccgcgcgttggccatgcttggccgtattgaagacattgtgattagttccgccgaacagatcaattacgacgaggtgagctcacaattagtagtagacaattactttttaaattattatttattttaaaaatttatttttaattatttcatttatttacattttaggccagcgatcagcttgatcaactgcaggatttggcacgccgtgccaatgttcactatcgccaagtggtggagccggaggcggaaaagcgcatgagcgaggtgccatagcaaaatttttaaaaaattccaaatttcgaaaattttaaaaccgtaaatctgtggcttttcagatgtacaggctgtcggcacagcagcgtctgcaacggttggactcatttctggtggagagcagcatgagccgagtggaaagagtagggcacagagaataataaattattattatttttttttaatggcatcaattttaaataattaatttcaaaatattgtccataccacttcaatttgtcttgttggttagcccttttcgcgaatgaattaattatttttgatattttgaaattagaaaaaacggacattcgacaaaaatgccatttacaaaatatgggactgtcgagagaaaaatgaatgccatttgtcgccaagttcctaacttttttggcactcattaaattttaattgctttttgaaagtgctttattatccaattaggagttgaagaaggtacatattttcattggccagggattttcaaatttttggcactcatttaaattttactgcgttttaaaatggcctttttcacccaattaggagtcggagaaggcgcacaatttcattgcttgggatctcggctttttttttgcactcattaaatttttcaatgccctttaaatgccatatttaatcacccaattaggagtcggagaaggcgcgcaatgacatgcgctgggagttggagcagttgaaggaccaaaatgcgcagctgaaaaaggagaaccgggagctgaagcatttgtgcgtccgcttggacggccgcgttgacgttttggagcggaagttcaaaacaatggcacggctgctgcaataatgactggatttgacgaagaaaaatgtgtggcacaatttgatcagttaaaattgttcgttggcgggccgatcaatcaatcgatcgatcgattgtttgtgcccgatcaaagtttttgatttttgacactgtttttttcttgataaataatattacactattttaaaaacatatagtacattttgacacaaaatgataaggccactctcgatttttgagcagtattttgaatgttccaccggcgaaagttgaaattgtgcaaagcagcaatacagaatgccaaaagaaaaaaataaaaagaaaaaaacaaagagaaatattttcactcttggtatgcaacagggatggtacggcatatttccgacatttttgagctcggaatcttctgaattccggctgggccgtccgaatttcgattgacaataaccaaaatttttgagcagttgaaattccgataatttgaatttcgattgcccaaattttttgagggagtcggctgtcagccataaaatttttcataaaatcagttacataaaatgataaataagttcattttcaaaaatcataaaatcggaaaaagtcgccccaaaaatttgaaataattcatgtaagcctaaatttttaagcttatcaaaaaagtcttttacgccaaccaaactgatcagaaatcactgcttcatcgtggtctgaaagcccgaaaatcgcttttcaaattcgattttcaaacaaagacgcattagcggagaattgtcgttgagccatttccaaaggccattttgtagaggattatgtgctctttaaatggatttattctgcggaaattttttttttaatcccctagaaattttcttcgaaaattttcctgattttcaggttttcagaccatgatgaagaggtgaaaatttcggttattattattattttttgtctcgactttcggcattaattaatctcggcctcgagtgtctctctctgtattcaatctcgattctcggctcgagaatatgatattcctgagatcagtagcacaaatttcacagatttcacaaaatttctcacccgaaccccttaaaaaacacataaattggcttcaatttcttaaaattcgaaattttttttgaattttcatctcatcaatttttcattcatcaatttcattttcgatataatcgcataaatctgtatgtaagtgaagataattatctcttttttttgttccagaaattaattaaataataaactacaaattactaatgtcgttcactaaaacaatgtgacattgacttatgaatgggacaaaataacataagtattatttaaaaatatttaaattaaaataagaataaatatttttaaatttttatagacaaaataaaagtaattaggtaattaagaaatatttattttaaatttatattaattctgaagcatttaatataaattgaaataataattttttttttttgaaaaattttatttggtaaacattaatttaaattaattaattttatttttaattctattttgtacttttaattaagaaagattaaattaaattaaaataattgtttttttaatattttttatggacaaaaaataaataattaataaaaatatttaatttaaattaattaattaaatttttatttttatttttttgaaatttattttgtacttttgcactttttattttaaattgatggaagatttaatggcattagttattgctaaaaacatgttctagatactacaagaatcataaacaaaaattaatgcctggaataaatatgtatttattacatgctggaatgccgaaaacgccttaaaatgccgttctcggtgggattgactttcgcg

SEQ ID NO: 16217 - DNA, 2992 bp, Heterodera glycines
aattaaatataaatgcttttaattaatttatttattttgtttttcattttacttgctctttgctcaaattttgcaccaatttttcccatgtgtccgattttcgttgttcgttctgtccatacatttcgcgcacctttcaaatcaacgagtgaacaattgtccattttgcccatttgctcctcacattttccttcgtcagataaaggccatcaaattcgcgtttgtatcgtttctccacttttttggcaatctcatcatcagtgccgtacccatcatcagcagaggacaacaaatgctgagaattgtaaatcattgctaattctggtgaaaattatttcctttaattggaggaggtttcagccaaatggacgacttaagttatatccaaaaattgtaattaataaaaagctaaatagaattacaaaacaagctaaaggtttgctaggggagatgagctagttggggaattcaaaataaatgatagttctggggcattggaaatgaaatgttcttttttcaaggacgtcttttggaaggacatgctgctataggaatataaaaacttccttttcaaggacataaaagatctgaggtgagactgtgagcaatcaaaataataaatttataaaaatattttaaaatttaagtcaatgaattgtttttgcattattcttccatccaccttcactgtgtccacttgctcgttgacccccgatgcttccatgatcagattaagccattcgttttggtctcggtccactaaatggaccccctccttcatcaaatttggcaaactcatttgcctttcaaggccatgcccttttgtgtgcaggctgaacagtgatggggacagaaaattagcctaaaacaagaaaaataaaaataaaaattttctatttttgaattatatatagataggtataatataacattccaatagtttttcaggaatttgggtgaaagggggcctcctgctgggcagcaggagatcaactcagtcccatcaacccgaactagctgagtacagtgtcttaaaccgtttgggactgagttggccggggacgtgttgtcgcgtttcgtccctgtcccgccccctctgatccgcgtggagctgatcaatgagcaattctgccaaaattcggcacctttcccctcgacttgctggccgtgacgctcataaaccgtggcgataaaacgtcaaccaatcggcccgcttccattgcttttgctctcgccgcttctccgccctttgccctccgttcgccgcttttaccgtattcctcgctctgttccctaccgtactcctccccctccatttcttcgtcataatttgccatttcatttctttttccttcgttgaattcgtccgattttgaatgttcgattgactttgactttctttccaactccgccaatcgcatgccgactttgatgccgtcattgaccaatttggcaatttgcgcttccaatttgcccactttgctaccgtaagccgttgtttcatcggccgaattcattttcagcagtgtttttttgtcatattttttatttgttgcaattgccgattttatgggctgaataaagcaaaagttattattcttttaataacaacaaattaccatttctttaagcgcataatccttccattttttttcttctcttttcaactgattgtgcgccttttttgccttttgtatttttgaaattgtttcttgccaacttaaaataataattttaatttgttttattatttactatattaatttgaattatagtattccttttacggtattgtccgtgttttgttcttccttcccaatatgccgctcatcaaaaagcgtgccaatcctccaatgggactgaggccaagtgttcgttttgcctccagcaaattgtatgaatgacttttcgaaattgcaatatttttgcgttttcttgccaaaaagtctttgtctaaatgccgttggtctctggcaaaaactgcttcccttttccgcactttggcaacttcaaattttggctttgcgctgtaataatcggttttacttgtacctaaataatgccggaaattaaaaaagaaaaagctctcaattggaagtgattaattaacaggcacagaattcgctcaatttttggcactttttaggttaattatatagtcaaaaaatcccatacccctaattatacaatgatacattattaaatttgcgaaaatttcatttaaggaaattcattcccattattcggcattttatttaccattaacagtttctttttctactgctgaattgctttcgtgtcctttttctgcctttttcttctgatgttccgtttgtccgttttcttcggcactttcgctttcgattcgaatttgtcccacccaattttcgcttttcaccaaatttttggtgccagcaacaattttgccatttttgagctcaatttcgaattcgttgttcaacagccgaacgatgcatttggccatccgtggcactgtctgtgcgccaaaataacattcgttgaatttgtccggcaccacgtctaattggtctttgttggaatgcctttaaaatatatttttaaagatttactaattaaattccatttaaagagcacaaataacagaaacgaacttttcttgcaaaaatactgacagaacagaggcaaatgcttgggttgtccaatgttcgtaaatctaaacacacacaaaaattaatttaatcaatttaaataattaaaaaaagtattaaatttatttacccgatatccctcctccgtggtcatttgaattgtggtgactttgggagaagaatgaagctgtacagcggagactgaagctgatgaagaagtaagcaaaacgagaaaagcgaatgccaacattgacagacaaataaaataataatttaatcttaaaataatcgcttattaatttcaaaaggaaataattcaaatctctaaattttttcttcatttaattacatttgacagatta

SEQ ID NO: 16218 - DNA, 2276 bp, Heterodera glycines
  misc_feature (44)..(44): n is a, c, g, or t
ttttgaattttcatctcatcaatttttcatcatcaaattcattnttcgatataatcgcataaatctgtatgtaagtgaagataattatctctttttttgttccagaaaattaattaaataatagactacaaattactaatgtcgttcactaaaacaatgtgacattgacttatgaatgggacaaaataacataagtaattaattaaaaaatatttaaattaaaattagaataaatatttttaaatttttatagacaaaataaaagtaattacctaattaagaaatatttattttaaatttaatattaattctgaagcatttaatataaattgaaataataattttttttttgaaaaattttatttggtaaacattaatttaaattaattaatttaatttttaattctattttgtacttttaattaagaaagattaaattaaattaaaataattgtttttttttaatattttttattgacaaaaaataaataattaataaaaatatttaatttaaattaattaattaaatttttatttttatttttttgaaatttattttgtacttttgcactttttattttaaattgatggaagatttaatggcattagttattgctaaaaacatgttctagatactacaagaatcataaacaaaaattaatgcctggaataaatatgtatttattaaatcctggaatgccgaaaacgccttaaaatgccgttctcggcgggattgactttcgcgtcaaaggatgccaaaaatgtatttagtgaaaaggaaggcattaaggcttatttttccgtgtcaacatttcggttcagcattattttctgtgccattcccacaaaaaaattaatcaaaacaacaaaaaaacagtttcaatttgaataaataattttcattttcgcccagagatttttttattttcaatttttgaaatttagcatttttaaaaataattcttgaaaaatttgcattcaaaaacattggctaaataaattttacgagtcaatgaactcaaaaaaagtgcccaaaattgattgagaattataaattaaaatccgagaaatttcgaaattttccgaatctaggaaaggtattccatagaataaatatttaacaaaaattttaaaaaacccactgccacaagagttaagttaactctcgcccatcgctccccccccccccccccgctcgtggatagctcagtggcttcgtttttggaaactgggttttgtggcctggttcaatgctcacccgggcgccggccggtctctttcgtttatttccctttcctttttccccatctttgcccacaaattgttgcaatatttgttggttgtggcgttgtgtttgtgtgtatagttgcgcgaaatgtgtgcaacagaaacagcaaagtttccttttttggcgtaccgcacttttttttttgttgctttgatcaaatcgcctaatactaatgatgatgatgatgatgatgctggcggttaatgatgatgaccacacagcaaccgaccaatttgaccatccttttggggaagggaatggatgctcatcacccatccgtcccccgccccccaattttccccaaaatctctcccctcccaaaaatggaatggagtggggctccgctcgcaaccccccgcctcgccgaaggggggtggtccttggagaaatttttggttgggttgtagtgggaaatccggttttttcttccccgctttttttgttgttggactatgatttggcttggctctccgcccggggcgggcgcgattttcggcggttgctgcgcaatcgccatgcgcttttgcgcacaccaatccgcacccttatgctgctgctggtgatgaacaaacttccggattgcgctttgcgccctcattggggaggaggactaaggcgcggagcgcccaaaaaattggacaaacgacgaacgaaaaggacgaaaaatgaccaaaatggcgacgcgcactttcgtccgtccgtcgtcgtcgttttgtcgcccgtcccctcgggggccccgctttctctctcccttattcgaccatgggaagcataaggagttctccgattagcagcaccaaatgtgtgtgctttcatacatattttgcccaattacagcagcccatgtgcatgaaaaagcacatattttcatcagcaaaaaaaattgggttccgtttttttacatttttttttaaattttgctattttttgatggattatattatttgaaaaaggccgatcaaatgattggcctaatttgatgttcatc

SEQ ID NO: 16219 - DNA, 1507 bp, Heterodera glycines
  misc_feature (69)..(69): n is a, c, g, or t
  misc_feature (93)..(93): n is a, c, g, or t
  misc_feature (1459)..(1459): n is a, c, g, or t
cggcgttggtgtggcgttgtgtggtggtgggagaaagatgactgacgtgcaaattttcctgccccgtcnccctgaggggacaaaaaaaaatcnggttttggtgcgattgtgtttggcattctgtcagccgccgccgctttccctgcccccacccctcgggggatgaaccgcgcgactgtgcgtccgtaaatgcaaaattgcaccagccaacgacgacgacgacgaagaggaagaccacgatggtgctgctgctgctgctgctgctgctgctgctgctactccgaccgatcagatcatcggatcatgggcggatctgggcctgtgggtgtggtggaatgagggtgaaagtggaagaaagagaagcggaagggagaagccggttcatggagagaaaggaagcagcgggagaagcggaggcttttgcatgaaaagcatgcgcgagagaaaggggggggggagagagagaaaggaagaaagagagaaatcagagagagaagatggctggcagagtaatcagagaaagcattggaggggaatctcatggatagggaaaagatagagagtggattgaaagagcgagaggcatgcatacagctagagaaaaatggatgatttaaagaagtcagaaaggagcgaaagagagtgagaaagagagagagagagagagactagcagagaaaaatgtgatcaaacgattggaattcactttcagattcaatcatccaaatttgatgggttttggtgcccctccaaaatgatatctgatcactttaattatgctaaaaattccaatttactaaaaaatttcaaatggcaaatcgatcaatcccccgcccccgcattatccaaacgcaaatctgcgactgactgatttaagtaaatccatccccgctgctcgccctcctactccgtcctccgtattcgtcgtgtgtcctccctccctcaaactgcccctccccttcccccccgtccccgttgtccccgtccccgcgcgcgcgacagccctgacccaatttggggggggggggggaattagtgctctgactgctggttggaagtggtggttgtcgagttggaattggtggtggtgtactgctccgctggtggaagaggtcgtcgtcatccgtccgtcttccaattccccgccgtccccgccaaaagcgcatttccccgcccgctttctccccgaaattgcgcatgtttaatccgccccaataacaccgatcatagctggcgcccccgcccccccggactcggcataacttgcaaaaactggcgactgatcactctgatcatcaggcatgcctgatcggataaaatgccggttccccgctttctttttagtgcccgaaattgcttttttaaaggtcaccgcttctatgaacacattaatcccgcttcggcggttcgtcccaatttgtagcaaaggatcaatgatcactaataaaccatcgatttnctccagtgtggtgctgtccccgcctcctcctccattccccgcttttta

SEQ ID NO: 16220 - DNA, 1501 bp, Heterodera glycines
aatcaaatacttgctcaacatcatcatcaccatttatctgtccatgtggaaaatcgcaaagcgttttccagccttcataatgctcagtgctatctcttataaagctttagcataagctacttcttttctaaaattcctgctaaaatcttcagacaatgagtctttaaacatattccaaagctcttccggtttggccgggcaatggactaaaatcaatgcaaaaaactctctcaatttccatggcatctcaaaactctctgcttcttctaatgctcttttccactcttcatcatttctaatcaaacctctttctaaacatgcggctgaaaaagtttcacaaacttttgcattgccattagtatcaaaaactgatttcaaatcatcataggagcatgctcccttcacatttaacaacaacagcctcaggtggtatcgttccggctcagccggtgacaccttcaccattcggccaattgtgttaaaatatgtctttctctctgtccattttcctttcttaaaacaaaacttttcaggtatctggtgataaaacaaattttttgccaaaacatttgtcttattcaattcaaaatatgccatcaactcagaaccattcgcaattctttcacgaatctcttcttcttccatattctcgtcaaaataacaaatatgttcaccttgtaggtgtacaggcaaagacataatacaatggcttctatcatacataggcaattcaaaaattctccaaactgcttcttgtgggcaaacataccgcgcatcaataaactctttaacttcatcatgatcatttttctcttctaattccaatcttgctctgtctggtggcttatgcacatacttatgcaaatactttactgaactaacactattaaccttttcaagattaatgtggcacttgaacattttcaacaggtacaggttgtgcgggacaacccatctgttgtctaattcatgtcttcttccatttgcaaatacttgaactgttcttccatcatttggtcttgcatacaaagccaatccattttcaagaacaactgtctcttcttgaaatactttagggtatcccttagagcatttccttcctttcataccatttttgtcaacaaactcttccatgcatgggcaatttgggttcaaattaccacatgggccatggatcataaaccttttcaccaaatcaaacagttctgcttctaattccttgtccggtattctcgcactaattcctttcttttcaacatcttcaccattaatcaatttgtcttgctccgccaatgtcaaaagcaaatggaagtgcggtagtccccgtccttggttctctaccggatacatccatgcaatcacttctcgaaaaacctttttattgactatctcattcataatagctttaacttttaaattaaaaactctgacaaccaaatctggtctatcacttgactttaatcatgaaacaaattctctgaaatctcttccccattgcggg

SEQ ID NO: 16221 - DNA, 3624 bp, Heterodera glycines
  misc_feature (45)..(46): n is a, c, g, or t
  misc_feature (51)..(51): n is a, c, g, or t
atagctttataattaagaaaactctgaggagttaatatattttgnnaactntggtcttatctttatctcttgtcacagaaccaccgtctgctcctgtctatctcatagcacaagagcttgccaatggactgataggagctaaaattgattttgacaacagctttccgcactttgttctgctcccaaatcgtttattgtcaagtggtcttggtctgggtgacttctttactcctggtaaattggaagccgacaacagatttaccatcctggcttcaaacgtcacggagatgacaaaggagaggaaactttggattaatccaaattcctcaattttggcggtccaagcgaccgtaattgacatcaaaagtaaatatctaagtctaagattctgaaaatttatatatattttaccatagaaatgtggcaatctgaacaaatcactgagattggcacaattgtcgaaatcaatgaacgctttacacccaccgaggtcattccaaaatatgtgatgactacttcgggatcagcgtcttgcccaacaaaggtcatacgacgtcaagcaaattttccgcttgaacacttcagaagagatcatcaagtcaatgttgttctcaaaagtgttcagctctcatctggaattaaaattcacccatcctttattttgcccggaaattcacctttccgatggcaccctgacatcattcgtcccaatggttcatttgttatttctcgcatttatatttgatggtttaaaataagctctgcggagctactctacatatatatatattcacacaaatttgtctaagctctgcggagctgattaaattaaataaacacaaaaaaaaaacacaacaagtgagaaatgattattaaagggaaaagttcaatacataaattaaaaaaaaaataataataataataataatatttaaattaaataaatgaatgtagtattggtatatgaatcccgtgggatttaagttcttggatcagggacgatcctcagatatgaaggggaggtatagtcatacagtcacaccaaattatatcaaaaatccaaattttagtcgattggaaattaaatgaaacaattattaaatttatataattttaaaagttttaaatttcatcagattttctcttgtctcataatttgaaaagcaatgccaatttaattcaaatccaattgaatcagaatttcaagaaaattaatttaaaaagggcggatttcttttagtagctcaatgacagagcttctgtggattggttggaggaatgggttcattcccattagaggttcggcattttccatttttattttgagtaattaaataaatatttaaattattttattttcagttttggcttaaaatcaaaacaaatttctcatcgtaaaacaaatcaaaagaaagaaaaagtctgaggacttcattcaaatttggaaattatttaaattttaacgaccagggacggtcttttggagggccggaggtgtaaggccgggaccggaaatggcctttacccttctcccccccccccccattttatctctccgatagggctcctcccatcccgaggggcgcttaaaaggcaacggataaccagccaaaggggacagtcggagttcagtcgggagtcattcagtggaatggctaatcgatccccgcctgggaggtacccccaggcatccatcaacatcccttcccttccaagccctgcggggcctaattacggacgcgtaagagggctcctctggactatttccctcataagcactgggtatgggacatcacggctttactcaaattaaaaaacccaaattaatttacatttttagctcgcaatgaaattgttttataaaaaagttttgagatataatgacgtcaaaaggtgcaagctcatttaatttttgagtaacaacaatttttagttttttaaatatggaacaacgatcacagaccatttgtggaaggataagagccttaagaatgtatacatttggaattgagctaggcattgatgacttagctaactttgttgcgcacacaactcccccagcccaggtagacatcaaagtgttagtatatctcaaattgaaattggcttaatttttaaaattggcaaatttgacctcattcagctccgttcaactttggctttggcatttttcgacccgacgaggcaaaataaaatggccgagtttactttcgcccaaattttggctgtcactcattcgaagtgaattttgtgaaaataaatatttaagtataatgtaaatttagctccaaaagtgccgccggtgctcagagcgtttctctccaattgctcaacgtcgaccgtttcattttccaatcgccacgttccgccgaattagcccttctgatcaaccaaatgctgcatcatttacgccagaaatcgctgtacgccattgcgttgcaaaattcatgtcccgaaaacggtaattaccatattttacgaagtgcgaaagtctcccgcttgtggtttcgtgtcagtgtctttggccatttccccgctgacaatgaccgcccacggggacaaattggccatcgttgagccaaccggcggagtaattgtggactcggaggacgactacgaacatcgggtaaacgaagagttgcctcggaatatgcattcttaatgacaattttcatccctttttattactttgatttcacatttcgaattgctttcttttttaattaatctttttcaggtttcggtctccgtttacactgtcaatgcgttgtccggcgactgttgcgctccgtcgttggattggacttgtccaattccgttgtcgcccttctcccgcctctgttggctgaattttacagccgttggaaagtaaaatataaaatttaaaaatatcaatcttttattccttttcagtttggcaacaatggacgaaggtatcaaacaaaccaaccagtccttgtttttctgttcatgtggtcttaagaatgcactgtccgtctccatttacccggccctaatggtggcgtcggtctttggcttccggtgatttatggttctgaactgctccgtgagcctgaagccgactttctgtggcccattgctctgacggaagtgccacaaccccaatttcgacatatttattgccgtagctcaaaattccctaccttcggcaccaaatctgtaccggaaactgttccatggacgatgcctttgctaaatatggtggaaattgggccggatatttaattttctctcgatttattattttaatatttttaaggattccgaacgtggcaaattggagaatgaactgatgctaaacgaaatccaacaaattgtggttaggcattcagcagacgacaatggcactttggcgttgaacgctgtacagtcgcgtcaaattgcacaacttacccaagattacatgtccaacctgctcaaattgttttccgtttcgtgccaagtccgtgggaagggcacaaaaaatcccaaaatttaataacatttgaagttgaaccgtgagggacgggccaccgaaattgctcgtcgggacacaaatttcaagctgatacaagcgatgtgaatatacgcgtacaaagcacggcgacccgggctcagtgaaaa

SEQ ID NO: 16222 - DNA, 2909 bp, Heterodera glycines
  misc_feature (1384)..(1384): n is a, c, g, or t
  misc_feature (1410)..(1410): n is a, c, g, or t
ataattagggttataagttgtatgcactaaaaaatgcctaatatgcgcataaaatatgcactaaaaatcccccaaatatgccctaaaaacccgaaaaatacccaaatatgccttaaaaattatccaaaatggcttttaaaccctcaaaaaaatgccaaaattgtgtaaaaatacagaattgactttaaaaactacaaaacaatggccaaggagcttttttagacaattgcaaaaaattttgaatttcaaaattttatgcaatttcgaattttttaaatttttatcatatgataaaacaaaattacatttttcttatatcaacaatttttttttcaaaagttcttacaaaaaattcaaaatttttcgatttttaagggtatattttttaaattcccaaaaagatcgatccttaggggtgtatttttcatttttattgcatttttcttattaaaatttgccaaaaatgaccgaaatatgctctaaaaattcaaaaatggtaaaatatgcatttattctcgaaaacccccaaaatatgcttttatatgcactaaaaaccttcaccaaatcgaaaacgcagaaatgcaatttttgagcccctttcttaatagcatatgcgcagaaaaaatatgcaaaatcatacaatttataaccctaatgataattaatatagggctgccaaaaatatgtacataaatatgtaaaaaaaaatcccgaaatatgtacaaaacaatccaaatatgtactaaatatgtaaataaaattttaaaatggttttttttaattccccgtaaaggatgaaatatgcagaaaatgccataaaaatgactttaaataggcttataatcaccttttagtttttaaaaattactttttggtattttacaacggtgtgtacattttataaattattttttcactaaattctccaaatatattaaaaatgaaaatatgtacaaaaaattttccgaaatattggattttttgaggatttccaaaaatttccgtaaaaaatcctcaaaatatgtaaaaaaaaataaaataaaatatataagaaaaaagtccaaaatatgtacccaatatgtaagaaaatcccgaaatatgtaaatatgtataaaaacgccgaaaaattaaaagtcaagattcttgttcgcaaacagaaaaataaagcgtttttcctactatttgagcatggagaagccaggaaaatatctatttacataaaattggcagccctaataattaagcatttatgtaatttcagcatcaaaaaattctaaattaaattcgaaaaaagcatgaaatagcaaaacaagcacaaaaattgaaaaaaaggtataaaaatttagtcatttttaggcaaaatttttttatcagttaacattanattcttaattttctttttcccactanagattcaaatattttcttttagcaaaaatggcatttttaaataaaaaatgttgtcaagaaagtggatgaatttttgagagtaaattttgcatttcttaggggatgtattttttgaaaattttaatcgatgttagggttttgtcttagggtagtgctggtagacggtgttttcgtcaatattttacaaaaaatgtcataagcactaaatgctaaaaatcacatgctcagcattaagcacaaaaatacgaatttaaacaaaaataagcatgaaaaagttggacctaaaagcctaaaaccaagttagaaattagttttcatgcttattagcacgccccaagttagcaaaaaatttagtgattgctgcaaagccggtcttattgttcgtcataactagagaccgacttttgaggcatatgccttttttctgctcattagttccggtatattacgcataaaaaatacattttgcttttggtttgaagcttctacattgacttttattatgcctttttttgtctttttcgggattttcatgtatttaatgcctttttggcattttgccgttttggtgtctttttagcgttttttccaaaaaatccattaaaatgcaataaaatcgggaaaatacactcctaagaaatgaaaaattttctcaaaaattgattaccaaattatttttttcttgttaaaaaattttaggtttaattattccttattcgaaaaacattttcaagcctagtatagtgcctttttcacgatttttactgaacctgcccgttgtgcaacaataacccgttgctgtgcatcattcgcaaccacaaaacaccgccccattctcagttgcacaacaatcgcaaccacaaccatttgcccctgttcaggacccaagtattcgtcagcatctggttcagatacttcagcaacaacaaacgcagcaacaccaattccaactgtcgccacctttgcagcgtgtcaacaaccccgggctaagcattaatccagtccgaatgataacatcaggtcaattgatagccaatcgtcaacaaagtcaagcgcagttacaacaacagcaacaagaacatttgttgatggattcgccaccagcggcacgttcgtccagcctacaccaacggattatacaacatatgcagcaacaacagctaccgcagctagccgctagactcccgacaatatcagttgaatagaaaatatttacgaaaaataaaaatcccgagtacggaaatgtgaagcccaatagagatgaatttaaaaaagtgctataataacagcccaaaaatgtatttttttcactatatttccctaaatatgaaaaccttccctatcaataaaaaaaacttacaaatcattgtattttaaacgactcctgtttccctctagtataaatatttaatggatatttcataaatatttttttattaaaaaatcggttttaactatttatttgttttgtttttaaatatcatgctttgttaaatttt

SEQ ID NO: 16223 - DNA, 1122 bp, Heterodera glycines
cgagagttgaaaaaggcaaaaagtaatgttggttgcattggtaatttattcaaatagggataaatcgtttttaaaaaagtttaatagccgtcagggctttcgcttttcgcaaattttgtactctcgcgttcgcatttaggcatgaaatgcgatattacacactaagaatgagggatgaaattcccctaaaattttcaaatttggccaacaaattggcaattttcactgaaaaccttattaaaaatgggcaaaatttccaatttttcaccgatggcgtctaacggcaccgcaggaccccaaaaactcatatttttttttaccaaaatggcaaaatttggtaatttttggcggaaatctgttaaccaattgatttattttcatttcgcttttttgcttgcgcaaattacgctttttgcattttatttttcgatttggcccatccctacataaaagatgcaccaatttatgtttttaacttttattcattataagttttttttattttattttttaaaattgattcactaataaaaaaaattttactgttagaattaattgagaacagaaaatcccaataaaaacatatataaactttataattgaagtacataagtaataaataagatttgtatgattaagagacatacgttatagaacaagttttttttaaaaaacaaactttattgtcgaaatcaatcactgtcgagatcaccactgtcgaaaactaacagcaccatttatcatgcttattttgccaaaataagtataaaaaaggtgaaaactaagaatagaatgccaaaaaaaagacttaatactctttgaaaaatttcttgagtaggcgattgggtcggcggtgccgataaacgtcgctgtcgaaaaagttatctcagacagtatttggcataaggtaacattaaattctcaaaaaaagaagaccgcgggataccgctcaaaacccaaatttgcagaccccgctgctggattgagattcaaaatttttgagggacgagattccgcaggataaatccagcagttgcgtaaacctcgcaaatcccgcattgcacaaaaatgcgaattgcagtgtgtcgcgaaaatctcgcgcggggtcccattccacgccgg

SEQ ID NO: 16224 - DNA, 1013 bp, Heterodera glycines
cgataccagttagatttttgccgttttttttgtccgcaacttattttttcgcaatagttgaatcaggaaaaattgtgcgcaacaatccgtcagatgacaaacagtccaccgagcgaaaagattggcaatgttgtgcagtgtgatacgcgatagtgcctattaattagaaaaattttgatcagaataagcctgttaaccttcggcagccagaactttacggtcttcagttgatggggccgaagtatttggcaaaaattcctgcaatggaattgatcggtttgctgcttttgccgctttctgatgttttccagttttttgatgatgagaaatggcagctttcccaatggaaagtaggttaatatcatcgttgcagacgacacaaagggcaaattcttcgccttttcgacttttctttatgtgccggaattctttttcgtagctctccaaatagatatttttacgttttgggggcattttggcatttaacatttacgaattacactcacgaaaataaattaaaatgtaattttttacaaaaacgaattaattcaaatattcgcttcaaaaaaatgatatgtaattcaaaaaattattcaatttttgcatttttattttcaaatcaaagaataagcacaaaacaaaggaggtcaatccgaggtgtccgtttccttcacttttacctacataccttatttttctgtatttttttttgatgtttattaaatatttacatactacataataaatggggtcggggtcgttttcgcgtggggcgagtttttgaacttaacttttttctttgtcaaccaaatccaataatcttggtatcattcgatagccctaagtgttctctattagcctacaaaatttggaaaaattttgttaaggttcaaaaaagacgcgaaacggcccacgcgaaaacggcctggcccgagtaaatgagtttcgatttaaatgaattaatttttattaaaattttaaaaagaattttttcaaaaaaataaaaatccatt

SEQ ID NO: 16225 - DNA, 2087 bp, Heterodera glycines
ggtttcaagccattttagggttttcatatcaccccgaaggagtgatctgatcactgtggtgcaatggactttttttatcagcatcaaaagttatactggtgtgaattttttcagattttttcttgccctataaaaaagttacatgtcttcaatttttgaagctataattttggaacagcaaatttggggaaatttttggataaaaaattcataaaaaaatttttcttttactctttccgatttttttttgtgattcttaatattttcatctttttcgtatacgaaaacgaaacgaaaaagtgcattcgatacgaaaacgaaacacgaaacgaaaaaaaatattttgaaaaccgaaaacgaaacacgaaacgaaaaaattttgacggacgaaaacgaaacacgaaaacgaaaaaataaccattttcgtacgaaacgaaacgaaaaaaccgaaaattttttaaacttatttcaatcataattaagaaacataaaatttaaaattgtatcctctaactgaaggaatgaagatcctagtaggtggaaaagctaatgtggctctaggacaggggtgtgaccaaacaatttttaaaataaagaacatcaatgacaaaataaggtttagggtcaaaaaagacaatcttgcaaaattggttcgaatcagttaatatataattttttcgataaaaaatgtattaaaatgttatgtttttcacatcctatttggattttaacaatttttggggaagaaattagcaactgctgaaaaaaaaagattttcaaacgttttttttgcagtgtattttttttttacaagttgatgaatgggaagtgggtccggcggcgccgataggcgacgccgggaaaatttttgaaaatttgagtgctattttatagcagattttcaattaaaatcggtaaaaacatgattaaaaaatcggtaaaataaagtgcggtcatgcgggatcgaacattaatgcacagcacaaagcaaacctgctgttttcaccactaaactaaaatacttaaataataaaacttattatttctttccaaaaaagtcattcttaagggtgtaaatattttcgtctttttcgtaaaatattgctctgacgaaaacgaaaacgaaacgaaaatcctaaattttaaaaaccgaaaacgaaacacgaaacgaaaaataaaattttgaaaaccgaaaccgaaaacgaaacgaaaaaactttagcggacgaaaacgaaacacgaaaacgaaactcaaaaagtgccgaaaatgtaggacgaaacgaaaacgacacgaaatttcgtccagccctggtgccaagggagatttacctttttaattcggttgtaccaccaaaatcagtccgtcccccgccgccattctgtggtgactgatagaatggaaacgccgcgctgcccgcctctcctcacattttttctcttctcttctcacttttcagtacccaattccatcgattgcatttttgatttaccattttcgttaccatccattttttcctctttcattcttttcaaacaaaaaatgtacccaaaattggtcgatcagattgcgggaggaattgccaaagcagtgcaaaaggccactgacagtcacgcctttcacgagttccccgattgcttatcattggcccacacggaccgactctccatcaaactgaacgctgctcacagtcaaatgtaacagtaatcattttttgagaggaaaaattagacgccgaggaaattttaaaaaaaaatatattttcgaattaaaaatgtgaaaaatgtaggcaaaaaaaaaatatttacataaatgctttagggactatccgtcagaaatttatttaaaaaaaagattattataaaatacataatgattaaaataatttgatatttataaaagtaataataactttttttttaaataaacataatttctataaaatggtaaatttaattaaatttttaaagaaatattgcaaaaaaaaactgcaactttttttaaatcaaacagattttatgtagcaaggaagtttatcattgagtaaaaaataaaatacatttggctgacggattgtcctccatcactga

SEQ ID NO: 16226 - DNA, 2388 bp, Heterodera glycines
ggatgtatgtcagagatggcattccgagacatcaaaaattttcggaagtcggaattcggagggccaaaatgtcgtaagtcggacaaaggaagtcggaaattcttgaaaaaaatataaatactaaattgaaaattcaaaacagaaataaaagtaaaatgatttcaaaaattattttcgctatttacaccactttttcgcggacgatcggcggtgccggtaggcgtcgccggaaaaattttgaaaattttaatgtaagcgttatttttgaaaaaattttaaaaaatttccgatttttatcagattttgtgagtcggaattacgacctgaaaatgtcggaactcggaattccgtgccatctctagtgtatgtattgaaaaagtaaaaaaaataaggcctaagaaactgacgattatatttattggatgcgtaaaaagagtagctaatcttcgatatttcatagagctttaaaaagcaccaagattttgttggattcaaactcaaaaagtcgcatataaccagttacaatttgtaggcgtccaccttttgccggttgcacatgttgcgccacgctttgcatcagtatgatgactagggcagcaacttttagtgaaaaaacttttttttgctcaattgttttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactatttcgacattttttgggaaaatttctcaacaaaaatgcaataaaaacggaaaatacatccctaagaatcgaccccaaaatttcaaaaaaatacacccctaagaaacggtcgaaaatttttgaaaattcacacctaataaatgaaaaattttctcaaaaattcttcccgcaaattttttttttttcatgacaaaattttttatttaaaaaatgtcaatatttgctaagagaattttataaaggaaatgtacctcatttgtaactgcaatcagtgaataaaacattttttgctcaatttttggctgaaaattatgtcactattcgtcactatttcggactttttgtcactgtttcttcactattttgggatttttactcactattttagttaactatttcgggatttttcgtcactaaaagttgcggccctaataattagtgattaaatacaattagtgattaaatggccatcccaacttaaaattgcgccccttctttcccacttccccattttggcattttccattttatgaccaccttagttcggccacttctgtgatactatgcattgagtgaattgtcggcatggtttgttggggttgtggcattcgatcggttcccaaccgttcaccgcccaccgaatgttctgatgggcgatggtgggaaggatgggcatgggaatgtgaggaggtggacagagtgtggccaccaaaatggagcatggccaggaagacagaaaaggcaacagtaacagtcaatggtattgtaacattacatactgtagttgaacaaagactgactaatgagagcaaaattataagtagaaaaaacacaagggaaaagctgaaagagagaaggaaagagtgaaaaaaggataaaggaaaaggtgaaaagggtgccacaccttcgttgttatgtaaatacagacaaaaaagaaattaagtgggggaagaatccataaatatgcctccatccgcttactttgtctgttcgaatatctccccctccccccccccccccccgtttgctctcatcaaccgatgaattcccttgaggggtcaactccaataggggggggggggggaagattcggcattttctattccatggagaagaaaaaaagcaaaagtcctaaaatttgttgtaagagttggcagacggaagaaaaccatcgctcaattacaacgcaacgaaagaagagaagaaaacgaagagaaagaaagtgagagcgaaggaaagagagaaaaggaaaagccgagccgaatcaaaagggaaggcaaaagggagggaaaggcggcggatgagtaatgggcacaaagggatttgggggaagggacagacgaaagggaagggagtggaggaagacgaagccgacggaagaagatttggtccatcaaataaatttatttggcactcaccggtagagtttggtggcaaatcgaaccctggagaacatttcgcggtaataccctcaaatttggaacaacagagaataagagaagcgaagggaagggaagggaaggggaaatgtgagtaacaattcgagttaaagtaaggaaataaaagggcaaagaaacgaaatgcattttggcacctgcggagaggggggggggg

SEQ ID NO: 16227 - DNA, 1416 bp, Heterodera glycines
tagcgcaataaaaggttttctgttatgaatctttctctaatttatttataactgctaaaaaatgcggattcaattttaaatgcgaaaatagtgcacaaaaaggagtctgccttacgggggggcttgatagctttgtacatgataattaaaagcgaaaataattttcgtatattttttcacaatttatgtcaaaagataacaacaaattgataaaatgttgaaacgaaatggtgcgcaaaaagggagggatggttagatgaaaagaggaatttttaggatgggatgctcattatgtgatggagggggtgaagaacacacactccgtcttctacctctttctcttccccattcttccaccttttccgctcctcttcccgtttccctcttccttttgcacttccctattcgctctcctcttcctcttcccatttcctcttcctccttccccttcctcccacccttcttcttgccccattctctcattccattatgcatctttcgtccgtccgtccgccttcctcctcctcctcctccctttcactttcgccttccctttgacttttcaactcaaagcgattttcgcagttggaaatgcacgcctttatgaatgagacgaaaaagcagcataatttatttttattagatgaaattgttttctcttattttgtgaagagagcgagagaaatggagaagaaaggaagcggagaaagagaagtgaataaaatccaagtttagctaaagaaatgaataatggcatgtccaatgggaagaaagacgaaatgagtgggggggggggggagggggaaatgcaattgacagcggtgccaaaagaggaagaaacgaaggaatgccattggcaccagcagcggaaaagggagaatcgaaccgaaaaaggagggaagaaaggggagggaaagggaagaaagggaagaaaggggagggaaagggaagaaaggggagggaaagggaagaaaggggagggaaagggaagaaaggggagggaaagggaagaaaggggagggaaagggaagaaaggggagggaaagggaagaaaggggagggaaagggaagaaagggaagaaagggaagaaaggggagggaaagggaagaaaggggagggaaagggaagaaaggggagggaaagggaagaaagggaagaaaggggagggaaagggaagaaaggggagggaaagggaagaaagggaagaaaggggagggaaagggaagaaagggaagaaaggtgagggaaagggaagaaagcgaagaaaggggagggaaagggaagaaaggggagggaaagggaagaaaggggagggaaagggaagaaaggggaggggaggggaagaaaggggagggaaagggaagaaaggggaggggaggggaagaaaggggagggaaagggaagaaaggggaggg

SEQ ID NO: 16228 - DNA, 1137 bp, Heterodera glycines
ttgaagaggaatgcacgccgaactttgctacgccgaattgcttgtcattcgtgcacttttgacttttttcatcgacgaaactcttggcggcttcatcaaaggcgcctttcgcattcgaatgtgttaccaatcattcaagtcagcccctccggcagtgccattgccgcaatttaatcattgaataataattgtgatgactaattggcctttctcccccatttcctccagagaatgccatcgggtgctccgttcaattcctccgtgccatctttccgcttgtccctcttcaaatccgtcgctgcgacgtcagttcgaggccggcatccgtgccggcttcgggttgttcaacgtgatgctgtccgcaatgcccacccgtgtgtccgcactgctccaacttgtcggcttctccggcgatcgggcaaagtccaccaattcccaagagttccaatttccctttacaggactttgggatgtccgaactcgtttcggtctgtcctttctttcttcctttcgaatgcccctttctcccacagagtgcctcaatggcggacactctccgcgcgcccctcgcggcaatggttttgatcaggcgagtgcccgggttgcccatccttacttattctgttcctgatcagttaccaactcttcctggcccatctgctggacggatgtccgcccgatttggcgttgtgttcccaacttttggcacctttggtccgccaattccccaatgtccgtctccatttccaaattcgtttgtccattgtcctttttctcatttgtcagggtgccgttgtgcttttccttcgtgcccgtttccatttggtcaacggcgaattgaacagagccattcagttgaacaacagatccattcaatcgcagaacgtctacaaacagttccagcacatttgccattgggaattggtgtcagcaaatagaatatcttttttttttttggtccattgctctcggggataggccaatctcgaggttaatcggattagcatttgtaaatctctaattaattcacttttggattggcaatggtcgatcccaagtttacccaatcagtctcgagttgggcaaaacaacttccgattaattcgcttttgtttagtaccgtccatatggtgctaa

SEQ ID NO: 16229 - DNA, 1879 bp, Heterodera glycines
tggcagaaatgctgccggaaatgattttcccttttttctttttagactttttgtctgtcggtcttttgtctgtttcgttttttcttttgtctgctcaaaaaacatccgttgaatatttatgtgctttaatgagttgtgttccttctcttcccgtcttttgctgcacataaataaataccttttcaatgaattcagttggtagaaaatgaagaaaaaactgacgacgaattgactttttttgactctttcctccgtcaatttccttagtaatttttatcacatacctaattctgttaatgcttctgccttttcaatattttatcaatgttatcatttccatcagtagcacaatttgcgtgcgcgacggcggccaatggaccgattgaccccccgggggagggaaatgaaacacaatttgtgatcgattggtttcccattaattttgtcccttttgtccaatttccaaaattaagcttttcacttctacgccaagtttattttgtttaaatttgaaatttaacactatttttcgtgtgcatttactgctgattgaccgaacgaagctttctttgctttgacttctctcaaatttcgtcggcggttcgttcatttccccccgggggaatgggcggaggggcgggggggggcctttgccacactttggccacgggaaaaggcccggccgaccagccgactctttctttcttttatttatttatttcttttatttattttgacattgcattggccgactgactgatcagtgccaccgctgatcataagtaagtcgttaaaagatttgaaaaggacgcgggacgaaaagcaaacaaatggaaaggggggggggaggacagaaattggcaaataatgcccaaaacatttggccaatggatggaagggcgtgggacggaatcaatcctttccgtggccaaaattggcattctttccttagccacctgatcaaactctgatcgtccctcaatttgatcactgatcggtcggccgtcctcagatcaaaggttgcgcatcgtttgatcaaattccccccaaaaatcccaaaacaaatcttattaattgctgctttttttgtgcgtcattaggcaaatgaaatgaatgagttgaatattttctgttgacacgttgactttcagacaaaaaaaaaaagaaaaaattttggcgcaatgcaaagatttttaattggcaattctttttcattttcactaattacttaattttaactttttatttttttgcttctcccttttcctcttctgtctttttttcaataaattgcgataaaaatgtttgtcttttgtcgatgaacgatggccaattaattttggcctcctcaaacccatccgttgacacttttctcgcgttttgatggttttatttgggggaatcattcgaaatcgaacgatgaaaaaaggaaaaacatcgaaaaaatttaaaaaaagtgagaaaattcacattttaaattctaaagaatgttttgtttttagtttcttttgaagtcaagtgtacataaattcttgtgacaaacagcttaaacatcggcactcactcatttgttaattagcaattaaagtgctaattaatggcggggacaacagcaattcatttacaaagaaaaaagaacaaattttgtttgggcaaacaaagaataattgtcaaattcaacaatattaattttcttttaaaaccattttcgtttttttttggtcatttaagccgatataaaagtggggagggatttggggaccattgaaatattttatcggaactttccggattctccgaatcgtcaattgtttggcacatcaatttgttggattacacgccaattcctcccttccctttcccattttgcattgtccgt

SEQ ID NO: 16230 - DNA, 207 bp, Heterodera glycines
ctcatcgccgtccgtttgggccttcaactttttgcaggtgacccggtgacgcttcagacttcgcgtggaacaaagctggaattggtgggccaaaaactacatacactaaggatgtgttcggattttccggtttccgattgcctaaatatttaagacgtcagaatggcaatttattaaattttttgagccatcggaattttgatttca

SEQ ID NO: 16231 - DNA, 4230 bp, Heterodera glycines
ggtttggggaagcgatgggacaaaatcaatccccaagacaaaatgatgggaaaagaatttgggattttttcggttaccggggagatggaaaggaggtcactttttgaggggtcatataaatattaattggcggaagcaatcaaagttgggaaaggatactgaaatggcgggcattggatgggaattgataaagcgatgggacaaatcagtcttaaaataagggagcagcaggaggaagtggtagagagggtcagaacaggaattttttttacggggtctcagttaggcaaaaatggtgagacaatcaatgtttgggaggcgatgcgtgccgaaatgtcggggtgggtcggaacttagagcgaggagtacacgtggtacggaatagggtccaaatgaagtaaagaaaaatcccagtaccgagacgttgccaaaaaacttgatacagagatccccaaaaatcctcgaggctcatcgacaacttcgagagtctggaacagtaatgggcattcttcactgaatattgtttcttatacaaattctttaagggaggacgatcaaaattttcccgcttgctcaatgacctatgcgtttgccacccctcgccgcctacccccccccccccccccctaggggtcattcgacggacggcaaatggtccgcgagaccgtgggtcgtccgtccgtcgtaaaaacagcgacggaccccgctgccggcaaaattgttggttgtgtgcagcaaagcgggcgcaaaaggagtgaccaaccattttattatatgtgtcctccaccacccaagaatcgaatgtttgttcaccaccggcgcccaagcggtggccgccgaactcagtcccgccaacagaggcccagccaagtttaagaagcaatcagtttttttaatttatcaaattttatatgtttttggaaccgctcgaaaaataataattattaatattcaaatgtttaggtattgtccggcgatgaaattccttaaaaaaattggtaatttcctgttttgtggcctcattttcaaattaaaaaaaacgcgacaaaaagccacgagataaaaaaaattttccatttattttattttagtgaattaaattttgttgtttgcgcttttgctgacattttttcaattaaaaatgagaccaaagacaggaatttataaaaaaaattttttgtaattttttcaaaaatagaaggacaattttaattccagtcgttatctcctgatctaatagagcatttaatagtgccaaacttataaaatatccaactcatgaaaaaaaagttacggcttcttaaactaaactgggacgtagttggcggaactcacttggccattccgggcggtcagttatcccttcgcctccgcgttctttgctctccggttgagtggtggtggtcgtgctttgctgtgttctgtgctgaaaatgtgacctctgactgcttggatgcgttttattattatttatttgaccctcaatctcaacaaacatagcccccccccactcctcgtgggattcattttactgatgctcaaatgagtcccggtgaaatttgggaaaaaagaaagtgatggatggcattggcattaaccaagtattttttgagaaattttgggaaaaaaagggatggcgttggcactaaccaaatttttaaagtttatttcaatggaactctcataaaacgatttaaatttagtaaaacagacagagagagccccgaggacttcccttagagggggagggtggctctattacggggggatatcaaaaaacgcaaaataaacgaaattaattcaaatatttaaaaatttttgtaatatggatattttaagttaaccaaatcttggtcaagaaaaaattttttacgggatgaatttttaataaatttttttcaattttattatagtgtattttcagaaattttttcattcttagggctgtgttttttttggtcattttttgcttttccgtaaatatccattttattattcttttttttcttttcaagtgccatcatttttccttatcaaattttgttaaaccccgcctgggaaagagatttgaacaacaaaaaagaagtaactttttgtacaattttttcaattggcaatattttttgaatgaattcaaaggcgaaaaggtaaacagagaaagaaaaaatgaaaggttagagaacaagaggaaaaagggttttgaaaatttgaatttaaatcaaaaatattgtcgaaatttaaatgggacagcatcaggatgaacatagaaaattgtaagaaatttggctaaataaataaaatttgggtaattaattatctatgatatggcccggagccgaaaatggccagaatatgttttcggaagtttttggggacccataacttttgtcaatttcattttgtcaaaaatttttgaggaaatgattccggaactcagggattagttcccgcaaaaaataaatttaattcgttcaattacggaccaagaaagaatcaatttgtctatatttttttggcagttttagactacggtctaatgatcaatattttcggttaaattttgttagtagacttttcgaaaattgccgatttttgaattttgagtcaatttcttaaagtatttagcggaaaattaaaattaaaaattcaataaaagttttcttaaatattctagcaatgttttcaattaaaaacaagcacaaaaatattccatgatgtttttttcgttaaaaagtagtaaaatttgaatgaatcacaaaaatgtttgcgacgatttatcatatgaacatttaaatgaaatttcggaattatttaatttttctttttttataaatggcaaaaaaaaaggaatttttgtgttattttttgtgatgaataaggcaaaaggcatcccatcagccaaaaggtgcccatcttcctgcacaaagcgccattagtcatcgccgacgaacagcgacgacccccgaggggcagggtaaatgatcaatttaatcgtcattaaaaataaaattaaaaaaagacacaaacattggcatggcatcggcaaatcggtgctttcagtcagaaatgttaaattttgaaattattggtccaaaatggactaaattgggggggaggagacgattaaccaatttaatttaggcaaatttgcggatgaagaaaaaggcgacctcatttttggactttctctttttcttttaaaataaattttttttaattttgatattatataattcaaatcatattatgagaaacatatattataatatatcatatttatttgcatgaaaaaataaatcttttctattagtgatcaacagggcttcattttctactctactgctcatcaaaattgcaatgaaattagggaataaaaaaatatttatgatctgtaggggtaaaaatgtttatttaatcgagcaattactttatttttatttcaatatagcttctttcaaattatttattttatatttagtgagaaattttattaaatatatatatttgccatgaataattgctgtcaaattaaataataaatttattttaatgcttttaatataatttgtttttagaaatatttcatcattaaaatgaaattacacataatattttctttacttttatttttgatcgtcttaataaaaattaattatgttgaagcaaaaaaggaaaagttgcaacaaaaatcatttgatgaaatatttggagaaaaatgggaagaaaaagaagaagaaaaacgaaatgaactcaaaaaaagagaaataattgaaaaattttataaaataaaagagaaaataaagcaaaagggaagaaaatactcaagaaaaaaatggaataaaattaatttgaaaatagcgaagaagttgggcacaaattgtaattatatttataaatggattaaagaattagggcttaatcaaaaaatacataaatgtcacaaatcaaaaactgatgaagaaaaacttgaaattgtgcaaaaatttatagcaatgaaaaaagaatacaaacaaataagaaaatattcgccaaaagaatggcgccaaaattatgccgaaatttgtaagaaaattggagtaggccgagacataattaacaaatggaagaaacaatttggcattagcaagaaaagaataacggagagagaaatccaaaaatgtatgacaaggaaattgcaaaaatgatgaacattggtcgaacgaacatttctaaatggaaaacaatttgaaa

SEQ ID NO: 16232 - DNA, 1332 bp, Heterodera glycines
tcatatatttttagactacaattcttaatatattcgtctttttaaaaaacatatcggtactgtcaaatcacaattgtcgaataaacaattttttgatattgtcgaaatcacggcaatcatggagtttactggtcccgttttttttttctttaaaaatcatggaaaattttttctagggctattttactgtgctgagcacgaatccggccttatttttgaccgattctgaaccccgaacccggattcgaacatttttcaaaaaaaaattttttaatttttttttctttcatctatgtttgtcttgagcataaacagcatacgcataatgggaaatttggtcataccatgataacacttgttttaacttagggccgtaggctcactaacaatttaagccatggatatatttgttttttgtgatcaattctctaccatagaccatacgatcggttacatgcgtaaccgaggtcttttgcgtcaaattgctccaatatgtggacgcaatggatgccagaggcgaatgacgcaagtgaaaaatccaagttttccgactgatgggtgccagtggcgctgtccttcacacaaaggacagaaaatgtctattcgagcgggctctttttttgagaaagcgcactttcctctgcgcaaaggaatgtttctggcatattgctgggcactaggtattttaatattgcgttaggaaaaaattgtctgggcaatcatttctaggcttcccgttacacacacagaagcaaatgaccaaattggacgaccatacattgattgattgggggaatttttacagaggaatctgtagccgttggctcctggataatcccattcggttgtcttttcttgtagataaggccttcatagttattttaggttgggaggggttggacatgtgattcaaattgatgaatcggtcctagcccgcaggaagtaccaccgggggcacagagtgcgcgagatttggatttttgggctttacgatgtccacgccggcatcggagtggtccgtataaagcgaaatagtttattgtcaaaaagcactcactgtttggatttcacgtcatttagttcgacaggcaccactccaattgatagcgtgctctgttgtgttcgaagtatctaataaataacgcttcttacgaatttgtagactttcaggcttattaagaattatttggtcaagcaatgaatataaaaacctgaagtcaacggtacagcatgttttttaacaaatttttagtttctcatggttggggtgggtccaggggtagaaaatggcgaaaaaagtcatattcatattcagcgacctctaaacccaaa

SEQ ID NO: 16233 - DNA, 1338 bp, Heterodera glycines
  misc_feature (10)..(11): n is a, c, g, or t
atgcctgcannggtcacctctaaaacccaaaaatagactgtttccgggttttttacatttcgtggtttttactcttatggacttccctggcttggatactttgtggcaaaacttccactgctactcaaattttatagctttgctcaaaatcaacaaagttaaatattttgataccattatagccctattcattttcaattatcctacatttttcaacaatttcgttgagctttaaaaaatcatgaccaaaaatgtttgaaaaataagttttttgagttctggcaaccgacaattggaacttagaagttgtttaaatggtctatttttaaaataataaaaatataaatagagcgagagatttgtatggatttttactataaaaacatttatacttatactatttcaaataaaccctttatttaatcgactgacaattctatcattatttttccgtattttaacaaaattattaggctaaacaaattaatttaaagaattgatatacttccatcaaatgtatttatttttatagcgcagacgcattttagttcatgtttccatacaaatcaaagctttaaacaatcaattaaaatcaagtaacgactcgctgatgattgacaaatgctaaactcccttttcagtgttatttttaattgctattattagttcatatttttaatttaatgaatttttattctgaattcctattgcctttgcgtttttcattagtccatatttaggtcttttgggaatttcaatgccgtgttgggtgaggaacatttcaacagccaaaattcgcttatgaaccatcagtgccaaaaacacaacggcattgagcgccagagtccatattgctgcaagcaaaatattttagttcattaatttcattatttgaaccctgcctataaattaaataaaaaatatgaaaataatttttcactttttcaaattcaggtagtcaaattgttcgaaggtaatggcgcgaaaaaaaaacaaattaggccgcaggattcttctgtcaaatgtaacttcgaagatatgaacacttttccaccgaaaatcacagagggaatgaaattatttaatagcaaaccgttcattaatttatctctgatatgtatttgtcattggtacactattttttaaataaaaaataccataacgaaaaccaaaatttgaaatttatttatgttcaatacaaccttcaacatttgttaagaaaaatattgtcaaactaaacaaaaccacaataaaatctttagaaatataaaatgaaaaaatagcgtgccacaacacgatctttgctgcaaaccctcgagagttttggttcgaagcttt

SEQ ID NO: 16234 - DNA, 2646 bp, Heterodera glycines
tttatttttaagttcatacggcgacgtttgtaggtgcaccccatggggggagggtggggtggtccgcagcccctaattggggggcagtcgtctcccccccccccccccgaaaccttcgaaattcaaaatttatccagtaaaagttggcacttttttacttaacaaaatgcattaaattcaaaagtttttcaagccccattttactttgttttttgaaattctaacccaaaaatggcaaaaattagtcctttttggcgaaaagcgactcaaattcctttttgttgacccgttgagtaaacaagaagctccggttgcactcccgaaattttttctggttacgggcatggtactccgttttcagtgaaatttccctaattgaaatgaattaatttgtgaaatctggacgttaatccataaaatatttttcaataaacattttactgcgtaatgcaatgacggattttagtcgacgacgccatactgtgcaaagttgaaaatggagggaaattgggcagtcgcaaaggggtgaatttgcccggaacaccggtcgatttgccagccgtttccgagaaggacatcaaggacctgcgttttggtgttgaacaggtgcggttatctgtggcattttattttatttaaaggcacttttcgatattttccttgattttttgtttaatattttgttcctccaaattttcagggcgtcgacattattttcgcctcgttcattcgaaacgccaatggcatccaaaccatcagagaagtgttgggcgaggcgggcaaaaacatcaaaatcatcgcaaagatcgagaaccaggaaggcgtggacaatgtggacgaaatgtgagtttaagctgaaagacgaacaagggagagaattcaaaaacttagaaagttcgttgtataagaaaattcttagaaaaaataatttcaaaaattttcagctattgtagaaatttttgaaaaatcctagtaattcgctgaaaatttttgatattggagtgggaaacggagtgcacccattttttctatttttacagcattgcggcatcggacggcgtgatggtcgctcggggcgacttgggcatcgaaatcccagcccagaaggtgtttctggcccagaagatgatgatcgcaaagtgcaacatggccgggaagccggtgataactgcaacgcaaatgctcgaatcgatggtaaaaaattagggttttaaaaaatgaatgaaagtgtgtgtatttaatttccaaatttgtcattaggtgaacaagccgagaccgactcgtgccgaggtcagtgacgtggccaacgcagtgctggacggctcggactgtgtgatgttgtcgggcgagtcggccaagggcgattatccggtggaatctctcaaaaccatgcacgacgttcgtttccctcgttacatttgataattaaagactgaaaatttaatttttcagatttgtctggaggccgaaaccgcctttttccactcgaggtacttcgaggagttgttgcagaacacgctcagccccaccgggccgggcgaaaccatcgcaagcgctgccgccaacgccgcgaggagatgccgggcaagcgcaatcattgtgctgaccaccaccggaaagtgggcattcatttttttattgtttgaactatttgcaaaattaatttattgtcctaattccaattacaaaaaagaggcataacttttgaacaattgcattctgcagattctctggtcaggagcaggtcgtttccctctcccttttcgccgcccctccccccgaaaatcttgaattttttttattacaagacttagcttttcctttggttttgaattataaaatttaaaaaagacaaatatttaaacctcaaaattttgaactttttccagtgaaatatggactataaactaattaataatcaaaataaaatatctgaaaataacaatttttcaaccgcaacacacccaacacgcactctcaggtcggcccaggagtgttcccgcttccgcatgccaatccccgtgttggccatcacccgctatgagcaggtggcgcgtcagctgcagttgtgccgtggtctgttcccgctgtactacccgcacatggaacgcgacacggagtggacggaggacgtgaacaagcgcatcgcgtacggcatcggagtgggcaaggagcgcgggttcatccacaacggcgactttgtggtgattgtcaccggatggcaagcgggtcagtgtggttgggaagtgacgcatttactcattcatcccccgtctttgcctccccaaaatttcaaaaaatagagaatttccgccaggcgaaatgcgtgccataccgtgggcagcattttaaaaaaaaatttggcccgatccgacgactaggccccgacatatgatagcttgtattggcctgtttgcgccatgtgcagccaactctgccccgttaatgctagagagtcagaattttcttcggcgcgcgtcccccgccctgaaaggcttgaaaaaaaaattaccgtctttcgccgggcgctttgcgcctgagatatgctaacctgtcattgctaactttgcgtggcgctccggcgccgaagtttggccccgcttcacgaaataagtgccatcccaaggggagcataatggcaaaaat

SEQ ID NO: 16235 - DNA, 3958 bp, Heterodera glycines
agagagtgagtgaattggccacactttcttccttccctctccctatttgttgtccttttttctcagttccgattggtcggttgaggaacttttggtggcgcagggaatgcgctgttctctgatcagatgcgtggacactgatcagcactcaatttgtcttgccaagtttgcctgcacttcgccaacactgtcggccagtgccaatttgacatttgccggcgttgaagggtatttccgggtcttgggatgttccaaggtcacaacacactccatttcgtactcatttttactttatgggagcaattcccgaatttcactctgtcgctgtggcctgacatattgctgctctgcgttttctccctttttcatttcgtttgtttattttatgggtgccacccactccactctcgttctgatcacttccactggctcttcttccattcaaattgttggccaatgggacgacggtcccgcgctcaactgtctgttgaacggcgtggaaacgacggccgaccaaatcgccgcatggctgcgatgctccgttagatccatcaaagggcccatttcgttgccaattgcctctttggtaatttacttttttcgccttttgatcccccccccccaagggaatgggcctttcgggcgcggaggacgaaggcaccaacaaacggctgatggcttatatgaaggcgcaacacggagacttgacacacaattttctgcttaccagcgattcaattgccgcagctgcaacttcgttcgacaaaggtcgtaaagcatatgcaactttcactgctttttcgttgttgttactgcttttattttttgtcatttggtagccattcaaattacaaaattttttattttccggtggcattgttttgatcgctggcacgggctcggcctgccgtctcctcaaggcttggacaaatctctgaaatgtaacctttcatttgttgataaatttaggaaaatggcgaagtgtttggaggttttctgttgttttacgcttttttgatatttttttaagttggcggttgggggcatttaatcggcgacggaggcggcggtttttggatcacaatgcggtgggataaaacatgtctttttgatgatttatgaatacacataacaatcattttcactgttccagtgctattaaacgaattttcgatgttgaagatggacttttgtggagctccgataccgataatgaaaaaacttcggcttttgtcgactcagtcaaaaagactttgttggaacacttcgccgtggactcgaaattgggcttgctggacattctgtacagcccaaagttcaacaaatctcgcattgccgctttttgcaaggaattagctgaaggtgaatagtgcaaattccgctacatttcccttattttaagaataaattcagttgccactggtggcgatgcttttgctgtcgaactgtttagcgatgctggcaaggctttagcgcaacatttggtggccatttcacggcattgtgacgacaaaatgttaagggaattgcccgttttgctggtcgggtccgtcttcaagagttggcattttatgagacttggttttgagcgatgtataaaagagtcaaatgacgccgtgacggatttgaatagacggatcaatcgagtgatgcttttccaattggagtgttcagcttcggttgggtgagttgttgctttttctttgttatggtcaactataaacgcatcttctttctaagagctgcgattctaagtgttaagcaaacaaacgatgggaaaatggacctttgtgaccttaaaggaatacaatcgaagaaactttttgatgaacttcaattatacgagtaaaaagctccgagtggaacagattcacgatataaagttgtatgttcatttttgcattaatttttttttattgtcagctaataaaatgatccataattcctaacaaataagtaaaaaatatgtagatagacaaataggcttttctttgcacacaaaagagtggacccataatgactagggttgtaaattatatggattaacatattttttctgcgcatatgctatgaagaaaggggcttattgtactttttaggtttatttaagcaaatattaaatatgcacaccttttttgggatttttgggggtttacaacatatattttggcattttttatccatattttggtccatatttggcctttttagtccatatttcgggcttttttagtccatatttaatgtccatatttcgcgttttttagtccatataatttacaaccctaataatgacgtcggcgtacaaacagggggaagaaatcaaaatagggggattttcggaccgggtcagtttagtacgggccgttttagtacgagcgcacatttttccactataacttttttatttgttatccaaatccaactttcttgatatcattcgagagcccttcggatgctctattagcctgcaaaatttcaaaaaatttcgttaggttttaaaaaaagttcgggccaaaaaagttggaaaatctggttgtatgaattcttctggccataacttttttgaactttaacgagattttttgaaattttgcaggctaatagaggacacttagggctatcgaatgataccaagattgttgaatttggtttgcaaagaaaaaagttatagccaaaaacttgtgctcgtactaaaactgcccgtactaaaccgaccccgaccggggatttcgcttcaaaaaaattatggcgaaattaatatttttaaatttgaaaaaatcattattttgaattttcattagtatctgcatgaaaaaagctcgcactagtcagggcttccttttttggttgatttattattgtgaccataatgataaaatttcttttatttctttgagccacttcaaaatcatcgtcttattataaacaatcgtaatttaaatttcctaaaatagtatcgggattcctttcagcatatcttcaaaaaatgatcacaaattttggttcctgttcctctgttaaacacaaagttggacctacaacgaagcgtaaaaatgtgcaagtggtcgtcagaacacgtcctctcagtgaaatggaacggaacgatcggtgtaaaaatattgtttcatgtgattccgtctccaaagtcgtttcgttgaaaacaaacacatgcgacaaatacagcactggtcagcgccaatttggagtgttcgataaggtcttgataaactcgaattgaatatttatcattaacttataaaaaggcagcttttaggtatatggccacgaatcaacgcagatccaagtctatggtgatgtggttgctccattgatgaaagaagttttgaatggctacaactgtacagtgtttgcgtgagttatttaaataatgttactttttgagggcactttttaccaaaaaaaaaattctcagatatggccagaccggaagtggcaaaacctatacaatggaaggccgccacgacgaaagtggagctttttcttgggattcggacccgacctctggcattattccgagagcactgcatcaaatattcacagagctcagcaacgaagtctgtctaatggagaaaagagtgtaatatttgcgttgcaattatttcctttttttgcaggacatcgatttcaccgttagtgtctctaatattgagctttttagtgatcagattaaagaaagataaaatgtttattgaatttagctgatcaaagtaaaaagttatagttcataaaatcaacccagtcgaaaacggaactcgcgaaaacgaccccgacccttatttgttatgttataattttaaatagatagataaaaagattaattgtcatgttgaaataagtataaaaccctataaggttgttgtcttttagctaaaattttaatatagtctcgtgtgtgaggttggagtttaatatgcattttccaatttaagaatac

SEQ ID NO: 16236 - DNA, 1105 bp, Heterodera glycines
cagttctttttggaactcggacgacgtcccgagtcgcgtttacgacggtttatctgtcgcacgaggtcgtagaacacttcgtggacattgattttgtgtttggcggatgtctgaatttatatggtagtttaataataattcattttgagaaatgcactgtttccttttcaaaaatacctccagaaaggagctgttgaattgccgtgccaaattcatcccctgctctttggccaccacacgctcatcctccaagtcgtatttgttgcccaccaaaatcatcggcacctaacaaaaagcattttttcataaaaatatagtaatgctattcacaaaaagaaaattccagaaatcggttaaaaagtcttaattccaaaaaaggtatttacatcgtccgtgtcctttacgcgtagaatctgatcacgcagatccatcaagtcgttgaaggtcgactgtgcagtgatggagtagaccaacacgaagccctggccgtttttcatgtaaaggtcgcgcattgccgtgaactgaatctcacttaagaattttgaaaacggccaaaaaacacctgttcggtgccggcggtgtctaaaatttcgagcatacactgctgaccgtcgaactccaactgaattttagtaatattttctcgatcgcttttgtcatccgtctatcctatcaatgacctgtttccggtaactgtcttcaattgttgggtcgtatttctcaacgaaaattcccttaaaataatttttatatttcaaaaatattttccagaatttgcgaagcccacctgtacaaattgcactgtcagcgcagactttcccacgcctccgctgcccaaaacgacaattttgtaatcacgcatgataaaataacaatgtaaggcccaaaaggtttatttcttaaaggaatttgaaatttaaggcaaaaaatgaaatcaagcaaaataagaatgcttttagaaaccaaaaaggaaaatcactgttagcagatttaaatttaaaaaaccctatttcaacaacacggggaatgaaatcaattaaatccatcgcaaaataaacaacaaaaagggaaagagatcgcactggcgaaaataaccgaaaatgaa

SEQ ID NO: 16237 - DNA, 1758 bp, Heterodera glycines
  misc_feature (33)..(33): n is a, c, g, or t
  misc_feature (48)..(48): n is a, c, g, or t
  misc_feature (88)..(88): n is a, c, g, or t
ttgtgatttctttcccttgccactttcgaactncgccaatcgctttcncaagaggtcggcctgttcacgtcctaaacaattcgttccncaaacgaaagtcaccgctcaaagataccgagagcggtaagctccttcgtctttgaatccaattcgtattgtccgtgtctgatcaggaaaatgttccgtgttgcggtcggaacaaacttaacaaatgtttgtataaaaaatacgagtcaaaataaaagaaattactgaccttggcaagaatttcctttttcttttcttcgtccgccgcttcgtatccctttccaataaccatagaaaaagggtctcttctaaaatatacaaatattgaccacattcaatcggctcaaacttgtcccaattatagtcccatcgcgttatttcaccggtgccaagcgattgaacatctttaggctgagaattgtgagttccactttttacgactgcttgctttgcgactttctgctgaacttcgcttgtgtttttttctgtcgatggagaattttggtttgccatcgtcacaccagcgtatgcgccaagggcaccggccaaaggagccgaagaataacaaaagacacggcgatacatttacacgaatgaattaattaattactaaattaagcaaggcgaatattgaaacataacaataaacacagcaggaaaattgaagattaattagttaggagagaattatatagacggttttccttcccttaaacttaatctcaattcattaattaggtatacatacataatgccactggaaatcatttctacaatatttcaaaaattgtatattcaattaacgccttttgtggcttttgcctaattaatgcgtcttaatttctgtccagatacatacacaatggccagtgatgataattcggacatgttcactttcatgccactcggttctggccaagaagtgggccgttcctgtcattttatgcaattcaaaagcaaaaagattatggttggattttcatttctcggatttttttctgattcgacatttgcttttttcagttcgattgtggaattcatccggtaattattgcgatagcatcaattagtttgttacccatccgcagggaatgcaaggcgttgacgcgttgccttttgtggatttcattgatgtggaggaattggacctgctgctgatcacccatttccatcttgaccattgcggagcactgccgtggcttctggagaaaacggcattccgcgtcagtgacacgaaacgaacgcattaattcctatggatttattaaaaatttttttacctatttttgaatttaaaaaacatttttgacattgtcagggtcgctgttttatgacgcatgctacgaaggccatctaccggacgttgattggcgattgcatcaaagtaaaaatggaaaacaaatttataaagggtttgaagggtgatgcttcaggatagaaagaaataagcagggttttaaaacagactgaaactgccccttttaaccggtaaataatgtaacatcaaatggcttgagatagcaaaatacggcagtggcggggccaatgaatcgcggatgctttacacggaggaggaccttgagaggagcatggacaaaattgaggtggacaaagcctttcaatttttatgttaccctttacttataaaggtactcgattttcatgaacaaaaggaagtgaatggcatcaaattttggtgttacgttgcccgccatgtgctcggtgcctgca

SEQ ID NO: 16238 - DNA, 668 bp, Heterodera glycines
  misc_feature (637)..(637): n is a, c, g, or t
aattttgaaagtaccggggctgggacttggagaatagaccgggacgggatcccgggactcccgtttgtccgggacccccggtcccgacgttttgtcccaaaaaagggaaccgggatcccggcaaaatcgcggccccatccgggatatattacagtttcaatctttgaatatttaattgtggaaataaaaatatttaaacagttattttatggaatttccgtcggggatgggtttggtccgtttccatttggcattttctctctttttttgcttcctctgtcatttcatcatattttatcttcgtgtgctaatttcaaattgaaatgcctttttcctatttttatgctttgtttgccaatttctttccctctgtccgtctgtcgctgcagtccctcacttttctttgtccgcttcgccccttcagttcctccactatttcatgcacttctctgtcattcgtttccggcaaataaacccaaaggaatgccaaacaaagcaattgaggtgctaaaagtggaaattggcatcaaattccaattccatttcatagggggaatttacaaaaatatgaccagtgaacagcgggaaaaggcgaaaactccgatggccgaataagcgggcaaagtcaaaatggtanaagcgaactaaaaaagggatataattataat

SEQ ID NO: 16239 - DNA, 2723 bp, Heterodera glycines
gtagcgaaaattgggcattgacagtgctgagacggtcaaaaagtgcgtagaaaacgatgcaaaaagaattgcccaaaccggcgtacaaaagcatcttccgacgggaaactctgcaaatgggagaattaaatcaaaaaataattctttaaaatgggtaatttgtattccaatttgacctcgacgacattagcattcccggcacattggccaccaaaccgagcacagagcaaattgaagaaaacagctgaacaattaattcaatccaatttgaaatttatttaagtgagttattatttttgtttattttgttcgcctgcgcttcattgagtgggaaatgatcagcaaaaagtgttgtgaggacgggccaaatgccaatggtcaattggagggaacaaatgccgagcaaagtggccaaccgaaaagaaaatgaggcaattaagcccaaaaaagaagaacggctttcaatgcctcaaatgccgctgtgtgaacagttctctcaacatttgaagcattggtcgctctttttcttcgttctgctgcttttccttcacaatctccgccagtgtcattttctgatcgacggaatcgcctgaaggaaattccaatggttttaatgagtggcaaaggcatttttaattaaaatgcgctaattagagaattttaatgatcagtgccaaagccattttttagttaaaatttcattaattgcactttcaatttccaatttttgttttgcttgccctggtaaaattgcaatgctttcagcgccctttctgtgttttcgcggtttaacagcagaaattttggcgtttcttccaacgcaatgctggtcaaaatgccgaaaaagcttggcaccatgccaaatccttaaattgggaaaattctattattttcctttcgttaattttaccgattaaaatttccaaattttgtcccaaaagcacatccatgccgagaagcatgccaatgtttgccaccacattataacagacgccactgacaaaaatgaccaatccgcggagttttgacgatgggaattcctttggagggaaaagaaaaaatgacacaaaaaataaataaatttagaaattatttttaaattattactgtaacaaaaagtgcaaatgcgcaaaagttcaaagatgaaagaatggcaccgaaaatgcgggaaatgagaaaaagttcgggcagcaaaaagacaatggccaaagtggagaaaaagctggcaccgaaaatgccacagttggagagcaacaaaatcactaaaggcacacaattaattcaattaatttttataaattcatttttttaaaatatatttttaaatattaattaatgaattaattattatttaaaatttcttaatttattttgcaattgtttttgttcatttcattttgagctcacttttcctgccaaattgttcgcaaagccatgaagtaaaaacggttccgagaatatttccgatataaagcgaattcaaattgaaactccaaagccacaataatttcccctgaaaattgaaatataaaaaatgtataaattatttgtaaattgaatataaaaaatgtataaagtcaatttgttttacttcggaaagttcaacgccacgcgcagcgtacgaaacgttcagaaaattttgcaaacttttggcagccgaaatggaatagtaagaagaataggcttgctgaaattaattttttaattttatttaaatttaatttttaatttacataaaaattgttgagtatcccaattataaaagcaaatagcaaagtctgcagagatcttccggccggagcaaaaaatggcattttataacaataataagaaaaatatgtctaaaacattgaattaaatttaaaaaattcaatgggtaattattggctccgaattattaaaataataatcgagtgatcagtattattagtccactgattaaaggtcctttgggcggtctccttcagcatatggcggagtgatcagcccattccattcccccgggctgtcccattgcactaacaaattaagtttttgaattcaataattactctaattatttgtgtttatttgttatttcttattaaatttttgagcattcctaagttggatttttaaaattcattaaactttttggggttaataaatgaaattggctaagattattttgtccgctttggatttgaatttgattctgttattttattttgtccaacagttccatcaaaagagaaaaataaaaataacatattaatttttaatgtgtgaactattttatttatttttttacatttgtttcggcagtgatttttattttttatatttctaaagttggccaaaagacccaatgtcagcaaataaaaaagagttgggcaacaattgacaatggccgggggcggggacttgcacaatgtctggggcaggggctgaagccgtatttgcattagttcgcttcctttgtcagtcggcgaatgaatggcgcgcgtttcccgcattattagcggggagggaaaagccatcggcgatcggtcggtcgtcacgctttacccccccccccccctcagttttcatatcatttgctcctatcattttgctactgctccatttatcattccttttttttgatcgatcactgcccaaatttttgctttcttatcaatccaattttatttggttgaattttttatggatttaaaatatttttaaacaactgaattgaataa

SEQ ID NO: 16240 - DNA, 2280 bp, Heterodera glycines
tcagatgtccaaggagttgtgctatcgctgtggtaaacccgtctatccgacggataaagtgggcccattgaaggacggggccttcttccaccagggatgcttcaagtggtagggagcaaagtgagccaattagcaacatcaaaacgttcagttatttgtgtggcacgcgtctcgccttgaaaacgtactgcaacaacagaaagtggggatagattaaaagattaattaatcttctgatcaataataggcaattaattaacaacacatgtccaattaacttgcaaattgggctttccgcagggcaaacgacgaccgcgaagtgtactgtcgcaaccacgtgccaaacgccacaccgcacgatcccacgctgccgttgccgccttccccgtcaaacggagtcgaacccaacgcgtgtcaccaacaacagcagatgcggcgccatcggcacaacgcggacgcaggactccatgacatgaaaattgcggtaaattttgaaaattggaagacgaatcaatgttttaatctaattaattaattatatttttaattaaatttaatataaactgaatttaaatatatgccatttaaatcatatgaaaatttgaatggttaagcacgcaatgaaagtgacgcaagcagttaaaccgtatccgaagatcaaacacggaggagccaaatacattgtggactacgacacacagacgcggctggaactgctgcatcggcaggacgaggacaaactgtaccaagaatttgatgaacaccgccaaaaggtggtggaatacggaaaacagagggggagaaaaaagaggacaaattggaaatttggaaaattttaaggaaatccaacagtttgaagaggagacgcgcgaagagtgggaaaaggctttggccgaattcgcacgtcgctacgaacaaaggcacgccacggcccgggagaaggaacagctgctgcacgacttgacactgcgcaaagagcggaaactcgaagtcaaacggaagaaccacagactttgatttgttttttaatatttttgatttaaagacaatcacttcgaaacggaaagagcgcgagagaatgcgaacggcggaattggtggaccaacaagccaaagagatggtgagagggactttggcatgccatcccaccctcaaatcggccgaatggcccacccatcgacgggggatactgtagccaacgaaaagaaaaatgccaaaactaaacaaattaatggagaagtcgtcttaaaatgctttccttttcaaatggaactgttccgacaagcgcgatcacagcaccaaaatcaacagcagcaaaaagagcaaagggaatgcgacgtggaggagacgaccagcagctgttctggtgcgtaagccatcgaattgcccttcgaatgtccaattcaggcggaatgccctcctacccgtccacccctccaccgccaatgccgccctcgtgcagcaaaaggtgggcacttcgaagcattcccactaaatgccgacttttgcacataggcacatttacacggacacggtcgtatttcaactaatcgaccaagtggcggtcagtgtggccaaccaggacgtgcacagtttcactgagctgatcagaactctgatcgccggtgcccgttgcgacgttgacaaagcacgcgcaatttaccgatggatcaccgtcaagaatttgaatgtgatgaactttgacaacgatttggacaacgagtgagttgatttcgtctgtctgacccaatcaaaattttagtgcttgaattttaaatttaatcgttacagtaccccaatgggactattgagaggcatcaaatacggtaccgaaagttaccacgtgttgttcaaacggctgtgcagttacgccggcctccactgtgtggtgattaaggggttcagcaaatccgccggatatcagcccggacttggcttcgacgacagccgcttcagaaacacatggaacgcggtgagctaattgggacaattaagaacagagttggccatccgccagcaatttgctgatcatttaaggtttttttggacggttcttggcgatttgtgcaatgcaattggggcgcaagacatttggtgaacgccaaagaaaatgccagaggcaaaagatcaatgacggtacaaaacggacacgaaaaagacggcaacggagcagtgggcagtaatttgcgatatgaatacgacgaccattacttcatgaccgacccggaagagatgatctacgaattcttcccggatgagtcccaatggcactgtaagcaa

SEQ ID NO: 16241 - DNA, 1888 bp, Heterodera glycines
cagtgacccgcggttgtcagcggttgtccgcgcggacaaaacgggcgcagtgtcaattgccatcgctttgggtgccgaggcaatggactcgctgatttttcattacaatttgcgttcctttgacaccgaagacgccgaattggacggaggactcagtctgaagaggtgggcaagatgagaagcccttgtggtcatcgtcgtaatttacccaagtgccatgttgaggttcgtgatgcaatcgtcgctggacgactccgtcattttccgcgtccacgtgcccaccacgcggcctcttctgctggacatttttgccaattgcgtgtcgtcggagcattatctgaccggacagccgattaagttcaaaagtgtttgcaagttcaaggtgctgctggtgttgggcaatgcccgtccgttctgtcggctgtacgcgttgcgctgttcagattgagtgcgactctcttcggcatattatggtgcctttgcccgagtgcgccagcggcgagtggggcccctcaaaggctttccgactgtttgggctcgtcccgcgcacgcacgaagagccgatcatcaactgtgaccaatattgcgaaatccgtttcaagttttcggcattttttgcgcaaaaaaacggcgattttcagagtgacaaagccactgactgaaatggtggcaaatcttcatcggaatgggatggaaagtcggcacttgcaaaagtgcgtgcactgttcgctggacgatgaagaagtggtgatcgaattggcatttccggacgaaggccaatacggactggacatttacacgaggtgaactcaatcgaactcaaacggataatcaccacccaatcgccacagggacgcacaccaaaggaatggaacaaacggtcgacaaatgttgacacattgctgtaaatatctgatcaacgcacgcgtcgactaacctcagaaaggacagagagagaggaaagagagacaaagaggcagagagagcgagaggcaacggatggagatagagacaacggatgcagagatagagagtgaatctggataagttcgaatgtataatttacaaacacacaaatgcttttttattctctttgacctcgccaaaatacagtacatagtcaacaacggacagacccaacttatgaaaaacgaaaataattcaaaaaatcgatgtttacgtgaaagtgctaactcaattcgtcaattcttaagaatccaaatcgttgttttaaatagtttatttccaaattacgtattatgtaatgtcatgttatggcaatgccatcggttcggcacttttaaacaaatccggcattgtcccgccttgggtcctccggcgaacattcagcagattccgtgggtcatcagatggataccattccatattgctatccttcatattagcatctttggcctttgttacgcccgatgtgtcctcgggtgccaccaattcatggtccatccttaaataaaatccaaatgaatggtttaaaagatggccatggtcttcaagggtttgtctctgtccgatgtcccaccattcgtccccctgaatgtccgctgcgtccaagtcgattttcccctgctcctctgaagttgccaaaatgatctgttcacggctcttctgatcgctcatgtccacttttttgtcgaataaaatgtctttaacggttgtcctttccaacgtcgtttggaagcgccccaaaagtgcaattgtctgaatgttcgtccttttaaattgctttttacttgtacattattaaatgacctgttcttcgcgctttgggtccaccgttttgactattccttttgtgtccgatttgaatttcagtttcaatttattgtacattttcattccctcggtcgatgagctttctgttggatta

SEQ ID NO: 16242 - DNA, 3113 bp, Heterodera glycines
ttgcttgttggacgtcatttcggaccctgaccgtcgtatggattgctagtttagcgtcttttcggacaatggttgtttggtggccggtgctttgctagtttaacgtcattgcggacaattgatgctttgctagtttaacgtcattgcggactttgggtggtttgtttctctagtttaacgtcattgaggacatgtgttgtttgcttttctagtttaatgtctttgcggacatttgttgtttggttggttctttagtttaatgtcattgcggacaattgttgtgtgggttggccgatgctttgctagtttaacgtcattccggactcgtggcagccgggtgattagcgtttcggacagttgttgatggcttaggctagtttaacgtcattgcggacgattgttggtgattaacttagtttaacgtcttctcggacgagtgctgttggcatggtgtcttactgattgttgccgagctcatgtttaggcaattctgttgactgcccttatcaattactgttgttgagtccgagcttctggccaatgtagcgacgcaatgatggttggcgcctgatccacttgcggttggcgacaaggctttcatttttctgttgagttcatttgtttggcttgtttgtgcgggattcgctgcttttccttttgtttgtttgctggaagaaaatgctggtcgcttggcaactgatgaactcttccttgttggcgttagccgttgcactgccataggaattggtgccgttgaatgctcatttggtgatttggcttgtctatccctgactggattttgtatgatctcaatgccggatgcgtcgctgtctgatgaaagatcaatcacgattgattttgagctgatgggagccgattctctcttccgtcttgatcgcaatgttgcaatgttggacaagagtttgttgcgttgatgccgtctcagttcgtccttttctttttgttgaatgtttttctgctgagccgctttactgctttgtggcgattcatcgttgttgaccattaggacgaaagagatgttggacggttgcttgagctcgattcgccctgttccactgatgatattgccgattttcgattggcaaatcgtaaatccgcttggcagttgttcaattggttgaacattcagctggtgccaaacgtccattccgatgagaatgtccggttgccgtgactcattcggcagggaaagcttcttttgttgaagttcgtcattatccaatgcgtttagttgtagtaccggcaaatcattcagcaggaacttcaaagcgttcaggttgaaaatgaacctgtcctggtcggggcataaaatgccgattgcgacgcggtcgcttatgtatcgcttcggttctcgttcaccgaagctggacaagtagcattcttccgtgctgaggacgttcagatccaattgttcagctgcactgctcgagatgaatgatcggtggcttcccgggtcaatgaagatggttcccatcatgctgagggatggccgtgacggattgaagatcgttgcctttgtcgtcattagcaacgctctggtttccttcctttggatggcattacacatttgttgttgttcgatcactgttgatcgcttgccatcgttggcatttggcttctcttcactgcaagaggtgctaggcgtgttgatgccattcttggctttgtactgatctcggcagagtgccgtgggatgccgacgtttgcagtgatagcacttagatggtcgagcgcaatttgatgcgcggtggtttggcttcatgcacttgaagcacagcttcttttctctgacgatgctgatccgttggttgagtgtgtcgacgttttggcattcgtcatgccaatgattgctgttgcagaaaatacaggggtatggcggaccctttttgaggctttgtacttggtttcgcatttgttggcagtgtttctttgcttgttgtgtgtgctgttggcttacatacccttgatgtttgtgaccctcgtccagtgatgaggcgataaatgtcatatcacgcagtgccattggttggttaggccttcgtgacctttggtttggtgttctcagtgcttgtacaggtgctgctgagacgacttctgcttttggttggacgtagtgatggccatattctcccatcacttcttggatttggacttctttccggactgcttcggttagcacatctcggaatttggttgtcgtccagtttgccggatcctctcctttctttgtgaggatgcttcgtaggaatggtggagtcagcttcttctccagcatgaggaacacctgcggtccctcgatgtcctctccggcattgttcagctcccttgtaagccgctcaagttgaagcagaaagtctttggtctcacggaggcttcggcacggcttgagattggccagttcgaagtgaagacttctgatgtgttcctccggagctccgtacgtgtcctttaacagctgaaggaccgtctcgtagtttgcgtcttccagccggaagcccgctatgagttctcgcgcttctccacccagcagattgcggagtaagttcagcttctgcgctttactgattgattgactgccgattgccgatttgaaggattcgtagaattcgggccattttcgcttttggccgaaaaatttatccagttgaattggttggaattggtagagcggtgctgtgaatgttggcattgtcattggtgctgccattgctggtggcatgggcggttgttgctgcggattggccaattgatccgcctttgcttccctgtcggctctgcctctgtgcagtttggctgcggcactgagtgttgcttcgagatctcgcaaatcccgaagtttggttgatgctgcgtcgtatcgttcggcgattttctcatttttgtcgaatttgatgtattctttttcgccgttgtctttgttgtctccggtcaggcgggcgagaagttcaatccaagcgttggataagtctcgtagactgtccatctgcatttctgttgtacggatttccttgacgacgcgatcaaattgagcctccaagttgatggcatttaccgcagtttgacaggtccggatcggggtgtagaaggagtga

SEQ ID NO: 16243 - DNA, 830 bp, Heterodera glycines
aatattagagtgaagcgggaccgggccgggaattcccggtcatccgaggtcccggttcccggtcccggattttgaaaaactcaggtcccggtcccggtagggcaaccgggaaaacaagcactggtaataatgggggtctgggtgaaaaattagtgatgaaaattggagtcaaaggaaaaaaattaaaaaataataattaatattctttcaaagaaacaataccagttgtgcaaatggcctagtggctagtcgccttgtctttccctttttctttcccctggttcaattcctctacagcacacatatatttttttttttttttttaattgatacatattttatcatttttttaagaaaaatccgtacaaattgagcatagtaatcccaaaaagctgccttttttgttgaaaatctgtaacaaattacactcaaattttcaaaatttcccccggcggcgcctatcggcaccaccggacccccttctttcctcattaaaagttttttggaaaagcgcgccgaaaaaaagatgtgaaacgtatatcttaatttctataatattcgatcatttggtccaaaaatgattaattgtttgaaatgactgatgaaaatttaatttgaaaattttcattaatttaatttagctttaacttttggagtttattcaataaaaacaaagtaaaaataaaaaacaaagaagaaattcgatagaaataaaatgttctaataaaataaagcatgcaaatttaatagaagaaatttctaatttaattttgtattattttcaattgaataaattaaaatatatttttttttatttttaaaaatttttt

SEQ ID NO: 16244 - DNA, 1383 bp, Heterodera glycines
attttgtattattttcaattgaataaattaaaatatatttttttttatttttaaaaatttttttgattttttaaaatttcccggttggtcccggttccggtcccggcttctcagttcccggcaagtcccggtcccggttttgcccaaaaattcccggtcccgcttcactctacctaaaatgcataattggttattgagattactaaattttaaaatagttaatcaacaaatcagcgtcattgtttcataaggaaattaaaaaaattttacagggaagtgttaattcgagctttagtccaacccaactttaataaaaagccgaaaattaattaaaaatgatgaaaaaactacaaatttgggaaaaaattgttacaacaaaattccgatccttcccatcactcgagccatttgctgcctttctctgatcagtcactggtggcacattgcctcagcgtacgctaacgcacaaaatgcttggccatccgagcagcttcaatttatcaaattaaaataataaagcgaaacttctaatatgttatttatttatttttttatcaaaaataccgtaaccctttgtggggtacaaaaataaaggccttggacaattttaaaaaagaacaccaaagggccattggacaaacagtgtcgaattctatttgaaattgaatttttgactttttgttctaatatgtcgcgggcatttgatgagataccataagacattcatgtcattttattcgactgacctgggagggcactaggcgccacaattccaagtgcaatctgtccgccttttgtattggcaagtctcaccgctgttcgaacagcgggatgaacagcaacggcatcagtttggcatggcatttggccgatcattaaaattgacaagcatagcacgggtgcgatgaaaaaaaatgccaatttgaatgccatttgaatagaaaaagagagttggaaatgcttctgaaaaggaggggtttaaatgagcgcttaataagaatttaatttattcaattattaaaagtttaggcctcaaaatttggcccagaagctcattcagcagctgtatataaagattttcataatggaatttgggataaaataatcactcaaaaaattacgtttggaaaatcaaaaagcacttgaagatccacacaatctttgtgaatgaggcattttcaattgacatcaattgactttcattctgattgcttttcataagaaatgattttcatgtcataagctaaaaattgattgaataagagcaaatgatgccataataaagccgtgaggtcccactacccagtgaaaaaatttgaaaagaattagcttttatatttaaataaaattaagatgtgttaaagttgcacagaactgattaaa

SEQ ID NO: 16245 - DNA, 1647 bp, Heterodera glycines
acatgaattttttcactcggaaaattctgaaccaatttgttactttttacaaaatgtgttgaagacgtttgatgagcccattttggcattacaagttaacaattatttttttaattaaggtcacaatgtttttacagaaatcaaatttgatgctgccagatttaatcagtattatggaacaatttcgtgccaaaattaaaggtcgtttgcacggcactggaaattcgggaaggccattttttggaggacattttgcgttgcgccgtgcatcaacggaacttgaaaaagatttttgcgtaaaattttttggtatttttgttttattaatgcatttttttaaagaatttttacaaaattgtgctcaaatacattgatcgctggttccaactccaattactaccaaaaaatatttcatggacaaatttacaaaatcatcctttgaattatgcagaagttatgcaacttgctgagcaaatttgtcccgaaatagcgcaattggatgaactgtttgatgaagtgtctgcggtgaaccaaacattggccgacattcccgaagaattttggctcaaatcagccgaagataaatggaaaggaatttttgtggcggatggtgctatagagggctacaaaaatttataccgagtcgtcagtgcagctttttcggtcattaaaaataaaaaaaagaaatgaatttttattttaaagattccgacatccaatgcattcgtggaacgagttttttcactggcaagcagtcaatggaccaaagaaagaaattcattggaagttgaatcggtgaaagcgctcttactggtgaaggtgaactttgatctctcgtgcgcggaaatgaggaaaatgatcagcggaaacaaaaaaatattggaaaaaatccattccggtgaaaaatacaaaccacttgaataaattttaaccatttttcattgcatataataaaaattttaaatgtccttggatttcatgaattttccccactatgtccttgaaaatcggcatacccgtccttggaaacggaggatggacgatgggagccctgcactaaactgaagattatgtatttcaaaaaacaaacaatgagaacctcatcaatgctcaaaaacattcaacgcagaagatgctcaacaaattgttctccgccttcaattcatttttgtctcaaattttgctcaatgctttgaaaatgccgcggcacaaaaaaagcggtggcacgttttcaaaaaactaaaaagcgtttacaataagatttcaaatgaatccatattcactcacccatcatttgggttgtgcccccttttctcaacaaattttgaaaacgccgcggcacaaattgcgacagcattcgaatcgcccaacactctgtgccgtggcgatattcagagtggcaatcaccgaccgccgacggttacttcgcatgcaccaaaggcactggcgtgatggcgacggaacacagcgaaaaacgatttttgaaagtttatttttggcaatttcttccaccgattggacgatttgtgcaatttttgtcatttttgaaggacgtgttgaaaacgtaaatcgaaaatccaaatttttaaaattttctcataattatgatatcagcgcaagaaattaatatcagtttggcggcataaa

SEQ ID NO: 16246 - DNA, 1147 bp, Heterodera glycines
  misc_feature (1058)..(1058): n is a, c, g, or t
  misc_feature (1102)..(1103): n is a, c, g, or t
ttttgtgacaaacaaagccaatgcaaccgagccaatgattagctatgaagaattttttctaacccgataattggtgtgtgggggactaagcagatcctgaagaagctccaccaatgaaaacaacgaaatgaagctgaccttttcgtggaatcagacgtaaaagaaactataaatctctagaaatgacctaaaatggtctacaaaaaagccaatatgaaaattgtaaatatgtcttcaaaacctatcattttttgattttacatatttaataatgttctcctaaattttcaggttatttttctgcagcatttttttctcatattaccaagttccataattaatcttatagggagttcatgtaagggccaatataaacattgaaaggcctttttgtgacaaacaaagccaatgcaacagagccaatgattagctatgaagaattatttctaacccgataattggtgtggtggggactaagcagatcctgaagaagctccaccaatgaaaacaacgaaatgaagctgaccttttcgtggaatcagacgtaaaaggaactataaatctctagaaatgacctaaaatggtctacaaaaaagccaatatgaaaattgtaaatatgtcttcaaaacctatcattttttgattttacatatttaataatgttctcctaaattttcaggttatttttctgcagcatttttttctcatattaccaagttccataattaatcttatagggagttcatgtaagggccaatataaacattgaaaggcctttttgtgacaaacaaagccaatgcaacagagccaatgattagctatgaagaattatttctaacccgataattggtgtggtggggactaagcagatcctgaagaagctccaccaatgaaaacaacgaaatgaagctgaccttttcgtggaatcagacgtaaaaggaactataaatctctagaaatgacctaaaatggtctacaaaaaagccaatatgaaaattgtaaatatgtcttcaaaacctatcatttttgattttacatatttaataatgttctcctanattttcagggtatttttctgcagcatttttttctcatattaccnnagtccccatatctatagggagttcatgtaaggggccatataaac

SEQ ID NO: 16247 - DNA, 944 bp, Heterodera glycines
  misc_feature (905)..(905): n is a, c, g, or t
aaaaaaatattttctcattaatgaaattgagaaatatttcaattaaatttattctttattttatcattaatgttaaattgacagaattatttcaatttatttaattattcttaaaataatttaataatttaaaaaaatatattttaactattaaaaaaaactttttattaaatttctttactttcaataataaaattgctgacaaaattcaaaaaaataagactttaaaatacaattaattttattaacataatttctaataaaaatatctacaaaaaaaataaataaagttacgaaacagtttcttttattatggcaattttttatttttaataatcagaataaaataaaaaataaaaataactaaaatttcgatgtttcccacctgaaccaccggtttatttgctgggcccattgcgcgctcaaagccgcttgcttgtgccgccatgcgttgttccccggcggcaacaattcgttgtacagacacgtactcaatttgcgggcctgatttggtcgggaaacagctgaaaaatttgttaaaattttgcgtattcgaagtaattttataaaaattaatgcgtatccgatgaaattttttgtttgcaaaatttagcgaaatcggctaacaataattgaattaaaaaatgcttaaattttcttttcggggaattttaaatgtttaattaaaaaaaaagtttatttagaatttcaataaaatcttttttttaattattatttttttgaaattttaaattggcactttaaaacctatttaaaattatcagcaatttagatctttaacattttagatatttaattaaaaaattttaaagaatttttttttttttggtgaattttacgtttttgcggtagtggtaatgcacgagatgaaactggtgaccagnccccaacggctctcaaagcattgctttaacacctctggc

SEQ ID NO: 16248 - DNA, 2181 bp, Heterodera glycines
  misc_feature (19)..(19): n is a, c, g, or t
  misc_feature (28)..(28): n is a, c, g, or t
aggtccacctctgggcttnaggggcaantctgtgggaaaaataatgacatatccagtaattggaccatttaaattaatgatgtccgataagtgtaatgtgtaactattgcaattgaccgaaaaaattgggcaatgcttgggccggaaaatgatcagagcaagaaaaaaaaactggtcgatcaacaacagaccgatctgttttttaggacaattgggacttatatacggcgggaatgaaattccatgattagctgagctgtgagtagttgtttttaagaatgcggttttttaaattccagcatgtacttgaaagcttatctgaaagagtcattggaattttaactatgattcacagtgttttttaaaataaaaattcaaatttggctttttttagaggggcgaagctctgctgaaaccccaatctccagtgttcataattatcaggattatcctaacggttaatgtcacagaaatataaattttttaatcttcttaaccctttattagtatgcaaaaaaggataaatgctttaatacacaacaaagaaaaatttttgttagataaaaatccctcaaaaaagaacaaactttttttgatgtacctaattttaaaataaaatatttattattttaattttcaattttttattgcccacttttcccgagtttttctgttcccagcatgtctcgaaacaggcttgaaaatccgtcaaaatgtccttcagacatggctcctgttcatcgcaagaacattgccgcacaaatttgcccgtttttgccgagatgatcatttcctccatcgtcttttcaaaagtcaattccttaattattttttatttaattattaaaatagaaaaagtgaaattctgtgtaaatttattaataataaccaattaataatcaaataaaaaacaataataattaaaaattgaaaaaattattaattaaattaaaaattcgaatcaattattgaccaaaggtaattaattaattatccaattaatttagcttttttaggcggccataagtggagagagtcaatgacgtaaacttttttttttggaaagttaaggagacattgtataaaatgtaaaatcttaaccaatttctgcaattttttcatataatcgcagtcatgtattattttttagttaattttataaaattatttttaaaaattatttatttcgatttttaatttaaactcaacctgctttttttgtggttgtgttgcattgttttcagctccaaatgacgtctcaaaaattgctactgtagttacaataaataataaaacatttttgtagcacatttaaaaaaaaatattttctaaataatttttttcttattcatttatttttctgtgtataaattatttttttcatatttaaaaatttaacgaggtcatgccaaccggacaatttttttattttcatgaatttatttctcaaaaaatattgtattttaggctttttttgaatatttttggcttaaaaaatgacttttaaataatgagtatgactcatgtcagggttttcgcaaaattatctttttgctcatttgacaaaacttttgctggttatatcaagaaatttttaatttaagcgcctaattagggtcaatgacgacgaaacagaaaaaatggcaaaaataattactggagctcgcattttgaggcatatgccttatttttctgcgcattagtttcgatatattaagcataaaaaacacattttccacttggttttaggcttctacgttgacttttattatgcctttttttgcctttttcgggattttcgtgccttaaatgccttttttggcattttgccgttttggtgcctttttggcgctttttaccgaaaaatccattaaaatgcaataaaattgggaaaatacacacctaagaaatgaccagaaaaaaatttcagaaaatacacccctaagaatttaaaaattttctcaaaaaataatttaattttttttcttgataaaaaattctcggtttaaaaattttccttattcgaaaaacattataaaatatttaataataatcatttaaatgaccaaaattaagtttttggttaagttttacgtgttttgctccctaaaaatccttaataaaaaatttttaaatgccttttttcatgcctttttcgggattttcggtccttttcatgcc

SEQ ID NO: 16249 - DNA, 2316 bp, Heterodera glycines
gtggactatgacggacaaacgctgtgctgacgggtgacttttgcgtgcgaatggtgcaattagtggacgcgaccgttgctcccccctcccctttttctctccccaattcactaccaaccgctctctaacaaatttgttatggcaatttgcatactttcgaggatactctctccctgtgcttttaatagccgaaaccgcgcggcctttccattttctatgttttcatcgccattcttcgctgttttgttttattatgtatgtgttttgcttcacttatccgggccatcaaatcgtatgcgatacattcattcatttcattttgctatgttctcttaaaaaagcacaacggacagataataattgttaaaacagcgtcaattccgtcgtcgtcactttttattattatttttttgcaattaaaaaatgtccgttgtgccgattgttcaatttttattcttcttcgacggtgtttagttttatatatttctttctgttgttcgtccgaccgacatttttggcatattgtttagtgtttgcaaatacattcattcttttttaattgtgctttttatttggacacttttcgcctaaggcatttccattttttgtcgtgttttttttactgtgctttctctcccttctcccagagtttctccattagttgggccaccttcgtcccttctctcattcgattagttactgtccttaccgacatcatttactgtatcatctacgattagtgactgattgtttttattttataatttctctctctttctgcatatttctctgcctcgtagtctctctctctctctgattgtcatctctgttagaggatatttacctttcgatttgttgtcagaatatctctctttctctctctctgctcattggtctttggtcgtcaccatcgcttaacgttgcaactcggttctttaccggaaacactgtctttgtttggtaaaatacggttacaaggttttaatattgtaaaggatctgataaaagtgattttctttgagagttggttctaattatcggtcgtcgacggaaatgcacttcgatgatccgttagtgggccgactggtccatggattcaattgggagttggcttggccttgtccggtcggatccatgttcttccgtccggtctctgctggccggtcaaaaacccgttttttagcttgttaggccgcttcgcggcctcagtcgggcgcttcgcgccggtttttcaatttttgttggccttggacgggcgcttcgcgcccgttttttaaattcgttgaactcatacggcgcttcgcgcccgttttttagcttgttaggccgctttggtcccgaatcccaaaatcggttttaattgcggatttttgtagtatttttaaatcctccatttattaattgaaaataacgttgaaaattaacaattgaatatttaataaatttaagatgaaatttacaaattcaaaaaataaataattaaattctttaatgtaaaaatttttttaaataatctacaacaaatcttcagattagttaatacattgaaaataacgtaaaaaatcatagaaaaataatttacaccggccggattcgaacctaccgcccccccccacagaagatgactcagaatccccaatcacacagggattcagagggcttaacgatgtcaaaagtaaaatctgatcacgtattcgtgatcagcgtcataaaatagccctaatgacatgtttttggaagatttttggtgaaaaaaatttttcaatcaaaaatcctgtcacccccctttggtcccgaaccccaaaatcacttttatttttatatcttttttttaaaatgtgataaaaatgtaaaataaaatttatattatagagaaaaaaattgcggatttttgtagtattttacttttccccaatagcttttcagaaggcagctacgaatttttttctgaaaaatcgaaaatttccagaaattctggaataacttttttcttttttgtgataaaaaactcaaataaatcccataaaattctccttattttgctctatttttaaggctttattcctggaaaattgatcaacccttcgatttggtatgaatttccaaatattaggtcaaaatcccgagggccaaaaaattgccaaaaaataaagaatttttaaaaaattccaaaaattctgaaacggaaaacaaagggcatattcgtgctcagcaccttaatttaccccagaaaaatattttttacccccatttttcaacccaaaaaaaattttcgaaaatttctagggggcctagctcgaaaatttttgaaaattt

SEQ ID NO: 16250 - DNA, 2364 bp, Heterodera glycines
  misc_feature (14)..(14): n is a, c, g, or t
atttttcaataatnagggctgccaattttatgtaacccttattattcgaaattttaatgatatgaaaaaatggtaatgcaattaaaaatacgaatattttgaaattaatttgataattaattttgttctcagtttcacggcgattttcacaacatcagcgcctttgttttgaacagaactcagggcattttctgtgccgcgcaattgcgctctttggacgtgcctttggtggcggaaattcccgagcaaagaatgctccaattccgcgaccatatcacaatcaatgggaccataaccaaaaatcgtcctcaaattatcattctgttgctcaacgaggcattggaatcgtacaactccggtacggtagtaaaattcgtagagaacggggggggtggtgtactgatgatacgaatagcggcactttcacgaaagaaagtgtctgccgatggcactttcattcgccgttctttttgctttcccccccccccccccctcgagagcggtatttatttgtaactttttaaaatagctatttttctataattttagtagtttactatttatgtgccatctcattttagtggcgcccagcgttatttaccatttgctgaatggcacttcaaatatgggtgagagatacatttttaatttgcttttaactttactcgaccatcaattttagtgggcaccatcgtcgtccgtgccattttcaccaccgatttggacggcaacgtcgctattcatttttcttatgtaaatttgaagggtgccggatcgttacttcaaaaaacatcaaaataagaatttttgaccaaaaattattcaaaactttgcccaaaatgaatcatcaaatataaaaaatttggttgcttttgtgcaaatttagatgaaaaattattttattttgatggtttttgagtaaccttatagcaccatttgaagaacaattcatttcaaccttataaattagtcaattaacaaatttttaaagaatgaagaagtcgaagagcatcatttgaaatcggcgctgaccgaaggacaaaatttccatctgaaaatcataatgcgaagacggcccatgttccatttggagggcttcggcaaattcatgttcggcatcgaaacaatgccaatgtgggcaatccaatacattcgggtggatgaaaatttgaaattttcgaaaaaaattgaaaataatttaagatcgaaggcgatttgaaactgcacgaacagccacgcattgaattcttcgaaaagaaaggacatcacaaatgaacagagagagaatggaatgattgggcatagacggcacttttatatatgcgcaccatttttgattaaactttttcattcgattttttgaaattttcaaggaaatttttagaaataattggcaaaactgcaagatatttgtataaaacagggctcggatcttaccaactcactttccaagtgcataacgggggaaatgtgtgaaatccaagtacatataaaattttatcaacatgcaattaaaaaacaagtccagacatttgcgcctatgtccaaaatcgggttaaaacttacattttttcaatcttatatgtctttaaacagcgttaaatttaagaaaacttattttgttggtttattagggtcaaaaattattttgcttaaaagatttattattttttcaaaatttgctaatgatcaaattattgcacacaatcactttcgatcgcttatttaaagctgtttacatctgggattgaaaaaatgtaagtttaaaccgcttttggacatggcgcaaatgttgggtaaccttaacaacggtgatttttttttacacaaatggtttatattgttccgcggaaagaattttttgcaaaattttttttatttccttcagatagagaaggagaagctcccccgagaggaaggaagattaatggatcaattgaggcgacaattgatcggatatgatcgagcaaattgaaaccgaccaaaatttttacctcaaaagtttccccagctcgtccattttttattttcatatgtaaaaataccggtttccaggtacaatttggaaataagtacagttaacatttcccaaccatgtcgaatccgagataattttctctgctaattatttgaaaaaatgtcaaatatttgtaaaaaaatatgtaagtgtcaaaattaattttaagggctaaaatttaaaaaaagggtttttagggtcaaacatctaaaatagaattccaggggccgaatagagacttgaaaaagaaacattttcgctgctacaataatggttttcctggttttctctttggctaaagaacagggaaaataaataaaagcttaaaaaggatcccctcccaaaca

SEQ ID NO: 16251 - DNA, 2895 bp, Heterodera glycines
ttaacgaaatttctaaacttttcattttatataactactgttttatgattttaattgttgtaaattttttattagttgtttcgccattttattatattgttcaatttttttgaaattaaaacaattttttctcttatcttttgcatcatttagctgtatgctttgatacaataattttgcaaaggaaaggcatttttgattttttaatttaccgagtttcttaaaagataagccccagagcttctatttttcaacccctcttgaaaggggacttctattttagggggaaggggggggggtaataatttagagaggcttttattttttaactcccatttttaaaccgaaacaaaaacggcgacttttctaaaaaatttcgcaaaatacggaaatatttttttgtgacttttaataaaaatgtatttttttcaatttatgtagtgatatatttctgttttttttctcctgttatgtataacgtaattttacacataagctaatcattgttcaatgcatatttttcacaaaaaatgttatgacatcaaaaagatggtaaaaaaagatatttgattatttttatgtttctttaaatgactaaatgaatttttatatgtaaagtcaaagaaattttttgcttaattatttagatttatttggattttcattcctccgaggtttcttctccaaataattttttccaatcttaatccttaattgttcctttgcttattactattttcttacaaatttcggcataattttggtccattcttctgttgaatatatatttttttgtttaaattcatttgtcatttcaatgaattttgcacaccttctaatttttcttcatcagtttttgatttttgatgaagtcctaattctttaatccatttataaatagtcggtcaaattttttactattttcgaagaatttttctccattcttttgctgattactttttctttttgttttatttttctttattttatagacttttatgacaatttctatttctttcttttcttataaattttgtgcttttttctaagattagttggaattttattttcttcataaattctcaaaaatataattttaacataaataggatttttttatatgacaaaaatcgcaattctactggttcccagcaaataataaaaacctatttaaccgaaaataataatacttaagattttattaaatttaattgtacttggaaaattattggcatgaataaataaattaatatgatatttttaaaatacttttatcattaattcaaattttcttataatcgtcaccggaaatgattaaaatcattataaaattatagcatatattaaaataaaaaaataaaaatgcgatctattatttttagcaaaatacttgcaataataaatttaaattttagctcgcctaataagtaaattaaaaaaagaaatatttaaaatattaatatgtattgaaaaaaattcttaaacatatgacgacacgaatagactttattaaactataaacaaataataaaatatctttattttggcattgagataaaaaattattaattttacttttttagtagaagaattggcgaagaagctgagcttagcactcaaattctatgtatgaaatgaagcccagtttgtagaagcaggtagcggctaagtcccaagttaaaaaaacgtaatgtttatgaagcttgaagcgtaaagtttaccaaaaaatataatttttcgtaaaataaaataaattgtaatataaaaaaattgaattggttcattttctaaacacttacttacctgaacacaattaaaatagaaaaattgatgtaaaataaaaattaaggttaaaataatacattgaaaaaataattaaaaaataaatcggaattttaaaaaatctaaaattaatgatttaattcattatcaatgaaataattatctgataagaataaagggtcaaaaggttgaaaatatattttcatttaaatatataattaaaactgatgactacgagaaaaactcaaaagttaaaaaaaaacagacaaagcgaatcgcagccgctgcaggatgtgccggttttgaagcacgaaaggaagcatgaatgacgattttgagttttggcataaatgaaacaatcttttttgaggaatcacgcgaattaataaataaattcaaatatcaaaaaatgtgacagagaaaaacataaaaattataaatgcaaataacactcattttaatttaagaagaaacaattaatttaaataaaattctgtcgtactaaaactgttaacacttttaaacttatttatgagaaaaaaccaatacaaatgtaaattatattaaataagaatcgcaaaaataatatgtacaaaatatgtaataaattttttttttgttattttttgaaaaaatcatagaaatgtcgaattaaaagaaatattaatatttaaagttttaaatctagtttttgtaaaatcgttaaaacatagaaaatgcgtcagtgatacaataagtttaaacacacagaaacaaaactgaaaggaaagtcattaaactttagaagttttattcgaatttggtcccgaagttcgaattgactgaagtggatgccggattcgtgatcagcgacgtcaaaaacctaggagacttgtttttatgacatttaaattcccactgacgcatttcaagaaacccttaaaaagccgtatcaaaggattgtatcgccgtttttttagcgcagaattgacatttggttcctttctaagttttaaataaaaatttccaattaaaaatataatttactattttatttgtttttaaatcctaaaaaaaaccgaacctggactagagtaaaaataaaggttaatctaaaacctaatgggaaatata

SEQ ID NO: 16252 - DNA, 1816 bp, Heterodera glycines
actactagaatatttatagaaaaaactaaaaaaaaaatttattacaccaatgaaataatggaaatttttccaaagcgatgacaagaaaatgcacaaaacataatttcaaagatcatgtttattctaaataaaaagaataatattaatttcattaagatgtttaagtgcaaatattatttgataggaagaaagaagtttgtatgatttacctaaagacttaatcaaaatattttatgaacatgaataaatgaaatataaaatgatataatgaaaaacaaattaatatatgtaaatgaataatcaaaagcgcctttttacataaattcctcatgtagccggggagaatgaaatattatatgcatgttcgagtttagaaaaaattataggtataaaaattattttttataacgcaaaagaaatcacaggacattcattgacggttcaaaaacaataaagaagataataaaaatttattaatattgaaagaaattaaaaaagaaatttaaattattatgtattttttgaaaatgttgccatcgacacaaacgagcttatgatgatttagcttaattaaaggcaaaattttattacattaattttctgtaaatttggaacaaataaaaagttacgcccctttgttttccccaattataaaacaacaaaacatattctcgaaattattaacctgttcactctcagctacgcaacaatctttcaaattcagaatgccgaacatgttaaaaaccaaaaaatgtaagttggaactgtgtgaagtaagcttttaattggaatcactggaattgtaaaatgtttaattaaaaatgatttaaattaaaataatatttgtattaaaaatgtaacataaacaataaaaaaaattacttacaatattaaaaattaataatttaacgatgaaaaatatattaaatatctcttttctaattaaaaaacaatctaccggtctaaattaattttgtaaaatgactatcccgaacacttcttatgaaatcatcagttgagccaaaacgattacaccaaccaagatgaacttcttgaaaacatcgataattggcttgatacaattcaagaaataaatttgaccccgcttacccaaattatccgtcccaacaagaaaatgaaattttttttattatcattaatggagaatttcaaatatcttacatatttaaatattatattattaatatttcgaattttatagaattaaaccaatagaaaatttttagtgtaacaacaatggaaacataatttctaatagaaaaaaatgaagtgcaaaatttttaaaaatatttgaaaaaatttactatgtctatcgaaaaattataatccttgtcaagttacggtaattttatataaaatctatttaaatacaatatcaacaacaatctaagtgaaataaatgcaacaaagagtttgacgtaaaaaaagtcatacgttttgcaaaatcattaaaataaaacgattggttttgacgtaaaaaaaaaaattatttttgcaaaatcaaataatcataacgcttgagtttgaagtaaaaaattcattcgttttgcaagagcacaaaaaattcaacaaaatgattcgacagtaagaaataaaagtctagtagaaggttttttaattcaaattcaaattaataaatatattttgacaaaataaaattaacaataaatggtaaaaattaaataggctgtcaacgccaagacaatcaattaataatttaatcaattaccctaaatatatggaaaaattacaaacgtaaaaaaaaattaaaaattcgtaagagaaaaaccaattc

SEQ ID NO: 16253 - DNA, 942 bp, Heterodera glycines
cggtgctgggacattagtcaaaaaccatcaaatggaaaatttttgacagaaaattattcataatttcgcataagatggatcaaattttataatcttgatatttttcggtagccctaagtgttttctactatcttgcaaaatttttaaaaaattcttaaagtttaaaaaaagttatgacctgagaagctcaaaaaaccatgtgtttttgaacattttcagtcataactttcttgaagcttaatgaaactttttgaaattttgtaggctaatagaaaacacttaggcctatctaatcatatcaagaattaaaaatttagttgcttttgagcaaagttatatcaaaaaatattttcatttgatggttttttgactaacgcccattatgatggtttttgactaacgtcatagcaccctccaatcgcgcaaataaaatccggcgttttacaatttgccgaaaaatacaccttttaagctggtgttttacaattgtaataatatctcatggaaaatttaatgtaattttaagtcaatgtttttcaattgtaactgtgttttaaatttccggaaaacgcgcaaataaaatccggcgttttacaatttgctggaaaaaaactaaaaaattgcataaaaactatcaaaaatggatttaaccttaaaattgccaaattttctatttttgtccgttttataaactccttccgggaattttgtaatccattggcgaattaaggccgacgggttttgaaactttggagattttggaagcgaacaaataccccaattgccaaaataaaaaaatcttaatattgataaaaaccccaaaaacgacaaaaacaattttttaaaattgttttgaggtgtatttttttaaaaaaattagggggtatagttttcggtttttttgctgatcctgtagggttgcgcataaaaatttttaaatct

SEQ ID NO: 16254 - DNA, 2129 bp, Heterodera glycines
tcggtataaggcgaagaaatgtccgagtgcaagcgcaagtccaaccgtcactgagcacaactttcatcatccacaacagcagaacgggaaaaagtgtgcagccgatttgacgacgatgatgagcaaacttttgcagcaacagcagccgcaatcattcgaatcattagcattgtcgagtaattaaggaatgggcggacgaggagccggagggaaagagattgggtaactaatcaaaatcacatttggggcgggggggggggggggggggtgccacggagtccaaaaggttccttcatattttaactaattctgaatttctgattgtgaattactattaaaaaaatttcgtgaaactgaattcgggattgacagtgcttccttcccctgatagggatgagagtcggtgccaaaaaaagtaagggataaaaaatcttccaaaaaagcatataaggcggatgcaaaaaatgatgagattgggattttgaatatattatttagggaaattgattacatattacttacacatttatttcggaataaaattaagtaaatattatttttatcttggtttaaaaataattggctttttctttttgacagaaaaaaaatgtttcgaaaatttgaacccagtttttgaggaatttatttttctgtccggcacttttgtcaataattcagcgtttttgtctatattttgaatttttgtccatattattccggccggtctctaataataaaacaaaatggaaactgcccattcttcaccctctgataggtgatgatccgcaacagctgcaccagcaaattgccatgggcacaatggcacaataattgcagccaactctggcacgaatggcgcccactgcagtggcactttactcgctgattggcacaactttgattggccaaccggcaacaatgggcgctggtgtcgggaacaattcgtccacaatggcagccacaacgatgttgccttcccttttcgaccaaaccaccaaaattgccaaaaactgcatctttgacaccaactcatccgccgtggacccaactccttttgtcgacaacacttttgccatttttggcttacgtgtggatacaccagagggatttgtttgagtttttagataatttagacaaaaattattttgaacctcctcagccaaaaatggaaatttgttattaaatttcaatcaaatttgccaaattttctcctatggcgcctattaccaattttaatgattcgcttattaaaatgttggaattatattaatttaaatttttagacaacaaatgacgacgaaggtgacgatgacggcactgatttgaccataacccgaccaaatgcattaatacttggaaaatgtgaatttttggaactttagccagtgaataaactttttgaccatgttatgagcaatttattattttctgcagtgtttttttttttgttttttattcaatattttcttaagtatttattttattttttaatatttataatttaaaaattttgatttgaatgcgcccaaaaaattggcaaaaacttcgtacaacaaaatgaagaaagttgagaaatgaattggtgagaaagcaatgaaataggaaaatgaaaaaaggatgacaaaaagcgattattaaatcatttaatttgatcaattcgtttgttgtgtcgttgtcacttcttcccactcgcagctgtccaccgtcgccgctgcggtgccgtgggcgcctgccgcttctttcctcaagagctgctccctttggtagtgcacctgcggacccaccccttattaattgtgcccaatttccgcgaagtcgatttgtgcatgtaaccctccctattgtacctatatatgtcgctgagctaatacgcggaatgatggagtacagatgaaacggagggtagttggtcatcttgggacattatgagagaagctacatttcttctcgtccttcatcataatataaaattaatatttttttattagaattctttcacataattgctttttgaactttattagtgaaaaattcagttttatagaaaaaacaaaatgcggaaggggggtggatggactgctcgctcttcgcgtcgcttccccccgttgctgtcgccctgtcacctctcc

SEQ ID NO: 16255 - DNA, 2016 bp, Heterodera glycines
  misc_feature (23)..(23): n is a, c, g, or t
accaaatccaacaatcttgatantcattcgaaagtttaacatgtttagaagctaattctaagctattccttcgcgattagtcaattaccaaaaaagttataacatgaaattgcaaaaaagccaaaaatttggaagttttttattaataaatttttacaggctagaaaatcttttgctttttgcaaggctaaaatagagcacgtgaagagctttcgaatgatatcaagatcgttagatttggttaacaacaaaaaaagttatcgtccgaaaaaacagaagcctgatttaataaattaacgcaatatttatattaataaaatttgaattaatatcagttcacttattttcttcaattatttgcagaagatatgtatagacagactcaactgattttttaattttttcagaatttagattgattattcccatgttcaccgtaattgttccatattatccccccccccccccccgtatttaaggggtgctaggtcatttcttaaaaactgccactatgggcgtttcttaaatactgccaagttgtagtaaaataaaaaatgtaagacatataaattcgtatcttggcccaatttcatccaaattaataattattggtatcattcaatagcattaagtgttgtctatcagaatagaaattttgaaaatttttttacaaaattttaaaaaagttatggtcataaattttcaataaattttcagtcaaattattttaccagaacttttttaaaactcgatggaattttttaaaattttattcataaatagagaattcttaggactatcgaatatataaatttattttctcttaattgcattttaatgccttgaaaattttaattttttctggacaaaaaattctgacttaaggttttgtggagttgaataaccatatctttttatatacttaagtaaaaaatttaataaaataatattctgatagagaacacctatagctattgaatgataccaagaattattaatttggttgtatttgagctaagttatgaatttatatgtcttacattttttattttcctacaacttggcagtatttaagaaacgcccacttggcagtttttaagaaaaacgcccatggtggcagtttttaagaaacgacccagcacgtatttaaggcatgttcttgacgtcgtcgtccccgccgggcacgggcatcggcattctgttcctgacggcacttctctgccactgctgctgctgcccgtccatgtttgtttggtcgctgtgctaacagtgccgttcggccacctgttggtccgatggcttggcaaaatgcttctgcgcccaaaactatcgtcgcttttgttgctcacaatcagcagcggcagtggcggtggcacaaaacatttgacaaaaaatacgacgccggcgacggccgcgacgaggacaaataagccgaaattgctgggcatcactaagtcaggagcagaggacgataattggggcaaagtgacgcaatcggaccccaaagacaaccgattaaaggtctcaacaattagtgccattctttgctttatattaccggatttgcgggacgaaaaaaatattttcgaaagggtttttttcaaaatttcagaccagcgagaaaaagctggaattgttttctggtttgtgctaaaaaatggcacatattttttgcaccattttggaatttaaaatctttcaaaaccagttttctcgacggaggcgctcaagaataaaattaaaaatttaatttttcaaaaacaatttagttggaagttggcagaagcaatgaaaatttgacgaacagacaaatgcgtcaacagcagctctggctttgaattagcgcgaagaaatattcgtttttggcgaaatatattttattttttattttgatttttgacatttttcaccaagatgcttcataatttttgcttcaacattttcgatacagtgcaattgctgaaaaacaatttacaagttaaatttatggtgctaccatcgctacgaccctcataa

SEQ ID NO: 16256 - DNA, 2990 bp, Heterodera glycines
  misc_feature (2974)..(2974): n is a, c, g, or t
attagtcaaaatgggggtgccgagtttcattataggtattagtggtacaaatgccactaattagtgacaaattggccaccctaggcccattctgtattggctggcactcgacaaaactcagagcgtttaacaaacggaaaccagggaatttccctaagtcaggaaccgggaacggaatcgctcccgcccctcattagaaatacctaactaaccgccttttgtgcagtccggtaaacattgaagcaacaaacagagtgtgccgtgccgtcccaccctgcggggaatgggggggagaggcgaatgggaggacaaaaggttctttctttgtccgttttgtgacgattctgcggatattagctgacagtgtcctcccgttaattccttaatctgttcaaatcgcccaccataaaactggcgttcagcagctcgcgcacgcatcacgggagacgagtgggggtggggagggggccagggagggacggcggacaaggccgacggggccgttgggtccgccctgcactcctccgccggctgtgtcgcgcattaattggttttctgctgctatcagcggggaatttgagcaccgttcccggcgccatgaccccaacatttttttttgccgggtaaagcgcgagaccggtgcgggatttcgcgggatcccagtctataatccctcatttttgaaaaatgagggggttatgggattttgcggaattaatgtcgcgggatttggtaccaaaattttgaatttcaatcccgcagcgggagccgcaaatttgaaatttccggtctatcagaattttggttgtttgccttatttgcttaaatgctaatatgtgtttcgcaaatggcacttccatcaaatgttttcccaattcaaattgagctgtagtttgaaattaggaaacagaaatgattttttaatggagaaatcccaattaattaactaatggctgcaattacaaataattaaatttcagcttttttacaatgaaatgcagaagtaaatttttcatgtattatttttgaatcttttttcattttatgacaaataaaggaaaagtttttgactttttaatagctatcaaaaagcattttaattcaaaaagtcaaaaatagtgatttgtagtgacgaacattttgtttctattttttattttatttttcactttttgttttggtgacacttttaatttgcgcagcggaaatggcaaaatcaatgcctgaaaaatagcatcaatttcataaacaaactctgactaaatattgtaataataattaatcaatttttcacgttcgcttccgctgaatttttttattttcccaattataagtgtatataaaaagcagaaaatataccaaatacaaagaaaaggcattctcattcaattcattatctctgaaaaattgaattggcaaatttctaagatttgccaaatttaagtttttgatattggtttcgattagtaatgtacaaaatttcggactcagtctcgaaaattgtgcgaaatttctgctttttgaactttgaatttcgtattggtctcgctcattgagagactcccgttcaaattctcggggtttttggccttttcttcaattctcgactctctcatcatttggctttgagtctcgggataatttcgcttaaatgtacatcattaaaaaaatattcacttataattatcaccatcttttttcaaaaaatcaaaaacaaaaccaacataattttctctcaaattgtccgtccgtttcgtctcccttcaaaacgtcgcccgaggggcgacggcggaggacgtcactcatttaaccataaccataaccaataataataatataattatgaaattgaaactgtcccaaggttattcaaaggcatgcgaatgaataatgaaacgattggtgatgaccatcgatagggcgaagagggtgaggggggggggggcaattcagcaaacgtttaaaattaaaaaatgcatcaaaacggaaatatgcgtaaaatttaggcgttcaaaaaatgaccaaattttgcgcaaatctcgtattttcttgagtaaaatagtgacattctgccataaatttacaaatatgagtttatttaagaaatcagaacaccgggcctaaaaataagattttaacaatttttttgcggcgcatttttccaaaaaagttctggtgaacgggcgaagggagggggtccgaaggcgccgcctgaaaaaatttgtaatttttaatacgatttgctcagacttttgtcaaaaaatgactaattttgcgcaaatctcgtattttcttgagtaaaatagcgacattctgccataaagtttcaaaattatgagtttatttaagaaatcaggagaattttggtcgctacctccaaatcaggacatttctgacaaatcaggacagattaatcggttttggcatgatttaactccactaacatttttgcgggattgttgactgggatcccggaaaatcccgcgcgggatcccgtcccgcaccgggctctactccccgatctcatattccgattaccgacaactcagcttttttttgtcttgggaaaaatgcagaaaaactcaataattttccattttttcccaaagtgttgtgccccaatcatgggccggccctgttcttagcccaccggttctccggctttaccatcgctgtgttttactgtccaatgtcatatgttttgcttctctctcgcctcccctctacagtattccaatcatccccattctcatgagcataagccaatgatgttcgtgcttcttccatcccattaaggtcacacggcccaaaagtccccccgcccatcccccgggggcgatgttcgcgcagattatcccccatcccttgacggggttgacccccgcttcctttatccgatcatccccccccctcctcccccattccttttgtcttcgctatgtttaccgcgattttgtgtgtgcgcccactcganggaggctctaaatgtg

SEQ ID NO: 16257 - DNA, 3284 bp, Heterodera glycines
tcgctacaacaaaataatgccgacacgtgatagtcgagttcttacgcgacagctgcgcaaaaaatatgtgcccgtgtgccacaaagggataataaatgagcagtatgaagtcttcccgtttggatatgaataaaaaatgattgtgattaaataaaatacatttaaattggctcgtccgttcttcatttactgtctgactttcagcgaaataccttgaccatgaatcggaaagttttatctgtttatgttgaaatcagagaaggaatgtccgacaaaagtggcagcaacgggaagaacgacgacggcggcaacggtaacaagaaaaagatgggaaagcaggcggacactcgaaaaagaagctacccgctccctcttctttcttgtcgcgcacggcaaacatggttcgactatcatgtgactacccattccattctttttgctacagggtagaagcagtcgatcgcattgaaaagaaatattcaaaaatggaagaggagataggcggtaaggaaagcgacgaagacaccattgactttttcgccgatagcatcgaagaaattatggaaaagtgtgtttaaaaagatagatgtgttaaaccattggttcaacctttattagaattcaccgttcggaagagaaggtgaaaaattggatgaacatgcacggtcgtggtgaagccgggaccagcagcgctgaatgtttgcctgctcaggctttggagaatgacaacgcggattccagcaacagtgagaaggatgctgatgagccaacctcaacggtctacctggaccgcaaaaaatgatagaaaagggaaattcgtatagaccctctctatagttagccccgaataagcgcaatttgttcgagtaaaatttattcagcaacaatcgtatgtatgaaataattatatggtctgtcaaaaaaaaaatagacatttatcctctttcgctttggatttcggcacttgcgacacgtaataattcaatgggaaaaatatcgcggtggtgaccaccaccaaactgaacaacacaaggaaggcttgggtactttaacatgacacgatggcgagtgtaaaggtgttgctgaaccgtgattcctaggaatccacggtatgcaaacacctgatttgcaccgttgggacacaaggcatcagggataattttaatatttctcctaaggtggacagtctcaatgtccaattggctcagataggcaaggttctcagttcgtcgtttctgtagttgcttggtcagtcgatagggaccacagttattgaatcggcacagcactctcaccaagttgcagtctcgttttcgcgttcgtcgtcgctccaatagttgaccaaatccaactcgtccacgatcaggtccatgttgttgttgttgttgttgttgctgctgctgcgcgctagttcgcaaaggcgtgaaagacacagcggcgagtcgcccggacaaatcttcaggtccttcagctccacatacagaggttcgctccttaaaaatgcaaatggaaatattaatgtttttatttttagaaaacttaccatactattccctcgaacttcctcttcggataacatgttgagtacagctcaacgtcagcaatcaattcaagcgagccgtcaatatgcacaggttggttcggatgatcggcgtttgcaacgtgtacacagtccacagcacaaagcgggttgggatagagacaattcccaccttcaggcccacttttaatttcttctttcaagcaggtgtacagatcgtctacactgctcagcccgtaactgtcgatcagataacggattgccctttgcatgcaataagcaggtaaatatattgtgacaattatgtaaaatgacaatagcttttcttaaaatttaggaaacaaatggccaactgaatccaaacaacaaaaaatcgttctttaaatactccgactacgggctccaccactttgatcactcgatgttgcagtttcatacggtatgttcagcaattgttgatgttgggacgaataagcgtcgtcaatgaacgggctgctgtaataatcggcgctatcggacacgttaagcggactcttttggtttactcgccgtagctgtttaagtatgtatgtgcacagtacaattaggaacagattgaacaggtacgatatcggcatccaggcgtccgacatgcgtagatgggcaaaaacaccgcggctaacattttggtctttgggtttataaattagataattaaagcggacatcatttgaattggttacaaaagttagcgcacgattcccttttgcatactcgccaatgtgaaatttatagatgcgctggtctctgatcacaaacacatggttgtccaccaaagtaaagtcgcttttatctggtggaagaaaagcgacaaagttgctcttcaagatcgtatgtgcggaagattggttttttcgaagccaccaatgctccaggtattcaagctctatttcgctgatccgcctctgatacttatcgatcagaaacaatcgacccgataggtgatcaaacacaacccgtccatgtttggacagtcgttgcacaatcttatgctggtgaccacggaagatagtagtctcaccagattcgctgtcttcaaaaaaggtaaaactatgcccattgtattcaaaacaggccaatggtgacattttcaccaatgatttcatttcgaaaaacacactgatagctgtgcaaagtgtacacattttgaagcgaaacggcccattcgctgtcacgctcacatttctctattcggcacgctgtattccgactataaccaaagtgttctgctgctgtagcatcttttgaaaaggtacgatatttgccgctgtcaaaatagttttgattgtcaaccgtaaaatctacatttatcagctccgattgcaatcgtgacggcacacagctgaggactatacctgcgtaaaaaacattcatgaaatgaaccagcatctttcttactgcttaggaaacgtgagcttttatagaccgttgatcaagtttctgacaaaccatttcacgaggtaatctgccatgcctcgagtcttgcgcaaagtctcaatcacacggcagaaaggaatgccagaacatcggcttgccaaaaaatatatacaaaaatggccacacgtatcggatgtgggaaattgaatttgatctttagcgaccagtacctctttaaatgtgttgaggtaggctgctaaatcggggtttgggggctcaccaacacgggaggaatattcaacgcttctatggcttaaagcatagcaag

SEQ ID NO: 16258 - DNA, 1853 bp, Heterodera glycines
attagcgaagtcaactgtttaatttaatttaatgcaaattaaatcaatcgtataatatttatattctcgttgagtatttgaaaattttttttcaaaggtttatttatcaattatgattgattgctatgattgcctttacacaaatgtactgaaataataagaattacttcgaatgaattacaagcgaaacaaataaaaatgttgcatattaacaaaattattaaaattttctaagttgcccacatcaagagctgtcgaatgatacctaagtttatccgggtttgatcctttcaaaaggtaaggagagcctcattttgttcatttttccgaatttagaactggtccaaaaaccggttaaaattaagcgagtaaaaaattttgatggcttcatctttttcagcgtgtaagaaaacctacaaaagtggtgggtgttgagcaattttgagtttggggctatgattaatattttcctcaatcaatatttaaattaaataaactcaaaaaatattggaaaattataaagaaaaattatgaataatataatgagtagggttataagttgtatgcactgaaaaatgccaaacatgcgcataaaatatgcactaaaaatcctccaaatattgcctaaaaaccccaaatatgaagtaaaatatgccttaaaaattacccaaaatggcttttaaccctcaaaaaatgccaaaaattgtgtttaaattaagaattaaatttaaaaaccaccaaaacaatggctaagtagacaattgcaaaaaattttgattttcaaaatttataaatttttattatatgctaaaacaaaattacaattttatataaataaatttttttccaaaagttcttacataaatttaaaattttttcgctttaaagagtgtgtttcgatccttagggcgtgtatttttcgttttttcgcatttttcttgtaaaatttgccaaaaaatgaccaaatgctctaaaaacgcaaaaatggccaaatattcatttattctcaacccccccccccaaaaaatatgctttatatgcacattaaaaacattcaccgaatcaaaaaattttaatgcagaaatgctatttttgagcccctttctttatagcatatgcgcagaaaaaatatgcaaaatcatacaatttataatcctttcatgagattattagttttttaaattttatttttaattcttgtttatttatttatatttttgggtgtttgaatgcttagtaaataggtattaatttagtcgttattagtacctaggaaaacctataagtgtttttgtgtgattttaagtctgggacctattctaaatttttccctaatgctcttttttacctaaaattatttgatgaaaaacattacgttttggtaaatgttatttattgacaatttatgaaatatttttttgcttcaaaaaattcccttcaaaatgctgtggaaactctccagctctcctatctttcactctctctctccccccttcacgcctcactctctctctctctctcactactttctctctcacctctctctatctcctatctttcactctctctctccccccttcacgcctcactctctctctctctctcactactttctctctcacctctctctatctcctctttctctctctctctctctcttatctctgtcttataatctcactatttctttaattttctctcttttctcacttgtctaattaactctctctctcatatcaattttccacctctctactcattttcaaagcgaccccgcgggcgaacgtccaccattcattttacaacaagaacatttaatagttaacaggaaacaaaatttctgtccttccttt

SEQ ID NO: 16259 - DNA, 1379 bp, Heterodera glycines
gggaaattggagccttgcaaactcaaaataaaatttaaaaaaatactactacaaaattaccgtttataaatcatattcaaatataattagttaaaagattaaattacaaaccaatataaaatatttagcttgcttaataaaatttattttgctttgcttgattgctgtggctttgtgtgtatacggcttctagggccgaaacacaaataataattaatttaaataaattaacccaaagagacaccgtactgatgaggcccggtctctttcggttaaatttgcacgtttcgcgaagtgcccatttttgcactgtcgcgaaacgccccatttttacaccatatttgcactgtcgcgaagtgcccaatttttgcatttttcgcgaagtgcccaatttttgcactgtcgcgaagtgccctttttgcacttgtcgcgaaatgaacggcagcaccccctccttttatcgatttgaaaaaatgaccaaattaaaaaataaaagatttttcttttaagacactaaacaaaaatgtttacaatttttaatgtttaaataaagaaaatcttaaagataaggacactttgtttctaagtctcaccctccaaatatggacaaatcttaaaaatttgtacatttagcatcgctgttaaaaacataaaacaagggtttttctaaaatcgtcaattatttatacattttcgagaaaattggtattttctcgccacctgtcatttgtcccaagactttttcacctgactgtaattggaatacattaaaatatcatttatacccaatgcaaagaaaagaaaattatgttaagatggattgcttgaacattaccaatattagcacaattataaaggtaaactaatctatatgcagcaagaaaaataaataagatttaaaattgactagaacaatatatgcttatgaatagggctgtgaattttagtgacaaaaaatcccgaaatagttaactaaaatagtgagtaaaaatgttaaaatagtgacaaaatagtggcaaaaagtccgaaatagtgacgaatagtgacaaattttcagccaaaaattgagcaaaaataatttttattcactgattgcagttgcaaatgagtaggactgggatttttaagaccaaaaaacccaaattagttacctaaaaaatttttaaaattaaaaatttttgccaagaaagtaaatttttgagaaaattttttttcttttcataggagtatattttgaaaaattttagctcgattcttaggggtgtatttttgaaaaaatttttaggtcgattcttaggggtgtaaggtttgaaaaaatttttaggtcgattcttaggggccctggggagttttattgcatttttgttaaggaattttcc

SEQ ID NO: 16260 - DNA, 3341 bp, Heterodera glycines
tgtaaattaagtgaactaatgatcaaacaaacgagccttttggtcatcgattaattgaatatcagaacctcctccggtgccgtgttcagattgacggcgccttccatccgttccaccaccaatttcagtgtgtacgtagtcgccatccttatgctgtccatcagatttacttttcccggaggcaattttcttcttccggtgccccgcttctgctgcacatattccatgggaaattcctggttgacggtaaataacgtgttggcgaattgcattaaaaatttctgggccattgcatttgtgtccaatggttcagatgggtttgacctgaaagaaaaagacaaattggactaattaattcgcctcccctgggctttacggcttcttttggaaatcgacaattagtgaaattgaagtgataatccgttgatcagaagtgaacgaaaacggctgaatctaaaattagcaaatgccattcattggtttgccttgagaaatgtttccgctttgacctgaacttctcggccaacttccactttcgtccattttctctggggcatggaaaagccgatctccccttttccgacctgcgcatggttagccactgagaagtgataatggtgggccggtccaccggtgagaacttttacgtatcttgccaaaggttagacttattaaatgggtcattaagctaattgaagaactttgtcaaatttgcatcgatgtcgctatcattcacctaaactttgttcgtcaatgactcagcaggtgatggaagccttgtcacttttaagcgaagaatcgatctgcttaaagatgtcagcaataaacaaaaattgtgcaaggaccaactcagaatagtgaaaatatggaatgataatcatattatttattattttaaaaatatgtgccaaaatgaaattgaaattatttacaaaattttaaattatggcaattaagagacaacattaattgtgcagaaaatacagccccaatgtatagcaaattccctgggtttggaaaaatatcggctcttgtctcgtgacatgggaccgagactctcgaaccaataaataaaattttggaattattatgagttcataattgcctatattctaattaattaattaaatttttacattattaacttcaattattctttcacatttgcactgtacggagttcccccccccccccccccaattcgacctttcctcttcggtttcctttgaatttggatttgcgaggtgaactcccaggaagcagcagcaaagtattaaaataatattcattcttttcatttcttggcttaaaaatcgaaatatgtaaaagataaaaataaaagaaaggtatataaatatttcgaggagcataaatgggcacaaaagcccaaaacggcaccaaatattttactatttttaaacgggaaaattttttaaattgaaaacaataattaaaatactatcgaaaaaaaaaatttcaactcaatttttgaaaaaaataaattttcggcaatgagtttgtgaaaattaccaaattttttacaactttatgccgtaaatttgtaaaaaattaccaattttaagatgggttttttttgtaaatttttaggtctatttttagggtttccttttttattgtattttgtaaagaattttctgaaagtcgtaaaaataggcaccaaaaaaggcgaaatatgcaaaaaaggcatctgcctaaaaatgggtccctctttagaaataataaatgctatgaattgggatgaatgaaaatttatgtgtaatatctcaattatattgttatcttattgtcaatcaattcaaatctgcatgacggacctaaaattcaataataataaaaataataatatatttaaatatttgtaggataataaatcataataattaagattggtggcaagtagagctgagcgggatcgggaattttgggcaaaaccgggacttaggtactcatttgtacgtttttttcagtaccatcccggtctcgctcagctctagtggcaagtggtagctcaagtggtcctctttatatttaagaaaaattcacaaaatgatctacaaaaaattgatattcaagaacttaaatcctacctatttttttgcaaattaaaaagataatataaaattttggactatcgaaatatataaaaaaactttaaattatgttgctcttcaaaaaattcaaaaatattaagtattacgttttaatgtggaccgaataatgttttatttttccataaaaattgcttacatatcaaacaacaattacatttaaatttattaatattagtgctgcttttttaggttcgccccattggtatttttagattcgaccttgcatcaatagaagcaacaccgacattttatattttcgattccaatttctttcagctgtatgcattttatagggaatataaatgtaaaaaacatctaaacatttaattttatgtagaaacatattcaaatttaattaatattacaacggatgcgattttgttgtttatttgtttttaaaaacaccaaattcactcactataaattagccggatatgccttgataaaaaatataaaattttctctaattacaattttaattttaaataattgctaaaggggaagatgcatttcgtgtcgtttgtagcgcttcttacagtatttctggccgttccatgcgtctcgatgaattgctgtggacaaatcgacaacaaatatgtcattttaccacgaaataattattcggtgttttttgtttccggagattttggtgaatttaaatattataattagggtttccatttttagtcaaaaaaaatcgcgaaataggcacctaaaaggcagaaaaaaccgcaaaataggcattacattaattaggcacaaaaaaaggcaaataacattttttttaggtagcaaaacatataaaaattaatcaaaaaacttaattttgcttatatttcaattattttaacgttttttcaaataaagacaattttaaaccaaaatgtttgccaagaaaatataattaatttttgggaatcagtttttgtgaaaacttttttcaattcttaagggtgtatttttcattgacttttccgaaaattctgaaaaaggcgccaaaagtggcgaaatagtcataaaaataggcaaataggcattaagcataaaaattccaaaataggcaaagttaggcattataaaagtcatcgtagacacccaaaccaagcgaaaacgcgtttttcgtgcttatctatgcgtatcaaaagtgcgcagaattttaggcattttcctaaaaatggaagccctaattttaatccctttttaatattt

SEQ ID NO: 16261 - DNA, 2206 bp, Heterodera glycines
  misc_feature (2088)..(2088): n is a, c, g, or t
aattcatgtcgcatgcaggctgtgtcaaatgtttgggcagatccttcggaagcatgactcccacacaaattcgcttacgcatgctgaacggattaggagagcagaggacgaagtcaatcagatgctcgcataattttccattgagaattgacttaaaatttattttgattaagcatataatatttttttaagtattcttacattattcaacggagaagcgaccgaaaagttgtccgtgaccaaaccgttgttgaattgcgaaaagcacaaaaattgaagaaattcagcaaagttttgatcagttgacagttgatctttgatgcgaaacacaaccgagaacaattggtccttgtcgaaagtcactttccgcagctcacaagccgaattgaatttctcacttaacattgccttaataaaaatattttaatttaatttatttaaatgatgatcgctaaccagcctattcttgaatacggtgtactcatttttccttgactgacgcaaagtttcaaatctccaattgattgggctgatcatcgagagccatcgcttcttttctattttagtaatttaaaaaatgtcagtctaaattttgtacctgcgctgccaacaaacaggcgcatcattgggatgcacatgatcagctcccagatcagctctgctgggagtggtttggaatatttagccttttttgaaattgacatggagcaacaatttgatacacgcttcatattcaaccagcaagaaatgacaaatgatttgtgattttgatcggtatgcgaaaagggtcgagaatggcgccaattgtgcaagcgcgcagggacctcaaaccgacaaaaggatgggcgtggcatagcatcgaagatcaaactatggcgaaaattcaccctgatcatacacccggccaaattggcaaatcattttaaaaaattttcgtttttgttcttttttttttgctcactcctctccttcctttccttctattcccggggtaatttttcttagttctgggattttgggggccgtataattaaataaataataaattaatatatttttttttttgctgttaaccagggcggttgctttaaagctccgtttatcctggcagcaatttgccttttaggacctgaggtcgttctaattacacacacaaatttcccgagccgtttaggtgccctgtcgtcttgtgcttcatgggtggcggtgtgctgctcctcaggccatagttggttttataatacatgtcaaaattggggggccgtataattaaataaataataaattaatatatttttttttgctgttaaccagggcggttgctttatagctccgtttatcctggcagcaatatgccttttagggcgtgaggtcgttctaatttctttcaccaatttcccgagccgtttaggtgccctgtcgtcttgtgcttcatgggtggcggtatgctgctcctcaggccatagttggttttatggccaaatgatttactttgaactctttccaatgcttattccctatcatccccttcacccctcccttccatttatttaccgccatataaattcattcatttcatgcaattcaccattttgaaaattaaaaaattcatctattctcaccttcctagatagaaaattatggaaaaccaacccccaaaacggccattcccattctctatccaatctattctcgacatgccaccacaaccaaaaaaaatgcggcacggcttcatgattaatcaactgctgggcattgtccaacagggaaaaggagctgagacaacatcgaccaaaaaactaccggctgaatacgtggaaaagatggactgcatcatggagcacgttgccaaatttcatttcaccaaagtgaagtcgagatttgtcataaaagatgtgcctgcagaccccgaaggactgctagcggccattttccaacactgtattgatgaagcaaagaaggacagtcgcgaaaagggaagcgaaccgacacaccttggctgtgtcatcagcagcccactgctggatggtggcgacataccaattccgctacgtcaaattaccgacaacacaatcaacaccatcctanatcagttcatcaacgtggcacaaagcaaaaagcaacaaaacatgactttgtggggcgagccgttcatcatcgccataacatcggttgatcgcagtggacttccgatgaagcggcacat

SEQ ID NO: 16262 - DNA, 3556 bp, Heterodera glycines
  misc_feature (14)..(14): n is a, c, g, or t
  misc_feature (3531)..(3531): n is a, c, g, or t
cccccccccccccnctcagaatgttatcattgccaaagccatggccaaatggcccatccgccgcagagaaagaaaaataatgcccttttgactatgtgtgctattaggctaaggcacagagaaaaatcatacggacactcaaagcgaagaaaacaaacagaaaaagagggaaagagggggggggggagagagagatttattcaaaagagtggatacgtacgtatgtaaccgatcgaatgtgttaaacgcttgccgagcgcacccacccgctgctgcttccctccccatcccatgtcgctataatggtcattagacattgtaaatatgggattggctatccagcaaacaatattactttaaaaaagaactatttcccaaccccccgccctttttatgatttggatttgttatttatttattaaattatttatgttaaaacagtttttggaagagtgcatttaagaccaatgctccctaaaaacgacttgtggactgatcaccgataagctcatctctgacaacgttcttccataataattttcttttggtattccgacaattcaaattcccctttaattagcaaatcatcgaatgccaaatcatcttcatcgaagtgaacttcgttttgtctaaatgttcaaggttataaaatggtgtcagagagaacataaatgaactaacggatttaaaaaatcaccataatactaaacttggtattttcttaaaaaccattagccttgtaggggtcccttaagtgaaatttttttggtacttgtggttttgggcctacagcgcaaaactcgactcctatttgtgcgaattccttttgcatgaggactgtaaaagacgcaaagttgatacctttgaacaaattttgcttcagattgttgcatttatgctgccaaaatagtaacgcgcgctaaaatgccttcagcgcgccctaacttttttaaaattttgtggtgtaggcccaaaacccacaagtaccattttttagcaaatttacaaaaattattttggtgagcatttcgcatttattatatttttttctaattggagggggatacggtcctaggggggccaagaccccattctaaatttttgaggcaaaaaataattgctgaaaattttcgtttaccccgctttcgtcccactaaggtctccttacaattcgtcactttccaattcgtcaaatgctgcgctttcttccgttaattgaaattgtaagtccgacagattgtgagctgccaaattcatttccaatgctcttttctcaaattcggccaattcgatttgtttcgtcacttccatctgttggtaccctttgaaagacaacgaaacgaaagcggtgcatttcatgaaagaattgaactgaagacacattctgagaagccctgacagaatcaattgtcgggtaagcttttgatagtcggcaacactttttgacgaattttgtgcctataaatggaattttcgatccaaattattttttaaataaatacttgcgaaaaaaataaaatagaaaataaaaaagacgtaatgtctagccgttataaatgaaattacctgtgacgaacacagcaaaggcaattcggacagtttgacccttccaattgcgctgactgttgacagaattcgaaacaccgatgggtcgtccccatcggtcggcctttgcttcgtctcatttttcataaaattgaaagggcaaatgaatgcactttcggaatcgcagtgttcttcgcaatatcccacgacagatttgagctcattttctttgctttttctaaaagacgcagtgcatttcatggctaaatcaattgtcagccagttaaatgacgaaaaccaaaaagaataccttcgatttcccgcaaaactcgaaattggtcctcaaagcgatagagcaacacgcaattggcgggttgcccatccctcccggccctccccgtttcctggcaatattctgtcaatgatcgcggcattgagcggtgaatgacgaaacgaacgtcccttttgtcaatgcccattccaaacgctaaaaacatttacaaaattagaatattgagggaatttccccccgtcccccgaaaatttctctggaaaaatgtagaatttaccggaagtggcacagagcacacgaaggcgcccatccatccacttgtcttggtaaagtcttttgagtctctcggataaaccggaaaaatacggtttcgcaatgtttccgagcagagcagcggtcgctttacattcatttcttaaacacatgtgatttttatgaacaaaaaggaaaagcccactccgtaagacaatagacaatgcccgaaccattcccaatgtccgacaaaaggccatggactgtttgcttgaagttcgacttggacttgggaataacacggtaattgaggtttggcctgtagagatcagatttgaacctaaaggttgttaagaaaaaataagttaatatttactcataatcaaattaagttggcgagaatttataggaatttttagacattttacaaatgtaatgcaatttgctaaccaaccaaagagcactttcacagtccatgcccaaatattggaatgcttttcggcaatcgccttcagaggtggacgcagttaaagccattatcggcactttcttctcggcattttccctgaatttcttcatgaggtcgcccagctgaaggaagtcgggacggaaagaattgccccattgggtgacacaatgcgcttcatcgaccacaaaacgagccaataaattcatgcgatgcaaatacctcagatatttaaggaattgtcgattttttaccgcctaaaattggttacttgatgagttaaatcaaataatgcacatttaattaccctttcgggggtaacataaagcaatttgaaggtgggaattcgattaatgtatacatctcttgccattcgttcggcatcaaaaacagcgcacggaattgttgtctttccattgaaaaagataagtattaaatttcgatcaataaaaatgtcaatattacagtgccattcctcaatttcatcgtttggtcccgaataagtgaaattaatggcgaaatcaccacagttacacctctgtcctcaagagctggtatttgaaagcataggcttttacctccaccttaaaatgaattaactgataagttgacggaatcaggctcggtttatgagattgtaattaacatgggatttgtttgtattgtatttattacctacccgttggcattcgcacaaacgcatcaaaaccgagcatagcagcggcaattgcctgctcctgtttgtgtttaaagttattgatgccgaatttgttgcggagtatgtgaaaaattttcagacgcaaatcttgaacagcattcattgagtaaaactttatctttttatctaaaaggaataattaatggtatggcacatgaccaatagaaacttttagcctggtttttttgttattctttttcctaatttaatggttgacaggctactttaatttaattatttttttcttatttaactccnggggttttattgggattaaattatt

SEQ ID NO: 16263 - DNA, 3111 bp, Heterodera glycines
tttttgaatttctatttaatcaattatatcgaaaaatttacacagaattcgttcgaccaatgccatcgccaccacgatgctatttctctttttggcagcggttattttgagttgcgcgtggccctttccgttgagagtcgcatggaattggccattgattttcgcactgtcagtccgcgcgccgttttaatgttcggaaaagggcttaatgactaccaaatgttgcggattgagcacggaatggtcatttgaagcattaaaaaggcaaattggcgttgttttcaggtccaatactcgtgggattgtggcaccggcgacggaattgttaaaattgaagttgcgcgggtcgacgacggacaatggcaccaaattcaaattttgcgtattggacgattgactcgactgacgctcgacgacaaattcaggcattttgccaaaattagattcaaatcgaattaatttgccgatcagagcggaagggacgagtccggctggcagtgatgtgctcaaccttttctcccatggcaatttgcttctgttcggcgctcgagtcgaaccttcgctagtttatcagcgccaattcatcgaagccttcaatgacacggcaatcaacaaaatgccattgacagtagaggaagaggacgccaaattggcactgacagcggacgatttgcgagtgcaaatgaccgatggaatggttggatgtatcggccgaattagcatggacggaacggagttgccgaagacgggccaaggcttcagaatgttcaacgcagccattggatgtgaagagaggacattgggaccatgcttaaggtggacaaatggccgaaagggaaaaaagacggacaaattccaaaattatgatgaaaaataaacacaattagttaattagctaattaattagtgctccctgccaaaacggtggtcaatgcgttccctctgtttcgtcccccgccatcggtgacttttccccctccaaaaatggttcctcgccgttgttcacttgccattgtcctcaacgcttcaccggttcccgttgtgaaattgatttgaatgcatgtgcgtcaaagccgtgtcccggtggaattccatgtcacaatttgtacggcgatttccattgttcgtgccctcccggactcaccggaaaagttggacattttgaataaccaaattagcagagtataattattaaagacatgccaacttcgtggcgattgggacccttgtgtgacggcgtcgtgcggaccaaacggcaaatgcgtgcggcagccgcaaaggaattctttcgtttgccaatggtacgcctccctttcctcattttgaccattttcaatttcagtgccaatggatttagcgggggtttgtgcacggacattgtgccaacggaattggcatcggaagagagggaagcgggggagggcgacgtatcccccggagggtcggacttcccttgggcggcgatcaccgcgccccaattggcccttttggtggccatttgcctgctgactttgttttgcacggcatttatggtgaattattcgaaaataaaaatctgtaagaaacaaccaatttgaggtgattttctgtcaatcgaaacgccaaaattcaaacgaaatgaatgaacggcgtaatcgaagaaagaaaaaggggcgggggacggaggagaagccgaggaacggcatgacgagcgcagcgcaacaccacccaactgcgcggggcacggcggtgagcagagactgccacaagggcggcaaggacccggcgagcaaccctctggtgccgagggagacggcaggcacggattggcattgaccatcaaagcttgaaactccacaaaattatcgaaatgctttttagcacccggacaaggcacttccgaccgcccccctcctcctttgcctccgcgacaccaccgccgaagtgccaatggccacaacagcgcccttcctactgtaacgtattaattaattagttgcttttttaatttatttggcaggtcgaagttcgaccgatgccaattggcgagcgaaaaaacaccgcagaggaagacaaaatgaaaggggtcgaattggcaaaggtatttgtacacagcacaagccaaataatgatgccaatttgaccacagactccgccattgccgccgcctcgcgattcgtccgaaagacaaaacggggaacaaaatcagcaaaacggacagaaacaaaatgaaagttatcgacgaaaggtaaatgaatgggagagagggggagggagggggagagagacaacgggagagaggggagagagagagagaaaaggaagaggggagagagagagagaaaaggaagaggggagagagagaaagagaagatttataaagccatttcaattttcagattgatcgcgcatgttcagcagccgcagatacacaaaagcaaaaagcgacttcatcaaagaaagggacagcgaataaaacgacgcgggacgacgggagaagcgacggaaagggaaaggacgagggaaagtcgacggactatttgaccatgaagccggtgcacagggcgaagccgttcagactgatcccaaaagcgagcagaggaggaggaggaggtgatggacacgacgcccccggggcaaagcaccgccccttttttaaaattcaaaaattgttttatttttacagaaaatccgccacctccgccaatgcaccgaacgccgttgctgaacatgcgagggagaagaagcaatggaacaaatatggagcattatgacagcccatcagacgcattggattatgcggacggatatgaggaaaacaatgacggggagcaagacaatggaagaggagaagagagaagaggaggaggggaggaggaggagaaagagaaaacatccaaaagataaagggaaaaagagagagagaaaggaatatagaagagagagagagagagagaagaatgataaagaagagagaaagaggaagaggagacagaatgtccaattataagggatgaagaagaaaaaagaggaaatggcccttcttcttcacttgcaatgcccaacaaactcagggataaccccaaattcgggaactttatataattttcgattgtcctttctttcatttaa

SEQ ID NO: 16264 - DNA, 1376 bp, Heterodera glycines
  misc_feature (1271)..(1271): n is a, c, g, or t
  misc_feature (1293)..(1293): n is a, c, g, or t
  misc_feature (1325)..(1326): n is a, c, g, or t
  misc_feature (1337)..(1337): n is a, c, g, or t
  misc_feature (1345)..(1345): n is a, c, g, or t
gtaacttaacgcatttttttaattttgcagtataatagaaaacacttagagctatcaaatgatataagcttttattggttgctcaaagttattttaaaaaatattttcatttgatggttttttgagtaacaaaaataattttaaataattttaagaattatttttttggtaataaaaaaatttattgaagtacataaattattttattattattacttctttaaaagtttcattttgattttcgtggattctttgagacagcgaatggtaattgaaactgaagattttttaaaataatcctgcttttctttgtctcttttctaggcgaaaaaatgagcattcctccaatttattaattagctaagcagcaaacgactaataaggattacattttttattcataatttcctaattaaatttaaaaaatcgaaactctatacacattcattaacattgttatcgtcattgcatcaaatcatcaacgtcaaaaacaattaattgattttctcgcttttagttttttaatttttgaataataatataagcattaatttaatacaacataaataaagcaattcaatacaatccaattcatatatttattttatttagagaatccttttttaaatctatgggcttttttaattttctccttgtcattattgttctttcaaatgtttgtatttgtaaaggcaaaaataatgtggaattcatgttattgccctcattggtcggcgacttcaaataccgggtttgtattcagcaaatttgattaattttaattaggaatggagtttaattatgtttgtcctttttcgccatttttgccattattaaataattttttctggatttttcatcactcaaatttaaaatcctaaaaagtaaaaataaatgttaaaattaacgacataaatctacttaaatttacttttattctattcgcattttttttaggtttcagtacaatttgacaatgaaaaatttgtggtgaactatggaaacaaacagccgaaaacgaaatctgaattagtccaactttatttcggaacggaagcgcttaaagctgaaatttacacttttcatatagaaatggttgatacaaaacatattgttgggttttccatctgggtaagagccaaagtttaagtgaaaagaggaaagaggaaaaatcaaatgaattttttaatattttacgaattaaatcgaatttacagccaaataattattcaaaacaattaattgctgacgaaatcaccaagaaaccattncgttatttttgggaattatttncaagtggaaattgagcccaaactgaaggccannttcgggatgtntctaccgngtgaacactttttgtgccggcagtgaccaat

SEQ ID NO: 16265 - DNA, 2262 bp, Heterodera glycines
  misc_feature (73)..(73): n is a, c, g, or t
  misc_feature (2198)..(2198): n is a, c, g, or t
caaaaactggttgttacgttagaaaaattaacaatagacaataagtaccatattttaaatacccaccaatatntggcaatttgggctggaaataaaaataaaatgccgagggtttccgctggtcctttcctttccctttgtatgtgataccgtaccaaatttatgcttacttaacctaccgtatatacataatactgtacagtttggtgggcctggccttctccaagaagggattagtgtcaccaatggcggaacacatcgaatttattttccaaattatttttatttgaatatttcaccaaaaatatcggcaaaaactgacaaattttattgggtggaagtaaattgtcatgacgccagcagagaagcagagaaatacagcacatacacgcagaaaagtgcgttaattgtcttaaattgtgcacaaaattgtgcggaatatgaaattttggtgcggaaattggacaaaaaatgtctgacaaatgccatgaaaaaggtaaaaggtttattaaaccattttgtaatcactcatcaatttagtaaagtgattaggaagttttttgtttaatttgagaaatttggtcattgactttcatttaatttagaaattaaatctgtacaatgaaaaagcgaaaaaaggacaaatcgcagtcaaaattttaaacggcgaagaatatgagttcgtttttcagcaggcttctccgtttttgaagcgagtttctgacaatagtaataatcagaggaacacgaataaacagcaggtgaatgatgaaaataattaacaaaataaaataaaaaataataataattcagaaattggacattaaaatttatgagaaaccgataaataatacggaggaaataaatgaacaacagcaggaggtggggagaacaaagcgattattgacgatttgccaatttacagaaaattgagccaattttgaccattcttccaaatgaatctggggaaaaagacgagaaagtttgaaataattaaatctataattaatttattgaaatttatatttaattaattgtaaatccacatttgaagcgatttgaggagatttccgcaaaagtccacgctgttctaaatgatttttcagaaataaaaaaggaaaatgcaacagtaaaacatttttgatttttaatttattacctatatatgttttagaaatttgtgcaagtgtttacttttatgaaaaatgaaatgtcaaatatgagaaaacaggacgaaaaagtaaaaggggaaggaaaactaagcaaagaaaagaccaggacggattagcaattagcagctgattagtgataactgataagggggaccaattgggcaatccgtcgtggaatttttgatgaaaattttattttattatttttttgtctgccgtttctaaaggtgaaaaaattaaattttaaaattacagaaatttgaagaaattattaagaaaatgaaagaacttcaaaagcaaatagaagaatcgacgacaaataaaaatgaagcggaagtaataattccatttgttttgattgttttttgcgataattattttaaaagaaaaagaaaaaaacattttcagaattcttcgctttcgcaaattaccgctgcgaatgttagcaatgaaacggtggcaattgtcaaattggaatatgagaaagtaaaaagaaaaattgtaattatgaaaatgaataattattttatagaaattcgaactaatgtccgtggaaatgggccaacttaaggaacaaatcacttcgatgaaacaccaaattggccaaaacgagtcaaattttgtaaggacaattgaggaaatcaaaagatttatggaggaacaattcaaagacgaatgaaacaaatggaatgaattgaatgatggattgagtgattagtgaatgattagtgaatggtcggtcatttggggagggattgtttggcctttttggaattttttattgtttttttattaatgcatacgttgttatttttaaaagaacaggataaaattgatacgcgtacaaaaaacaaacaattattatttaggaattttcaaatttgaccccaaaataatcaacaaaaaaactggcaatttttgatgaattatttaataaattttggcggtggttaataaataataaaccgtattaggccaaatttattaatactatctaatgttttacaatctttccgtttttctcanatttgcctttttttcatttcttcggcttcattaatattgtaaaatcttttttttaatgaattga

SEQ ID NO: 16266 - DNA, 1086 bp, Heterodera glycines
  misc_feature (58)..(58): n is a, c, g, or t
caaatttgcttttttttcatttcttcggcttcatttaatatgtaaaaattcttttttntaatgaatgacaaaattaaaaaattttaattatcgtttaaattaaaaattaaaaatacataaagtgaacgaaaaatattaaagagttgattctctgggacggttggtccctaactgctgtaattcttttggtttgatcacagcgactgtcatccaactggtctgatcagcctccgccgcccgatcagttgggtcataaaagtgtttcgtcgccctcgatcacagcgctgcacaaaatgccgtgcaactgcaactgatcactgcttccgatcgccgatccgttgctgctgcacctttgccgatatgggccataaccgttctgttgttgctgctgcggtgccttttgcttttgctgctctttctgtttctgttcgtgctgtaccaccaccgttttccgtgccgccgttcggttggcatttgccgaattgtgtctctccaccacaacacttaaactcgtgcgccttacatttggtggtggcggtgccgccgcgttcagcagaacctttaatatcaaaaaaggcaatttgtttattttgtttatttattattattattattattgtcctttttttattttttgcccaattaaaatttaattgacctccttttctgctgctgcttctttgttggttttgttcttgttgttgttggtgcaattgttgttgttcacttccgccggaaatgcccttagcacaagcggataaggggcaacgattggaaattttgtgccgtccgcgggagtgccgggactcccctgctgcacacagctggacagttcaatctgacaatgagcatttggcaattcttcaaaaaatccattggaataaataaacatcggaattcaaaattctcagagtaaaacaatgcgattattacaggaaataagagaaaattaagtgtttctgatcactcggatcactttagctgcgcccttttggtaatgttgcccatgtcatataccaaaatcagctctcgcgccaccccagaagaagcaaagccgccgggaaaaattatattatcctattttta

SEQ ID NO: 16267 - DNA, 2231 bp, Heterodera glycines
attttaatgcttttgtaatcgaatgacaaattgcccagtacgaacaattcccaccaaaaatgcaaaattagaataaaaattaaaaatattaattaaaatgttcaaatttatttatttcgtcgatctttcttttcacattcgctttctcttatttccgtccccatggaaagcgtgggagtgtgtggcgtgtgtttgtgtgcgattggagaaggaaggcaccgagggaactgatcaactgatcagcattgatgttcactgatccacacaaagagaggcaaaagggcctttggaggggggggggagctaattggacaaaaagcttcaaaggtaaatgggacgggaggcaaaagcatcatggataaatgcagccgaggtgatgctggggtaatcggcaggccgagaggccgaaccaccactctcggggcagatcagtggggcaaggcgagaggcagagagtatatggaaggtggagagcggaaaagtggaaagagaaagcgggtccgatctgaacattcgagaataggaacaaggagcagagaaaacatagtgaaaaggaacaaaagaaagttgcgagagagagacagagaaaggcagagaacggaggagaatacagcgagatgaggaaggatcaacaaacggagcagatcactttggatgaatgaatgtgttgagtcttctgtccggatttgcttatcccgcagatattcctcccccgttcatctcatctcttcctctctcgaacatttgtcttccatgaccgaagaaaaagagagcataaaagtaagaagagagcgggaaggaaagaaaagacaaaaggaagagaaacgagaggaaaaacaaaaaacagctaaagaaaagagaggaaaacggagaaaaacagctaaattcgtccacccaacaacacattctccaatttgcccatttcccacacattttgaggagttcggctcgacaaaagccaatgtttggggatggccaccacaaattggccatttgaaagctaaagaaacagaggaataagaagcatatggaaatgttgagagcacaaagtgaatctaaaattgaagacaaacggcgaaatgcaacaaaaaaaatgagagggaaatttaaatgcatggcattttgggaagttgattaaaaatgactgcaattaaataaacccaaagcaaagtaaatagcctgcaaatgaaaaggaaagtattgtattctgctggataagaaaagggaggtcggatcatttgagggtcaaaagtgggatggtcgaggattttggcgtttatcctatattttcaaattgcttttagtcgggaaggggggataaagttctccaaaccaggaattggttctgccttccatctaatcctaaacttctgccgtttatatggccatagccccaggggaggggggagggggggggaacgttcaagcagcgaaacgggcgaccaaaacgccgctgtttttgccacctgaggcggaaataggaaaacttttgacgccatgggcaattggtgccctaaacaatgggaaaagcggaaaaagtgaaaagcattgaacaaaaaggcatcaatcttcagctgaaagaacaaaaagaaagaacctttcagcaggtcgaagtcttctcaaagaaccaatcaaataaaattcattcacttttttcgtttatttatttatttatcctaccgaatctttcatccgttaacatttgttcatttgttttctttgccgccctttgcccatgaaatccgaccttttgtcttgctattgtttagtcatccattcttttattgatgccacatatctgagacccctttcattgagaatgggattaggccttataaagtgagagaaatttggcaaattgattgactaaaggcattgttgatcgatcagagataatttggctgatcaaattcccaaaaattcctcaattcattgcattatctcattttgttgatcattttttggttgtttttctatgcaaaagccgcgatcactgaggagaatttttggaggagagaaagggtttaaaaagaaggcaatgagaaaaaatagaagcgaaaaattgactggataaagagaaacgaaccaattgggtttggttttgtttgatgagtgggaaggagaaaaactcatcaaaagagggaggaaaagcatcggacaaaaagcataaacaaaattagggaagcaaagccgaaaatgctcttcaaaagtcaactaatgaatgaaaggaa

SEQ ID NO: 16268 - DNA, 2511 bp, Heterodera glycines
attgatccctacttgctccctctctattactcttctactcttatgacacttcctcacttccctcattcacattcaattaaaatcaaaaacatttgttttttaatcctcatctaatccaattgattgacataattaaaatgttgtttttttggtacaatgtcatccacttactcgttgcacccgtcaaagaatatgccattcaattttcgttggtttaaatattttccaaaagttcatcattcgaaaaagatttaatttaaaacatatttaatttttttttaatttttagggagtcgtaataaatcctaaaaaccctaattatttatttataacaaaaatgcaaaaacataaacaaactaaacatccattagcatgttccgatggaaaaagttattttaaaaaatcattaaaaataaaataaataaatgctttcagttaaccgtatgtcatctctagccccgtttaacgagctgaacataataacgggcgatcgtcgtgtaattttgaatttattttaattaataaattcagcaaaatttattaaaggtgcgccaattgattgctaagattgagagagaacgggcaaagaatgaagcggtgagtacgtaatgaaaaaatgcctaataatcattaattttatctcaatttattaatatgccattccccatttcttagaattgtttaaaaaatgcgatcatgttctgcttcataatttgcgcgtttggcattggcttgactttgtttgaaatcgggagtcgagcgtttggcaccgcagcgtcggcattgagcttcgggctttccattggattgtgcattagcgattcgcttttcccacaatccgtgccatccattacggtaaagctttttaagaagggcgttggatttccgatgaaattttagaattttggggttgttctgcaattaatttctcctttgtcccgtcgttagatggaaaatgttatgaatttattccattaaatttttctttagaccataccgaaaaacttttgataggatttttggatccaatgacaatgattgttaaagaaaatagtgaaatccaaacatgcaatgagggacaatttaaaacccttttactgaacaataagctcataaaaataaaccaattaactggcaaatatacttttattggagaaccaactatttataaaatcgatcaaaaaatatggggtgaggaaaatttacctatttttcctttacaaattttcaaacaattaattttaacaaatttaacgaacaaacaaattgacatgctggaaatgcttcatgcattccgtactagccgaattattgacaatagaccaaatgaagaccgaaaaatttggaattcaaaccaatttcaagcatttacctttcaaaatttaattactgaaattgattggtggaaatatgtaattcgatcagtcgttttagtcattataattaattgggtctacaaaatttataaatggaaacaaaaaatcatgatcagaaaagaaattgaaaagaggaatagtcaaaactttcagcaacaaactggtgccattcaaattccactggccgctctgaaacaacgtttcgttgggggagtgtcggcgcccacgaccgacgcagccgagatgccagagaatgccgaaagaattaaatgccaaaaacagaagagacggaggaaataatttttgaacaaatttgcatttaattatttattaatttaaatttcattctccattttattattatcatccatatctttcatcctttgcctttgcgatcactttattcatttatggaaaagtcgttggagacaagaagaaaaagagcgatagggaatttcacagagtttaacaaaaagcggaaaatgtccgtgagcgaaaaaagggggaaagatgaaaaataaaaatccgttattcattcgcttaactttctaatccgttcaacatcttctctctccgattaaaaattatttattaatttcgaattttcgcaccgtaataaatatttgtcaccgggacattgtttgaaggttacggtaggggaaaatttggtactaaaaatcgtttcaccgggaaacgggaattggtccaccggggacttttgaaaacaaaatctgtcaaggggttggcccaccggaaattaaaagtgattggcaaactctaatttgttccaccaaacaaaggctgattgattgattcattgtttgattcttctactgtcattggacgaactgacaaaagagaacagcggacgaagagcggacttcgacacgtggcgaccctttggccattgcgaaccgaattgtttaaaggtggacaaattaatttttgttaaatttctaaaaagctagttggctagcaaaagattaaaatgagttcgccaatattggatataattcacgggctagtcaatcggttagaggttgaattaaacagagatattccgataaatcccggtcaaaatgcaaccccaaagaaggtacaaagacatatgtacagagcaaaaaatgcgtgtgaa

SEQ ID NO: 16269 - DNA, 2644 bp, Heterodera glycines
gtaactttcaaggaaaaaatttcaaaaattgttcactgatgttgcggagcatttcaaatgaatcacccacctattttgatttatgcatacaatttattacagaatctctgaattttataaaaattctggcgtatatcactggagctcattcgtgtcggaaaaacatttataaaaagcgcattgataaattgcaatccaaataaaccatccctttgtcggccattcatttcgaacttggcgcttttccacatcgttggcgtaacgaagcggccaatttgctagagttttcgagactttgctcaaaaattaattcgcggttcattgagtcaaggatgctaagagataattaggagttaattaaataagaattaaggttataacggacaataaatgagttaaataaagcatagtaaaatgcaaaataaattttaattgatgcttaacattcaacttagtcggtttgttcaaaaaccgggggtagcattttcactatgaattccattttaccgattggccgaatggcaatcctataattgatttatctgatcagagagagcgcagccattgcaacaaaattaaatatattaatttgaccgtccgtgtacactttcttgccttagggacttttatcaatttagaaaagttcggtttggggaaaatatgcatcattttccccactttaaaattgctgacaaaattctctaccgaaaaaattttttgctccaatacttttgcacctgactgtaagaaagttccaaaaataaaaattttcaacgattttaggttaaatggcaactgtgcacaggcaactcttacaataaaaaataaaaataagcctaacattaagcctcggcctagcctaagccaatgtacgagttgcctttgtacgatacatggcttatttttgtagacaaattttctaagtaatggaaaggacataacagaaagtgattattatttattagagtagagcgggaccgggaattttgggcttaaccgggaccgggaccttttcgggtttaaaaaacgggaatttttggctgggaaaaccgggaaaaaacccgggactggtcccggtcaaaaccgggacctcggtactcagttgtccgtgttttggtcccggtcccgctctactctattatttatgcatgctattgtgagatgaattcaaattattacgcatttaatttttcgaatacaaaaattctgaaaattttggcgtaatttcacggcaaagttttgtcccggtgtaatttcggccgctgaaattttgtcctgttccgattaaaaagattttccagcggctttttttgcaccgcctaattttttttgaaagcgtcaagatcctattctggctaattaaaagagcaaaaccccactcaatttctgttggcacttcgttttctccagttggacttccccaaatgcaaagagttgctgccccggcacgagtattaggccacggatttgtgctggcgcgacatcggcccaaaggcaccggccgagacgggcggaagtgagcagaatatgctgagtactcagaaaagtccttccgccttcgctgatgctgcccccgaacagactgcaggaactgattaagcaatgtcaattaaatgccgcaaaataagcacctgtttttgacactcattttgtcaagaaccaaaacttcttgcatttattaatgccaatcaatttccattgcccgaccattcaagtgtattaaatcactccgtcatcacatttctccgttacattcagtaaattttctaatctgactgggctgaatttaaatcaattcaacttggccgttgcccggccaaattcaactgctggtcaagcgttgtccaaatggttgcacacccaacgaagtgatggacagccgaagcaattggttaagcgtttttaaattttttcactgacagcgacccaagtaaaagtaaacacaccgtttcaaaaaacgagatacctatcagggatgtgcctaggtttcgcttttcgcatttcgcctttcgcattattcgcattttttggcgtttcgcatttcgctttttggcgcgaaacgcgacttttacacccctaagaattggattaaattcccataaaatttttcaaaattttacctataaattggctaattttcagggaaaacctgtttataaatgatcaaaatttccaattttcccccggcggcgcctatcggcaccgccgcgccccaaaactcttatttctcattaaaaaaatgataaaaatcacaaaatttgatcattttttattgaaaatctgtcaacaaattttaatcaaattttcaaaaattttcccggcggcacctgccggtgccgcctgccccctcttcccaaaaattttctttggaaatagcgcgcctcaaaaaagcgttttattgatttttaaatttggaataaaattttaaaaaatgatttttgctttatgattttaactattaaaaagttgtagaaaaaatttcgcttttttttcattttgcatttttcagtttcgcaaatttcgcttttcgcatttcgctttttatttttcaatttggcccatccctgatacctatgtaccaataaatagagagtaagtgcatagaaaaaaacatctctttttggcgtactatttctttatctct

SEQ ID NO: 16270 - DNA, 1950 bp, Heterodera glycines
cttaacttatcggaccaatcctttgcccgtggcacctgtcgcctcagcgttttaactttacatttaaatgttatcccgttttaaattcgatactaaaaattattgaataatttttcaaatatgccatgttaaggacattctgtggtttctctcttccagttacggtaaccgtatcccagcactgtttggccaacaattgctgcccttttaccgtatgatgcccggctgggccatcgttctgtgtttttattttgcaacaacagtcgcttaccaagcctcaaatattgccacttttctcattcagatgaatcgtttgactgcaattgcatttcccctcaaacagaaaagggtttttaattattaaaatattaattaatattttaatttcatccattagatttgggaaaagcaatcatttttgatgatattggcactgattgtgttcgttgtgccattgctaagctgtttgccaattatgaaaatgaacgtcactccaatgcccttcgaaacggaaagcgacggatttttcatccaagaacatgtttcggtatgaaggaaaagcatcggaaagtggaataatcgagcagagaaatatttagataaaaattttgcatatttccattaaaaaaactattcaagctaaaatatgaaagtcaaaaataagactaatctttggcctagacttcggcttacacataagctgagcttgttagttttagctagccttagtctttgcttagaccgtcctagctaagtcaactgaaggcccaagtaaaggcctctggactttggctaaagcataagctaggcttatgccgttagctcagaccgttttaggtccgttgtttagatctatggccactgatacattaatactaactgatgcgatttgtcaacattttccgctttttaggagtattccttccttggctatctcaacggtatgaaatcgcttacttctgttattttcttgctcttgtcgcttttggtcaatttgtcaacgctaattgcctatagaagaagcaaaaaagtgcaccaacaaaattctcaaaacggaagtgacgtcattgagaagaaattgctaatttacgcccttctcacttttgctggccacgcttttgtctcagtttttttggttaaacatattaaattcaaaatatttttaattttatatttttagattattatgggcaccggagttttctatgactatccatcgattgtctacacccaatatccgtggatcaacgacttgtgcactttggtgttgtccagttggatgttgttgttcaccagcagcattttccgccaccaatttgtcaaggacttttgtccaaaatgcatttggccaatgccaacaaacacttttcagacgccagtgacacatttaacacaacaaaatcaaaatgattgccgtttatttgaaaagccatgagcccaaccaatcgaagctgatggacgtacatcaaatagaaattgaggggaaaacatttccaaaacaaggacaaaacattaggaagcagttcagcaaattcggaattataaaacgaatgatggaataaatgttttgttaacttttgcattttacgagattcctttcttaacttagtgggttttttgaaaattctttcttaatttagtttaatgcagattagattcccaattagtaaagtgggttcctcccagtattgttgaaggttctaattcccgatcctgacgttttgtaccaaagaatttctgaatttacatgaaaaatgccaaaatatttacaaagcattgacaaaacccccaaaatattgaaataaattaacttaaaaagtttacacgtcttcaaagttttgaccttataatttttcaaataatggcaataatttattaggacaaactttgggaagcagttcagcaaattggaattataaaaccaatgatggaattaaatcttttgtgaac

SEQ ID NO: 16271 - DNA, 1513 bp, Heterodera glycines
tgtgacaccgatcgaaagtttccatttgtcaaaaaaatgcgatactgagaaaatacggcacaaaacttagattttttaaataatggaaattgatttttcgaaatttcatcctgaaaatgagaatccgtaccaacaaaattttcttgaaatgaaaaacgttctctcggtgtcgcatttttcagggagccattcccgatcttggctttttgtaccttccggtcaaaaagtggaaagctgtctatttttttaaatttatcgcattcaccttcggtattctattgaagtaaatgtaaatataaaactttattatttgaaatttcaaatgcatctttttctttcattcattcatttcccggcactattttcgccttcgcatgccaatccagcctgaaagtgaattgaagttactttggcgttttgcccacaaatccgtttccaaactgttcgggttgaatccgaagtctttcagcggcatgtacgcgtcacttcccgttgtaaatagcggcttcgaaaaggcggccaaccagttgttgttgtcttggcacgagaccttggacatgttcaatttcaatgtaccgaaacatgctttgttatggccaagagtcccgggccctctgatcatttaacaaacgaattctccgattcgaagaattacggtctcgagtttatgcgccattagctgtcccgagtccgaaaaatcgagaaattttcagtctcgaaccttaattattagggccgtggttttttgttacgaaaaatctcgaaataattaactaaaagagtgaggaaaaatgccaaaacagtgacaaaaagtccgaaacagtgacgaatagtgacataatttcaacctttaggagtgtaaaaatgtattcaaaaagtaactaaatcaagcaaaatcagtattgagataaaataatttttaaaatcaaaaattcttgtccgcaaaaatttttcatttcttaggggtctatttttgaaaattttatggtcattcttaggggtatgtttttctgaaataaatgtgttttttgagcgcttttcttcaaaataattaagcaaaaaaaaaaaaaaaaaagttgaatcactaaaaatcaaggccctactaattatgtacagccgtgctggacgaagtccgaattgggcaaataattatatttaatgatattttatgaaatgttaaattaactgttgtaacaagaaaacaaaatacaaaggttgaaaacaaagtgcccgattcgcaattaatagttgaaaagtgtcaatcgagagatcctacagaatcaatctatataattggaactgaagacaattttaaaatatattcacaagataatgaaaaaaataatgatatttatctcatatgtaaccaatgccggtaccttcaccgtaaagagaaaaatagagctttgaaaaaattgtgattgaaagtccagaaactatattgcttgaaaatgtggcaggttcaacaaatacagcagcagctaagggtttgaatgcattaaaatttttattt

SEQ ID NO: 16272 - DNA, 2230 bp, Heterodera glycines
  misc_feature (16)..(16): n is a, c, g, or t
  misc_feature (2193)..(2193): n is a, c, g, or t
caataacaagaaaaancaacctgcagtccacagcagccaatagccgacataatggacgcgttgtgaatcttgaaaataaataatttgaaaatttatcacaggatatcggggaaacaaataaaatttatctctatggcaacatttgttttagggatacagtttattgcaatgaatgtgaccaatttcaaatttgcaaaattgactgaccactttcaacgggacgcccatggcgcgtgcacggagtaccaactcggcgtgggtggtcgccccgaacgggtcgccgacgacgagcagtgcaatgtcgacggagcgtgactggtcaagcagcgattctgttgggaattatgtgatatttgggcagtttaaaagacaaaatcctgccggatttcggatttcccccaaaaacttgccattagtagaaatagtcattgttataattgggacggctgaccaatgcgttgttccaccaattctctgtccgcctcaagcacagtgcgaccgtacaactgctccaggttggccacgctcagcccatgggacagcatgctggtgtaggactccaggaaaaccttggcgcaactgcggaccgaaagatgaaccaaggaaatttattggaattcacaaaaaaaaatgacagtgacagacaagaaccccgtattgaaatagtttgttagatagaatatattacccgtttgatcaattttcgtatgaaaaatatcaaaaatcgaattgaaaagcgttccttacaatgttcagtccattcacggtgatatcgcccgcgtcgccaagtccaagtccgatcaggtaaaaaaccatttggcaatgttaatttgcagaaatgaaaataattgggaaatcctaaaaaaaagttaattacaatgttttaggcttatattaattcaagttaatcaattaataacggtagaataaattgtgcaaaggtcagcatttgatcagttttcaaaaatgaattaaaaatgtattgcaaaaatggaaaaaaattaaaataaataaaaatttgggattgacaatgataaaatcgctattcgcttttttgatcttgccgatcaacttccaccattctctcttcttcgggtgaataattgcgcacaaattggatgatcagaaatgtgttgatgccaagaaaagtgagcgaagcaaaccaaacccaattgagggtggcccaaccacggaattcatacagataggcgggcaacagccaaaacgcctggccaaacagccacagagcgaacagtttgagccacatttgccaagaaaactgagaaaatgatgccattttagaaacacgttttaagaatttgtttaggaaatgggagagtttgatccaataatcggggggggggggggggctcaattaggagaaatgtggcaataaaaacaaaattagcaatttaatttctacggggcctgcctttagacgagtgaagagaagcggcacaaagcacaaataccacacaaagtattgcgaggtggacactttgttgaaggagacgaaagcgaacgttgtgaggaaccaacagaagggcaaatcgtcagaatacctgaagaaatttcaaggaaaataaaacaaattggaagaaatcagactcaaaattttacaaataaatgtttcttaattaggctaaaaaaaagttcaaccaaaaaccagtgtatctaaaatcattttattggaatagcgaagcaaatgaatttctgagatttgttcgattttaaataggtttttaatgtcccaattttacaaaagttaaaacaaacaagagtggaaataagcaaatattttataatttattcggcttacattcaaaacaataagatttttatcatattattaaggcctgttaatccaaattgcgacacaaaaggattttcaattctaaattactcaccacaaagcaaaaacgcaaatgcaaacaatttgaggcacaaaggcaatcagtccgatcagttgggtgagcgacgggctgtccctcaccaaataaagcggtaaaaaatagggcgaaaaattgtgacggatgtccacacgcgacaaatggtaaaggaaagcggcattcaaaaaagggtggccataaagggcaaaacagaaagccacagacagagcaaacgatgccaaacttatctggaaaaatgccaaatttgaggcatttttagtctaggaattatttgtgcaattanaaaagaataaatgtgtgtaccaaaatgaacgcaaaac

SEQ ID NO: 16273 - DNA, 1230 bp, Heterodera glycines
tcaggtccattgataaatatcttaattaaaaactcttcctttgaaattcagaaaattcaagcggatcaagtttttttacgtctcctgttaaaaaagtgcctcgagatgattttgcatctttttcggacatgaaaaaggcccttcaattttaccgttcggctgataaggggcatcgttcattatcatgtatgaagtcgcattttcgatttatcaaaacagaatcagagctgaaaatgctccgaaggtaaattacaaaatttaattgaaaaaaaattaaaagttaagatttgaaacgaatttgaaaagtaaatagcaataattatggcgaacaaaaaatatattcacgattttttttctcaaaaaaattttgcaaaacaatacggttcccccctttggtttttgataaaactcaaaatttgtcaatttttaactagcgctaaattttcttttaaaatgtttttttcagtttattaaatagtatgcaatacgttctatgttaaaaaaacaaattctgcataaaaaaacaaaaaaaaaaaattgaccaaaaaaaacgtgcaaaaaacaaattcaaaaaggccctctttgcaaatagcgcccaaaattttcccctttacttcatattaaaaagtgaattttttgtttagtttcttggtctccgccaaaacttgttgacatcgttgaatgcgaaccttggccggttgaccacgcttaccgagttggagctgtacgataaccaactgactgaaattgccggcctcgaccagttggtcaaccttgtgatgttggacatgagttacaacagaataaccaaaattcaaggtgactttgcattttaaataaatttttaggcaaataaattgtcttttgctcaacattgacgcatttttttattttcgatttctctccgtcatttgaacaaatgttaaatttttttaaaatggaaattaaatgcattttaagggctttccacaatgacgaagttacgccgtctgttcctcgttcacaacaaaattaaacggatcgaaggcctggaaggtttggacgcgttggaactgctcgaattgggggacaaccgaattaaggcgagtttttaatccatcaggaaatcaaagtttatctcaatcagtcgccatttatattccctccccttccattcaaaaaaaggtcatcgaaaatttgtgccatttggtcaatttgaatgaactgtttgtggggcacaacgaccattca

SEQ ID NO: 16274 - DNA, 2548 bp, Heterodera glycines
aaaaaattaaaaaaatttaattttatgtccaaaattaaccttttagtctgctttagcctgagttaattccattgcattgcttaaaaaaaacaaatttacatgacaattggcaggggtccttaattgcattttgctcgctctaaaatgtgttgaagactctcacatacctgcgctcacgcttacgatcgcgatcatcctcacgtcccgaccgacgacgacgctcctcccggtccttgtcatccgcgcgtcgtttctccgaccgacgctgatcgattgctttctttaagtttaacatgtaaattattgagtgcttaggacacgagccttcatttcagcaaaacggtctctgatctcaaccattcccaggtgcattttgcccccgtaatggtcctgcagtcgcgactcgtggtccatgatgttcagttgggccccgcatgcctcgcacacgcgcaaacgctgcatcattgccgggttcatgttgcgcatttcgctctccaactcgcgcttcttacgctttaactcgtccacctccttggaaagttcgatagactcggctatgcgcccttcgttgccgagtgcctccacttggaccagcgccgttccgattttctcgttcatctcgaagactttctgggtctgaaaatgagtaatgcttccactgaatcacagaattctatgcttccaaatgtgaagaggcttcaccaccacaaacacgtacccgttgttgctcactaatgtccatgttctgctccgcgtctcgcttcactttttcctgaagacgacgaatgtcagcgtccacaatgcgaatggcatcatccaactcctcaaaagcctaaaaagcggctttgttcacttaaaaactaaaaaaagattcgctggaaaatcgacatacgaaaacattggaattgcccactgagataccctcattcacatcagcacagaattagcaattcaattaaaattgctacaaaaacatttagttgtctgacacttgtctaaagtttgacttaccatttcgctcaaacatacatatttcgagtgggtgggtgacaattttttgagtccgataacttaagaaaatttctgtggcagtttctctttccaattaaaaccaaatgtctttagtatgcggtacctaagaggtcactaaccaaggcctctcaaggtaagtctaacacagtccaatttgccaggtcttttaccggaagattttggactttacagcagtgacagtcgcgaatttggcgaaaatatcagttaattgtaaggaaacaccggaacagacctggctatatttcagagttcgtgtcatttgagaaggttgtctttctttttcaatatgtcaatcaaaaaccaacctcgatgtcatagaaaaggtccttcttctcctgtgcacggttgaactcgcccttgtgagccggttcatgcaactttcgacaggacatcatcgattccagcctcgtatcggacaacaaatcgcgaggacaacacccaagcaaataggcacgacacaccgaatgatggtcaaagggaggcagtcggcgaccctcctcctccgcacgttgctggcccatcagctgaaaaagtgtacattgttaatgccgaagacccagtccacaacctgtgcaatcatttcacgcattacatcagtcatttttacgaattctctcccttagatagtaattgtaatgcaaaattggaaaagtccgactatctgtatagacaaaagtataatgatgaaagttatttcctagtgcccaggaaaaccacaaacttctccgaatacagggcgaaaataagaaattttcccgaagtgtaagaaattcccaaaaatgagttcgtttcccatgtacatgtgtctttcaattttcgtttgaaaagtgcgtgtgaaatggaaacgacaatcactttttacccttttcagaataaaaacagttttattaactgtgatttcagcgcggtttttatttgtcaaagagaaccgggtgttagcttttgacaaggaccacagcactgtcccgttcaaacttttattatctgtgttggagtacaaaacggcgatgatgtgcaaggattttgacagtcgatcatattttaaaaagcatttcccgaaaaccttccctttccccggttctttttccttttcttttctattaaatttttttttggcgtattatgtattaaatcgttaaatttaaatttaaataataaaggggtaaacccaactcatcctaacccaactcatccataccagggatggagttccgaggcactaaaaattttcggaagtcggaagtcggaattccgaggccccaaaaattttcggaagtcggaattccgaccccaaaaatgtcggaactcggaagtcggaatttttcaaaaaaaaaatataataaatttttaaaaaatatttaataggctaaatttttaaatttttaaccatgtaaaaggtaatttcaaactgtttttagtttatttctatattttttaaaaagatcaaaatatatgaagtaattttacattattttggattttttttttgggaaag

SEQ ID NO: 16275 - DNA, 1595 bp, Heterodera glycines
atatttaatggattattacgaaccgctcaaatatgatatgtacactggcaaaatcagtcccaaatcatttgaaaattttattaaaaatgccaatttatttttaaaaaatagaaaaatttacaaaaaaaaaatgaattttatgttttccaccataaaaaaatcattaacaaacatatcatggcagcaaacttttgtttgaagaaaaataaataaaaaagtggcggagcaaaagccattagggagggggggggggggcaaagttgacattgcatggatgcttaaccgggcccaagttggcggcgccgccggcacacggccccgtgccgttgtcggcggtcgaagccgtgccgtgtgctgtgtgccgtggccaagtgtaattgttgctgggaagccccaaaaatgggcggacgtcacgcaaatttggacacattgagaaaaattgaatgcgtgtgtgcgtttgaaatggtaattaaatacggcaccaatttgaaggggccaaaaacaaaaaaatggcaaaatttatggaaaaaaaatttgctttttttattattagaaaaattaaaaattattttttaattaccaattttaattggaaaatgaattgttgttaaggtagaataaaaaattaattgatttaaattacttttatttgaatgatttaaaaaaagattaattaaaatataattagtgaaaaaataaacaaatttatttatattgtcatgtgaaaattaaatatttttacttctcaatattataattagaaaagtaatttagctgaatggaatattaaattttaatttatgtatttgtcaaagacttttaattcatttttattaaaccgatttaaactcttttaattaataaattaaaaaattttcaaaaaaaattcacagaaaaacattccacggcatggcacaaaatctgcgccatttttggtccccccgtgccaaaatcgatgaattttctgggaaaggatacgcttggagagaggtaataacgaagaattgaataacgccgtgtgctatgaatgagtgcgcaaaaatggccccctcctgccccagggcacgtcgagacccaaatccaattagcggctttttgcctcgggaaaaaggggttattagacaaaagccggcacacacaaattttttggcgggacgtctgacgcgtgccgttaatgaatggactattcaataagttctgtggcataatgtttcaaagggtatggaatgccaatccaaagccgatgatgatgatgggatgccgaaaaacagaaagatagtgaaaatgccaaaatggtgggaatttaaaaatttatagagtgccaatgaaattcttcaaaaaaaaaatcatgggaaattggcagcaaaatgccacagaatgacggatttaaacatttacacaatgccaatggaatgcaaaaataataaatgccaaaaagggtttgaaatgtgccacaatttctgctttccgatgatttttgaaacgaattttttggcaaaaaattgccaattttggcgcaattttttcaaaaattccgacccaatttttaactctccagcaaaccacaaaaaatttatatgctgcggctactcttg

SEQ ID NO: 16276 - DNA, 950 bp, Heterodera glycines
agcgcaatttaaacaatggacggaacggcaaacggcacacaatgccaacaaacgtaaaaaaataaataaattcgccgagcaaatcgagaccatgtgcaaataacacactataatcatcataatggagaacagagttcgtcgtctgtcccggcatttttggcacctaataaattttatgtgccccgcggggcggcacaatgtgagcaatgccatgccattcgttggaaaaacggtgtgtaaatggacaacgactcatgccatgctatgccaagcatgtgccgtccgtcgtagagttgcaagcttgcggcggaatgggaacggcattttggaggtgtgccaaaaattgaaattgcgggggcgttttaaaaatttccgaaaaaattaccaggcctaaaaaataaattgctagggtcacaatgtaaaaaaaggctgttaaattaaattaaattattatttttttatataaagaagcctctcgaaaaatataattgatagatgaaaaaaagattaaataaaaaattaaatgaaaatttacaaaaaatggcatttccaaaagttttttgcgcccaaatgatcgaaatgccaagagctcagaaaaagacataaaaaattattaaaaatgctgggcgttttccaaaaacctccaaaaaacaaaacaaaaaatattataagtttgtttaaatttaaccaaatggttaattctatacctaatattttatatatatttgcctgcaaaatttcaaaaaatttcgttttaattttcataaatgttattgcacacaaaaaaaaacggttttttgaaaagatttttggtcatatttttttagaaatttaacgatttttttttgaaattttgcaggctcaaagaaaacacttaattcaatggtgactgaacatttgcgcaccggcacatttgcgcccctaccatttgcgccccgcaccatttgact

SEQ ID NO: 16277 - DNA, 2567 bp, Heterodera glycines
gaccgacgtggtggaacagctgaacaacgcgaacattgcaaaggcaacgggctgtgtgaacaacatggtgttcatcttttttctatttgtcttcatgacccaagtaaagtttaattggaaaatattttgatttaattaataaataattaatttaatgaaatactcaaaatgtttttttaatcaaggtctgtattttttgggcgatgtatttgaacatcccagcgcgggggattcctcttccttctcgtcgtcgtcgtcgtcccgtggttcttcatgaggaaattgggcgtcctcttgaggtgattagctcgccgcggatggtgagtgatttttcccaattgatatttaacccggtaaacaaccatttttcagcgctcaccgggaggcgaatcgaatacgcgccgcgtcgctcgggtaaaggaaggaaggggaaggaatgggaaagaaagagtgcgggatcattttctctactcaggtctcgacttcgccaactcgctccgaagacagcgttgtgacggtcaaaacggtgagttatattttattattgctgagacaaagatttttttttgatatttagcgccaataagcaaacaaacgctgcgttgcatgaggaagatgaaataattttatttaaatttttgaagaaaaaaatcagtaataattttatattaaacagacgatcaaatataatattttatatttcttttaaaaatttttatgattttttttatcattatattatcaataaaatattgggaaaaatatctgtaaattgtaataaatttaggtatgttttttatttggcattggttgaaatagaacagttaaatgatcgtaaattaaaataattgtgttaccaaacatccatcctttgcgttggtcatgtcgtcattctttcaattgttcatctttaaaaaaatatatataattatatgaaataaaagaattcataaaaatcatacctaaataatccaggccaaaattagcaaaatgatgaggataaagcaccaaaccccatatgctgaacgcttgcgttcaaaaagaatgatctgaaatattaaaaaaaagctaaagattgatataaaatattaaaataatatgtacctggccaacgtgaaaatgtcgtacagtaggtttggtgcgtttaaacaaaggaagattcatgggacgtgccatttcgctaaattaaaaaggggcacaaaaaaaaggaaaagggcacaaaaaaagggaaaaggaatatgagaatgacgctagacgttggcgagatatcatcccaagtgttttccgttctcgactgatgacccccttttcgttggtttggtccatcactcgagaacgacaaacatgagggaccatcttctactatgaataaagtaattattgaataaaataaaaacgggcgggtgacagggggggggtgaaggtatataaaagtcgagaaatcggatcattctaattcttgacaatcttaaaaatgagcattaattatagcgccaaaaagcttctcatggacaacattttgcccgccgtagaaatcagccaaacgtccaatggcattacgctgatcagcgagcgaattgcagtgcctcgaacaattccgtatgacatcgttggcaagtgtcgagaatgcaaagccaccgaatgcgagaccgagtggtgcatttcaaaagaaggcgtaacaatttggtgcacccgcttcaaaattaatcctcgtttcgttccgtttgattatgtttatgagttgccaggctatacctttttcaaggttttaaaatattatatgatttttctttaaaaataatattcagattcgtaacaaaggccgagtttttaatgtcgaccacggtttccgctccaatgtttgcacgcggaccgagactcccgtctacaatttaccgcccccaccgcctccgcctcaactaaagccaaagggaaatgagcgaggaacggacgagcaaactacacaaaaattttttgagtctatcacggcagctactacaggattggatgttcctcaaaagaagcatggagaagcaaatgaattttttgatgctcttacggcagcaacaatgggaatggaagtcgacgaaaacaaagagaaaaaagcgcttccacaaccgcagagtaatgcctccgatttcttttctccgatttcggcagctactatgggaattagtggcgaccacctgaagcccaaaccgaaactaagacaacacttgccaagcgcttcggatttcttttctccgatttctgcagctactatgggaattagtggggaccacctcaagcccaaaccaaaaccaagacagcaccagccaaaagcctcggatttcttttcaccgatttctgcagcgacgatgggaatgagtggcgaacagaagaaagacgaaccaaactcaaaccaacaaaagaaagacattccagaatttgcttcggccatttctgccgccaccatggggatgagcaattacgaactacagcagcaacttccggttgaaaaagataagcagcaaacggacgaagaaattcttgatgaatttcttgagagtgtctccgctgccacaaca

SEQ ID NO: 16278 - DNA, 1397 bp, Heterodera glycines
tgcttcttctccgtcgcattctcctgttgttgctgccgtttttgtttacggtcacgtattgccgcttccagttgtgtttttgcgcttgactcggcttcgttgatcagcaggtggtaggtgagctggatttggcgcagctcagtggccaatttctcactgccttcgcccaatgcgcgatgcaaactggtgagcagttcgctggggtttcgcactgtgctggccgggacggggatgcgcacctgttccccggtctgccattcgacccggacaaattgctcctcagttgtgcccagagagggccaagagtgtgggtacagcagcactgccaaccccacgctccactgcgagccgaactgtagcttgcgtggcaaacgtacgcggaatgagttggtccggttgccctcaacctgtgtgtttgacggtaagacaatgtagaaggaggatgatgaggacatttgtgctctccctttctaccttttttttttgttgttgctttgcgctcggtttccctccccctttttatatgattgatgtggcagggatccagctgttgtgcgctgcggagtagcccttccatttgataaggcaatgttccacgccgttgcgtccttgccgtcgccttttcagcacccgttcaatgtcataaacgggaccaacgacggcggctgcggcagcagcagcagatgcctctgccccttgttgtgttgggcgctgtggtggggctgggggcgggagcacaaggcacaagtcttgtgcgtagaaccagccggtgagcagctccccggtgtcgtcgcgcaatttatacgtggtaggcgtacgtgagtctcgcacctctgccacagtgaacacctcatcggtgaagcgtggcaagtagccctttttgaacacatgcttgtgcttctcaattcgcacacggtctccagcgttgaagcgtggaggccgcggatttcgcccacgcacatgcttgctactctccagttgctggcgtcgaatttgctccgcgttggcaaaattgacgtcccggggccgtagcccagacagggcacgatgcggagacgcattcagcgccgacaccaagtgctgtatcacaccggtccagcactgggtgccacggtgggtgaagtatcgatacagccgctcctaagaatagaaaaattaaataacaattgttttttcttgtctataccaccaccttgatgctgcggattgcccgttccgcaatcccggcgtgccactggggtgaggtgtgcatgcaatggtgttgcacctctttttcgttgaaaaagcgctgcacgggggcggcagtgaactctttgccctggtccgtcatcagcttccatggcacgtagccgacacgtttgaatatgtgctcaaagcacggatcatgtccactgact

SEQ ID NO: 16279 - DNA, 1972 bp, Heterodera glycines
  misc_feature (1950)..(1950): n is a, c, g, or t
gtttgggctcagcaaaatgatacgtgagtaacgtatccaaatcactgttctgatcgggacggtacgcgccttgcatcagccggtacacctgctgtccatctccgatgcccagcgtgcccgcgttgcgtaacgcatagtcaatggcttgtcgtttcctctgctcagtgtcgcgtaaggctgctgctactgctgctgctggtgctgcagttgctgtcgatgttgatggatgcagttgcacgtccgcttcttcccgctgtcctttccttgcggggccaactgccgccatattttggggtcggtcgtcgttggggctgtcttcacgctcagtcgtctcagctcctcctcttcctccattatcagtgcgtgtcaacaaggaggcggcagacgacgatgacgggaagcggctagcttcggcgccatccgtagagactgatgtcgtacggggtgaccttttggctggtcgttgtctgcgacgtggaggctgcctcattggtgacgaatcagagtgcgacgactgctgttgttgttggtgcggcgccggctgttttggttgaggttgttgttgttgttgaattgttcgcgccgcctcggaaagtgcatcgcgcagcagccccttcgaggcttcgtcggtgggcagttgggtgagacgaacaggcgctggacgctcctgctcatcctccagcaattttttgaacctcttgaactcctgttggtagtggatcaaccgtttgtcatcgttcagaaggtgttgttgtttcgatgccggagatacgccatccgtgctctgggtgacgccgccgctgtgtgcagcgcgcgccatgcgctttgccgtgtgctcaattggcgtggtatgctgcggtaagccgcccctcgcagaggatgcgtcggcaacaggagccgagctcctggccaacaaggagcggtacagttcctccggtactaacagcatgcgggttgtgtgcttcatgtttggatgatgctgtctttgcggctcatgagcttatccgccagcagtggaagcacaacgctggccaccaagccagccaaggccgggacgccgcgcccggtctgctgtctcagcaacagtcgacgtgccccgtggccgcttctcgcacggcccaacgcacgcacgtgttgggcctgagcgcgcaagtgctgaagatgagtgctccggagcgggacgcgtgcacggagaatgttcaacgcactttccaccagacacaacagctgctcactgctcgcccccctcaccagctgacggtaggcacgtgcgcgtgccgagcgacagttgctcagttgcttgaaaaagctagtgttccgttgaatgtattgacttggtttcggccttttcttcgcttgcttttgttgttgttgttgttgtctcttttcttgttgtattgtttctggtctgtcgctgctgctgttaccgttgttgtttccgcttttatgcttcttctgcattgaacattgctgcccggtctcgtggtgcgtacacaacggtcagctcgcccggatatatatgagttttgaggcgcatctgtggtcgggtggtcgggtgcatgtccaccaacaggtaaccaaacgggtccgctgtcgcgtcatcgtacgcctcgaggaagtggcgcagcgcacccgggaacagctggacgcccaacgagcgtacctgaagtgcgcccgacgggttgcgcatcagcaccaggtagtgtgcattgttacgtgcaatgcgcagctcgcggatgaacaaatgctgcgtgatcaataccacactgacgccccagttgtgtgagccacgtgtgaacaacgtgtccaggaagggagcggcatgccaaccatcagatcgtccaacaccagcagcagtcggccattgcactcgcttgccgcccgcttcactccctcctcgtcaggcagcgcgtgacagacacgaacccatcgattacaccactgctgctngtgctgctgctgctgatttttt

SEQ ID NO: 16280 - DNA, 2116 bp, Heterodera glycines
caaatgaataaaaaggatgattgaatggaaaatgaacttaatcaaaaaaaaaagaaagaaaaaataaatgtttcagaaataaatacaataataaattgaaaatatatttttaatttgaatgattacaataaaaaatatactaaaacgcgcttactgtaagtaaaaatatcttcattaataaactattaccaaccaaatcgaacaattttcttatcattaattttggataattggttttgtaagttaaatattaacacaagaattgacataatctttaagaaatatattagaaataaattacgtaaaatattattttcagctaaagtaccataattcttaataattagtaagtttattttcaaagaaacagcttatctacttagctgtcttgatttgggcaatgtcaattttgaacttaacattaggcgccagatttactattagtgatgaataattgaccggataaaaattcaaatttcattcattgccaaattaatttttcgataaatggcatttttataagtcgatagcagtttgaatgtattaaaatttgtggccatcaggcctgacatctctgcattcatgaggtttggcatggaaaatatataacgtctgactctcactctctcctgattaaataattatcaagaacagcatttcatacatttatgttttacggaaaacattgagcatcatcctaacaattcccatttaatcacatgtgagacactttttcttatgaaaagcaggatcatctagagctaaaaattgtcaatgtgacttttctataaatgtcattttataagtcggtatcagttgaaatgtattaaaatttgtgtccataaaccctgacaagctaataagaacgagccgtcataatgcatatcatctagacttgtagcagtgattcgaggcataaaaccgcttgggttggttgttaattcattaaaaggcggctgagctgcattcccgaaaagtatttctgatgcccatttaaaattcagtacaatcgtaaaaatcagggcattttttatatttctaatgccatttaaaattcagtacaaatcgtaaaaatcattactttttttatgtttcaaattgttgcgactgaacaacatccgcaactgtccgtggaaggaacagaaaggggggaaagggatgaatgatgacgaatttcaaaaaggagggcgcgcaaccaaagggcgggaagtagaacgggtgacaaacaagtctgaggcggacaaaattttattttttttactaaatatagaaaaattacaaaaaataaatctctttcagtatataaacaaatttaaaaaatttctttataaataatattcatgtattttttattacaaataaaaataactcaaagaaaataaataaaaaattacctatccttcaatagcataagccacaaaaaaaaaaacaaacaaaaatttattcataatttatttaaatttaatccaccccacagtaaataaacttgactatttacccaaaattttcaactttttacaatttattatgaacattttgcgaaacagaacaactatagcactgaatttttcaaaaaaatttgcaaattcaaaaaattaacaaaaaattacaagaaacgggtttttaacgcaattggcaatagccaagtataactactgtaaagtggattaaatttaaataaattatattaaattttggtttattttgggagactttccacgaattgtaattatcagggattttatatttctaatgcccatttgaaatttaataaatataatcattttttggtgtaaaacttggtatttctttatgaaacgaaaattttaaagcgaagacggagcaagtattcttcccgaattctctctatttctgttggtacgttaaaaatttgttttcccttttgtttatttttctcgtctttaatttcaaaattaaatcatccctcctcatttatcaaaacaatcccaattatactattgatattcctcaatttgttttaccctttttccaacaacatttcgaaatttcattaaagttttgacgacataaactgacttcaattgaaaaatttccataataatgcataaatattggcttttatgttgaaaatgtt

SEQ ID NO: 16281 - DNA, 1970 bp, Heterodera glycines
  misc_feature (1901)..(1901): n is a, c, g, or t
atgtgaaaaatgtttgccaattcagcgctcttaccttaatatatgattatcagattttaaatcattaatttaaataaggattggataaaccgtcaacaaaaattcctaagaaatattcatataaaatctgcgaaatttttggcattctgtccgttcatattttaaattcatcttctattttggcacatttccaaaatgaatctttttatacaaaaaatatatttagaattcttggcattaacattcgagttattcgatgcatttacctcatggaataataagttattatcatttatttttacatttaattcgcgtaaaaattaataaaattatagaaaattaatttaattagtatcaatgattaatctcaacctaattaaagtgaaaaaaaataaaaattataaaggctaaagaagaataagtgcaaacgaaataaaagttcaaaattcaaaagttaaagtgttttaaaatctttttagaatgtcaaaccaaatgaagatatgaagagatctgaacgagaatactggagtaatgatttaattgagataagtaattccaaagtctcaaacataattcgatagagataaatacaaacaaataatcaattaaaaaaatatatatattttaaatatgtcaaatatatttgatttcatattaaatttacttcgataatttaatagattcttcgttaatttaaaatcaagtgtatacataggcaattggaatgaacaaaattttaagaaatgtttcttaaaaattttctttcatttagataatcacagaaatttcaacaccaaaattttatatttaattctaaaacatgtgccattgaaaaagcaacctgaataaaaattttaaaatcctaaattaaatagtaagaaattaaaaataatatctcaaaaaaggtaaaatgttaaattatgtgatataacagtaacttatttataagtttttttaaagtaacagtgctaaataaaaaaataaaataaaatcattctccttttatcgaaataaaattgttataaaactttaatagtaacaataatagattattaaattatttgtttaataccttaaacgaattaaatttatttagcaaaacgcaaaacaatatacaagacaaaatccgacatctaaaatcataaaaaaataatctaaaattttttccgaatataccaaggttaaaataaaatagaaaatatatttaaacggtataaagaaaaatataatagaaatgacattaaagcggcaataacggcaatcgacaatacaataaacgtaatcgacgatgcagagcgaggaaatacatttttcaacaataaataaatcctaataatgtggagtaaaatgtaaaagttaaaaaaaaagaaaaaattgttattctttttaaataaaaaaagtaaataaaaagaaaaaattgttattctttttcaaaatttaatgctatgaaaaaaattaattaaatctttatccttaaaaatatattaaaatgtgaaagtgatttattaaaaatatggtttaattattaactgatttattaacttaatctcagaattgattttttgaagacaaaatttaaaggaattagaaaataacacaaaaaactaaaaaagtctaagtgtatttataatttaatcaacttaaattgatgcattgaagacaaaatttaaaggaataagaaaataacacaaaaaaaattacccttttgtgtagagcctatacgatatttaaaagtaatttttttaaagataaatacatttttatatatttaaaaaatttgaaaaaaaatctattagtttttaaatattaatacagctcaatgggaatgaagggagtcccatcatttacaagtgaaattatgcaatctattaactattaatgttaaggtataaataaagtanattataaaaaatatatttttaacaatttatttctctatttttacgatatatcaattagtaaaaacatta

SEQ ID NO: 16282 - DNA, 3826 bp, Heterodera glycines
tttgtgcaggtcggcataacagtggagaacatcgatttttgaggcgtaagagcagaaaatggaaacactgagcaggttgacgctgataggactgcccaaagtgagcagtttgttcagttgggcactcaattttcgctgcttttccgctttttcctgaaccactcgatccaataaatgacggcgaagctcattcagccggtcaatgatcacatcacatttgtgatcgattcttaagcaaaaaatgaagaaggaattaaaccaaatattcactcctctctcaaattctcgctgttcttcgaaagttcgtccgtcaatcgtttcctcaactcaatttgctcacgaagttcctcctgaaaaatgcgcaaattcaacgcatttttctccaatttatcacagcaaattttgtgcgccagttcgatgttgacgaaatgtccgctggtgaaaatacaattcatacgaattttaattaatttggaaaaccgtcgttccaacgaagacgaattgaagcattcgatgcacatcagcgatttcgagtcgagacagaataaaatgaacggctcattgtgctgtggacagatggggcgacttctcaactgaaatcactatttttttctgtttttgtttcgccgtttaccctcccgcgctcctccaactcaaaaatgtgatgagtcgagaatattttggcctaaagaaaaaagaaacgattggcaaattctctttttcccaactttgtgggtcgtctcgcgacacccgctgcaaagcggctgatggcacgtgtcgcagaagaacatcggttgcgaaatctgaaataacataccaagaaaggcaagggcagttaatttgctctaattaattaaaggcaagggcggcagttaatttgtttcagttaattacctggtcgcaatttgcacatgtctcagtgacctcactcgaactttccaacacgtaattcagcactttgtcctctactaactcggaacagccaatcggatgaccacaaatcacacaacacttctcatcggcgatgcacaaacgacaaaaatagtgctgacaaggcaaacggacggggcatttgataggctaaaatggaaaaaataacaaaaacaatgtgaaaaagcatgggaaacagacggaaaagcatcgcagacaatcgagaggatttcgctgcactgtgtcagtgcaaatgccttcctcttcatcggcaatttctaagcccatcctttttgatttgatagacagtgataggagcaaattaggaaataacaggaagtcaaaccgaatatatagaaattgaaatttggtcatcggattaatcaaatttacaataaaaatctgtcagcaaaaagaaaaatcatgtggttaaattggcatggttttccgcaaatccgatcaatttcttcctgctttcggcattgattgaaggcctaacactgcgaatggcattttccaaatcggttacattcactgggcgcaattgttcagccgtacatcgcctcaaatccctgttttccattctcgcactttgcacgggaaaaagggcggcggctcgacagagggccttcaaatcggaatacgagtaattgtcagtcattgcagcgattttcctgaaaatggctttgggtgacaaatgagtaccggacggattactccaattcggcatcgttgagttgtaacttggtgttgctttgtttaaaggtccttcggatcatttgaaaacgtgcttttttgtccggcaaatcgatgaaaattcgctgaggaaatcgtctcaaaatgccttcgtccaattcttgggggcgattcgttgctgccaacaccaaaacgtggccatttgcctccttttccgaagaacatccgtccaactgaaccaaaaactccgtcttcactcgccttgctgctccattttcctgctcaaaacgctgacaaagcattgaatcgacttcatctgatgttattgggttcgatgtctttgaattactcatttcccttttttaattttaccgatgaaaatgatggatggctgtgcatttctggccacttggaaaagcgctttcaccagtcgttctccgtcgcccacccatttggacataattgtcgctgccgaaatgctaaaaaacgtcgaattgcactcactcgccacggcttttgccttaaattttcatttattagccaatgaatttgcctaattaacccacgagcatcgttttgccattccccggaggcccaaacaacaaaattccggtgcacggcgcccgcagacccatgaagagtttcgggtttagtgcaggcagtacaacactttcttccagcgctaattttgccattgcatttccttcgatgtcgtcgagtcgaatgtccgtcgtttccacgatggtggcgagaatttcatcgccgagtttggagtcgacgcttttcagcagagacattttggacaaattttgacgatttgagacgagctaaaagacgaaattaataaaatgtaatgacttactattaatgatttagtactatttataatttcctttactgcttttttgccgaccctttggtccgtggaagtgcacggcattctccttgctctgttgttgccggtttcgaccgttgccagtggaagaggcgtcgctctaagcgccatcggctcaatggatgctgaataaatttaataagttataccaagaagtccacccgcttacccaacttttccagccgatccttcgtctgtccaacaaaggcttttctaaaaacgatttggatattcttcaaaatatctttgtcaaaaccacaattttttctgctgttcctgcatttccgtctgcttgtgtgaagggcacgaagtgtgccgtatctccaatgctttgtttatttgctttaacacattctcgtacaatccgatcactcgcgatttggcaatcccttaacaacaccaattaatccatccattccgtcccattcaatttatgttgctttacagactcgtctcgtcagcttcgatggcctttctcagactttcccgcactttcctgttcagttcgtcaaacagccgataattggcataagcgacgtcggcggttgcaggggccgacttggagcccatgggggacgaattgggcaacaaatccaagcagaaattagcaaaagcgtagaacaaattcaaaaggaacagaacagccgactcgagcataaacaaaaaatgagcagcggaactcactccatccgtagcaaaacggaaaacaaatgataatcggaaaataaatgatgaaatagcaacggcacggcaataactgtatgaccatgaacaatggaaaaataaaaggaaccataaaatcattttattacaattacatatcagttgattaaaatataatttctgattgttaaaattttcaattctttgtttctccctctcttcgcttctcttttcggtcgtcaagcgcttttctgaagttgcccacggactgtaaatgggcatcgtggagcaaaatttggggacgtttctgaaaatggatttgccaatacaaatgttggaacagtgctggtcgtaaacaccttggacagagcatcaaaagcctcgtcaaccgaatagtcaaatttgtgcatcaaataacaaattgtcactgttgcacttcgcgtccgtcccgccttacggtgcaaaacggtcaaagcgtcggccaaccccaaattccttggtcaccttacagtgcacatagcaagtccgtccttttgacgatattttgtcaatgaaatgcacggcctcctcaatgttttgatgggaggtggaaccttcgaaattcgaccaatttgttcaaaaatgatttaaaaaatttataat

SEQ ID NO: 16283 - DNA, 2117 bp, Heterodera glycines
  misc_feature (35)..(35): n is a, c, g, or t
  misc_feature (76)..(76): n is a, c, g, or t
  misc_feature (96)..(96): n is a, c, g, or t
aaaaatttgctcaaaatcacaaaatttggtcattnttgtggacaaatctgttacaaaatcgcattaaaaattacanaatttttcccctaaaagttnttggcaaaagcgctgaaaaaaaatcaatttcgatttttcatactcagattttcacaaaatgctaatttcaaataaaaaaattgatcatggacagtcaaaaatacaacattttaaacgtgttttgaataaatttgtaaaaatgaggctttttgacccaaaatgaggcttttttgcttgccgaatgaggcttttgaaaattttcatctgcgagccctggtcaaaactgattatttgatgagatgctgatttgctgctttttgagaaaatttgttgattttttgaaaaaagagctttacgagttggtggccgaacgtttcgtcactgaaataaaataaagaattttaaagggaaaaaatattaaaaattatatacatagatacatgatctatttgaaaaacactagtctaatacatatttaactttctgattcgtaggccgattaatttgttttagaaattggttcgatcatgagaataacctttaacctcccccgtgttttggtggttatttgtgggttatttctgatacttggctaatgttgagttctggaagtgtgttaaactgtgataacaagaaattttagggatgacaaaatatatccttgaacctaacccagtgtggtactccttgttttgctaccccccccccccctcgaaaaattttaaaaattaatatttttgggcttttcaaggtcactgatcatcatcaatatggcgtttgttttgacatctgctgatacctacatacctggtcatagactggacaaaatatctgtgattttttaaaatattttggggagggaggcagggctggacgcaagtggatttacaattacggaaatccgcaatccgcaattgtggcgattttctcagttgcggaaatccgcaatccgcaattacgggtgtccaaaaaccccgcaatttccgtaatttccgtaatccgcaatttaaaaaaattttttttttaataattttaaattttattttaaaaaatcctataaatcttttaaagcaatttaaaagcatattaaaaagcaaatttataaaagcaaaatcattcaattgaaaatccggttagaagcaagttatggtgaagaaacattcacgttgtttgtaaagttcagggtggtgatttttgaggtgaaaagtcagcacagttgtgctgagagaagcatttaatgtctttgagtaggaacatccatcggctttacatttagcagttgctttgccttgacgctcaaaataataccaccaattaccaggatttaagtttgacatttttaaattgctaaagaaataagaatttaaacaaatgtatatattttctttaaataaaaatagaaaaaaattcattttataaaaaataatattaaaagaaatcgtctcgaaaaataatccaatagtcaaattacggatcaaaattgcggataaatcccaaaaatccgcaacccgcaatccgcaattacgggggtccaaaaaccccgcaatttccgtaatccgcaatccgcaattgcgtccagccctggagggaggggtagcaaaacaaggaagtacccccagtgttaagcattttgttaagcgaatgtttaaagatttggtcgctggcagcacattgtatccgattactataatgtaacggtcaacgggattatgtgaaaaggccttaagaaagtccatttatctgcaacacaacaatttgtaacaactctttgctggattcaaaaacctgcgggacaagacccattgaaaatttattcaaaaaactaattttcgaacgcccatatcttttttctaactcatccaatcggttagcatttgcttagaaaaagcttcttctcatcaattgctttcgaatgataccaaaattttcaaattgttgccaatttccaaaaacttttacaagagctcattttcgggatggtgtgttatgtatagggaacggatttttaagcgcgaaaaagtccaaaataagtgcttaaataagggcgaaaaaagcgcgaaataagtgcgaaaataagcatg

SEQ ID NO: 16284 - DNA, 3459 bp, Heterodera glycines
  misc_feature (3426)..(3426): n is a, c, g, or t
tttacctattctattactatttattatcaattttctttttataattatgtacatttaatgaactaataaataatctataatttatcttaaattattatttcattgtttattatttattttgttcaattaatgaatatgtttttcttaaattagaaaaattatcaattgcatttataatcaatctattttaatgaaatttaaataatgcaaaaaatatataataatttatggaaattgtataaattttagaaagtaatttttttattgttaattataattaatttttttctttttgaattaactataattttttaactttgttttttcgttatctcattagtttaatataaaattgttatgacgaaataaataaaatatgataacttcacaattataagaaaaaataaataaaattcttaatgataatcttatattaaattaaaagtgtttgattttatttttttttaatataatttttattattcttaaataaaagaaataaataactttcaaaaaaatatggatattatattctttttatttataataatctcgtcggttgttcctcttcgtacaaaaccaaaagcataattaattattatggcattttttaataatgtaatatttattatttcaggtttatttttatctagagtcgacaattaattctttttacttttttactctagtggcgtaaaaacggaaaccgtcttggtttcgacctgttaatattcaataaatttttttaatttaatttaaaagcttttttattatttaccttaaattgattgaaatgatttattttattgatatttgattatttttccagtggatttattttataacgtaatgattatttaatgtggtcgagaataacttaacatttagggcttttcattaaattctcaaattgctcattcattataccttctaatttatataaatttaattttataaaaatattaaccctatattcgcattttattaacataaaatttgaattttatcttaaaataatttttaaaataaattcaaaaatataagtgagcttagtaaaattttatttgcattttaaaatttttaatgaataaatttattatctcaaaattaaataatcatattttgaacaaaattttaaaattaattaaaattattaaaataaaatttaaaaatattataaaaatatattatttttatgggaataagtattttttgtattttatttatcctgatcagatatcagaattcttttttctaataatttttacatcatcttgacactgtgcccactttattgatgagttcgtggaccaaaaacaattgaaacagcattttatggaaccgcccagagaattttatttattttatagatttttgatgcatttcgcttttaattattttaccattaatatattcaaatttaataaattattttgtagacaaatatcaaattggagcattaaaatagtgcaattcaattattcgaaaaacattgcataattaatagaaatataataaaataatgattattaataatttttctttcattttattatgatccatctaattatataagagaatattctaacaaaaatataaaaaaaattatttgcgttatatatttatatttaacacttcatatgtttacagttacaagaaatcaataatgagccatttataaatttaatttgtgccttttcaatatagtaggttaattgtcatattatattcaaaaagaataaataataataataatatatttttatataataatttgtaaaaaataaataattaatgactaaattaaattgtatatttagtgaaggtttacatattaaatttttttagctttttattgttttttaacaagtattacagaaaatatctttgatataaaatataatatgatgaattgcttagatttttgattaaataatgtttttagattaacataaaagccattttttaatttattgtctgttttttatccaataattttaataaatcttcttaaattagtgaggaggacagtaacccgcgctttttcatgtccggtgttgaggacagggaattttttaataggtaggtacttttttagtcgatgattcaggtaaggtttttgttgcgtccataattaattataaaatgatttgtatttggcacctgaaagttaaaaagcaatgtagtttttcgtaaaaagttgaataaaagaaggttctgaaaaattgcattaatttgtaggaatatttgaagggttgaacaataaaagccccccctcgattggaagcccccccctcgaatataagccccctttggagggggggtgaacaatagaagccccgggggctatataatcgaggaaatacggtaaatgatttaaaccaaaatcctatttaattatattcgaattagtccatgttagcataaaaatatttttttatttttataaaatagatttcattttttatttcattggcaaaaataaaaattttttctttcccttttttcttaaagaaaaaatattttcggtaatataggagaaatataaacatttaatttttaatttaaaatatttgtagcatcattttatttcgactttttttcttgcctcaatattaatttataaaattctgtttattaatcttaatacaattattaagggatataaaattttagctaacaaatttttcttaattgtcttttgttgtaattttttaagaatggtcgttatattaattttttaatttaaattattatttttcttaaatttacactaaatattttgtcttcgtttcattcgtgattttactctttattgttttaaagaattatattattcacaaactaattaatttatttttcgtgtaaatttaaaattataaattaattatttgatttaggtttttaaatagtttctagtttctataaactggcttttttctaatcctttattattttattaatattaaattatggaatttttattcttatttttcttaaatttaagttttatttatttttgatgaattgcggcttttaattcttcgtaatttatttatatctgtttaatataaatttattcatctttataatgatcaaataatatatactcttttaataaacattaaaatttattgatggtcataaaaaattaaagtgactcaatgaatttgttttaattttattagtaaaccttttatagtttcttaacaaacaaagttaattatatcgcgatataaagaaaaagattatttgactaaaaaatttaaaaatatttaaatccaaataaattttaatttatctaataaaaatgaaaagcatatttttttgttttctttagtgttttctcataatcaagatgcgattattatccatttcactataaatattggaaattcatttattattattatattatagttccanataaataaaagtttcacaaatctgttttttata

SEQ ID NO: 16285 - DNA, 1298 bp, Heterodera glycines
cgtcctttgacggcggcagctgtccttttccaaggcctttattcgcctcccgaaaaagtccggggaactaaaaacaatgactctattgcagtttctgcaatagagccccaatacttctccacaaattcacaaaagtgtcagcagtcccgcgggggaatgttcggctgattttgagttcccccccccccccccgggggacggaattgtgccaacgaaaattcctcgcatttcccaccttcgcctttgacctccgttgcccaaaataaactgcaaatcccaacagagattaatcagtgaatgaatgaaatgcatcgactgaatttgtgagtggttgttttaattaattttaaagcaataacgtaaattttgaaaaattttaacccaaaaacggatacaaaccggattagtaccgaattttattattgcttctcataattattagttttttttaataaagaattaattaaaagaatttttagtgataattgaattatgaaattaaataaataaaaattttttatttcaacgataaatttatttgtttgttccaaattttgcataaacccttaatttttatcaattttggattagtcattaaaatcagtttgttctgtcctttctaagaaataagaaaaaaaagaaattaattttcatttgtaaattattaataatccaaggacacattaattttgtaaaaaaataattaaaatttgaaattggaaattctttccttttgccatttatcgcctgtaaactgcgaaaattcagtgggaaaagtttgaaatctgagactttttgtccaatttgttctgacgtcaaattgggcgtctcgcgtgttttgttgacgtctgatcgatttgtaagggaagggaaacgcgtaaaagccaagaaaaaagagagacatccgccggagaaaagccaaaggatttttgagattttccaatcattttggaaatttaatggatggaaaaaaaacattttaattagggagtatattaaaaggtcattgagaataggtagaagaaaggcacagcaaaaattaggggattattaggaaaagttaaaattttaattactttttcataattcgttttaaattttaatgagtatatttgattttccttccctttccatggaacttaattagctcaacaaatgccttcttttcctcacaatcagttcgtttcttcctgctccataatccgctaatcagtgatcagtcagcagttggtcatttgtcacttttggtttttgactcccccccccactaattatgttctattaaatcacaattagcg

SEQ ID NO: 16286 - DNA, 1865 bp, Heterodera glycines
  misc_feature (79)..(79): n is a, c, g, or t
agatttcagttatacaaattattatgaataaaaaatcatgcgaatgaattgtcataaagtaatacacataaagatattnttgccgttcgctggccctgaaaatgcacaaaatttggcatggtttcgcggcgacaatgacccaaagtttggcagggcgccgcgccctcgggcgacaagcgccgctggcgcagtgagcgagcggtgggcggccgtacgtcggccaggcggcaaggcgcgaccatcgcacagaattttgacgctgtgcaagcggcgtccgtctccagccccaccgtactgacaccccagcagaccaagagtgtgaagacggtgcaggaccgactggtgctgatcaacggatacgataaaagaccgtcaaagagttcgatggggtcggccgcaacggcggctgtcgaagacgaagaagcgcaagcgacgacatcgacagcggcaacggcaaaatcggcaagaaaacagcaacaaaagctggggagggggggggggcgagtgatgaaaaaacgaagcttctaccgagaaaagacgacccgaaactctcggttcgttatggcattttatttgggttgagtcgaaatttcacaatttgacactttgtccattcgtcggattgtctgaatcgtcatatcgtattgccaagggattcgtccttatttaatgcccaacggataattttaataaaatcttcatttacgcttttaggccaagcctccaatcccttcgacatcgtccgccaatcaaaaagtgagcagccggcgcaagtcgcgcggcactgcgacaaaggcggcagcaccggcggctgtcaccacggacgatttaccggacaaagtgtcgaatcgggatacagccaatggcgccgaattttgggtcgagaaaaaggccaattccgccaatgaaatgagcagaaacagcaaaaagcagcagcaacggcccggcactttgcttcagcgcatacgccaaaggttcaccaaaagtggagaccgacgaagtgccatggccgagttggacagtgccgtggtgagtgaaagatgggaatgccaattaagtaaaggaggtaactgggaaaccaaattcatactttggcacagccatcggcggagcaccgtttgtcagtgacaatgacagtggaagttggcacgtgccaaaatggtgccaatggggcacaacaacatcaacaacagaaactgcagccacagcagcacctcggtggtgctgctccaatggcacaacagcggagggaggactatcgcctgggcggggaatggacgcggagcggcgacgcacttggggacgatgacgcatcgcaggcaaatcgacggactaattacattattattgggactaattagctttaattgctttgaactgaatgatttgaatgcgcttctcccaaaagggtcgttgttcgtcttttgactatttttcggccaccgcctcgcccatcgaacggcaacgggcgacggaacggcgcgaaagtgggacgaccgcggaacaaacatcgccttgccattccggcaacaaagcagcggacatggaggaggagctgcgatttgccacggccgctgaagcgcgggcatatttacggagagagcaagcaaaaggtgggaggagaggggagaggaaaacgatcggaaaaaggagcagatcaagggagtgatcaaaaataggccaaagcaaaactgatcaaggaaatcgtacgcaatcagtgaaatgctaggaacaaggaccagagatcttggaatgaacaattgattgggatgggatgatcactgtaaagaaattaatcgaaaatcatgtcctaatggcccaaaatggaaatgatcacttttgaaaccaattctaataaacgactt

SEQ ID NO: 16287 - DNA, 1198 bp, Heterodera glycines
atttgccaattagaaatattatatttaaattctttgtggataattaaatgaatattaatgatatctcataacatgatgagaggaaatgagaggggtaattccccttaatttccccacccccccccccgcaattcgacggctggccagaattttcgcatgagaataggcacatttgaggaagtttatccccgaaagatggacaacagatgagagatgaagcattgctcccttttggcttcaaaggagccaaagggcaattgccgaggcattgaaattttgggtgaatcgataaggcggattaaatcttaaaagtgcaccgccaaagacaagaaagcagtcactcatcaaatgagccgactcaattcaaattaatgaacaattaattagtgcggaaaaaacaaattggaaaatttgtattttggaaagaaaatttctttaattgtcataaaaatgaactcttaaaagatacaaagaaatgccactttagttgccgttatgaataatgctggaaaattacattttcgctaaggcaaattctccgggcgatggcacccgaggcaaagagaattcagcagaatttcctgtttttgcctgctcatcgtcggccaaagtttaggcaagcggaaaacacagaaaagggaatgaaaaacagagaaaagattttaagaaagagaatggccattggagtgataaaattattagccctttaaattggctaaataaaaggaataaacaagcgaaatccttggccgaatgatggataagtcgagacatttgtggattttgctgaaagagaggaaagtgaaaagaagagagtcgaatcgatcagtgaaagaacacgagattagcaaagagggatagtgggatgagaagagagttcagtagagagtagagaaaaaagattcagtgggaagggataaagcggaattaatgagtgagcacggagagacggatcagtgcaagggatgcttgctgacgacaaacaaatcagtgaaacatcctgatcagtacacaaggagagatggagggagagagaggggggagaggggggaaatcgtcaacaaaattggaggtgagagagtgatcaaagaaaaatttgatcagtcgaagaacagagggaaaggaaaggctttggtggtactctatcagcagagcgaatgcgaggagagagagagagagagagagagagagagagaga

SEQ ID NO: 16288 - DNA, 2014 bp, Heterodera glycines
  misc_feature (16)..(16): n is a, c, g, or t
  misc_feature (30)..(30): n is a, c, g, or t
  misc_feature (1873)..(1873): n is a, c, g, or t
  misc_feature (1897)..(1897): n is a, c, g, or t
  misc_feature (1970)..(1970): n is a, c, g, or t
aaaattatttaatatntaagttaaatgaanaattaagaaaaaacatgaataaattttataatcgattaataaaatgaatgaaatcaatggaaatatttttagctaattcactaatcataattattttgccaaataataatttaaaattcgaaagatatttaaaatgatttttttaaattttttgaatataataaatcatcgatttgatatgtataaatgtgaaagatgtttttttgaaacccatatattctttgaagcaaaatttggtcgaaatgaatgaacgaaagccgtaaaatgcggtggcgggggaaataaccaacgaaatgccaacagatggccaaggaaaagcctcggggacccatggccattttattctcataaacattccctgcgtgaaaaattggccaaaaattattgcgtgcattcataaaaaggcacaaaaagaattgatggatggaagaatataattgtgcggaactgacgacaagacaaacaaagggcaaagaaacactttttgaagtggaaaagcaattaaaataaattaaacttaaaatttcaaatgaaattaaaaaaaataataattaggggaaaagaaacaaagaaatgccaatgagaaaaggcactcatttattaatcagctcatttagcatgtatcatatcaaggttctgtgttgatagagacaaaagctgctttaacggagtttgttgtaagtttatcatttaaataaataaacaattataaatttaaaaaaatattaattaattatttttaatgcatttgtgcgtttattgaatttagcattttcatttgtatggctatttttttattaatttcgaatttagttttgtctaattaagctcttcttttaatataatatgtcgatatttgcatttatacccatacaaatcaaaaaagttctggattaaattttttattaaataaactaatattatacaaaagttatttaaaggttacaaacaaaatactaacaatccgtacccatatgacaacaatatcaacaacaacccttacccagtgaatccgtacagtaacaataacagcccatacagtggctataactatccatcacgcggctacgatagacccgatccaaccgtaagacgaatgttttcaacatttgggattaaaaaaattaagatcatcgtgataaatgcaaatccaacaaatacgtatgatatacaatatgtgaaatagttaaaatgcacacaaaaaataaattcagtccagtctacagtaatccatcttacccattcaacagcaacaatttatataatggatataacccaagcaacaacaacaacgcgtacaacccttataacaatggatacaatccgtataataatgtaaacaacccaaacaacaacggatataacccgtacagtaacggatttaacccgagcaacaacagatataaccaatataataatggttacaacccatacagtaatggatataatccaatcaacagcggatataatccaatgaacaacggatataatccaagcagtaatggatatagcccaattaacagtggatataatccaataaacaacggatacaacccatacagtaatggatataacagtggatacaatccaatgaacaactataaccagtacagtaatggatacaacccctacagtaatggatataacggtggatacaatccaatgaacaacggatataaccagtacagtaatggatacaacccctacagtaatggatacctgaacaacaacggatacaatcaaaacagcaacggtataaaaataaatgctaatatatttcaattaatatgtttttcaaattgatgacttctcctggttaacaaagcaattaagcttatattgnattttcagattgcttcaccgcgtncatggtacaggaccaaagagcatgcagcgcaatgcaaaggacatgctcaaaccccgtgggtaattaataattnaacgaacacaaaaaattgggttcatttcactatttttgcatttt

SEQ ID NO: 16289 - DNA, 1045 bp, Heterodera glycines
  misc_feature (26)..(26): n is a, c, g, or t
  misc_feature (64)..(64): n is a, c, g, or t
tcccttttccctccccctcttttttnggaagaaatcccgaccaaaagtgcttgtcctccctttntagggcacttcccgaacccggacccaaacaaccctggtatcattcgaaagcctagactttgtagaggtgcttaaacatgttcattttttgatttaaccttttttaaggcatgcaaaaagcgttcgaaaataggtcatccaaaaaaagtgcaatttttaacttgtttttctacacaacatcatagaataaagaggaaaagaatgaaacgtaaaaaaagcgttcgaaaataggtaatccaaatagtgtgattttgggtcggtttttcggttgcagttcgaacagttctgaacattttagaaacccaatttttcccttatagcccttgaaaaactgcgtcgattgaccccactcccgacccgtaacatttgctaaaaagtcttaaattagtttttatgcttggatcataggtataaacttcttatatagggaattaatgatcaaggcaacatgctttaagttcatttgaatcatttggttttatttgcaaataaatagcaaagaagcaaaatgaaatactcaaaaaaaagataaaaataaatttaacaattatcttctttggaaaggatttatgaaaaaatattcgaaagaatgaaaaaaagtcgaccatatcatttaaaatgaactaacttatgattaagccaaaattcatctctcattgttcagttgggtttcgttaaatcaattgtgatttgttttgatacattgaaaaattccgaagaattaaaaataaaattttgctgtaattttcttttttatatatttttttatttcaattaaattcttttacctctttgttttcgtcgaaaatttttacgtgaatgttttgttcaaaacatttgtttgccttttctccgtcaaaaagtgacaagtgaatttgggcagtgccggcttctttttgtccggtgccaaaggcgagtactgtactcgtaccgtctgtgttggcaatgttacagtacacctccacgaagcattgctttctgt

SEQ ID NO: 16290 - DNA, 3243 bp, Heterodera glycines
ttaagtttcaaaatttttacttatttaagtttgtccaaataagtgtcataaaatgtgccactttcatgggcctacataattcatttttttaagaaatacttgagcaatttgacgttctttccaccaaaaattttagtttttcatttgcgatgaatgcggcgagactctgccccgtaagaaggtgctgcagcacatcgaccagtgcccgaatgagcggaacttttcgtgcatggactgccaattggtgttcgaccaggacagttctcaaacgcacaccaaatgtatcacggaggatcaaaagtttggtagcccgagagatgtgccaaaggtgaacaaggtaaatggagcaagaaacaacatgactttattaaattacaatttgtagaggtaattttttaccacccatttttcagtttttgggtgcctaagaggggttggtctctatctatattgacaaaatattcgatttattaatgttatccacggcctagggcccagaggattcggcttggaaagggttcgaagaatttttaaatccgatttgcttttaaaataggcattttcaaacagaggggcgccggtggtgccgcccataggtgccgtcggtgaatattttccgaaaattttgatgtatttgtttatacatttgtgccaaatgactaatttttctggatttttgggtcaaattttctgaaaaatctatggaaagccattgccaataaacagttttcaaaatttcgaattactcaaaattttcaagaaaaaactgcacttgacggcgttttgccttttgtaaaatcataaaaacgtctcttttttaacacatctcatcatttctcaattcattttttggttcttcgcttaaaaacctttttccctgtgctattttttcaaaaattttctcagtcggagaaaattttcactttagccaactttaacaccatttttgggcgcccgcttttggtcccaaatttccaactaattttttttttcataaaaagcaggatgcctgggtgtcgcaagtgcgtgccgcaatccgtcatgtggacgacccacggctgaacaaagtgttgcgctccgtctacgcatatgacaacattccgcgcagtaaggcaaagtttgtcaacttcatgcaaaattcggtgcgcgtccgggaccgcgcggtgtgtgtggacgcgtggaatgccataaggcggggggcggacgcggtagcggaagagaagatggtggcacaagcgaagcggacggaacacgcggaaacaatggcggcggaagcggcacaaaacggcgacgacgcggacaaaacagcaaccggacgaacggacaatccagaaacgacgacaaaaaccatggagggacaagcggaggagcaagaaatggaggacgacacagagcaaaggtgtgggtttttggaaattttgataatttttacatacatgtacaaggggtgtctcagaccaagggccatacgacggacgattgggacagggggggtgtctcgggaccgatttttcatacgaaggtccaaatgttctccggcgacgaccttttttttttttttttgcttttcaaaagcacttattttttgcgacctttgcattgcttttcaaataaaacaatttttatacgccattgcttttattcatgtgaaaattttaaaacacaaaaaatattttattcgtcaaaagcggtgtgcaaagtcaaattggaattggaagaacactccggcgccgtcggtggcaattgcatttgagttgaaggcaaagaaggaagtatttttgtaattaaggcaaattataaaaataattttcacttgagagattgagattaaagggtacctctcgagattttcccgggaatttccggtcctgggtttttttaaatattgctaattttgtcgatttttgtaaaaaaaattttggaaaatttgggtgagggggaggccttggagagggtaccaataaggaaaactgggaaatttcggttaccccacatttgcgccccagccacttgcgcctatgtccaaaattggattctaacttacattttttcaatcccaaatagactaaaccgctttaaaaagcgattgaaagtgattgtatgcaataatttgatcgtcagcaaatttatgaaaaaataataaatttttgaaacaacataattattgttcctaataaaccaaaagaacaagttttcttaaatttaatgctgtttaagacctctaaaattgggaaaatataagtttgagcagcgcgtcatgacgcagaggcttggcaccgcaactttaaaatgtcaaactgttttttcatagacaaatttattgttggtatcatttggtagcccaaagtgttttaataacaaacacaaaatttaaaaagttatattcgcttccaaaaaagatttggtgcacgacgccaaaataacaaaaaaaaagagagtcgattttgccataactttagtaccccaaatgaatttttttcgaattttgcgggttaaagcagtaacaggcaagcgctttaaaagcacacaaccaaattcatttaaattaattgtgccactaaaacattgagaattttaataaatcaaatttttgaaaaaattacaccgaactctcaaaaaaaaaaacttttttttccaattattgtttttttaaatgattcaaaatgcctttcttattttgtttcttttggtttaaggacaacaacaaaaactgtgatgtcgggaggacaacaacgacaacaattggccggccaatcgtcggtggtggcgggggacagcgacgacggcggggaggaggacaatgacaactgcacaacaacaaccaccacccccacttacatcaacacatcatcatgcagcatcattttggatgaccaccagcagcagcagcagcaaagtgatgccgaagaacaggacgaagaagacggagcagaaaacgatggtggaggaaatgccgaggaaaatgcgcaaaatggtgacgggggggaggaggtaagaaaagggaaggggtgggagggcagaccagcaacgggatttttaggctttggaggcaccaattggcatatcattcagctaattttctttaattttttttgcgttattttttggttgaagaaattccaagaaaaaataatttaagaattttaaaacggtttgaatattctgggcacagaaacgcaattttcttgatttaaaaaaacttcagggtctctcttcaaaaagcaattttatttttgtttattt

SEQ ID NO: 16291 - DNA, 1512 bp, Heterodera glycines
aaatactgaaaaaatccgcaattttttgctctattatataaattttattttacatttttatccctttttaaaaaaaagttataaaaataaaagtgattttgggattcgggaccaaaggggggtgaccaggatttttgagtggaaaaatttttccacccaaaatcttccaaaaacatgtcattagggctatttgaggctgctgatcacgaatacgtgatcagattttacttttgacatagtcaagacctcagaatccctgtgtgattggggattctgaggcatcattttgaggggggagggggcaggttcggatccggacggtgtaacattatttttctgtgcatttttacgttattttcaatgattttaattaatttaaaatattttgttgagttaataaataaaaaattatatttaatttttttttgataaataaattttataagtttaaattaattatttttttaattgatagaatttcatgtatttttttaattaaatttgttaaaaaatattttcattttaatttaatgaatcactgttgcacctcttctaatcacggttgtacccctaaaaaacgggcgcgaagcgcccgtctggccccaactaaatttaaaaaacgggcgcgaagcgcccgtacgaggccgcgagcggcctaaaaatcaccaaattaaaaaacgggcgcgaagcgcccgcctggcccaaacaaatttaaaaaacgggcgcgaagcgcccgtctggcccaaacaaatttaaaaaacgggcgcgaagcgcccgtctggcccaaacaaatttaaaaaacgggcgcgaagcgcccgtctggctcaaacaaatttaaaaaacggtcgcgaagcgcccgtacgaggccgcgagcggcctaaaaatcaccaaattaaaaaacgggcgcgaagcgcccgtctggcccaaacaaatttaaaaaacgggcgcgaagcgcccgtctggcccaaacaaatttaaaaaacgggcgcgaagcgcccgcctggcccaaacaaatttgaaaaacgggcgcgaagcgcccgccaagcccaacaaaatttgaaaaacgggcgtgaagcgcccgtctggccccaactaaatttaaaaagcgggcgcgaagcgcccgtatgcccaaacaaatttaaaaaacgggcgcgaagcgcccgtctggcccaaacaaatttgaaaaacgggcgtgaagcgcccgtctggccccaactaaatttaaaaaacggtcgcgaagcgcccgcccaagcccaacaaaatttgaaaaacggacctcttctgatcactgttgagcgcaaagcgcccgtctgaggccgcgaagcggccaaatgagtccacaatatttagaagcgcaaagcgcccgtctgaggccgcgaagcggccgaatgagtccacaatatttagaagcgcaaagcgcccgtctgaggccgcgaagcggccaaatgagtccacaatatttagaagcgcaaagcgcccgtctgagggcgcgaagcggtcgaatgagtccac

SEQ ID NO: 16292 - DNA, 1000 bp, Heterodera glycines
aaaagtttaattgaaaattttataagcatactccccggtacagggctaacttaacctgaaaatatttcaacgctcattggtttttttgaaattctgagttttccattatatattttttttgtaaaattaatttataaatattttttcagaaatggctctgaaaacactccaaattaaattgccatgatactaattccctacaataatgaatatgggagaacaatacttttatttccatcccatagggtttccttaaaatttttttggattttccaattttctatacttttccaatttaaaaaaaattttgttctacataatttttcgaatagtatcagaagctcaccaaactttgcagggatgctaaaaggatgaagagcatcctattttaaactttttcatcccatatccttaaaatatttctacgctgattggttttaaacaaattatttttaacttttcttttttttttttgcaaaattaattcataaatatttttcataaaaggctctgaaaacgcacaaaattttagggtcatgccattaatgctacgataatgcttataagattttttatattttatcggaccaatttaaattttgaattaaagaaattcatttttttccttttttgttctttcaacatttacatcaaaatttttcccagggcttgcacccgaaatatttgctcagctccagtgatcacttccacaaggccattgcacgctgatcgaatgtacaaatcgatcactttatatgtgaaaaaagcgccattattgttgtctgaaaatgccattgggacgacggctggtcttaatggggacccatttttgctgctgaacatgatcggcgctgaattgccagccgatcggctacatttatgtgggtatttaaattttaaaatttgtgggaatttaattttaaagactccaaaaaattattaatgtgcttaaacactataaaatattaatctttgtattaagcattgttttaaaaattat

SEQ ID NO: 16293 - DNA, 1856 bp, Heterodera glycines
  misc_feature (11)..(11): n is a, c, g, or t
  misc_feature (21)..(21): n is a, c, g, or t
  misc_feature (48)..(48): n is a, c, g, or t
  misc_feature (70)..(70): n is a, c, g, or t
taatttaattntaaataattntaattcattatgtccattctgaacttntgatacaggaaatatatacatntaatgatttatttatttattttttgatttctattatatatatattaaataattttaaatttttataaattaaataaaaaaagcaaaaaatatttttttaaaaattatatctaaaatatagattccaaaaattattttttaaattttaaaactttaatgatttatacataaatttctttagacccaaaattaccacccgcagacgctggcattgtgtcactcgcatttgacaacagctccggccatactgtaccaatcatggcaaagggtgtttacagtaacgcgcagttttgatccaatcactactgtaacaccgttatctgcccatttcctggattctgtacattttcacgcgatggcattgctagtatcacgtgccactgtgttgtttgcttcatcgtacaccgtgtttgcctaccgtagcacttcgtccttttacaaaatgtgcagtaacaattttgttaggttcattaccgtaatctttacgacaaatgatgcaatgtctgaaaatgaatgctcaaattattttagatttgaatattgtgcgagttttttaattaaaaaatgtttttgtagcgtgtacaactgccaaccatggtctactgtaggcggtgaagagtgcggtaaggtgtacggtatcgccaccgaagaggaccacccaatgagagggccagggcgtgtgtttctgctcaccatgctttcctctggcgctgttcagctgctctcatgcagttctgatctggcacaaccgttccaactgatcgccacgacaaaccatttcccatacaagtgagttggtttgatcaaatgttaatccgatctcaattagaatgtttttttttgatcattattatatgtatatagagatgaacatatttccaaatttgagagatttttagtatctttcgtattttttatgtaattaggaaaccaattggtttcacggattaatgtgttaccatactcaggaatgaattattgtaaaattttgggcatacaaaatctaacatcatcattttctaaaaatgatcgatttgtatgaaaaaaattaattaaagaattcgtcaaatggcatttgcggatgatcgcctgttaattctgacggatgatggattcttcggcaccattgatctgacactccaggtctgtttacactttttaatgatggggacaattgtgttaaaaattttttttattaaaattaacatttttagtttaaatattttcagaaaattagacaatttttttaattaaatttaactaattaattagtaacattaattgcttctaccttaattagttggttgctctttcagatgatcaacttgaacttcgctgtccgtgacattcaatttttgttggccagtgacaatgtggaagatgttggcggcgaccatcgcatccattttgagggtccaatacaatttgacgacaaattgggccaattcagctggacggtcagcagctggcaaaaccctgttgggcaccatgaaggtatggatggtgaaaattgagatttttgcattttggaaattcaatttttggatgactaaaactgtgccgatacgaattcctacagttttagcttcaaattggtaacaatttatttgggtttttaccatgctgatcatcatcatagctgattatgatgcacattttaaattctattcttctttagtgaaaattctcagagactcacgaaccgaggcactaaaaaatgaagaaatttcttgacactaaataagaatttcgaaatcggcgatgtcgagagctaaaatttatcatta

SEQ ID NO: 16294 - DNA, 1013 bp, Heterodera glycines
ttttctctaaccaattttttctgtcccttttcgtctcatatttttttttttcgtaaatttgccctaattagtgcaaaattttcatttttaagccattctttcacttttgctcactctcatttttcactgaaaaaaaccatcgccaaaaagtaacatggaaaccaagcgcaacaactacaacaacatcgactcgttgtggagcactttgtgtgacctcggctaccaaacctcgcagggattggcctactccgtcggcatgcccaacttctcattcggcgccttcattttgctgtccgtcatggtcggttttttcggggaggtggaagaattgtaagtaatcttattttgctccattttcagacttggtgctgctttttcatgccggtaaatgccatcattttgtcgaccgataattaattgaaaaaatttatgaactttctcccttttttagcccgtggctgtgttcttccgcggctatctgcgcgacgggaacgcgtgcactgagcatgtcatttacaacatcattttgtggtgagtgatgccctcgggggctgcgggtaccattttgtattttttcaaccaattttttcaaaatttttttttacctttaccaatttttttatttttgaaagggctgaaaatttttcgtaataccaacagattgctttaattgtagggtttttttttaaatttaatattttaaataattgacatttttatttgggcctatacaaatttaattaatttaaatatattcagattttttattttttttctcccttttcagctttttcctgtgggtgcccggcatggtgcacgccttttggtactgcttcagcgacatgttcagcgggccgaagaaggagggcgccgggtacagcaaaaatgcctgagcagaagagcactggcgagcggacgaacgcagaaatgagcattttttgaaaaatgacgtcatcgatcttattaatttttgacacctaattaagcgataataaatatctctctcacctttt

SEQ ID NO: 16295 - DNA, 1772 bp, Heterodera glycines
  misc_feature (1072)..(1072): n is a, c, g, or t
  misc_feature (1716)..(1716): n is a, c, g, or t
tcaggccgttttcgtacgaacacatgttttttgactataacttttttctttgtcaaccaaatccaacactgttggtatcttcgaaagcctttcagatgctctattagcctgcaaaattccaaaaaatttcgtcaagtttaaaaaaagttcgagccaaaaaagttggaaaatttggttttttgaactcttctgaccataacttttttgaaccttaacgaaatttttccaaattttacaggctaatagagaacacttagggctatcaaatgataccaacaatattggatttggttgacaaagaaaaatgttatagccaaaaacttgggctcgtacgaaaacggcccgtacgaaaacgaccctgaccgagtttgtcccggattttgttatttttgttaaagttatgaattttctacaaaattttatgaatgggaaacaaaaaatgataaatttttggttctattagttcttaagtttttctaattgaatctaacgcttgtacaagaactcgtacgaaaatttcccccgtacgaaaacggcagtacgaaaacgacccccctcggtacgaaaacgaccctgaccggcgggggagggagccagagaaaagaaaaaaaagaatttaaaaataaaatattaaaaaaagtcaaaaatgatctgtcggtaagggacaccctcgtttcggcgccgctcgtttcggcgccagcccagtttttggactataacttttttctttgtcaaccatagcattattggtatcattcgaaagctctaagtgttctctattagtctgctaagtttcaaaaaatttcgttaatgctcaaaaaaaatatgactagaagaattcaaaaaaccaggccacatgtgtacttttggccataactttgttcaaaattgatcaaattttttagaattatgcaaaataatagagcatcagaagggctctcgaatgataccaacaatgttagatttggtggaaaaagaaaaaagttatagtccaaaaactgggctggcgccgaaacgaggtggaccccttagaaatgcgttttttaaactataaaaagggaaagtgatccangttgtttcaaatgtcacgcaaaactcatgatagctaaaaatgaacgtcatattctgttcagcgcataaaaatgccctagaaaaaattattaaaaaaaattttagggggggtcacaaaagggataagaaccggtaaaaaaaggttcgtttaatcccataactctaggcagataatttgtagttttacccttagaatttttatatttatttattttctcagttcgacattgtatacgaagccaatttgcacgtagatgatctttttaggcataatcaagaattcctaatgtgccatttttactgatttcgcaaaaaatttaattagcttagatcgctgacccacaaaatgtccagcccacgaaatgtccaagtctcgaatttgagttttttattattcagacgggcctaaggttaggcaaggggtaatataaagggtatattcgtattcagcgaccccgaaaaccctaaaaatcctaaattagactcattttgtttttataatttaagtcatacccccccccctctaagaattggcatttgacagatttaatatcattaataataattattattattctatcaaatttttcatccccttccctccccatcacaatgttcaagacttttcttcttcttcttcttccnctctttgcgcctagaaagagtgaatgccgtggcattgaattggtcttacgcaataa

SEQ ID NO: 16296 - DNA, 1122 bp, Heterodera glycines
cctaaattcaagtttattttgtttatttttttgtccattttcacattatcatcatctccttgaaatttcttatggcatgccgagcataaaatgcatattttcggatggagtggcgatcggccttcatcagctcgaagcagttcgtcatgtaggaagtgaccatgtgaaagaattccacggaaaaggtagcgtacacattttggcacgaaatgtgactgtgccgggcaaaagcaagagcaaaagtggccaaactgaggaagtgttgttcattgagtttattttgggagttgtggcgatccgaaccgataaaagcctaaaatgcaaagtatttttgcgaaaaacagattctaaaatacaatttctcttgtcattttcatcaatttattatagcgtccttcgatgagcaatcgccaaaaaaattccttcatcgaacgcattgcctccggcgccaaaagttgcaaattatccgtttgtttttcagacagacgcccgtcgacgtcgttgttcatttgtagattttttggcagtctcttcgggcgctttctctctgaaagtgccttcaaaggcgccgcagctgccgactgtccattctctttgttcgccactgttcctcgaagaacaaagtcattttccgaattgaatgccttcaccccttttaacgtgaaagttcccgtcaaaaaactccgtcggtttgccatcctaaaaattgtgaaatttaaaagttagtgtcaaagtttttgcgcggccttttgtttgcttcttcgcatttcgccagttcaattttggctgcttcgtcctcttcgaaaagcgccttttcttctatttcatttcctggaaattcgtcatcgccccgagcgacagtcaaaggattctaaaaataatttaatttatattttcctcccatagggtttttgccttttaccacaaaccaatgatccgaagaccaaagccaaaattgaaacaatataacaacagaattcacgttcagttgaattgttcgaaagtttcaagaaaatcgtttcaattcccgacgaaaagagacattttatcgctttctcgcgatcgcagtaatccacttcagggaccgaaacgtattttgcgggactttcagtgccaatagca

SEQ ID NO: 16297 - DNA, 2723 bp, Heterodera glycines
ttttgcgggactttcagtgccaatagcaaaaacgtaactgtagcaacacaaaaatacgttcaactaacaatcgctgattttcacttctgtcctcccactcctaaaaaatatgcaaataaaaaaacggaaataaaaaatgatgccttgtcaaaatattgttggatgtttgcgaagaattttttgaaaataataacatcggtgaaagcaaccaaagattggacaagtgacgtttcaaattcgtaaaaaatttgcaataaatcaaattcattttctccaggcaatttgccaccgaacgcaagcaaagtcggctgacacaaattgacacaaagtctgaataaggacagcttgcaaatttcaattgaaattattaagtatatattgttttaataaaattccattttcaccggctgcgcctatcagcaacgccgacccaaggcacttaccgaagcgtggcaccgaaaagttcgtccgatatctccgaatttaggatgggaacaaggtcactcttcacaatgttgtgccccatgcaaagccttctaacggtaaagtgtcggtcatcacgatggaggtaacgtatcaaatcccgaacactctctaaaggaagaagacacataaaacgaaaatgaaagaatttttcattatgaaatgctcacgaaaacagtccggctcaggataataaacaccattattgagaaaaccgagtgagttaatgagtgactgcacctcacggtcaacagaagacatcactaattaggacaaagcatcacaaaaagataaaatattcacggaattatgataataaaattggaaataaaataaaatgaagccaaaataaaatgggagacatttgaatattttcaatgttaagaaaattaatgtaaaaataaaaatattgattataaaaaagacttcaatttgaattcagtgaataatacaaatcgttctaatccatcaatgtttgttttgacaaaacggacggtcttcgccttaccaaaccctgaaaaggaaagaattcattttaagagaataacccccacccaaccatctcacttaggaatgggttgctttttcgcgcttcggtaagaattttctcgaactgagacaaacagccaagcttcgaaagaatttgaacaagttcaagagtgagtacgggttgcaaaacaggggcaaaatgtgagaccaattcctgttgagtgagaccagaacgatggaaaacgacggaaagcactccctcaagcatccatcttaatttgacgaaagtttagacaaggtcgaacaaaataaacacaaccttagcactttccagtttactcgcccggatgggaacaaccaaggcttaggcacaaagccatgaccctcccgggtccgaatgagccacggcctgcaatggccgatgcttacaaatcgcacttcatcaatgccgcaaattacaacgtcagcagtctccaccagtttattcaattgttgttgtaccatctccacgtcaaaattatgaacagacattcgttcctaaatttaaattaaccaaaattttccggtggtgtttatatggacctatgaattccagttatttgtaaaataaaatgccgaattaattacaatttgtgcatatttaatatttataaaaattcgcatagcctaccagcaccgtcgtacaaaagaatcaaatttgcccaccttcaattcttcttctgacactccaacagctccactttcatccaccaaatcaagcagcagcttacagcaattgtcgacaagagatgacgacttcttcccacgtgccggcgacttctcctgcactttcagactctgtccactgtttttggcattgtttggagtttcgtaagtgcattcaaaatccatttcttttggcattttgttttgatgcactatttgaacatttacaagacattctgggtcaggtagaagttgaataagagattcgatgaaactgtgactcaactcgggttgaattttgaccaattccagccgtaattcagtagtctccaaatagcgaagttgtttggttgcacttgcggtaaaatgctaacaatgagaagataaagaaaaacagaaaaaaatattttaccccaaataaatcactgccatcatttgctgaattaattatttcattattacgcgcagaaaacagttctttgattgaattcggcattgaagttgtaattgagaactgcaaatataaggtgttagtaataaagattttttaattataaaacctcgctaagattttggcataaatgattggcgagtgttaaaagttgaccagggcattcggagtcgccaaaagtattccaaattcgattcgttaaagcgtgcgaatattcattgaaaagcgattcacacaaattcttatggtactcgggttggaaaaaatgttgatagctgaattgggtgaataaagcaaaaggagcaagcaatggaccagtacaattgggtgcatctcacgtggttgcgccattcttcgcccatttgaatgcccaacttttgggggctctccgtcgtcttagttgccactggcgccgcacccctcgccgtcccgaaacattctccgccaatttcaacttccggcatttccctctccctttctttggtctcagttggcatttccatctccacgtcaatgttttgaacagtttcacttaaggttgtttccgatgctgcgcttgctcgtacgcccaacgatgtcgcatgtccacgaaacg

SEQ ID NO: 16298 - DNA, 1055 bp, Heterodera glycines
cagttggcaaaggaattggaggcggaccaacaagcgcaatgtgtctttctaattattttctaaactaaaaaaaaaaatttgtttagcttctaacaacaccgttcctggctggtcaatgggaatttcgtgcagttccgctgcgggtacatcagttcccgtgaccaaagtgactccagtgactgggtcatccaatgggagttcggatggcggtggaggtactacgccgttgcagcgaatccctggaattgcgagtgcattggctgctgcggttgtggctgttcaacagcaacaccataataataataacgttccgccatggccgtccggaactccgcccaacaacgccactcacccatctcttgacactccgccaattcgtcagccattggcacaaagaattttctcgcccgctgtcagcaactcatccagtttgtcaatgagcagcggatcttccaaaagcagcagcggggtttcctcagctacgtccaatgcactgttgcagtcgccgggttccagtggaacaacaatgatgaccggactgaacaacagcgacgttggcaaggagttcagggtaagatctgctgcattaaaaacatacctgtgcaagggggttagtcaaggggggggggtcatgacgtcgaacgtaaggggttaacgggtgtcgaacgtaagaaatcgggggggggggtcaagaggaaaaaaggagagaaaaaagaaaaagaggaaggaaaaaagggagaaaaggcagcgtcgaaatcaaggaaagtgccgtgaattacgttcgactaaccctgaggaatgcgatttgtcgaacgtaaaaaaatggagacttgaaaataaaataatttccacattaaaattttccaattcagctacgttcgacactctttccttacgttcgacgaattctgctgaagaaaattcgtcgaacatgagaggctgaaaaattcctaaaattttgctttcttttttttaagctttcattaaaatttcaatattttttctaaaaaaagtggcttataatcgcaaaaaacctaataaattttttggtaaaa

SEQ ID NO: 16299 - DNA, 924 bp, Heterodera glycines
aagcgatgggatttaccattcataaaacaaaacctgcagttcattgtctgccgagccatcttctcaacgaaaaaggcattcttccaccggttcgccgatttctgtccaatcgcttgacgagggaatagaaacaaaaacagagagggataaaggcgggaatcaaaagccgcgacagatcaaacaaacacggaaaagcaacgaagtggcacgactattgaacgatctaacggccggaaattgtacggatgagttgaaaaaagaggggacaaacgaaagtaaaaatgggaaaaagagggcccgattggaggaactgaacaatcaaaaagaggggaacgaaacaaaggaaaaagaattcgatcatgaaagtggacctgggcaaaaacattttggaagagacaaatgtgatcaaaaagaacgacacggaacagaaatcgacaatgattattttttggaagaaaaaatggctggcaaatatttaaaaatgaaaagccagaaaacaaatgagcaaactttgtttttggggaagtgggttggacaaaatggtgagtgtgacaaatatttgttgtgtatttagccggcttttaataaatagtagtaatattgcaggttcttggcaatatatggcagagaggagtcaaaaattggcttcccaaggcagcaaacccaatgttcgtggcgatggtactgattcaacaccaacgaaaaaggacggacggacgggcgttgaaaaaggacagaaaaacttgcagtcgcaatttgccaaaatcgaacggaaaaggccgttgaggttagaggaacggaagaaggcggagatggatcgaaagagagcgcacaaaatgatgcgacagattagcgacgagagcagcgacgaagagctcaaaggagggggggcaggaagcacaaatgggagacgggagtgcatgg

SEQ ID NO: 16300 - DNA, 1756 bp, Heterodera glycines
  misc_feature (1643)..(1643): n is a, c, g, or t
cgccatcccgcacaaatggtcattgagcaagtcaaattttgaagctgcggatttctcccgtcgacgggacccaaagcaccgcccgcgtcacgcatgtcgcgcatttggccaatgtcgtgggaggcgagtgtaactctgaagggaagaaaaagataatttataaattgaatttcactcactctctgactccattcttatcgtcaaacacaaaacagagggaatcgccgacattacaagcgcaaagaacgaaggaagaagaagcacggacgggggctaccaaagccacacaaagtgtggtcaacgcaccgccctcctggagaatgagtgcatgggcagcatggaaagaaccgagcagacaatggaacacatccttaaacagaggaaggacacagaattgctaaacttggccgaatgaactcacattcgttgttttgaaactgtcccgctcaatagctaagttcaattgctcaatagcgcctcaaaaaaatccaaaattattggatggtctgacagatattgccaaccgcggatggcacatcgggcagccaaccgcgcaccttcgccccaattgacaccatcagccagtgcgagaatggctaaataatatgccaaacagttgagttttaaaagattaaaacgaatgcacaattgttttcacgggcaattatgccgaacacatcggcgatgggatggccagcggacagtccggtgaccggatgcttctcatagagagaggtggacagaccataagcctgtcaaaattggcatttggtggcctactttgagttgcttgctcattttgacagatttatctttttttccaccttcgcttcgtcccaattgttccaatcgtatcgacccaaaaaggaacgtggggtggtcgtcttttcaggattcttttttgaatcgatgctgtcaagtatgtctaatgaatcattcggtgttcgtgacagcgaattctttgctcgccgcttcccttttcgagagcgaccactcggaggaagtactgcttcagtggtttcatcctcatccttaattttgctgaatttacaatgttttaagtgcagattgaagaaaagcctttgttttattttgatatttctcactagtgatgacagactgaactcctcgtcatccaacttagccattgtggcgatggctctttgtcgtatgggttgaacctgcacctcaaatgagttccgcgctttttcgaagtcttcgcttacttttgtgagtcctccgtcgggccctgtgtgacaagctttcacttccgtttcaaatttatccaaatgtatcgtcggcaaatccaaccccgttttgccctgaatgagtcaattctttgtccattatgctttctgtcagtttgcagtgctattcccaccgaataaacttctggttcattttcaactctccgcccattctttccattcaaaatctgctcgtaaaccgtagcggactcagaagaaggacccacgccatttttgtgcccgttgagcttcatcataagcatcagttcctcctccacttcgtcacactggaattgttgttgctgctgctcatcggtgccaccaaacgaactgacctaaaaatgaaaggtaaaaaggcataattataggcaaaacggtatttatataaatggcggngtacttatacagtttgacccacataaaattttttgcttttaatgataaaaaagggtttccaggggttttcggggcccgctgatcatgaatatgaactctatttgacgaatttc

SEQ ID NO: 16301 - DNA, 1953 bp, Heterodera glycines
  misc_feature (50)..(50): n is a, c, g, or t
ttttttataaatattcaaagtgttcgtgcctcttttgtacttatttgttntatggaaaaatgtttagtagctttctgatgttttaaatttttctttgggccattgaataaagaagccttttttcctagtgttctgatattttttattggacaatatgtacaaaaattttaattctaacttttcgtgatgtttgttaatttttaatcaaatcatattttttgtccatattatgtataaaggtttaagcttttcttatttatttattttaaataaaatatttctatattctcgcttccaatgttttttatcctctatatagcaaataattaaaaaatttcaattttttaagaaaacctttgaacttataattgagtataaacagccctcataatttaatattatgaagttttcggattcatattaatttaagcatcttgttttatgtcttgaattcttgcataatttaaaaaatattatttttttgtgatttttacatttttgcttatccatgatttgtcatatatatccaaatattttgaaaattcaattaaaaacatggaaaatttctaatcaaaagttattttcgatgtttgaaaattctgccgattattttcgctatccttctcttgcggacaactcctgcggtgttccgttctcggtgttgaacacaagaaaccgcttctcgtcgcgaattttgcgacagattagaaataatgacgtttgctttttcgtattataaaattagatttttattgaaatttcattatttttaaatcattattgtatatatatatatatatatttttatttccgtttattattcttatattacatttatttttatttggttttgaattcttaatttttaattaagtacaattctgaatgttgtaattaatacactttaatgcgccccacctctttgtcattagaaataattcttttaattatcatagttaggttttaattttaattaatttttcagataaatatttcgttatttattttttgaaaattttatgaagttgattatttagaaacataatttatttttgatttattttcaatattatttatgtatttagttgacaatcagggtttaataaaattaaattcaatgttagttttatactgacgcagtcaaatcagtattgagttacagaactttttaaattcaaaaatttgtacaaaaaaaaaaaattttaaagacgatttttgagaaactttttcatttcttaggaggtttattttcagaaatttttgggtcgattcttaggggtgtatttttaaaattcccaaaaaatctattcttaggcgtgtatttttcatttttattgcatttttgttaacaaattttcggcaacacgccaaaatacgcaaaaataggctctttcaaaatttttttaggctttttaggctctaaaaataaaagcctagaaaataggcactaataagtcgaaaagtagcttaacaacagcccaaaaaaaacatgcttttcgtgcgtttcaggccacggggagctcaggaaaaaataggctaaaacctaaaaattgcatccctaataattaaaagttcttttcccctacaggaccaataaataattggccaatttcattgtttaactgacaatcgggcggggggggggggggcactcgcgcattgtgtagtggtggtggtgggtggtggtgaatggatgttttaattttcaaccaacgacagacgacacagtttagaggttaaacaaatttttgaaatttctgggcctccaaaactttgttagggtatacggtccttaattgttagttcaatgatttaatgttgtcacaaatacctaatctttttagacacagtaaactgaaacaaatcccattgcttttttcttttctttggttcatttattcttcattgttcctgacttttgggtactcatcaaaaattagtgaatttgaaaaa

SEQ ID NO: 16302 - DNA, 2267 bp, Heterodera glycines
tgttttcggcttttgttttgccaatcatttcgcgcctcattaaattcggagaattttttgatggcgccgcgggcaaatgggtcgacaaataattcaaattccgtgcgatgcgccgaacaaattgcgcaccgacggggcgaagaaaaatgaaacaaaacgaattaaatattttgacaaggaaaagatcagtaggagaagattgaacaattaattaattaattagtgagctaattggcttaaaagagaaaaaaccgcccgtggcaaaggccgactgatcggatgagcagaaaaagtgatcaaaaggagcgcaaaagcaaacgtcacaaagtcacagacgcattcaaatccaattagaacaaaacacaaaccgaattaagtgcgaaaaacgctgttgcgacaaattgggcaaaagtcgaagggatggggtcaaattaggcggcgactaattggcagtggggttgcaaatggaattgggggggggggaataaggaactaaaattggaaaaaagtgagtgtgtgtgtgtgtgagggagagagaggagagagaaattaaaaaatcccatgggtttttatggagacctctgatcagtgatcagaagaagagatgctccatccaattgatcactcagtgttcagtggtaatgagtgatcactaaatgaatcgtctttgatttgtcaccttttcttcgtcgtctgtgctgctgcgtcgtgccgtgccgttctcccccacccttgtgattgtggtggtggtgatgtcggccggccgccgaccgcaaatgccgtgccctcgtcgacggactccgttcggaaatctgctgccacgcttcctcagctggggctgttgttgtcattgtcattgtgggggaagtgacggtgccaaagtcgtcgaccatcgccaaagaaagaggaatttccctgaaaaaggcggaaattggcaaatgttacggttaacagacaaataaaaatcagaataaaatgtgaaaaagcaatcagcgagatgcccacttcaaatcggcccttatccgcaaaatgccgtttcttttcgctccgtccggaggcactgaatgcgccgcggtggtggtgaacaaaggctaaacacttggctaattagtttcgcggctcaaatgattaattcggcacattttgctgctccgtctcttcctcctcctcctccctttccttctcctcccaacttttctcttcttcatcctcatttggcgtctcttcgctgggctgaagtgcctcgtttagcatcagcgaattggcagtcagcgagctcaacgactcgagggatctgaatgtttttgcatggatgaccattgattggcagtgccaaaacgatgtttgcccctaattgtgctgtctatggcccggcttttccttttttgtttggcttctcccccctcccccgcgccgacgctacctttgcaaatgttgcaatgctttgatgcgcaacgattgcacaaattcgcggttcgcttcgtcctctgtgccaatgctttccgtcgtcgtcgtcgtccgtgccattctccgctgccgttggccgcccgccactgatgcgaaagtgtcaatcagcaaaaggacagcaaaaatggctgttctccgtcgattgagtgctgctgccaattggtggtgccgtcgcccaaacctccgttggcacttttcacccgttttttgccgtcccattgccctttttctgttcaatggcaaattccagcggaagaaaacaacgacgattttgttgtcgtttttgtgacggaggaggaggccattctcagccctttctttggttgtcttttgtcactttttcttttccttttttgtaagtgatcagagaagtccgtcaccgttcaattccttttcaaaaaatgaaaaatgttcgccaaaaaagggaaaaaggcaaatggaaatgattaaaaagcattcgtaaagccaaatttggtaggaaaatcataggaaaaaatggaaaatggaatgaatcaaatggaaataaatttggggggggggaaagcggagggaaagaaagtgacggaggagaaacaccgaagaaacgaagggaaaagagcacagaaaaggcaacgacgcatcattctgtggccataaatcagaaagcaattgttttcattgtggttaaatgacagacaattaataaataaataattaattaattgccctttggcgccttgtaattgttttgcaatatttgcttccgattcagcacaaattggcaaattgtggggagacaaagcggagggggcgacgggggg

SEQ ID NO: 16303 - DNA, 854 bp, Heterodera glycines
atcgccgagcgggccaacagctcgttgccctgctgcacacaccaaaaccaactgccggtacacctcgggcaacataagagtgcccaacgaggcgtagtattgggagaacacgtccacaatggcgtacagggcgtggttgcacgtggtgaccatccattcgtttttctgaattttggaacaaaaaattgtcgcaaaatattttaggaaattgtcttcaatggcacctttccccctgctgaactgaatgtgctctttttctgctttccgctttccccttccttttcccgttcatttttgttatcacttccaattttttgttttaggtattctgtattagaattattttcgtcataatttcttccaaatttgcttttctgtaaaatttgtacattcacaaagaatggttttttcccttttcactcacttcgttgcccaattcgctgattttcccaaaatcgaaaatgcggaaaatcactcggaataagtcactccatgcgtccgcaccaaatgtgccaccgtacgttttgataagttcgaacaaaacctgcgatgatatccaagtgaaaggtgataaaggctttaaaccacaaaagttgcaaaccaaccgttaaacttcgtgtccgtacgtccaatttgcatcgatttatgatgcaggacaactcgaaaatgattggaaaccacccaatcagccagacgggttgtccctctgcaaaaattgtatcattcggaaaaagaaacacttcccctcatcaacctttgtgtctttccttcgcttttgttgtgttcagctgttgctgctcactcggcgctattccattggttgtcactgttgaagcaaaacgagcgttgattgt

SEQ ID NO: 16304 - DNA, 3013 bp, Heterodera glycines
  misc_feature (1857)..(1857): n is a, c, g, or t
  misc_feature (2945)..(2945): n is a, c, g, or t
cgattgattatccaaccccggataaatcgatcaacaaaaccatatgcaccgtattctgcttgttcatcaaactcatcaataacttggaactcaagaacatttcgacaaccaatccaggtaagcaaaaaatagcggaccaattctagaattttgtgtctcaaaaaaaatattattcaaaaattacattcgacttcctgatcatgtgggaattggtggaccaacaaacaaaagtaattgtaaagaggttcgcccacaggaacaaatgcaagcgaaaaaaagcatttaatgtttgtgtgttgttcggcgttttccaaaaattgggtatgaagacccggcagacgttgcaattttcggtaaattgactgacaaaaatgaaaaagacagccaattctgatggcatttggaaacaccttaagttcaggatttcttgtaaaatttgttatttttacattagttatcgcgttcagcgcactggactcaaaatcagacataaatgtttgtgggtgccaaccaggaaccgtctgtgacaccgcttgaaacatctaattttcgattatattataaatttcaaattatttaactgacattagcatatgtgttttcggattttgagttgagtattccataaatacaaggaacagcaactttgtcaattagaaccgaaattgtgtaaatttgggtaaaatgtgctggggcacacttaaaaatttttaataattttattttatttgaattatgtataatcaccttgaaagtaccgtcgacagcgacatgattgccgtattgttcgagaagatttctcgaaaatggtgaagcaaaaacaaacatccgctgttggtcaacaatacggtcgagaagaagctgattttgcagtctttctgggatcacaatttgagaaatgtcagccagatcaagaagatcatctccgcgttccactttttctcgggcgatgtaatttcggtaggttctcgacattgctgaagcagaagtcccctgttgcattcgaacttcaattggaatgtttccgcgtgcatctgcaatagcttggcgtacagggaccgggttcggagccgaggcatgtgcttggagattcatttgcgcatcccttatctacatatctgcgaattagctaacaaaactaaggcgtgccgaatcgtgaatccgtgcatggcgatgagctgcattaacgattcggcccattttgaaacggccaattccatcttggtgccaagctgcgttggaatgaacccggccaccacagtattcgcgcccatcagcaccgcggtaaagacaacggtagaattcgatgtcttacaaaacgaaataagtcgaaaaagataactaaaaattactagggtcggcacgactgaatttgtcgaatccatattcaaagccatcatgaacgagaattgtttttttttgcgtcgattttttttctcgcagaatgatctggtcagcttcgggatttgccaggggaggattaggtccaggtgaattctcatgaatttcgccctcttcggaagacattgacaaaatcagggggtagagtggaaccgagtgattcgagaacagaggacggaatggcaggcaaaatgaagaacatcccccttcccatagcaaaaaactgataagcacttatttacattctcgttttcccaggggtcacagagattatttttataattttttcgagataatgagaaaaggggcacacaaataaaatatgcatatatatcatatgcctgccttagatagatttatggcaataaaaaaatttaatttaaataacttcagtaatgtaacttttattataggtacgaattctattattaactcaaataatcggaaattattttnaaaaattaaagtcggtgtcggattttccagcggtgtcggattttccgcttgtgtcggattttccagtgtcggattttccggtgtcggatttttcagtgtcgggatttttccgggctccccttatacagcatttgaattttgaaaattatagtgttaccacacctttgttgatcaaaattttttaaatgttaataatttgaaaaaacatctcacaggggattttggggtcgctgatcacgaatataatattcatttcggcctatataaaatccctgactaacaaaaaaattgaaattcaaaatttgccaaaatgtattaaatatactttttcggattagtaaaaaaaaaattactactggtctaaaccgaaaagaaataaatttaaaaccaattaaattccgatttcatgtcactaaattacccgcgctgggtcatcaaattggccagcagcgaatgaaagttcaccgggggccaagttcacatctgttgacatttcgacacaaattgcgacaggatatcctttaattcccaatttttcattattttacttcgttaaaatcaccgagtccgcgcgaaacacccatgaaaatcgccacgccgggcttgtacggtatgaccgtggcgccttcgaccaacgccggcggcgtggcgatttcagggtgtttgcgcttcgtatgcgcccggaaactcttttcgtttccgcaccccacagggcaaatgctaaacaatttcttattaattccattttcgttcacatacacttattaattacattaaatcaataaaagcgagccgagcatggtaccgtgcctggccaaacggtccggcgatatttggtaaaaactggttttgaggttgggctcagaatccgcccgggtaatactgtaatttattcccccctttaaaaaatttcgaaattttttttgccctaaaaaactttgcagggctttttgggttcgctgatcacgaatctggcgtccatttcgaatcactgacccaaattcgaacaaaaagtcgaaaattcaaatttgttttttttttgtttcaaaaatagtttaaatgagctctcattgcttttttaaaaaaanaggtgtggtactatcggcagtattacacagaattgatcttttattgcaaaattggtaatttttagaat

SEQ ID NO: 16305 - DNA, 415 bp, Heterodera glycines
cagcaacagccacagcacaaacagctctactgaccaacgaattgtggcggacatggccgagaataggcggagggatggcaccgccgccggtgctgacgaagaaatgcgacggcggagagtgaccaattcgaaagacaggacggaattgaactgctggttgttgtggtgatgcattcgatgcaaagaatggcacaaaaaataatgggggaggggagaatttcagcgcaaaagcaatggacggtggtctccgtctggcgacattcgccggggcccggtcaataagaaggtggttaaatgacgtggtcaaacgaccatggttaaatgacgggtacttttccgcatttaactacatgcaattttggggcagattcacataaaaattttgtttttttcttctatttatgtgataatgagg

SEQ ID NO: 16306 - DNA, 3108 bp, Heterodera glycines
aacaaaattgaattctttgtaaccatttaaaggcttttcatttttaccatcaaaattttcattttttttgcaaatattttcttttaatttgatgacaaaaaccctaaatttccctttacttttaaaattgaatttatttttattttcgataaatttttctctagtattatttttgacaccgtaaattaaaatactgctaatttatttttgttggcggttatcattcaaatgaatttattgttgctttttgtagggattctctttcacttaaaattatccaatattgaacccaatttatttgttgataatatctccctccacgctcttttgttgtattctttggcccctccctttccgttccccgagtcgcataattgatgcaaattttcaatcccccttctgcgcttcagcggaatgaatgctcaaaatgattaaattacgaaggtccgttcaccttttaatggattcgtcaatgttccccgacacccccccccctccttcacacttcttttgctgccgttctttgaccccccttcccttttacttcatccgaggcatctaattgatttgcaaatcccccccccactcgctgcatttctgtgcaacgattgcgtaaattgattaaagatgtaaaaattgaatattttcatgttttctttgtacccatttaaagggttttcatctttaccataaaatttcgttttgcaaatattacctatgacaaaaaaaattgtcaccaaaattccctttacttttaaaattgaatttatttattctgtcaaattatttccgtaaattaaatacggctaatttatttctagggggtttctcattcaaataaattaattgttgctttttgttggggattctctttcacttaaatttgtccaaattgcatatcccactttttagtgcatttttgacaatatacagctacgcatttggttgttgataatatctccctccccgctcttttgcagactttctttggtccctccctttccgttcccccgagtcgcataatcgattccaattttcaattcattccttctgcgcttcagcggaatgaatgctcaaatgattaaattacgaaggcttatttaaagattaaatatgctaaaatttaagtgccttgtcaactttgatttttaatttaattatttctacaacaaaatctatcaatgataaccttcatctccctgcagattagctttactatttgaccccccccccgccctcctcaaatttccatctaatttttaatcattaattaatttttctcatccaaatcctggctgtgcttctgcgtaaagttatgcaaattttttaaacatcgattaatttttaatcgttaattaatttttctcgtccaaatatttctttcgttttttttcttatgacgttttaattaaaatttaacctattcattttttttgatttgtatcatttcaaaatataaaagtttttaatgtgtttattcccaaaattttttgtttattttgctgtaaactgaaacatttcctaacaatatttttgttttgataaagaatttaatattttaaaatatgcttaacaaatatatttagaattttttcttcagacattttgccatttatttttttcatggcccttttttcgaccttgaacggaaagttaactttttgtcatttacgtttttcgggagcgcactacccccaattaggtaaattatttttaaattttatttgtcttttatttctcaagataatctgagttattattaaatagctcagacctttagagcgtcgtgtttgtacgaaggattaactgagttataaatttagctcagcccctaactacaaatacatctatatcatatcttcaataaagcttttttttacctacacatctacaatccttatctttcgcttcttttcctttaaataatttaatcttttatttccacaacttatttaataatatgcaggttaaaacattatctgaaaaatttatttggaatttatttttccattaagaaaaaccaaaaaaaatttcctccccacagtagcccatcatccccgttcttttgtgaaattacccaaccctttttttttgtgttaaggttttcttgacaataataataattgtttgattcaaaataacttttttgttgatatttttcagtgcaccctacatttttcccaatcatttctaaatatttaaacaggtgcttattttaaatttcgtttctgaaaaaattatttaaattcgcattttgtaattttgtggatgttggaaattagaaactctctgcctcccaggcactttttttaaaatactatcccaaataataataacaaaaaatcttaagtcttaaccttcgggggttctagttcgctgatcacgaatgttacgtcctttttcctgaaattatagtcccgaattttaagttcactgtggagtttagttgagcccaaatttatgaataattggtgcggaaggacaaggttaaaataaaatctgctcaactaaactcaattaaaaaatgaaaaattctcaccaaaaaagataatgtttgaataaattatcattttcgcaattttttaaaaatgtatatctttatttgcgttaatcaagcgattttttttgacatcgccgttaagtcggttcttaggcggtccttcctttacacaaccgatcaggcagtccccacttttcaccttcgatatgcggtccgcaccgtcacgccgccgaccaggcggtccctctccttttcaccgccgatcaggtggtccctcccccatttcaccgccgataggcggtccccaccttcacaccgccgatcaggcggttacgcttttcaccgctgataggcggtaccaaccttcacacgccgatcaggcggccctcccccatttcaccgccgatagtcggtccccaccttcacaccgccgatcaggcggttatgcttttcaccgctgataggcggtaccaaccttcacacgccgatcaggcggccctcccccatttcaccgccgatagtcggtccccaccttcacaccgccgatcaggcggttatgcttttcaccgctgataggcggtaccaaccttcacaccgccgatcaggcg

SEQ ID NO: 16307 - DNA, 2787 bp, Heterodera glycines
  misc_feature (2776)..(2777): n is a, c, g, or t
ggctccgccgctccggcctcatgccgccgcctcatccgttaccgtcgacaccccaacacccccaccgctacggtggccttcacaccatatttgaggacaccgttgagcagaaggcagggcatgagaaagacgtacggcaacaaaaagaacaacgcagtcacacttcatcagctgctactgtcaatacagaggccatggtgcgtgaggctcaccgggtgacctcccaacttgctgccgcaattccggagcctatgcgtagcgctgtgacctcctccgtggccattcccatccttgtgtcggcggcacaaagtggcggtggtcgaaaagaagcaacgcaacacaacagtgaggaagaagaagaaaaggaacgcaattgatatagtgatggaagggcaaactcaaatgtgtttactagtggttcagtgaaataaatttggttcgccgacggatcatttcctgtaccgtgtgactaatgtgcgtaaaaattgcggagcaaaaaatggtgatggcaacacggttgctcaatttattgcacacccccaagtcgtgccttatgctaaattgggaacaatgtttccaacaccatttcacaactccattcttctcaaaaaaaacatttttatttttttcatccaaatgtttcgcctagtaaaaaacgttgaccaaatatacacagcaaaaaaaagtggaacaggcccgcaaagtgtcaaagaagacaaacggggcagagaggggcggggggtggcaaacgcttgtgttggtgcggatcggggggtgggcgtaaataggcccagtgaacaccgctgaccaaccaacccccaccctcaaggtccagctaaaaaaagtcaaatacggcccgcaaagtgccaaggaagacaaatgggcagaggtggcggagggggtggggggacacatacgcttatgttgatgcacgcctggcggaggggggcgggggtctggtgggcgcaaataggccccagtgaacaccgctggccaaccaaccccaaggtccagctaaaaaaagtcgaatagggcccgcaaagagtgcgccctatatctactgccaatgcgtcggatggccaaactgtggccaaatggctattcacgcctcgacctgacaattttcctaagcagctcatatgctttatggattcaacgatggaacagtggtcggcaaccgtggaatatcaaagcggtgatttatttgtcaaatttaattcgtttttttaatttttgcctttttaggcattttcctctgcttcttcgcctgttaatttcgttatttgcgtttgctttccgtccgattcgttttctgccgttgtgccgtttaaactgaccaacggatttactggagagaaattgacattggaattgtcacaaggagcaaatttttttaatcttatccgttgttcaattgcagcagtcgatggagaatggtttttatttgatggacataataacagcagaattgagcttgtcatcagagacgacgtcgacagattcgacgatgggtgaacaattttaaaaacactcaatgctaaatttcttatttttgttttgtttttgaggcttctcgacactgtttcttctgccggaccgagtggtgatcagaaacagtaaaaaatgaactgattgattgatgatgcgtttatgtcatctaattgtaggactttgccatttacgtgtaattattgtgtatttgctttttgtataaggaaaaagatggaattctcccaaattttctaaaaatgatttattaatagatctcgacaaaaattcattataacggcggaacgaagttcttaacccataagttaaattggattttattgatagctgatcacgaatctgaaattcgttttagtcaattttgaatcccggagccgaattcgaaccaaaagttgaaaattcaaaaaacgcccactctcgctaattggcgggcgttccgcgccttcagaaaggaattccttgtttatattttccatagatgctatgacgaagtgacataagtaataatgaattgaaatatttaaatttatttacctaattttaaaaaaatctagcaaaaatttacaaagttgttctgctcacaaattcataaaatgttaagctttactaatcctttgtaaattaaaaaacgcattagtttgaattgccaaaaaagcgcccaaaatcttagtctataggatcaaaaaagctgaattttgagaaaggaatacctaggctttagggttagctaaaaagttatacaaaaaacaaaatttcgaaacctcacagatttttttaaatcattaaattgttagaatttgcttagaaaagggatttctcatcatgagctttcgaatgataccaagattgttcggtttcgtggggaatgaagcgagttatggctgatcaaataaacaacacaaaaaaggcattgatcaatgtattttttgaattaacgcgaatttgtttttggcgtttttaagaaatttagcattgagtgtttttaaaattgttcacccatcgtcgaatctgtcgacgtcgtctctgatgacaagctcaattctgctgttattatgtccatcaaataaaaaccattctccatcgacggctgcaattgaacaacggataagattaaaaaaatttgctccttgtgacaattccaaggtcaatttctctccagtaaatccgttggtcagtttaaacggcacaacggcagaaaacgaatcggacggaaagcaaacgcaaataaacgaattaacaggcgaagaagcagaaggaaatggcctannaaggcaaaaa

SEQ ID NO: 16308 - DNA, 2710 bp, Heterodera glycines
  misc_feature (2580)..(2580): n is a, c, g, or t
  misc_feature (2625)..(2625): n is a, c, g, or t
attcccgagcctaagcacattttcgagaagggtactcgattttccacattttttcggtcaatttattttaattttaggttatagacccaattactctgatcacgtttacacagtagacgaggcccgctcaaccaacccccagcactatttgctcaaagactattatggcacaaagttgaagagaaaattttatttgccagaattaacaaaagtacaagtggatgaaaacacaatgtatcgaattgaaaagaaatacaaagaacgagtgagagatggtaaaagagaaatgttggtgaaattcattggattccggaaaaatattgggtcacaaatgaagaaataaatgaataaaaatattacaaatttaatgaaaattaaaaaataaaaacaattatggcataatgtcggggtcattcagctcctcttctgtgaacatgttcacattgaggtctgggttgaacagacaggtacaagcgccagggcagttccacttacaccactcttcgtcgctgtacccaaagggcaccaccttcaacccgtgatccctgaccacccccttattcacggtcgggttgaactgcttgaccaaggggacggtgaaaatctctcccttcttggtgatccgaaagttcttcgttgggtagttgaagcggacgttgttgtccggctgtcccagcttgttctgcaccatgtccttcatcttctcgaaagttatgcgctcgcaggcatccgagtcgagcgtgatgccgcgcaccttgagcttgtactcgtcctcccccgttgcgttgttgcgcagccacaatccgtacgccttgggtccggctaaacaaaaagtttccatttattttggtcaaattttaactaatcttaccacaaataaactccatgatcgtatgattcgggtactcgtccgcgagttccccgagctgctcaccacccggaagtgggtcccccagccgcgtcaggtagtcgtaaaagatgctgtccgtgtcctgattttaaaaaattacttcacattttcattttattttctgaattttaccatgtagagaatgcgggtgtcgaagcgctctacacctggtgcagggccatacacctttttcagcgattccagcaagtggattcgcgcagcagaggtggtccatagggcaatggccacctgagaaaatttcaattgtcttttttaaatattttaaaacttttcttacattgcttgtgctgtgctccaccacatgctcatctttggccttgtagcagaccatccagaacttttccgtcagctgatcaatgctgctgacctcaatcttcgagtcgttgagcagtttggccagctcggcatggcactcgacgatttcggttttggtaagccggtttctgtatgatttgtatttttttcataattcttaaccaaaattttaccgaagtgcgaaccggccccacagcgaattcaaacacagcttggacaggtagcggagtccggggttgtgtttgattcggtccgcctcaagagggacttgggccttttctttggccttgtcgatgtgttcctgctttctccgtgccgactcctcctcgctgatgcccgcctccgtacaagacgctggatatccgcttgcttaaaattttgtttgtttaattttttttattaagtttttcaaattttaccctcaaatttcattttgaggaacttcagcaggtacgagtggaacaacccattgctccaatcgcacgccagaggccagatataggcacggtacacatgcgtcaccttgtaccacgagcggagagcggcttccagctcaatgtgtgtgactgttgtcgaaaagcctattaagaaaaaatatttgcttaattacaagcttcaaactcacccctttcagagtcctcaaaatgatcgcaattgtactcggggtcgatcaagccgcgcgggtacatttcggaacacgtccggcagaggggaaacagcgtgcggttgttgatccggtacggaaggaccgggatatcgtagtggcagtggcggggcggcactacgaagcacttgatgatgccctcaaggcggatgccgtcgtcgccgacaatgtcctctggacgcctccattccacgtccttgtcaaactgcaccacggtcgggtggccaaccggataattggtgaacatattccttaaagtgccaaagatttttcaactattcattttttttccgacatttcttaccgcgacggataaagactgttaaagtccttcactttgatcgtacggctcttccagtcgcccgtctcagggttgatcaccgaagcgcccaaatattcgggcccagttcgacctgtgccggaaaattagttaaaaattaaatggaaaaaggtaccgccaaagaatgcatcatggaagtcaattgggccagaatccgggcagttgtcgaaatacgccttcatggctgggttgtcctccagcattgcgttcaagtggcactcccaaatcacttccacttcgaattcccgcgcaatgtcccgggttcgttttgcgtcccgggccctgagggctccggccgtttctcctccgccccacaattgcgcatcgtcnggaaagcagcttgggcatcccatgccatagcaccttttgaatggngtaaatggcacatttttcgaattatttcctttaccattggactcgatggccaagtttttgtcctcatcaaggcgctccatcatcc

SEQ ID NO: 16309 - DNA, 838 bp, Heterodera glycines
tcacccctacaaaagcgcagcacttcaacattgcttctttcttcctcccccctcccctccctccttctcagccagtaactgatgaagcattcgtccgctctgttctgcggttgtgcgctgctgtcaatggttctccaattgatttatttcgtgccctccggggacggctaacatttcttagcctcgcttagcttttccctctcctcgggccaaactcagtcggtccgttgtgtgggccagtcaatgcgttgtttggtcggtcggttggtccggcaccattcccacgcattttcttcagcatttaacactgtctacgctcctacgaccggcttctttgctctctgcgagaggaagacaccgcgaaaagcgatgtcagacacagcaggcgcaaatggcacttttgggggggcaaaagcattgacagaggcacggacggcgccaccgcggcggcagcggttgctgcttgtcgacgatgtccgataagcagtgcagtggccaacaaatagcgacgataagagagcatggccaaattcgcccccttcctcgcccaatccaatccaaaatccaatccatgtgtcacgaagtgtcagattaaagagatttcattttaccaattttaattgcaaaatgaaatttaaataaaatgaagctaattatttaatagaaaaagaaagattcatgcctttaattcgacattaaattcctttcaaaagcttacattttctgtcgcccctccccattccatttatatagcaatatttgtgatgttaatttaaataattaatgtcatattaaatgttgacgagggacttttggattcttctctttctccatttat

SEQ ID NO: 16310 - DNA, 1089 bp, Heterodera glycines
  misc_feature (1055)..(1055): n is a, c, g, or t
ttttccaatgttttttttttaaaattttataattataattaattttttcattaattacacattctttaagtgtttgatgtatatgaaaacaaaaagtacctttatttactgctggaacatgtgtcgggaggtgaaactcacatcaaacccaattcattaaagcaattttaggcgaattgttcgattatttggtcaaaaaaggccgtctaatggcgaaggaagcgcgcaaatttttccgacaaatcatttcagccataggtaattattaacaaattaccctttaaaaagcgtttaacttcattagacttttgccatgcccacaacatttgccatcgtgacttaaagccggagaatctgttgcttgacgaacggaataacataaaggtgaccgaagccgaaaattaacatttttaatgccttttaggttgccgattttgggatggcctcactccaagttgatggctcaatgttagagacgagttgtggtcagtgtattttattaaacatattttttattgtgccaataattcaaaagcatttccctaaaaaaggatcgcctcactacgcatgtccagaagtgattagggtaatttattattaatatttaacagtgattaatgtttgaatgtaattaactccttaatttcagggagagaaatacgatggacgtaaagccgacgtttggagttgcggggtaattttgcaacaatttgtgccaacaaattgtgcttaattaaggtaattttgtacgctcttctcgttggtgccttgccctttgacgtaagcgaaaaataaaaattatcatcattattattaaatgttttatccagtattatttaaaagaaatgaatttatttttattttaatatttattaacttttaggacgataatttgcgaaatttgctggagaaagtcaaaaagggccttttccatatccctcattttgtgcccgccgattgccaaactcttttgcgctcgatgatcgaagtcgatccggcaaaaagaatctcgttgcaggaagtgttgaagcacccgtggtcagtataaggaattntgaatttcgtaaattcataaaaaattctaactat

SEQ ID NO: 16311 - DNA, 1005 bp, Heterodera glycines
  misc_feature (25)..(25): n is a, c, g, or t
gaaatgccggtagcacaagtggtgnaagtaattatgcctttttgaaaataaattataattcaatgttaaaattataattgttcattcaaagttttttgattttcagacccacataattccaaacgaagaaaacatcgacccggacgtgttcagacatatgacaaacttaggctgctttaaagacaaggaaaaactcgtgacggaacttctttcaccaaaacataacacagaaaaaattgtaagtgaatattttcataataaattttaaaatatcctattattttaggtgtattttcttcttctcgaccggaaacggcgtcgtcccgcaaagtcaacgcttaacatttatttaaaaatgaaaataattttaatttagggaagacgaacttgaagttgtgcatcgtgggtcggcactgaacatcattgacccgccgcgaaagcgaatcgatcagacaaagccacgatttccgttgtccgcccgaagagcggacggatcgccaatgaatgcgaggagaaacaggtgggcaaaaattaaattgatttaaaaaagagcttaatattaatgacaccaattgttaagaagaaagaatattaggtgttgtacttttgtctgatcagttttcctttgaccgatcaaaatgatcagtgacaaattaaaagaatggttaatgagttcatctgtacgtttaagcggtttctgttagtccgattttaggtccccatttttcgatttttgtacctaaagctatttaatcgaactttggcaccctattttaaggtacaataggagcaggcagtcctcgttgagtggttcgccagaatgttcaccccatccttcgccgcgtccgttcctttcggtgaagggtggcagcagcagcacaagtttgacatttttaatgatcttaattaccaacaaattgtttcagcaagctataataacagcatcgaattgtgcggcggcacttcttttacctcgaacaatcacacaaatgtcacgtcaattag

SEQ ID NO: 16312 - DNA, 1505 bp, Heterodera glycines
tcctttgccaccagaattgcctcataaacagaaatccctctagaccaaatatccgctttcacagacaacttaattttcctattaataaaatagcttttaaaatatgggcttattgtaaaaaaaaaatttaaaataataatattaatttactttaacagaaaaatttgccattttttctatttgtttttatttaattttttactattgagcaagaattttttaaattttttccaaacattaaaaacatcattttagacttttcgtttgtggtttcttgtgcccacagcctaattattaatattaattatgaattcttttatttgttcccatttaattaacttgtttattgccaacaaatatttcaggactactgtatttcccgatgtccaatgtactgtgtattacggttgttgtatcagccatgattgctggttcttcttcaatttcattgcatggttcgctgttgttgcaaatgcgaataatttgtgcccggtcaaaatcaattagtttcacaagtttttcgtttccattcggattaattggcacaaaaatgagtttatcaatactataatgaagatgagcagcaacttaaaaattttttaaatatttttttaaattcctaaaatgccaagtgcaaaaaataggcattataaaattgatcctagaagactcaaaccaagctagaaactcattttttgtgcttatctcaacgttattatacagggtgacaaataagtcttgcaccactttaaaatttttaatatttcataaaccagaaaaccgattttaatctttttatactcattttgaagcccattaaattctctttaaagtactctgaattataaagaaaaatttctttttctcaatggagtaatagtaccatcaaaaattgtgacccatttttttcaccaaaagtttactatgcgtagacaataaaaaaattcaaacaactaaactaagtgaagcaaaataatgaattcatgtggagaatatgtcataacatagttctttaaaatgagcttgaaatcggtggttattactgtttctaagatcagaaaaaaacatcaaaacgagagtgatcagaaatcgttgatttaaatgaaaacaatagcgcactgagtcaagtcaaaatgaaatgtattaatttagacaaagcgcaaaaattaactagaattattcctttattagatagttaaagccaattttattacaatgtatatggaaaaaagttatgggtctatgaaataggggatacccctcaggcacgcaacttggaaaatattttttcgggcattaattttctaaattaaaattgtttatattaaactaaaatcatataacatacatatgcacacaaataattactcagctgaaattctttggcgtgacataaagccttggtccaagtggtagcttatgccagataatggcctttttgaagaaatcaggaataatattttggatgattggaatttatgactggttcaggggcaattttttgg

SEQ ID NO: 16313 - DNA, 1876 bp, Heterodera glycines
aaaaatttaggcatttgcttaaaaatcccatctctagtgattaatatggttgaaataaacaaacaaaaattatatatttattttacccaattatataaattaacttcatttaataaaaatattctgttctgataatggtgatataaattttctaattattatgtattaataagaaataaattgagaataatttaaatagtttaattatttttgattgtttttttcttcttaattaccttggtgtaattcttttaaaggctgtgccattcttttgatttcttttattaattcgacttcttccattggcatttcaaagtgtaatcttcgtcctaattgttcacgtaaacttattccaccaagttccattatgagcacagaatatgcattttcagtttcagcaggacgactcgtcaaagtgccgctataaaaatcgtaaatttttttaaaataattataatttaaatttaatatttcatttcctttcaaaaaatacaatgttttttataaataaggtaaaatttctcaattattaacattagttgctttattaaaaaagttcaaaatgagcaaaagatgggaaaacatttataaaaaattaattcaaactaaagaaattgattttgcccgcaggcgcttatcgaagttgccggaccctaaatttctcaatgtttttaaatttgacgcaaaaattggcaattttgaataaaaatttatttaaaaaatcagtcaaaaagtttccaagatgttcctcatgcctcccccccccccctcagaagttccctgtaactcactaatcaattagtccaataatgtgttttctctttgattcctcaattttttgaatctcttccaaaacttgaactccgttgataatctgctgttcttgtatgcgatttatagcaatttttattgccacgcatttttcgacaaaattttgagcatttcttgacactttttcttcattcatataaccaccaaaaacctgaaaattttcaaaatttttttaaatagtttaaaaatattacttggccatctgctgagggttttgaatcgattgaaaaaactgttttccaaatgttatgctcatgtccatcatttttggttgatatgaattcttcaaatggaagcatattttcagtgacaaatccattacaattggtaataaatggcgatgaaaactttaaagtttttaatagcacaaatataaaaatggaaagcataaaacccatttggctaatgcgtaaaaagtggctaaaaatatatgataattattaattagggtgcgacctgctaaaaactggtaaaacgagaataacggtttcgccagctatattttttaaatatttttaatttttatttttttaaatattaaaaaaagaaaagaataaaataacataataaaagggtagcgaaattattaattggatatttaatttatttgattaaatttcaaagaatttattatttacaattgcattgagcattcattaaaacaataatttgtaagtaatggaataagctaaaaaaatttgcgattgaaaatcaatttaaatggtggttttcttcaaccttatattcacctaataaaaatatttttgcaactaaataaacaggaaatatcaccaaaaatgacatcataagaaaaaaaaacaaatattttttcattacatataaattgtccgcgtctggtttaacataacatttacgaatattaatatgtggatcatccattttaaacaaatcatttttcaatccaatccatcccgcattaagacaaggccgtaatatgatggtggttgcccgcgagccgagtatggcggaggcggcggtggaggcggtggtggcgggggcggtagtggctgatactgtggcgggg

SEQ ID NO: 16314 - DNA, 3217 bp, Heterodera glycines
  misc_feature (2553)..(2553): n is a, c, g, or t
cacatggaataatgtcctttattccggaggcggatcctcttaatacaatatgctaatataatgagtaaaaaggggaaagggaccccgatccgtacaggacggaaggggaggggatcgggggtaaatgtgatcccggttatatgaatgaattgaggtgatcgctaggaaatgggccacattacgagaaggggcggagttaaagttgatcagagtgatcagaggcactaacaaaaccagacagtcagaaaataagaaatgaaataattcagtcttttttgcaaacgaagatggtccaaggaaacagatttcgcagacaaagaattgtagaagaaacttaattttcaaaaatccagtcaggtcctctgaaaaagaacgaatttgacaaaatgctccaaaaagagctcacattaaaagtaaggaattttataaactaaaatattaaataattgatttttctcatttttctttaaaaattttgaaaataagtgatttcgattaatgttgattattgcttaaatggatgaatttttaaaaatttttttggttatcttatatttaaaaaaacgcccttattttactataattttttgcacttgaaaacaaataataaagttaattatttagtaaaaaaaattgctcgttcgtcgtccattcttcgtgaaaatgctccaaataagcaccacatctgaccacgtctagtggaaaatgccagtgataacattgccggcggagttggctttgtatatggccgattgggaccactgctgccaaaaatgccatcgcttcgacacccataactagggctgctaattttatgtaaatacatattttttcctggattctccatagcctaattagtaggaaaaacactttcttttttgtgtttgcgaacaaaaatcgggacttttatttacatatttcggagtttttctacatattacatatgtacatatttttatacatattttggactttttcgcattttttgtacatattttgcaatttttgaagattttttaaggaaaatttttagattccccaaaaaaattgcaatttttcgtacacattttcattttttttcatattttgagaattcataaaattttttgtgaaaaaaaaaaaattttgaaaatgcatccctaaaaatcgattttttttttcaaaaaatgagatatcaaaaattaatatttaatgtactaaaatgtgattctaagcctattttggtcatttttgtggcattttgtgcctgtttcactttttacgaagaatttttacccaaaaaattaccatttaaaaaattttatcgatcagtttaatcggaacccattcaggcaaaaaatgttgtcgatgatgaagagctaaattgaaaagcaaataaaacattcattgcattatattatatattcacactttttaatgaagaaaaaatacaattttttaaagccatggccaaaactttggcaaatttggttaaaataattttaaattttttaaaaacatggaaaaactgacactgaataaagtccgaattgtacaaaatggtcgcatcgtccggcatcaaataagcaatccaccaagaaaaggttgaagtctgtgccgtgatcagcagtgaatcgcatgccaacacagcaaaagcaaaatcatttgcccttggcattgattttggcaaaaaaacattggcaaaaagcgaaaaataaataaaaatttatttaatttaataagcaaatatttaaatcattctttgcctggccgttgaatgataaatccgtcaaaaattgcttttcttctcccagcaaaacaacagaaacgaaaatgttgccaaatttcttcttgaatttaattgcataattaaaacagtgaatgaatgctcattaacgaacaaacccttaaatattcaaatccaaattcaattcctttctccgtaaaatcctttttcgattcccaaccgaaattgacaaagtctcccattcgaatgtgcacgcaaaatttgtgcgaatgatcatctctgaaaagatgaaaaacagaatattaaactagtaaattcaatatatttttattttattaattttacgttttttaaaatgtattaaaagtgtaattaatgaccgtacgtaataaaatattgttcattttaaaaataattaattattatttttttataccaacccaaataattcatttttgaatgccgtaactcttttacaaatgccttttccaaactgaaaaatttgacgaatttcggtcctccgactttcaaagtatttgtacgattggagacaagattcgccctgaacaattcatttttatcatgtttaatacagtaacaaaggcttacatccatttccaaatatttctgtttgattcttgaaatcgcaaatcttaaaaaaacaaaattcggaaattacaaaatttgtcaaaaaatcggttcaaattctcgaaataccttaaagcaattattttttcggtcaaaagcgaaaacccaattattttcaaagcaagctaaaaacactatttatttgattttctaaataaatattgaaaacccaataagcncgcgctaaaattatatcgtcaaaatcctaatctccatttttgtttattacgtatgatttttttgaagtttcttttgttcctgactttttttgcgccggctcccattcttggtttgtttaaagcgcttttaaacttccgacaaaatcttggggatgccaaagcttgtaataatgagattcaaatcactgagttaagggtccattgccataacggaaatgaaggtaattaaatctaaatttacaatacatttttttaatttaggcggatttcgcattgtcttagctacccatccaattttgtttggcaaggatttctccggcattttttactttgaaatttcaatcaaaaaaaatgcatcagtaaataaacagcatttattatcctaaagacaaatttttacaaatttttaatttatttagttccccttacgctttactctccttcggattcaccgtaaaaaaggacaaaaaattgggagaaacaaacattttttatcttaatcgtggattttttatcattaatggcgtatggaagtgtcgacaagttgattcttacacagaaaacgatattgtcggatgtggcattaattcggccacccgacagattttcttcaccaaaaatagacggcgtcagggtttgttaacaaaataataataattaataa

SEQ ID NO: 16315 - DNA, 3415 bp, Heterodera glycines
cactatgggtcaactccactgtgcagagaaaagcctagtactatctcgtcgtttctctttttctttgtaatttctcttactttggcgtactatctcttcattttaattatgtaaaaaacaacatttacttcgtgacgtttaacttttttcctgcacgttaaatccacacaaaattttgcaaatcgatagagaaaaaaattctgcatcgattaatgcaaaaagtttttttgtttatgcgctagatcaaaatttgcatactcaaacaaaattaataatttcttttcctctccttttggcgtactattttcatgtctctaacacattaaaaatcatgaaattcgcaaattctaataattttggttataagggtacaaaatcactttgaacatttagaatcaatagaaaaaagaataaatttagcattttggttagaaagagctggctaggacttgagttataacatgataaaagtttgaaattccgacaacttttttctgagatgacaaattacttaacattcgcttagaaaaagattctccttttcaaaaacttttttttgataccaaatttgttcagtttagttgggaatgaagcgagttatggcagatcaaaataaaaaatacaaaaggcattttccagtgtcaattttgaaatagcgcgcaaaaatttacgccaaatgcgctatttggcgttatgagcaattttgtctgacactgggcttgacccatagtgagagaaaaatctcaaaagggtggaggaatgggtacaaccggcacggttaccgaaaaaaactccgaatgacaattttagtcgaacgggttcggatgggactcgaagttagcctaaatgttggttaatttgtttgaccggcgcttcgaaaaccgcagaactcttttcacgatctcacccaattcttccaaatggagaactgacaccgaaccagcagttcgcatggcccatcatttttcaggctaataaaaaaaatagtttaaattcgaaaattaattttaaatgtccaattaaaaaacgttaatttatgcacctccgggttatataaaagattatttgtttgtgtactctttttgcttgccgcctttgaactcacaaatattttttcctcgattattttaaaataaatttgcagaaaccacccgccgaataacaacatttctttatccatttgaccaacaaaaaaggggtaacaatgggtttttatctttgtgtgctcattcatcggcaatggccaccttctccgacacataaatgccgtccaggaatttccgaatgtccttgtttttgacggtcgtcgactgttggatgcgagcagctgaatttggggagaaaaagttattaaacaaatattttttatttatggggttgtatcggtcggtcgaaaaccattcgcttggaactctttggtagaacaaaaacgaacacagacttttaacattggaatgcaatgcctgcccaaattgtaatgcaagatttcatgatcaagagtccaatttgaaaatggcagttttcccgaaaagggattattccatggaaccgaccccggtaaataaaaccagtcaaattgggtcgacatttatcggcactcaccggcctgggacactttttggatgtcggtaccgtcaatgatcaactcgtccttctgtttggtcgacattacagcgctaacgccttgcggtagtccgacacggcgcacaaatttctcgcccaagaagtttcgaatctaaaaatgtcactttttccggttttgccaaaggtaacgaaatttttggattttcgtgatgcaggacgcggcccctgacctttctcaggatatttagtgtaccagtacttaacaatgaatgttttatccgaacccgacccttaactaaactcgggtaatttttgttggtaacacttcagtttatccctcccgcacattctgaatggtcatttcttacattgcttcgattttgtgcaattaatgtgaaaacatgaaacaaattcgaaattgctcaaaatgtgtatcaattcgtaaccagtgactctgaaaatcctatcttttggtgatcgtcatattaatatttaaacaaaaaaaatcggaacttcgcatttcaacgaatttcgaatttttcgtctaaaaaaggcttatgtgatcttttattacaggaatgatgactttcagtttgttttcatgcatttaagtcgttttcgagacattaacccaaatttaaatttaacttcgattctttgttcgaaatcaggtccggttttaggaattggtcgaaatggatgtcatatttgtgatcagcggcccaagtaacccccgtgtgacaaagaatcgtaaaaaccgccttatttattctttttttatgggaccagtaaattaacccattacccgccccccccccctgcaccaaaaaagtcgctagtaactaatccaattcaaaatcccgggactttactggattgcatataatgcaaagaagacaaaacaaaacaaacctcgacgacggtgttgttctcctgaagcgtgatgttaatcggaaaatgcgcgtagactgagcgcattttgtaccgaaatccaacagtcacacctttgatcatgttttcaatgtgtgagcacactgtgcgaatggctgccaactctttgcggatgccaaaccatttccgcacacggagcagctaaaaacccacattttagcattttgaaagttggaaaaataaaagtttaaatttgagactattttaaacgaaagcgcaatcatttcaacaacaattagaaatgaaaagagcactataaatttcagattttgtttgtttgttactcagaataccttcgggttttctcgcataatttcaatgtttaagtggcgaaagtcgcgcttgagcgtaccgcgcggtcccttcacagtcacaacacggttgttgagcgcgaatgtgacattgtctgggaatttgacgatgtcgctggattcaatcagcttcatttttcgttatgtttaaacagaaaattgatctgtaattgaaacttacaaaatctcttttttttactcctagaaaaatatatagcaaacaatactattatcataggagacttttaacattggcagcaaagatataacttgggtcaacaatcttccagtacctcataccagtctaggaataacttttcttgatttttttaataaattttcactaaacactaatattataggtccaagaagaggaaattcaattcttgatctttgtctttttacaacccttgatttagtctcttcaattgaactaaaggatagtattgttttttcagaccattcagcattgtattttaatattgatattccttgccaaagacaaaaacccctaaaaattacggtcagaaatttcacccagtctaaaattaaagcattcaatacctatt
